(12) United States Patent
Nguyen et al.

(10) Patent No.: US 8,692,064 B2
(45) Date of Patent: Apr. 8, 2014

(54) QUANTITATIVE TRAIT LOCI ASSOCIATED WITH SOYBEAN CYST NEMATODE RESISTANCE AND METHODS OF THEIR USE

(75) Inventors: Henry T. Nguyen, Columbia, MO (US); David A. Sleper, Columbia, MO (US); James G. Shannon, Kennett, MO (US); Tri D. Vuong, Columbia, MO (US); Xiaolei Wu, Cary, NC (US)

(73) Assignee: The Curators of the University of Missouri, Columbia, MO (US)

( * ) Notice: Subject to any disclaimer, the term of this patent is extended or adjusted under 35 U.S.C. 154(b) by 383 days.

(21) Appl. No.: 12/896,864

(22) Filed: Oct. 2, 2010

(65) Prior Publication Data
US 2011/0083234 A1 Apr. 7, 2011

Related U.S. Application Data

(60) Provisional application No. 61/278,233, filed on Oct. 2, 2009.

(51) Int. Cl.
*A01H 1/00* (2006.01)
*A01H 1/04* (2006.01)

(52) U.S. Cl.
USPC .......................... 800/278; 800/265; 800/260

(58) Field of Classification Search
None
See application file for complete search history.

(56) References Cited

U.S. PATENT DOCUMENTS

| | | | |
|---|---|---|---|
| 4,743,548 | A | 5/1988 | Crossway et al. |
| 4,940,838 | A | 7/1990 | Schilperoort et al. |
| 4,945,050 | A | 7/1990 | Sanford et al. |
| 5,015,580 | A | 5/1991 | Christou et al. |
| 5,149,655 | A | 9/1992 | McCabe et al. |
| 5,302,523 | A | 4/1994 | Coffee et al. |
| 5,453,367 | A | 9/1995 | Paszkowski et al. |
| 5,464,763 | A | 11/1995 | Schilperoort et al. |
| 6,096,944 | A | 8/2000 | Vierling et al. |
| 6,538,175 | B1 | 3/2003 | Webb |

OTHER PUBLICATIONS

Anand et al (Crop Sci 28: 563-564, 1988).*
Chen et al (Genome 49: 938-949, 2006).*
Anand, S.C., et al. (1988) Soybean plant introductions with resistance to races 4 or 5 of soybean cyst nematode. Crop Sci 28:563-564.
Anand, S.C. & Rao Arelli, A.P. (1989) Genetic analyses of soybean genotypes resistant to soybean cyst nematode race 5. Crop Sci 29:1181-1184.
Arelli P.R., et al. (2000) Soybean reaction to races 1 and 2 of Heterodera glycines. Crop Sci 40:824-826.
Arelli P.R.. et al. (1997) Soybean germplasm resistant to races 1 and 2 of Heterodera glycines. Crop Sci 37:1367-1369.
Arelli, P.R., et al. (2009) Inheritance of resistance in soybean PI 567516C to LY1 nematode population infecting cv. Hartwig. Euphytica 165:1-4.
Caldwell, et al. (1960) Inheritance of resistance of soybeans to the cyst nematode, Heterodera glycines. Agron J 52:635-636.
Chen, Y., et al. (2006) Molecular marker diversity of SCN-resistant sources in soybean. Genome 49:938-949.
Churchill, G.A. & Doerge, R.W. (1994) Empirical threshold values for quantitative trait mapping. Genetics 138:963-971.
Concibido, V.C., et al. (1994) DNA marker analysis of loci underlying resistance to soybean cyst nematode (Heterodera glycines Ichinohe). Crop Sci 34:240-246.
Concibido, V.C., et al. (1996) RFIP mapping and marker-assisted selection of soybean cyst nematode resistance in PI 209332. Crop Sci 36:1643-1650.
Concibido V.C., et al. (2004) A decade of QTL mapping for cyst nematode resistance in soybean. Crop Sci 44:1121-1131.
Cregan, P.B., (1999) Two simple sequences repeat markers to select for soybean cyst nematode resistance conditioned by the rhg1 locus. Theor Appl Genet 99:811-818.
Fan J, et al. (2006) Ilumina universal bead arrays, Methods in Enzymology, vol. 410 410:57-73.
Guo B. et al. (2005) Identification of QTLs associated with resistance to soybean cyst nematode races 2, 3 and 5 in soybean PI90763. Theor Appl Genet 111:965-971.
Guo B, et al. (2006b) Quantitative trait loci underlying resistance to three soybean cyst nematode populations in soybean PI 404198A. Crop Sci 46:224-233.
Hyten D, et al. (2008) High-throughput genotyping with the GoldenGate assay in the complex genome of soybean. Theor Appl Genet 116:945-952.
Mansur L.M. et al. (1993) Generation mean analysis of resistance to race-3 of soybean: lcyst nematode. Crop Sci 33:1249-1253.
Matson, A.L. & Williams, L.F. (1965) Evidence of a fourth gene for resistance to the soybean cyst nematode. Crop Sci 5:477.
Meksem K, et al. (1999) Clustering among loci underlying soybean resistance to *Fusarium solani*, SDS and SCN in near-isogenic lines. Theor Appl Genet 99:1131-1142.
Niblack, T.L., et al. (2002) A revised classification scheme for genetically diverse populations of Heterodera glycines. J Nematol 34:279-288.
Rao-Arelli, A.P. (1994) Inheritance of resistance to Heterodera glycines race 3 in soybean accessions. Plant Dis :78:898-900.
Schapaugh, W.T., et al. (1998) Registration of 'Magellan' soybean. Crop Sci 38:892.
Song, Q.J. (2004) A new integrated genetic linkage map of the soybean. Theor Appl Genet 109:122-128.
Wang D, et al. (2001) Loci underlying resistance to Race 3 of soybean cyst nematode in Glycine soja plant introduction 468916. Theor Appl Genet 103:561-566.

(Continued)

*Primary Examiner* — Shubo (Joe) Zhou
*Assistant Examiner* — Keith Robinson
(74) *Attorney, Agent, or Firm* — Lathrop & Gage LLP; Dan Cleveland, Jr.

(57) ABSTRACT

Several QTLs that are genetically linked to resistance to soybean cyst nematode (SCN) are disclosed. These QTLs have been mapped to genomic regions on Chrs. 4, 8, 10, 11, 18, and 20 of soybean, *G. max*. Candidate genes underlying these QTLs as defined by the flanking markers, as well as genetic markers associated with these QTLs are also disclosed. These markers can be utilized for introgressing SCN resistance into non-resistant soybean germplasm. The unique resistance genes can be introduced into a non-resistant plant by marker-assisted selection (MAS) or by transgenic methods.

8 Claims, 39 Drawing Sheets

(56) References Cited

OTHER PUBLICATIONS

Winter, S.M.J., et al. (2007) QTL associated with horizontal resistance to soybean cyst nematode in Glycine soja P1464925B. Theor Appl Genet 114:461-472.

Wu, X., et al. (2008) QTL, additive, and epistatic effects for SCN resistance in PI 437654. Theor Appl Genet (accepted), 13 pages.

Young, L.D. (1995) Soybean germplasm resistant to race 3, 5, and 14 of soybean cyst nematode. Crop Sci :35:895-896.

Yue P. et al., (2001a) Mapping resistance to multiple races of Heterodera glycines in soybean PI 89772 Crop Sci 41:1589-95.

Arelli PR, Young ID (2005) Genetics of resistance in soybean PI 567516C to LY1 nematode population infecting cv. Hartwig. Crop Sci Soc Am p. 234 (Abstracts).

Elliott RJ (1999) learning SAS in the computer lab (2nd Ed.) Duxbury Thomson learning, USA:39-48.

Vooriips RE (2002) MapChart: software for the graphical presentation of the linkage maps and QTLs. J Hered 93:77-78.

Webb DM, Baltazar BM, Rao-Arelli PA, Schupp J, Clayton K, Keim P, Beavis WD (1995) Genetic mapping of soybean cyst nematode race-3 resistance loci in soybean PI 437654,Theor Appl Genet 91 :574-581.

Xie M, Arelli PR, Sleper DA (1998) Genetic relationships among soybean plant introductions with resistance to Heterodera glycines using RFLP's, Soybean Genetics Newsletter, Xie continued: 25:157-163.

Young LD (1998) Heterodera glycines populations selected for reproduction on Hartwig soybean. J Nematol, 30:523.

* cited by examiner

>Glyma18g02560.1    >Glyma18g02990.1    >Glyma18g03440.1
>Glyma18g02570.1    >Glyma18g03000.1    >Glyma18g03450.1
>Glyma18g02580.1    >Glyma18g03010.1    >Glyma18g03460.1
>Glyma18g02590.1    >Glyma18g03020.1    >Glyma18g03470.1
>Glyma18g02600.1    >Glyma18g03030.1    >Glyma18g03480.1
>Glyma18g02610.1    >Glyma18g03040.1    >Glyma18g03490.1
>Glyma18g02620.1    >Glyma18g03050.1    >Glyma18g03500.1
>Glyma18g02630.1    >Glyma18g03060.1    >Glyma18g03510.1
>Glyma18g02640.1    >Glyma18g03070.1    >Glyma18g03520.1
>Glyma18g02650.1    >Glyma18g03080.1    >Glyma18g03530.1
>Glyma18g02650.2    >Glyma18g03090.1    >Glyma18g03540.1
>Glyma18g02660.1    >Glyma18g03100.1    >Glyma18g03550.1
>Glyma18g02670.1    >Glyma18g03110.1    >Glyma18g03560.1
>Glyma18g02680.1    >Glyma18g03120.1    >Glyma18g03570.1
>Glyma18g02690.1    >Glyma18g03130.1    >Glyma18g03580.1
>Glyma18g02700.1    >Glyma18g03140.1    >Glyma18g03590.1
>Glyma18g02710.1    >Glyma18g03150.1    >Glyma18g03600.1
>Glyma18g02720.1    >Glyma18g03160.1    >Glyma18g03610.1
>Glyma18g02730.1    >Glyma18g03170.1    >Glyma18g03620.1
>Glyma18g02740.1    >Glyma18g03180.1    >Glyma18g03630.1
>Glyma18g02750.1    >Glyma18g03190.1    >Glyma18g03640.1
>Glyma18g02760.1    >Glyma18g03200.1    >Glyma18g03640.2
>Glyma18g02770.1    >Glyma18g03210.1    >Glyma18g03650.1
>Glyma18g02780.1    >Glyma18g03220.1    >Glyma18g03660.1
>Glyma18g02790.1    >Glyma18g03220.2    >Glyma18g03670.1
>Glyma18g02800.1    >Glyma18g03230.1    >Glyma18g03680.1
>Glyma18g02800.2    >Glyma18g03240.1    >Glyma18g03690.1
>Glyma18g02810.1    >Glyma18g03250.1    >Glyma18g03700.1
>Glyma18g02820.1    >Glyma18g03260.1    >Glyma18g03710.1
>Glyma18g02830.1    >Glyma18g03270.1    >Glyma18g03720.1
>Glyma18g02840.1    >Glyma18g03280.1    >Glyma18g03730.1
>Glyma18g02850.1    >Glyma18g03290.1    >Glyma18g03740.1
>Glyma18g02860.1    >Glyma18g03300.1    >Glyma18g03750.1
>Glyma18g02870.1    >Glyma18g03310.1    >Glyma18g03760.1
>Glyma18g02880.1    >Glyma18g03320.1    >Glyma18g03770.1
>Glyma18g02890.1    >Glyma18g03330.1    >Glyma18g03780.1
>Glyma18g02900.1    >Glyma18g03340.1    >Glyma18g03790.1
>Glyma18g02910.1    >Glyma18g03350.1    >Glyma18g03800.1
>Glyma18g02920.1    >Glyma18g03360.1    >Glyma18g03810.1
>Glyma18g02930.1    >Glyma18g03370.1    >Glyma18g03820.1
>Glyma18g02940.1    >Glyma18g03380.1    >Glyma18g03830.1
>Glyma18g02950.1    >Glyma18g03390.1    >Glyma18g03840.1
>Glyma18g02960.1    >Glyma18g03400.1    >Glyma18g03850.1
>Glyma18g02970.1    >Glyma18g03420.1    >Glyma18g03860.1
>Glyma18g02980.1    >Glyma18g03430.1

FIG. 1

>Glyma08g12490.1
>Glyma08g12500.1
>Glyma08g12510.1
>Glyma08g12520.1
>Glyma08g12520.2
>Glyma08g12530.1
>Glyma08g12540.1
>Glyma08g12550.1
>Glyma08g12560.1
>Glyma08g12560.2
>Glyma08g12560.3
>Glyma08g12570.1
>Glyma08g12580.1
>Glyma08g12590.1
>Glyma08g12600.1
>Glyma08g12610.1
>Glyma08g12620.1
>Glyma08g12630.1
>Glyma08g12640.1
>Glyma08g12650.1
>Glyma08g12650.2
>Glyma08g12650.3
>Glyma08g12660.1
>Glyma08g12670.1
>Glyma08g12680.1
>Glyma08g12690.1
>Glyma08g12700.1
>Glyma08g12710.1
>Glyma08g12720.1
>Glyma08g12730.1
>Glyma08g12740.1
>Glyma08g12750.1
>Glyma08g12760.1
>Glyma08g12770.1
>Glyma08g12780.1
>Glyma08g12790.1
>Glyma08g12800.1
>Glyma08g12810.1
>Glyma08g12820.1
>Glyma08g12820.2
>Glyma08g12830.1
>Glyma08g12840.1
>Glyma08g12850.1
>Glyma08g12860.1
>Glyma08g12870.1

>Glyma08g12880.1
>Glyma08g12890.1
>Glyma08g12900.1
>Glyma08g12900.2
>Glyma08g12910.1
>Glyma08g12920.1
>Glyma08g12930.1
>Glyma08g12940.1
>Glyma08g12940.2
>Glyma08g12950.1
>Glyma08g12960.1
>Glyma08g12970.1
>Glyma08g12980.1
>Glyma08g12980.2
>Glyma08g12990.1
>Glyma08g13000.1
>Glyma08g13010.1
>Glyma08g13020.1
>Glyma08g13030.1
>Glyma08g13040.1
>Glyma08g13040.2
>Glyma08g13050.1
>Glyma08g13060.1
>Glyma08g13070.1
>Glyma08g13080.1
>Glyma08g13090.1
>Glyma08g13090.2
>Glyma08g13100.1
>Glyma08g13110.1
>Glyma08g13110.2
>Glyma08g13120.1
>Glyma08g13130.1
>Glyma08g13130.2
>Glyma08g13140.1
>Glyma08g13150.1
>Glyma08g13160.1
>Glyma08g13170.1
>Glyma08g13180.1
>Glyma08g13180.2
>Glyma08g13190.1
>Glyma08g13200.1
>Glyma08g13210.1
>Glyma08g13220.1
>Glyma08g13220.2
>Glyma08g13230.1

>Glyma08g13240.1
>Glyma08g13240.2
>Glyma08g13240.3
>Glyma08g13250.1
>Glyma08g13260.1
>Glyma08g13270.1
>Glyma08g13280.1
>Glyma08g13290.1
>Glyma08g13300.1
>Glyma08g13300.2
>Glyma08g13300.3
>Glyma08g13300.4
>Glyma08g13310.1
>Glyma08g13320.1
>Glyma08g13330.1
>Glyma08g13340.1
>Glyma08g13340.2
>Glyma08g13350.1
>Glyma08g13360.1
>Glyma08g13370.1
>Glyma08g13380.1
>Glyma08g13390.1
>Glyma08g13400.1
>Glyma08g13410.1
>Glyma08g13420.1
>Glyma08g13430.1
>Glyma08g13440.1
>Glyma08g13440.2
>Glyma08g13450.1
>Glyma08g13450.2
>Glyma08g13460.1
>Glyma08g13470.1
>Glyma08g13480.1
>Glyma08g13490.1
>Glyma08g13500.1
>Glyma08g13510.1
>Glyma08g13520.1
>Glyma08g13520.2
>Glyma08g13530.1
>Glyma08g13540.1
>Glyma08g13550.1
>Glyma08g13560.1
>Glyma08g13560.2
>Glyma08g13570.1
>Glyma08g13580.1

FIG. 2

>Glyma08g13590.1
>Glyma08g13600.1
>Glyma08g13610.1
>Glyma08g13620.1
>Glyma08g13630.1
>Glyma08g13630.2
>Glyma08g13640.1
>Glyma08g13650.1
>Glyma08g13660.1
>Glyma08g13670.1
>Glyma08g13680.1
>Glyma08g13690.1
>Glyma08g13700.1
>Glyma08g13720.1
>Glyma08g13730.1
>Glyma08g13740.1
>Glyma08g13740.2
>Glyma08g13740.3
>Glyma08g13740.4
>Glyma08g13750.1
>Glyma08g13760.1
>Glyma08g13770.1
>Glyma08g13780.1
>Glyma08g13790.1
>Glyma08g13800.1
>Glyma08g13810.1
>Glyma08g13820.1
>Glyma08g13830.1
>Glyma08g13840.1
>Glyma08g13850.1
>Glyma08g13860.1
>Glyma08g13870.1
>Glyma08g13880.1
>Glyma08g13890.1
>Glyma08g13900.1
>Glyma08g13910.1
>Glyma08g13910.2
>Glyma08g13910.3
>Glyma08g13920.1
>Glyma08g13930.1
>Glyma08g13930.2
>Glyma08g13940.1
>Glyma08g13950.1
>Glyma08g13960.1
>Glyma08g13970.1

>Glyma08g13980.1
>Glyma08g13980.2
>Glyma08g13990.1
>Glyma08g14000.1
>Glyma08g14010.1
>Glyma08g14020.1
>Glyma08g14030.1
>Glyma08g14040.1
>Glyma08g14050.1
>Glyma08g14060.1
>Glyma08g14070.1
>Glyma08g14080.1
>Glyma08g14090.1
>Glyma08g14100.1
>Glyma08g14110.1
>Glyma08g14120.1
>Glyma08g14130.1
>Glyma08g14130.2
>Glyma08g14140.1
>Glyma08g14150.1
>Glyma08g14160.1
>Glyma08g14170.1
>Glyma08g14180.1
>Glyma08g14190.1
>Glyma08g14200.1
>Glyma08g14210.1
>Glyma08g14220.1
>Glyma08g14230.1
>Glyma08g14240.1
>Glyma08g14250.1
>Glyma08g14250.2
>Glyma08g14260.1
>Glyma08g14270.1
>Glyma08g14280.1
>Glyma08g14280.2
>Glyma08g14280.3
>Glyma08g14280.4
>Glyma08g14280.5
>Glyma08g14290.1
>Glyma08g14300.1
>Glyma08g14310.1
>Glyma08g14320.1
>Glyma08g14330.1
>Glyma08g14340.1
>Glyma08g14350.1

>Glyma08g14360.1
>Glyma08g14370.1
>Glyma08g14380.1
>Glyma08g14390.1
>Glyma08g14400.1
>Glyma08g14410.1
>Glyma08g14420.1
>Glyma08g14430.1
>Glyma08g14440.1
>Glyma08g14440.2
>Glyma08g14440.3
>Glyma08g14440.4
>Glyma08g14440.5
>Glyma08g14440.6
>Glyma08g14450.1
>Glyma08g14450.2
>Glyma08g14460.1
>Glyma08g14460.2
>Glyma08g14460.3
>Glyma08g14470.1
>Glyma08g14480.1
>Glyma08g14490.1
>Glyma08g14500.1
>Glyma08g14510.1
>Glyma08g14520.1
>Glyma08g14530.1
>Glyma08g14540.1
>Glyma08g14550.1
>Glyma08g14560.1
>Glyma08g14570.1
>Glyma08g14580.1
>Glyma08g14590.1
>Glyma08g14590.2
>Glyma08g14600.1
>Glyma08g14610.1
>Glyma08g14620.1
>Glyma08g14630.1
>Glyma08g14640.1
>Glyma08g14650.1
>Glyma08g14660.1
>Glyma08g14670.1
>Glyma08g14670.2
>Glyma08g14670.3

FIG. 2 (cont.)

>Glyma08g14680.1　　　　>Glyma08g14950.1　　　　>Glyma08g15280.1
>Glyma08g14680.2　　　　>Glyma08g14960.1　　　　>Glyma08g15290.1
>Glyma08g14690.1　　　　>Glyma08g14970.1　　　　>Glyma08g15300.1
>Glyma08g14700.1　　　　>Glyma08g14980.1　　　　>Glyma08g15310.1
>Glyma08g14710.1　　　　>Glyma08g14980.2　　　　>Glyma08g15310.2
>Glyma08g14720.1　　　　>Glyma08g14990.1　　　　>Glyma08g15320.1
>Glyma08g14720.2　　　　>Glyma08g15000.1　　　　>Glyma08g15330.1
>Glyma08g14720.3　　　　>Glyma08g15000.2　　　　>Glyma08g15340.1
>Glyma08g14730.1　　　　>Glyma08g15000.3　　　　>Glyma08g15350.1
>Glyma08g14740.1　　　　>Glyma08g15000.4　　　　>Glyma08g15360.1
>Glyma08g14740.2　　　　>Glyma08g15000.5　　　　>Glyma08g15370.1
>Glyma08g14750.1　　　　>Glyma08g15000.6　　　　>Glyma08g15370.2
>Glyma08g14750.2　　　　>Glyma08g15010.1　　　　>Glyma08g15370.3
>Glyma08g14750.3　　　　>Glyma08g15010.2　　　　>Glyma08g15370.4
>Glyma08g14760.1　　　　>Glyma08g15020.1　　　　>Glyma08g15380.1
>Glyma08g14770.1　　　　>Glyma08g15030.1　　　　>Glyma08g15390.1
>Glyma08g14780.1　　　　>Glyma08g15040.1　　　　>Glyma08g15400.1
>Glyma08g14780.2　　　　>Glyma08g15050.1　　　　>Glyma08g15410.1
>Glyma08g14790.1　　　　>Glyma08g15060.1　　　　>Glyma08g15420.1
>Glyma08g14790.2　　　　>Glyma08g15070.1　　　　>Glyma08g15430.1
>Glyma08g14800.1　　　　>Glyma08g15080.1　　　　>Glyma08g15440.1
>Glyma08g14810.1　　　　>Glyma08g15090.1　　　　>Glyma08g15450.1
>Glyma08g14820.1　　　　>Glyma08g15090.2　　　　>Glyma08g15460.1
>Glyma08g14830.1　　　　>Glyma08g15100.1　　　　>Glyma08g15460.2
>Glyma08g14830.2　　　　>Glyma08g15100.2　　　　>Glyma08g15460.3
>Glyma08g14830.3　　　　>Glyma08g15110.1　　　　>Glyma08g15470.1
>Glyma08g14830.4　　　　>Glyma08g15120.1　　　　>Glyma08g15480.1
>Glyma08g14830.5　　　　>Glyma08g15130.1　　　　>Glyma08g15490.1
>Glyma08g14830.6　　　　>Glyma08g15140.1　　　　>Glyma08g15500.1
>Glyma08g14840.1　　　　>Glyma08g15150.1　　　　>Glyma08g15510.1
>Glyma08g14840.2　　　　>Glyma08g15160.1　　　　>Glyma08g15520.1
>Glyma08g14850.1　　　　>Glyma08g15170.1　　　　>Glyma08g15530.1
>Glyma08g14850.2　　　　>Glyma08g15180.1　　　　>Glyma08g15540.1
>Glyma08g14860.1　　　　>Glyma08g15210.1　　　　>Glyma08g15550.1
>Glyma08g14870.1　　　　>Glyma08g15210.2　　　　>Glyma08g15560.1
>Glyma08g14880.1　　　　>Glyma08g15210.3　　　　>Glyma08g15570.1
>Glyma08g14890.1　　　　>Glyma08g15220.1　　　　>Glyma08g15580.1
>Glyma08g14900.1　　　　>Glyma08g15230.1　　　　>Glyma08g15590.1
>Glyma08g14910.1　　　　>Glyma08g15240.1　　　　>Glyma08g15600.1
>Glyma08g14920.1　　　　>Glyma08g15250.1　　　　>Glyma08g15610.1
>Glyma08g14930.1　　　　>Glyma08g15260.1　　　　>Glyma08g15620.1
>Glyma08g14940.1　　　　>Glyma08g15270.1　　　　>Glyma08g15630.1
>Glyma08g14940.2　　　　>Glyma08g15270.2　　　　>Glyma08g15640.1

FIG. 2 (cont.)

>Glyma08g15650.1
>Glyma08g15660.1
>Glyma08g15670.1
>Glyma08g15680.1
>Glyma08g15690.1
>Glyma08g15700.1
>Glyma08g15730.1
>Glyma08g15740.1
>Glyma08g15740.2
>Glyma08g15750.1
>Glyma08g15760.1
>Glyma08g15780.1
>Glyma08g15790.1
>Glyma08g15800.1
>Glyma08g15810.1
>Glyma08g15820.1
>Glyma08g15830.1
>Glyma08g15840.1
>Glyma08g15850.1
>Glyma08g15860.1
>Glyma08g15870.1
>Glyma08g15880.1
>Glyma08g15890.1
>Glyma08g15910.1
>Glyma08g15920.1
>Glyma08g15930.1
>Glyma08g15940.1
>Glyma08g15950.1
>Glyma08g15960.1
>Glyma08g15960.2
>Glyma08g15970.1
>Glyma08g15980.1
>Glyma08g15990.1
>Glyma08g16000.1
>Glyma08g16010.1
>Glyma08g16020.1
>Glyma08g16020.2
>Glyma08g16020.3
>Glyma08g16030.1
>Glyma08g16040.1
>Glyma08g16050.1
>Glyma08g16060.1
>Glyma08g16070.1

>Glyma08g16080.1
>Glyma08g16090.1
>Glyma08g16100.1
>Glyma08g16110.1
>Glyma08g16120.1
>Glyma08g16130.1
>Glyma08g16130.2
>Glyma08g16130.3
>Glyma08g16140.1
>Glyma08g16150.1
>Glyma08g16160.1
>Glyma08g16170.1
>Glyma08g16180.1
>Glyma08g16190.1
>Glyma08g16200.1
>Glyma08g16210.1
>Glyma08g16220.1
>Glyma08g16230.1
>Glyma08g16240.1
>Glyma08g16250.1

FIG. 2 (cont.)

>Glyma11g34400.1
>Glyma11g34410.1
>Glyma11g34420.1
>Glyma11g34430.1
>Glyma11g34440.1
>Glyma11g34450.1
>Glyma11g34460.1
>Glyma11g34460.2
>Glyma11g34470.1
>Glyma11g34470.2
>Glyma11g34480.1
>Glyma11g34490.1
>Glyma11g34500.1
>Glyma11g34510.1
>Glyma11g34520.1
>Glyma11g34530.1
>Glyma11g34540.1
>Glyma11g34550.1
>Glyma11g34560.1
>Glyma11g34570.1
>Glyma11g34580.1
>Glyma11g34590.1
>Glyma11g34600.1
>Glyma11g34610.1
>Glyma11g34620.1
>Glyma11g34630.1
>Glyma11g34640.1
>Glyma11g34650.1
>Glyma11g34660.1
>Glyma11g34670.1
>Glyma11g34680.1
>Glyma11g34690.1
>Glyma11g34700.1
>Glyma11g34700.2
>Glyma11g34710.1
>Glyma11g34720.1
>Glyma11g34730.1
>Glyma11g34740.1
>Glyma11g34750.1
>Glyma11g34760.1
>Glyma11g34770.1
>Glyma11g34780.1
>Glyma11g34790.1
>Glyma11g34790.2
>Glyma11g34800.1
>Glyma11g34800.2
>Glyma11g34810.1

>Glyma11g34820.1
>Glyma11g34830.1
>Glyma11g34830.2
>Glyma11g34830.3
>Glyma11g34830.4
>Glyma11g34830.5
>Glyma11g34840.1
>Glyma11g34850.1
>Glyma11g34860.1
>Glyma11g34870.1
>Glyma11g34870.2
>Glyma11g34880.1
>Glyma11g34890.1
>Glyma11g34900.1
>Glyma11g34910.1
>Glyma11g34920.1
>Glyma11g34930.1
>Glyma11g34930.2
>Glyma11g34930.3
>Glyma11g34930.4
>Glyma11g34940.1
>Glyma11g34950.1
>Glyma11g34950.2
>Glyma11g34960.1
>Glyma11g34970.1
>Glyma11g34980.1
>Glyma11g34990.1
>Glyma11g35000.1
>Glyma11g35010.1
>Glyma11g35020.1
>Glyma11g35020.2
>Glyma11g35030.1
>Glyma11g35040.1
>Glyma11g35050.1
>Glyma11g35060.1
>Glyma11g35070.1
>Glyma11g35080.1
>Glyma11g35090.1
>Glyma11g35100.1
>Glyma11g35110.1
>Glyma11g35110.2
>Glyma11g35120.1
>Glyma11g35130.1
>Glyma11g35140.1
>Glyma11g35150.1
>Glyma11g35160.1
>Glyma11g35170.1

>Glyma11g35180.1
>Glyma11g35190.1
>Glyma11g35200.1
>Glyma11g35210.1
>Glyma11g35220.1
>Glyma11g35230.1
>Glyma11g35240.1
>Glyma11g35240.2
>Glyma11g35250.1
>Glyma11g35260.1
>Glyma11g35260.2
>Glyma11g35270.1
>Glyma11g35280.1
>Glyma11g35290.1
>Glyma11g35300.1
>Glyma11g35310.1
>Glyma11g35320.1
>Glyma11g35330.1
>Glyma11g35340.1
>Glyma11g35350.1
>Glyma11g35360.1
>Glyma11g35370.1
>Glyma11g35380.1
>Glyma11g35390.1
>Glyma11g35400.1
>Glyma11g35410.1
>Glyma11g35420.1
>Glyma11g35430.1
>Glyma11g35440.1
>Glyma11g35450.1
>Glyma11g35450.2
>Glyma11g35450.3
>Glyma11g35450.4
>Glyma11g35460.1
>Glyma11g35470.1
>Glyma11g35480.1
>Glyma11g35490.1
>Glyma11g35500.1
>Glyma11g35510.1
>Glyma11g35520.1
>Glyma11g35530.1
>Glyma11g35540.1
>Glyma11g35540.2
>Glyma11g35550.1
>Glyma11g35560.1
>Glyma11g35570.1
>Glyma11g35580.1

FIG. 3

>Glyma11g35590.1
>Glyma11g35600.1
>Glyma11g35610.1
>Glyma11g35620.1
>Glyma11g35630.1
>Glyma11g35640.1
>Glyma11g35650.1
>Glyma11g35660.1
>Glyma11g35670.1
>Glyma11g35680.1
>Glyma11g35690.1
>Glyma11g35700.1
>Glyma11g35710.1
>Glyma11g35720.1
>Glyma11g35730.1
>Glyma11g35740.1
>Glyma11g35740.2
>Glyma11g35740.3
>Glyma11g35740.4
>Glyma11g35740.5
>Glyma11g35750.1
>Glyma11g35760.1
>Glyma11g35770.1
>Glyma11g35780.1
>Glyma11g35790.1
>Glyma11g35790.2
>Glyma11g35800.1
>Glyma11g35810.1
>Glyma11g35820.1
>Glyma11g35830.1
>Glyma11g35840.1
>Glyma11g35850.1
>Glyma11g35860.1
>Glyma11g35870.1
>Glyma11g35880.1
>Glyma11g35890.1
>Glyma11g35900.1
>Glyma11g35910.1
>Glyma11g35920.1
>Glyma11g35930.1
>Glyma11g35940.1
>Glyma11g35950.1
>Glyma11g35960.1
>Glyma11g35970.1
>Glyma11g35980.1

>Glyma11g35990.1
>Glyma11g36000.1
>Glyma11g36000.2
>Glyma11g36000.3
>Glyma11g36010.1
>Glyma11g36010.2
>Glyma11g36020.1
>Glyma11g36030.1
>Glyma11g36040.1
>Glyma11g36050.1
>Glyma11g36060.1
>Glyma11g36070.1
>Glyma11g36080.1
>Glyma11g36080.2
>Glyma11g36090.1
>Glyma11g36100.1
>Glyma11g36110.1
>Glyma11g36120.1
>Glyma11g36130.1
>Glyma11g36140.1
>Glyma11g36150.1
>Glyma11g36160.1
>Glyma11g36170.1
>Glyma11g36170.2
>Glyma11g36180.1
>Glyma11g36190.1
>Glyma11g36200.1
>Glyma11g36210.1
>Glyma11g36220.1
>Glyma11g36230.1
>Glyma11g36240.1
>Glyma11g36250.1
>Glyma11g36260.1
>Glyma11g36270.1
>Glyma11g36290.1
>Glyma11g36300.1
>Glyma11g36390.1
>Glyma11g36400.1
>Glyma11g36410.1
>Glyma11g36420.1
>Glyma11g36430.1
>Glyma11g36440.1
>Glyma11g36440.2
>Glyma11g36460.1
>Glyma11g36470.1

>Glyma11g36480.1
>Glyma11g36490.1
>Glyma11g36500.1
>Glyma11g36510.1
>Glyma11g36520.1
>Glyma11g36530.1
>Glyma11g36540.1
>Glyma11g36540.2
>Glyma11g36550.1
>Glyma11g36560.1
>Glyma11g36570.1
>Glyma11g36580.1
>Glyma11g36590.1
>Glyma11g36600.1
>Glyma11g36610.1
>Glyma11g36620.1
>Glyma11g36630.1
>Glyma11g36640.1
>Glyma11g36650.1
>Glyma11g36660.1
>Glyma11g36670.1
>Glyma11g36680.1
>Glyma11g36690.1
>Glyma11g36700.1
>Glyma11g36710.1
>Glyma11g36720.1
>Glyma11g36730.1
>Glyma11g36740.1
>Glyma11g36750.1
>Glyma11g36760.1
>Glyma11g36770.1
>Glyma11g36770.2
>Glyma11g36780.1
>Glyma11g36790.1
>Glyma11g36800.1
>Glyma11g36810.1
>Glyma11g36820.1
>Glyma11g36830.1
>Glyma11g36840.1
>Glyma11g36840.2
>Glyma11g36850.1
>Glyma11g36860.1
>Glyma11g36870.1
>Glyma11g36880.1
>Glyma11g36890.1

FIG. 3 (cont.)

| | | |
|---|---|---|
| >Glyma11g36890.2 | >Glyma11g37200.1 | >Glyma11g37550.1 |
| >Glyma11g36890.3 | >Glyma11g37210.1 | >Glyma11g37560.1 |
| >Glyma11g36890.4 | >Glyma11g37210.2 | >Glyma11g37570.1 |
| >Glyma11g36900.1 | >Glyma11g37210.3 | >Glyma11g37580.1 |
| >Glyma11g36900.2 | >Glyma11g37220.1 | >Glyma11g37590.1 |
| >Glyma11g36900.3 | >Glyma11g37230.1 | >Glyma11g37600.1 |
| >Glyma11g36910.1 | >Glyma11g37240.1 | >Glyma11g37610.1 |
| >Glyma11g36920.1 | >Glyma11g37250.1 | >Glyma11g37620.1 |
| >Glyma11g36930.1 | >Glyma11g37250.2 | >Glyma11g37630.1 |
| >Glyma11g36940.1 | >Glyma11g37260.1 | >Glyma11g37630.2 |
| >Glyma11g36950.1 | >Glyma11g37270.1 | >Glyma11g37650.1 |
| >Glyma11g36950.2 | >Glyma11g37280.1 | >Glyma11g37660.1 |
| >Glyma11g36950.3 | >Glyma11g37290.1 | |
| >Glyma11g36960.1 | >Glyma11g37300.1 | |
| >Glyma11g36970.1 | >Glyma11g37310.1 | |
| >Glyma11g36980.1 | >Glyma11g37320.1 | |
| >Glyma11g36980.2 | >Glyma11g37330.1 | |
| >Glyma11g36990.1 | >Glyma11g37330.2 | |
| >Glyma11g36990.2 | >Glyma11g37330.3 | |
| >Glyma11g36990.3 | >Glyma11g37340.1 | |
| >Glyma11g37000.1 | >Glyma11g37350.1 | |
| >Glyma11g37010.1 | >Glyma11g37360.1 | |
| >Glyma11g37020.1 | >Glyma11g37370.1 | |
| >Glyma11g37030.1 | >Glyma11g37380.1 | |
| >Glyma11g37040.1 | >Glyma11g37380.2 | |
| >Glyma11g37050.1 | >Glyma11g37380.3 | |
| >Glyma11g37060.1 | >Glyma11g37390.1 | |
| >Glyma11g37070.1 | >Glyma11g37400.1 | |
| >Glyma11g37080.1 | >Glyma11g37410.1 | |
| >Glyma11g37090.1 | >Glyma11g37420.1 | |
| >Glyma11g37100.1 | >Glyma11g37430.1 | |
| >Glyma11g37100.2 | >Glyma11g37440.1 | |
| >Glyma11g37100.3 | >Glyma11g37440.2 | |
| >Glyma11g37110.1 | >Glyma11g37450.1 | |
| >Glyma11g37120.1 | >Glyma11g37460.1 | |
| >Glyma11g37130.1 | >Glyma11g37470.1 | |
| >Glyma11g37140.1 | >Glyma11g37480.1 | |
| >Glyma11g37150.1 | >Glyma11g37490.1 | |
| >Glyma11g37150.2 | >Glyma11g37500.1 | |
| >Glyma11g37150.3 | >Glyma11g37500.2 | |
| >Glyma11g37150.4 | >Glyma11g37500.3 | |
| >Glyma11g37160.1 | >Glyma11g37510.1 | |
| >Glyma11g37170.1 | >Glyma11g37520.1 | |
| >Glyma11g37180.1 | >Glyma11g37530.1 | |
| >Glyma11g37190.1 | >Glyma11g37540.1 | |

FIG. 3 (cont.)

| | | |
|---|---|---|
| >Glyma20g33290.1 | >Glyma20g33760.1 | >Glyma20g34220.1 |
| >Glyma20g33300.1 | >Glyma20g33770.1 | >Glyma20g34230.1 |
| >Glyma20g33310.1 | >Glyma20g33780.1 | >Glyma20g34240.1 |
| >Glyma20g33320.1 | >Glyma20g33790.1 | >Glyma20g34250.1 |
| >Glyma20g33330.1 | >Glyma20g33800.1 | >Glyma20g34260.1 |
| >Glyma20g33340.1 | >Glyma20g33810.1 | >Glyma20g34270.1 |
| >Glyma20g33350.1 | >Glyma20g33820.1 | >Glyma20g34280.1 |
| >Glyma20g33350.2 | >Glyma20g33830.1 | >Glyma20g34290.1 |
| >Glyma20g33360.1 | >Glyma20g33840.1 | >Glyma20g34290.2 |
| >Glyma20g33370.1 | >Glyma20g33850.1 | >Glyma20g34290.3 |
| >Glyma20g33380.1 | >Glyma20g33860.1 | >Glyma20g34300.1 |
| >Glyma20g33390.1 | >Glyma20g33870.1 | >Glyma20g34310.1 |
| >Glyma20g33400.1 | >Glyma20g33880.1 | >Glyma20g34320.1 |
| >Glyma20g33420.1 | >Glyma20g33890.1 | >Glyma20g34330.1 |
| >Glyma20g33430.1 | >Glyma20g33900.1 | >Glyma20g34340.1 |
| >Glyma20g33440.1 | >Glyma20g33910.1 | >Glyma20g34350.1 |
| >Glyma20g33450.1 | >Glyma20g33920.1 | >Glyma20g34360.1 |
| >Glyma20g33460.1 | >Glyma20g33930.1 | >Glyma20g34370.1 |
| >Glyma20g33470.1 | >Glyma20g33940.1 | >Glyma20g34380.1 |
| >Glyma20g33480.1 | >Glyma20g33950.1 | >Glyma20g34390.1 |
| >Glyma20g33490.1 | >Glyma20g33960.1 | >Glyma20g34400.1 |
| >Glyma20g33500.1 | >Glyma20g33970.1 | >Glyma20g34410.1 |
| >Glyma20g33510.1 | >Glyma20g33980.1 | >Glyma20g34410.2 |
| >Glyma20g33520.1 | >Glyma20g33990.1 | >Glyma20g34420.1 |
| >Glyma20g33530.1 | >Glyma20g34000.1 | >Glyma20g34420.2 |
| >Glyma20g33540.1 | >Glyma20g34000.2 | >Glyma20g34430.1 |
| >Glyma20g33550.1 | >Glyma20g34010.1 | >Glyma20g34440.1 |
| >Glyma20g33560.1 | >Glyma20g34020.1 | >Glyma20g34450.1 |
| >Glyma20g33560.2 | >Glyma20g34030.1 | >Glyma20g34460.1 |
| >Glyma20g33570.1 | >Glyma20g34040.1 | >Glyma20g34470.1 |
| >Glyma20g33580.1 | >Glyma20g34050.1 | >Glyma20g34480.1 |
| >Glyma20g33590.1 | >Glyma20g34060.1 | >Glyma20g34490.1 |
| >Glyma20g33600.1 | >Glyma20g34070.1 | >Glyma20g34500.1 |
| >Glyma20g33610.1 | >Glyma20g34080.1 | >Glyma20g34500.2 |
| >Glyma20g33620.1 | >Glyma20g34090.1 | >Glyma20g34510.1 |
| >Glyma20g33630.1 | >Glyma20g34100.1 | >Glyma20g34520.1 |
| >Glyma20g33640.1 | >Glyma20g34110.1 | >Glyma20g34520.2 |
| >Glyma20g33650.1 | >Glyma20g34110.2 | >Glyma20g34530.1 |
| >Glyma20g33660.1 | >Glyma20g34120.1 | >Glyma20g34540.1 |
| >Glyma20g33670.1 | >Glyma20g34130.1 | >Glyma20g34550.1 |
| >Glyma20g33680.1 | >Glyma20g34140.1 | >Glyma20g34560.1 |
| >Glyma20g33690.1 | >Glyma20g34150.1 | >Glyma20g34570.1 |
| >Glyma20g33700.1 | >Glyma20g34160.1 | >Glyma20g34580.1 |
| >Glyma20g33710.1 | >Glyma20g34170.1 | >Glyma20g34590.1 |
| >Glyma20g33710.2 | >Glyma20g34180.1 | >Glyma20g34600.1 |
| >Glyma20g33720.1 | >Glyma20g34190.1 | >Glyma20g34610.1 |
| >Glyma20g33730.1 | >Glyma20g34200.1 | >Glyma20g34620.1 |
| >Glyma20g33740.1 | >Glyma20g34210.1 | >Glyma20g34630.1 |

FIG. 4

| | | |
|---|---|---|
| >Glyma20g34630.2 | >Glyma20g35010.1 | >Glyma20g35430.1 |
| >Glyma20g34640.1 | >Glyma20g35020.1 | >Glyma20g35430.2 |
| >Glyma20g34650.1 | >Glyma20g35030.1 | >Glyma20g35430.3 |
| >Glyma20g34660.1 | >Glyma20g35040.1 | >Glyma20g35440.1 |
| >Glyma20g34670.1 | >Glyma20g35050.1 | >Glyma20g35450.1 |
| >Glyma20g34680.1 | >Glyma20g35060.1 | >Glyma20g35460.1 |
| >Glyma20g34690.1 | >Glyma20g35070.1 | >Glyma20g35470.1 |
| >Glyma20g34690.2 | >Glyma20g35080.1 | >Glyma20g35480.1 |
| >Glyma20g34690.3 | >Glyma20g35090.1 | >Glyma20g35490.1 |
| >Glyma20g34700.1 | >Glyma20g35090.2 | >Glyma20g35500.1 |
| >Glyma20g34710.1 | >Glyma20g35100.1 | >Glyma20g35510.1 |
| >Glyma20g34720.1 | >Glyma20g35110.1 | >Glyma20g35520.1 |
| >Glyma20g34730.1 | >Glyma20g35110.2 | >Glyma20g35530.1 |
| >Glyma20g34740.1 | >Glyma20g35120.1 | >Glyma20g35550.1 |
| >Glyma20g34750.1 | >Glyma20g35120.2 | >Glyma20g35570.1 |
| >Glyma20g34750.2 | >Glyma20g35120.3 | >Glyma20g35580.1 |
| >Glyma20g34760.1 | >Glyma20g35120.4 | >Glyma20g35590.1 |
| >Glyma20g34770.1 | >Glyma20g35130.1 | >Glyma20g35600.1 |
| >Glyma20g34780.1 | >Glyma20g35140.1 | >Glyma20g35610.1 |
| >Glyma20g34780.2 | >Glyma20g35150.1 | >Glyma20g35620.1 |
| >Glyma20g34780.3 | >Glyma20g35160.1 | >Glyma20g35630.1 |
| >Glyma20g34780.4 | >Glyma20g35170.1 | >Glyma20g35640.1 |
| >Glyma20g34790.1 | >Glyma20g35180.1 | >Glyma20g35650.1 |
| >Glyma20g34800.1 | >Glyma20g35190.1 | >Glyma20g35660.1 |
| >Glyma20g34810.1 | >Glyma20g35200.1 | >Glyma20g35670.1 |
| >Glyma20g34820.1 | >Glyma20g35210.1 | >Glyma20g35680.1 |
| >Glyma20g34830.1 | >Glyma20g35220.1 | >Glyma20g35690.1 |
| >Glyma20g34840.1 | >Glyma20g35230.1 | >Glyma20g35700.1 |
| >Glyma20g34850.1 | >Glyma20g35240.1 | >Glyma20g35710.1 |
| >Glyma20g34860.1 | >Glyma20g35250.1 | >Glyma20g35720.1 |
| >Glyma20g34870.1 | >Glyma20g35260.1 | >Glyma20g35730.1 |
| >Glyma20g34880.1 | >Glyma20g35260.2 | >Glyma20g35740.1 |
| >Glyma20g34880.2 | >Glyma20g35270.1 | >Glyma20g35750.1 |
| >Glyma20g34890.1 | >Glyma20g35280.1 | >Glyma20g35750.2 |
| >Glyma20g34900.1 | >Glyma20g35290.1 | >Glyma20g35760.1 |
| >Glyma20g34910.1 | >Glyma20g35300.1 | >Glyma20g35770.1 |
| >Glyma20g34920.1 | >Glyma20g35300.2 | >Glyma20g35770.2 |
| >Glyma20g34930.1 | >Glyma20g35310.1 | >Glyma20g35770.3 |
| >Glyma20g34930.2 | >Glyma20g35320.1 | >Glyma20g35770.4 |
| >Glyma20g34940.1 | >Glyma20g35340.1 | >Glyma20g35770.5 |
| >Glyma20g34950.1 | >Glyma20g35350.1 | >Glyma20g35780.1 |
| >Glyma20g34960.1 | >Glyma20g35360.1 | >Glyma20g35790.1 |
| >Glyma20g34970.1 | >Glyma20g35370.1 | >Glyma20g35800.1 |
| >Glyma20g34980.1 | >Glyma20g35380.1 | >Glyma20g35810.1 |
| >Glyma20g34980.2 | >Glyma20g35390.1 | >Glyma20g35820.1 |
| >Glyma20g34990.1 | >Glyma20g35400.1 | >Glyma20g35830.1 |
| >Glyma20g35000.1 | >Glyma20g35410.1 | >Glyma20g35830.2 |
| >Glyma20g35000.2 | >Glyma20g35420.1 | >Glyma20g35830.3 |

FIG. 4 (cont.)

| | | |
|---|---|---|
| >Glyma20g35840.1 | >Glyma20g36250.1 | >Glyma20g36690.1 |
| >Glyma20g35850.1 | >Glyma20g36260.1 | >Glyma20g36690.2 |
| >Glyma20g35860.1 | >Glyma20g36270.1 | >Glyma20g36700.1 |
| >Glyma20g35870.1 | >Glyma20g36280.1 | >Glyma20g36720.1 |
| >Glyma20g35880.1 | >Glyma20g36290.1 | >Glyma20g36730.1 |
| >Glyma20g35890.1 | >Glyma20g36300.1 | >Glyma20g36740.1 |
| >Glyma20g35900.1 | >Glyma20g36310.1 | >Glyma20g36740.2 |
| >Glyma20g35910.1 | >Glyma20g36320.1 | >Glyma20g36740.3 |
| >Glyma20g35920.1 | >Glyma20g36330.1 | >Glyma20g36750.1 |
| >Glyma20g35930.1 | >Glyma20g36330.2 | >Glyma20g36750.2 |
| >Glyma20g35940.1 | >Glyma20g36340.1 | >Glyma20g36760.1 |
| >Glyma20g35950.1 | >Glyma20g36350.1 | >Glyma20g36760.2 |
| >Glyma20g35960.1 | >Glyma20g36360.1 | >Glyma20g36770.1 |
| >Glyma20g35970.1 | >Glyma20g36370.1 | >Glyma20g36770.2 |
| >Glyma20g35970.2 | >Glyma20g36380.1 | >Glyma20g36780.1 |
| >Glyma20g35980.1 | >Glyma20g36390.1 | >Glyma20g36790.1 |
| >Glyma20g35990.1 | >Glyma20g36400.1 | >Glyma20g36800.1 |
| >Glyma20g35990.2 | >Glyma20g36410.1 | >Glyma20g36810.1 |
| >Glyma20g36000.1 | >Glyma20g36420.1 | >Glyma20g36820.1 |
| >Glyma20g36010.1 | >Glyma20g36430.1 | >Glyma20g36830.1 |
| >Glyma20g36010.2 | >Glyma20g36440.1 | >Glyma20g36840.1 |
| >Glyma20g36020.1 | >Glyma20g36450.1 | >Glyma20g36850.1 |
| >Glyma20g36030.1 | >Glyma20g36460.1 | >Glyma20g36860.1 |
| >Glyma20g36040.1 | >Glyma20g36470.1 | >Glyma20g36870.1 |
| >Glyma20g36050.1 | >Glyma20g36480.1 | >Glyma20g36880.1 |
| >Glyma20g36050.2 | >Glyma20g36490.1 | >Glyma20g36880.2 |
| >Glyma20g36060.1 | >Glyma20g36500.1 | >Glyma20g36890.1 |
| >Glyma20g36070.1 | >Glyma20g36510.1 | >Glyma20g36900.1 |
| >Glyma20g36080.1 | >Glyma20g36520.1 | >Glyma20g36910.1 |
| >Glyma20g36090.1 | >Glyma20g36530.1 | >Glyma20g36930.1 |
| >Glyma20g36100.1 | >Glyma20g36540.1 | >Glyma20g36940.1 |
| >Glyma20g36110.1 | >Glyma20g36550.1 | >Glyma20g36950.1 |
| >Glyma20g36110.2 | >Glyma20g36560.1 | >Glyma20g36960.1 |
| >Glyma20g36120.1 | >Glyma20g36570.1 | >Glyma20g36960.2 |
| >Glyma20g36120.2 | >Glyma20g36580.1 | >Glyma20g36970.1 |
| >Glyma20g36130.1 | >Glyma20g36590.1 | >Glyma20g36980.1 |
| >Glyma20g36140.1 | >Glyma20g36590.2 | >Glyma20g36990.1 |
| >Glyma20g36150.1 | >Glyma20g36600.1 | >Glyma20g37000.1 |
| >Glyma20g36160.1 | >Glyma20g36600.2 | >Glyma20g37010.1 |
| >Glyma20g36170.1 | >Glyma20g36620.1 | >Glyma20g37020.1 |
| >Glyma20g36180.1 | >Glyma20g36620.2 | >Glyma20g37040.1 |
| >Glyma20g36190.1 | >Glyma20g36630.1 | >Glyma20g37050.1 |
| >Glyma20g36190.2 | >Glyma20g36630.2 | >Glyma20g37100.1 |
| >Glyma20g36200.1 | >Glyma20g36640.1 | >Glyma20g37110.1 |
| >Glyma20g36210.1 | >Glyma20g36650.1 | >Glyma20g37120.1 |
| >Glyma20g36220.1 | >Glyma20g36660.1 | >Glyma20g37130.1 |
| >Glyma20g36230.1 | >Glyma20g36670.1 | >Glyma20g37150.1 |
| >Glyma20g36240.1 | >Glyma20g36680.1 | >Glyma20g37160.1 |

FIG. 4 (cont.)

>Glyma20g37170.1
>Glyma20g37170.2
>Glyma20g37180.1
>Glyma20g37190.1
>Glyma20g37190.2
>Glyma20g37190.3
>Glyma20g37200.1
>Glyma20g37210.1
>Glyma20g37220.1
>Glyma20g37230.1
>Glyma20g37240.1
>Glyma20g37250.1
>Glyma20g37260.1
>Glyma20g37260.2
>Glyma20g37270.1
>Glyma20g37280.1
>Glyma20g37280.2
>Glyma20g37280.3
>Glyma20g37290.1
>Glyma20g37310.1
>Glyma20g37320.1
>Glyma20g37330.1
>Glyma20g37330.2
>Glyma20g37330.3
>Glyma20g37340.1
>Glyma20g37350.1
>Glyma20g37360.1
>Glyma20g37370.1
>Glyma20g37380.1
>Glyma20g37390.1
>Glyma20g37400.1
>Glyma20g37410.1
>Glyma20g37420.1
>Glyma20g37430.1
>Glyma20g37440.1
>Glyma20g37450.1
>Glyma20g37460.1
>Glyma20g37460.2
>Glyma20g37470.1
>Glyma20g37480.1
>Glyma20g37500.1
>Glyma20g37510.1
>Glyma20g37520.1
>Glyma20g37530.1
>Glyma20g37540.1
>Glyma20g37550.1
>Glyma20g37560.1
>Glyma20g37570.1

>Glyma20g37580.1
>Glyma20g37590.1
>Glyma20g37600.1
>Glyma20g37610.1
>Glyma20g37620.1
>Glyma20g37630.1
>Glyma20g37640.1
>Glyma20g37650.1
>Glyma20g37660.1
>Glyma20g37660.2
>Glyma20g37670.1
>Glyma20g37680.1
>Glyma20g37690.1
>Glyma20g37690.2
>Glyma20g37700.1
>Glyma20g37710.1
>Glyma20g37720.1
>Glyma20g37730.1
>Glyma20g37730.2
>Glyma20g37740.1
>Glyma20g37750.1
>Glyma20g37750.2
>Glyma20g37760.1
>Glyma20g37770.1
>Glyma20g37780.1

FIG. 4 (cont.)

>Glyma18g51590.1
>Glyma18g51600.1
>Glyma18g51610.1
>Glyma18g51620.1
>Glyma18g51630.1
>Glyma18g51640.1
>Glyma18g51650.1
>Glyma18g51660.1
>Glyma18g51670.1
>Glyma18g51680.1
>Glyma18g51690.1
>Glyma18g51700.1
>Glyma18g51710.1
>Glyma18g51720.1
>Glyma18g51730.1
>Glyma18g51740.1
>Glyma18g51750.1
>Glyma18g51760.1
>Glyma18g51770.1
>Glyma18g51780.1
>Glyma18g51790.1
>Glyma18g51800.1
>Glyma18g51810.1
>Glyma18g51820.1
>Glyma18g51830.1
>Glyma18g51840.1
>Glyma18g51850.1
>Glyma18g51860.1
>Glyma18g51870.1
>Glyma18g51880.1
>Glyma18g51890.1
>Glyma18g51900.1
>Glyma18g51920.1
>Glyma18g51930.1
>Glyma18g51950.1
>Glyma18g51960.1
>Glyma18g51970.1
>Glyma18g51980.1
>Glyma18g51990.1
>Glyma18g52000.1
>Glyma18g52010.1

>Glyma18g52020.1
>Glyma18g52030.1
>Glyma18g52040.1
>Glyma18g52050.1
>Glyma18g52060.1
>Glyma18g52070.1
>Glyma18g52080.1
>Glyma18g52090.1
>Glyma18g52110.1
>Glyma18g52120.1
>Glyma18g52130.1
>Glyma18g52140.1
>Glyma18g52150.1
>Glyma18g52160.1
>Glyma18g52170.1
>Glyma18g52180.1
>Glyma18g52190.1
>Glyma18g52200.1
>Glyma18g52210.1
>Glyma18g52220.1
>Glyma18g52230.1
>Glyma18g52240.1
>Glyma18g52250.1
>Glyma18g52260.1
>Glyma18g52270.1
>Glyma18g52280.1
>Glyma18g52290.1
>Glyma18g52300.1
>Glyma18g52300.2
>Glyma18g52310.1
>Glyma18g52320.1
>Glyma18g52330.1
>Glyma18g52340.1
>Glyma18g52350.1
>Glyma18g52360.1
>Glyma18g52370.1
>Glyma18g52380.1
>Glyma18g52390.1
>Glyma18g52400.1
>Glyma18g52410.1
>Glyma18g52420.1

>Glyma18g52430.1
>Glyma18g52440.1
>Glyma18g52450.1
>Glyma18g52450.2
>Glyma18g52450.3
>Glyma18g52460.1
>Glyma18g52470.1
>Glyma18g52480.1
>Glyma18g52490.1
>Glyma18g52500.1
>Glyma18g52510.1

FIG. 5

>Glyma04g34160.1
>Glyma04g34170.1
>Glyma04g34170.2
>Glyma04g34180.1
>Glyma04g34190.1
>Glyma04g34200.1
>Glyma04g34210.1
>Glyma04g34220.1
>Glyma04g34230.1
>Glyma04g34240.1
>Glyma04g34250.1
>Glyma04g34260.1
>Glyma04g34270.1
>Glyma04g34280.1
>Glyma04g34290.1
>Glyma04g34300.1
>Glyma04g34310.1
>Glyma04g34320.1
>Glyma04g34330.1
>Glyma04g34330.2
>Glyma04g34340.1
>Glyma04g34350.1
>Glyma04g34360.1
>Glyma04g34370.1
>Glyma04g34380.1
>Glyma04g34390.1
>Glyma04g34400.1
>Glyma04g34420.1
>Glyma04g34430.1
>Glyma04g34440.1
>Glyma04g34450.1
>Glyma04g34460.1
>Glyma04g34470.1
>Glyma04g34480.1
>Glyma04g34490.1
>Glyma04g34500.1
>Glyma04g34510.1
>Glyma04g34520.1
>Glyma04g34530.1
>Glyma04g34540.1

>Glyma04g34550.1
>Glyma04g34550.2
>Glyma04g34560.1
>Glyma04g34570.1
>Glyma04g34580.1
>Glyma04g34590.1
>Glyma04g34600.1
>Glyma04g34610.1
>Glyma04g34620.1
>Glyma04g34630.1
>Glyma04g34640.1
>Glyma04g34650.1
>Glyma04g34660.1
>Glyma04g34660.2
>Glyma04g34670.1
>Glyma04g34680.1
>Glyma04g34690.1
>Glyma04g34700.1
>Glyma04g34710.1
>Glyma04g34720.1
>Glyma04g34730.1
>Glyma04g34740.1
>Glyma04g34760.1
>Glyma04g34770.1
>Glyma04g34780.1
>Glyma04g34790.1
>Glyma04g34790.2
>Glyma04g34800.1
>Glyma04g34810.1
>Glyma04g34820.1
>Glyma04g34830.1
>Glyma04g34840.1
>Glyma04g34850.1
>Glyma04g34860.1
>Glyma04g34870.1
>Glyma04g34870.2
>Glyma04g34880.1
>Glyma04g34880.2
>Glyma04g34890.1
>Glyma04g34900.1

>Glyma04g34910.1
>Glyma04g34920.1
>Glyma04g34930.1
>Glyma04g34940.1
>Glyma04g34950.1
>Glyma04g34960.1
>Glyma04g34960.2
>Glyma04g34970.1
>Glyma04g34980.1
>Glyma04g34980.2
>Glyma04g34990.1
>Glyma04g35000.1
>Glyma04g35010.1
>Glyma04g35020.1
>Glyma04g35030.1
>Glyma04g35040.1
>Glyma04g35050.1
>Glyma04g35060.1
>Glyma04g35070.1
>Glyma04g35080.1
>Glyma04g35080.2
>Glyma04g35090.1
>Glyma04g35100.1
>Glyma04g35100.2
>Glyma04g35110.1
>Glyma04g35110.2
>Glyma04g35120.1
>Glyma04g35130.1
>Glyma04g35140.1
>Glyma04g35150.1
>Glyma04g35160.1
>Glyma04g35170.1
>Glyma04g35180.1
>Glyma04g35190.1
>Glyma04g35200.1
>Glyma04g35210.1
>Glyma04g35220.1
>Glyma04g35230.1
>Glyma04g35230.2
>Glyma04g35230.3

FIG. 6

| | | |
|---|---|---|
| >Glyma04g35240.1 | >Glyma04g35780.1 | >Glyma04g36170.1 |
| >Glyma04g35250.1 | >Glyma04g35790.1 | >Glyma04g36180.1 |
| >Glyma04g35260.1 | >Glyma04g35800.1 | >Glyma04g36190.1 |
| >Glyma04g35270.1 | >Glyma04g35810.1 | >Glyma04g36200.1 |
| >Glyma04g35280.1 | >Glyma04g35820.1 | >Glyma04g36210.1 |
| >Glyma04g35290.1 | >Glyma04g35820.2 | >Glyma04g36210.2 |
| >Glyma04g35300.1 | >Glyma04g35820.3 | >Glyma04g36220.1 |
| >Glyma04g35310.1 | >Glyma04g35830.1 | |
| >Glyma04g35320.1 | >Glyma04g35840.1 | |
| >Glyma04g35330.1 | >Glyma04g35850.1 | |
| >Glyma04g35340.1 | >Glyma04g35860.1 | |
| >Glyma04g35360.1 | >Glyma04g35860.2 | |
| >Glyma04g35370.1 | >Glyma04g35870.1 | |
| >Glyma04g35380.1 | >Glyma04g35880.1 | |
| >Glyma04g35390.1 | >Glyma04g35890.1 | |
| >Glyma04g35400.1 | >Glyma04g35890.2 | |
| >Glyma04g35410.1 | >Glyma04g35900.1 | |
| >Glyma04g35470.1 | >Glyma04g35910.1 | |
| >Glyma04g35540.1 | >Glyma04g35940.1 | |
| >Glyma04g35560.1 | >Glyma04g35950.1 | |
| >Glyma04g35570.1 | >Glyma04g35960.1 | |
| >Glyma04g35580.1 | >Glyma04g35970.1 | |
| >Glyma04g35590.1 | >Glyma04g35980.1 | |
| >Glyma04g35600.1 | >Glyma04g35990.1 | |
| >Glyma04g35610.1 | >Glyma04g36000.1 | |
| >Glyma04g35620.1 | >Glyma04g36010.1 | |
| >Glyma04g35630.1 | >Glyma04g36020.1 | |
| >Glyma04g35640.1 | >Glyma04g36030.1 | |
| >Glyma04g35650.1 | >Glyma04g36040.1 | |
| >Glyma04g35660.1 | >Glyma04g36050.1 | |
| >Glyma04g35670.1 | >Glyma04g36070.1 | |
| >Glyma04g35680.1 | >Glyma04g36080.1 | |
| >Glyma04g35690.1 | >Glyma04g36090.1 | |
| >Glyma04g35700.1 | >Glyma04g36100.1 | |
| >Glyma04g35710.1 | >Glyma04g36110.1 | |
| >Glyma04g35720.1 | >Glyma04g36120.1 | |
| >Glyma04g35730.1 | >Glyma04g36130.1 | |
| >Glyma04g35740.1 | >Glyma04g36140.1 | |
| >Glyma04g35760.1 | >Glyma04g36150.1 | |
| >Glyma04g35770.1 | >Glyma04g36160.1 | |

FIG. 6 (cont.)

>Glyma04g00930.1
>Glyma04g00940.1
>Glyma04g00950.1
>Glyma04g00950.2
>Glyma04g00960.1
>Glyma04g00970.1
>Glyma04g00980.1
>Glyma04g00990.1
>Glyma04g01000.1
>Glyma04g01000.2
>Glyma04g01000.3
>Glyma04g01010.1
>Glyma04g01010.2
>Glyma04g01020.1
>Glyma04g01020.2
>Glyma04g01020.3
>Glyma04g01030.1
>Glyma04g01040.1
>Glyma04g01050.1
>Glyma04g01060.1
>Glyma04g01070.1
>Glyma04g01070.2
>Glyma04g01080.1
>Glyma04g01090.1
>Glyma04g01090.2
>Glyma04g01100.1
>Glyma04g01100.2
>Glyma04g01110.1
>Glyma04g01120.1
>Glyma04g01130.1
>Glyma04g01130.2
>Glyma04g01130.3
>Glyma04g01140.1
>Glyma04g01150.1
>Glyma04g01160.1
>Glyma04g01170.1
>Glyma04g01170.2
>Glyma04g01170.3
>Glyma04g01180.1
>Glyma04g01190.1
>Glyma04g01190.2
>Glyma04g01200.1
>Glyma04g01210.1

>Glyma04g01220.1
>Glyma04g01230.1
>Glyma04g01240.1
>Glyma04g01250.1
>Glyma04g01260.1
>Glyma04g01270.1
>Glyma04g01280.1
>Glyma04g01290.1
>Glyma04g01300.1
>Glyma04g01310.1
>Glyma04g01320.1
>Glyma04g01330.1
>Glyma04g01340.1
>Glyma04g01350.1
>Glyma04g01360.1
>Glyma04g01370.1
>Glyma04g01370.2
>Glyma04g01380.1
>Glyma04g01380.2
>Glyma04g01390.1
>Glyma04g01390.2
>Glyma04g01390.3
>Glyma04g01390.4
>Glyma04g01400.1
>Glyma04g01400.2
>Glyma04g01400.3
>Glyma04g01410.1
>Glyma04g01430.1
>Glyma04g01440.1
>Glyma04g01450.1
>Glyma04g01460.1
>Glyma04g01470.1
>Glyma04g01480.1
>Glyma04g01490.1
>Glyma04g01500.1
>Glyma04g01510.1
>Glyma04g01520.1
>Glyma04g01530.1
>Glyma04g01540.1
>Glyma04g01550.1
>Glyma04g01560.1
>Glyma04g01570.1
>Glyma04g01580.1

>Glyma04g01580.2
>Glyma04g01580.3
>Glyma04g01580.4
>Glyma04g01590.1
>Glyma04g01600.1
>Glyma04g01600.2
>Glyma04g01610.1
>Glyma04g01610.2
>Glyma04g01620.1
>Glyma04g01630.1
>Glyma04g01630.2
>Glyma04g01640.1
>Glyma04g01650.1
>Glyma04g01660.1
>Glyma04g01670.1
>Glyma04g01680.1
>Glyma04g01690.1
>Glyma04g01700.1
>Glyma04g01700.2
>Glyma04g01700.3
>Glyma04g01700.4
>Glyma04g01710.1
>Glyma04g01720.1
>Glyma04g01730.1
>Glyma04g01740.1
>Glyma04g01750.1
>Glyma04g01750.2
>Glyma04g01760.1
>Glyma04g01770.1
>Glyma04g01780.1
>Glyma04g01790.1
>Glyma04g01800.1
>Glyma04g01810.1
>Glyma04g01820.1
>Glyma04g01820.2
>Glyma04g01830.1
>Glyma04g01840.1
>Glyma04g01840.2
>Glyma04g01840.3
>Glyma04g01840.4
>Glyma04g01840.5
>Glyma04g01840.6
>Glyma04g01840.7

FIG. 7

| | | |
|---|---|---|
| >Glyma04g01840.8 | >Glyma04g02190.1 | >Glyma04g02540.2 |
| >Glyma04g01850.1 | >Glyma04g02200.1 | >Glyma04g02550.1 |
| >Glyma04g01860.1 | >Glyma04g02210.1 | >Glyma04g02560.1 |
| >Glyma04g01870.1 | >Glyma04g02220.1 | >Glyma04g02570.1 |
| >Glyma04g01880.1 | >Glyma04g02220.2 | >Glyma04g02580.1 |
| >Glyma04g01890.1 | >Glyma04g02230.1 | >Glyma04g02590.1 |
| >Glyma04g01900.1 | >Glyma04g02240.1 | >Glyma04g02600.1 |
| >Glyma04g01910.1 | >Glyma04g02250.1 | >Glyma04g02610.1 |
| >Glyma04g01920.1 | >Glyma04g02260.1 | >Glyma04g02620.1 |
| >Glyma04g01920.2 | >Glyma04g02270.1 | >Glyma04g02630.1 |
| >Glyma04g01920.3 | >Glyma04g02280.1 | >Glyma04g02640.1 |
| >Glyma04g01930.1 | >Glyma04g02290.1 | >Glyma04g02640.2 |
| >Glyma04g01940.1 | >Glyma04g02300.1 | >Glyma04g02650.1 |
| >Glyma04g01950.1 | >Glyma04g02320.1 | >Glyma04g02660.1 |
| >Glyma04g01960.1 | >Glyma04g02330.1 | >Glyma04g02670.1 |
| >Glyma04g01970.1 | >Glyma04g02340.1 | >Glyma04g02680.1 |
| >Glyma04g01980.1 | >Glyma04g02350.1 | >Glyma04g02690.1 |
| >Glyma04g01980.2 | >Glyma04g02360.1 | >Glyma04g02700.1 |
| >Glyma04g01990.1 | >Glyma04g02360.2 | >Glyma04g02710.1 |
| >Glyma04g02000.1 | >Glyma04g02370.1 | >Glyma04g02720.1 |
| >Glyma04g02000.2 | >Glyma04g02380.1 | >Glyma04g02720.2 |
| >Glyma04g02000.3 | >Glyma04g02380.2 | >Glyma04g02730.1 |
| >Glyma04g02010.1 | >Glyma04g02390.1 | >Glyma04g02740.1 |
| >Glyma04g02020.1 | >Glyma04g02400.1 | >Glyma04g02750.1 |
| >Glyma04g02030.1 | >Glyma04g02410.1 | >Glyma04g02760.1 |
| >Glyma04g02030.2 | >Glyma04g02410.2 | >Glyma04g02770.1 |
| >Glyma04g02030.3 | >Glyma04g02420.1 | >Glyma04g02780.1 |
| >Glyma04g02040.1 | >Glyma04g02430.1 | >Glyma04g02790.1 |
| >Glyma04g02050.1 | >Glyma04g02440.1 | >Glyma04g02800.1 |
| >Glyma04g02060.1 | >Glyma04g02450.1 | >Glyma04g02810.1 |
| >Glyma04g02070.1 | >Glyma04g02460.1 | >Glyma04g02820.1 |
| >Glyma04g02080.1 | >Glyma04g02460.2 | >Glyma04g02830.1 |
| >Glyma04g02090.1 | >Glyma04g02470.1 | >Glyma04g02840.1 |
| >Glyma04g02100.1 | >Glyma04g02480.1 | >Glyma04g02850.1 |
| >Glyma04g02110.1 | >Glyma04g02490.1 | >Glyma04g02850.2 |
| >Glyma04g02120.1 | >Glyma04g02500.1 | >Glyma04g02860.1 |
| >Glyma04g02130.1 | >Glyma04g02510.1 | >Glyma04g02870.1 |
| >Glyma04g02140.1 | >Glyma04g02510.2 | >Glyma04g02880.1 |
| >Glyma04g02150.1 | >Glyma04g02520.1 | >Glyma04g02890.1 |
| >Glyma04g02160.1 | >Glyma04g02530.1 | >Glyma04g02900.1 |
| >Glyma04g02170.1 | >Glyma04g02530.2 | >Glyma04g02900.2 |
| >Glyma04g02180.1 | >Glyma04g02530.3 | >Glyma04g02910.1 |
| >Glyma04g02180.2 | >Glyma04g02540.1 | >Glyma04g02920.1 |

FIG. 7 (cont.)

>Glyma04g02930.1
>Glyma04g02940.1
>Glyma04g02950.1
>Glyma04g02960.1
>Glyma04g02960.2
>Glyma04g02970.1
>Glyma04g02980.1
>Glyma04g02990.1
>Glyma04g03000.1
>Glyma04g03010.1
>Glyma04g03020.1
>Glyma04g03030.1
>Glyma04g03030.2
>Glyma04g03040.1
>Glyma04g03040.2
>Glyma04g03050.1
>Glyma04g03060.1
>Glyma04g03070.1
>Glyma04g03080.1
>Glyma04g03080.2
>Glyma04g03090.1
>Glyma04g03100.1
>Glyma04g03110.1
>Glyma04g03120.1
>Glyma04g03130.1
>Glyma04g03140.1
>Glyma04g03150.1
>Glyma04g03160.1
>Glyma04g03170.1
>Glyma04g03180.1
>Glyma04g03190.1
>Glyma04g03200.1
>Glyma04g03210.1
>Glyma04g03220.1
>Glyma04g03230.1
>Glyma04g03240.1
>Glyma04g03250.1

FIG. 7 (cont.)

>Glyma18g01760.1
>Glyma18g01770.1
>Glyma18g01780.1
>Glyma18g01780.2
>Glyma18g01790.1
>Glyma18g01800.1
>Glyma18g01810.1
>Glyma18g01820.1
>Glyma18g01830.1
>Glyma18g01840.1
>Glyma18g01850.1
>Glyma18g01850.2
>Glyma18g01860.1
>Glyma18g01860.2
>Glyma18g01860.3
>Glyma18g01870.1
>Glyma18g01880.1
>Glyma18g01890.1
>Glyma18g01890.2
>Glyma18g01900.1
>Glyma18g01910.1
>Glyma18g01920.1
>Glyma18g01920.2
>Glyma18g01930.1
>Glyma18g01940.1
>Glyma18g01950.1
>Glyma18g01960.1
>Glyma18g01970.1
>Glyma18g01980.1
>Glyma18g01990.1
>Glyma18g02010.1
>Glyma18g02020.1
>Glyma18g02030.1
>Glyma18g02030.2
>Glyma18g02040.1
>Glyma18g02050.1
>Glyma18g02060.1
>Glyma18g02070.1
>Glyma18g02070.2
>Glyma18g02070.3
>Glyma18g02080.1
>Glyma18g02080.2
>Glyma18g02080.3
>Glyma18g02090.1
>Glyma18g02100.1

>Glyma18g02110.1
>Glyma18g02120.1
>Glyma18g02130.1
>Glyma18g02140.1
>Glyma18g02150.1
>Glyma18g02160.1
>Glyma18g02170.1
>Glyma18g02180.1
>Glyma18g02190.1
>Glyma18g02200.1
>Glyma18g02210.1
>Glyma18g02210.2
>Glyma18g02210.3
>Glyma18g02210.4
>Glyma18g02220.1
>Glyma18g02230.1
>Glyma18g02230.2
>Glyma18g02240.1
>Glyma18g02250.1
>Glyma18g02260.1
>Glyma18g02270.1
>Glyma18g02280.1
>Glyma18g02280.2
>Glyma18g02280.3
>Glyma18g02290.1
>Glyma18g02300.1
>Glyma18g02310.1
>Glyma18g02320.1
>Glyma18g02330.1
>Glyma18g02340.1
>Glyma18g02350.1
>Glyma18g02360.1
>Glyma18g02370.1
>Glyma18g02380.1
>Glyma18g02390.1
>Glyma18g02400.1
>Glyma18g02410.1
>Glyma18g02420.1
>Glyma18g02430.1
>Glyma18g02430.2
>Glyma18g02430.3
>Glyma18g02430.4
>Glyma18g02440.1
>Glyma18g02450.1
>Glyma18g02450.2

>Glyma18g02460.1
>Glyma18g02470.1
>Glyma18g02480.1
>Glyma18g02490.1
>Glyma18g02500.1
>Glyma18g02510.1
>Glyma18g02520.1
>Glyma18g02530.1
>Glyma18g02540.1
>Glyma18g02550.1
>Glyma18g02560.1
>Glyma18g02570.1
>Glyma18g02580.1
>Glyma18g02590.1
>Glyma18g02600.1
>Glyma18g02610.1
>Glyma18g02620.1
>Glyma18g02630.1
>Glyma18g02640.1
>Glyma18g02650.1
>Glyma18g02650.2
>Glyma18g02660.1
>Glyma18g02670.1
>Glyma18g02680.1
>Glyma18g02690.1
>Glyma18g02700.1
>Glyma18g02710.1
>Glyma18g02720.1
>Glyma18g02730.1
>Glyma18g02740.1
>Glyma18g02750.1
>Glyma18g02760.1
>Glyma18g02770.1
>Glyma18g02780.1
>Glyma18g02790.1
>Glyma18g02800.1
>Glyma18g02800.2
>Glyma18g02810.1
>Glyma18g02820.1
>Glyma18g02830.1
>Glyma18g02840.1
>Glyma18g02850.1
>Glyma18g02860.1
>Glyma18g02870.1
>Glyma18g02880.1

FIG. 8

| | | |
|---|---|---|
| >Glyma18g02890.1 | >Glyma18g03330.1 | >Glyma18g03780.1 |
| >Glyma18g02900.1 | >Glyma18g03340.1 | >Glyma18g03790.1 |
| >Glyma18g02910.1 | >Glyma18g03350.1 | >Glyma18g03800.1 |
| >Glyma18g02920.1 | >Glyma18g03360.1 | >Glyma18g03810.1 |
| >Glyma18g02930.1 | >Glyma18g03370.1 | >Glyma18g03820.1 |
| >Glyma18g02940.1 | >Glyma18g03380.1 | >Glyma18g03830.1 |
| >Glyma18g02950.1 | >Glyma18g03390.1 | >Glyma18g03840.1 |
| >Glyma18g02960.1 | >Glyma18g03400.1 | >Glyma18g03850.1 |
| >Glyma18g02970.1 | >Glyma18g03420.1 | >Glyma18g03860.1 |
| >Glyma18g02980.1 | >Glyma18g03430.1 | >Glyma18g03870.1 |
| >Glyma18g02990.1 | >Glyma18g03440.1 | >Glyma18g03880.1 |
| >Glyma18g03000.1 | >Glyma18g03450.1 | >Glyma18g03890.1 |
| >Glyma18g03010.1 | >Glyma18g03460.1 | >Glyma18g03890.2 |
| >Glyma18g03020.1 | >Glyma18g03470.1 | >Glyma18g03900.1 |
| >Glyma18g03030.1 | >Glyma18g03480.1 | >Glyma18g03910.1 |
| >Glyma18g03040.1 | >Glyma18g03490.1 | >Glyma18g03930.1 |
| >Glyma18g03050.1 | >Glyma18g03500.1 | >Glyma18g03940.1 |
| >Glyma18g03060.1 | >Glyma18g03510.1 | >Glyma18g03950.1 |
| >Glyma18g03070.1 | >Glyma18g03520.1 | >Glyma18g03960.1 |
| >Glyma18g03080.1 | >Glyma18g03530.1 | >Glyma18g03970.1 |
| >Glyma18g03090.1 | >Glyma18g03540.1 | >Glyma18g03980.1 |
| >Glyma18g03100.1 | >Glyma18g03550.1 | >Glyma18g03980.2 |
| >Glyma18g03110.1 | >Glyma18g03560.1 | >Glyma18g03980.3 |
| >Glyma18g03120.1 | >Glyma18g03570.1 | >Glyma18g03990.1 |
| >Glyma18g03130.1 | >Glyma18g03580.1 | >Glyma18g04000.1 |
| >Glyma18g03140.1 | >Glyma18g03590.1 | >Glyma18g04010.1 |
| >Glyma18g03150.1 | >Glyma18g03600.1 | >Glyma18g04020.1 |
| >Glyma18g03160.1 | >Glyma18g03610.1 | >Glyma18g04030.1 |
| >Glyma18g03170.1 | >Glyma18g03620.1 | >Glyma18g04040.1 |
| >Glyma18g03180.1 | >Glyma18g03630.1 | >Glyma18g04050.1 |
| >Glyma18g03190.1 | >Glyma18g03640.1 | >Glyma18g04060.1 |
| >Glyma18g03200.1 | >Glyma18g03640.2 | >Glyma18g04070.1 |
| >Glyma18g03210.1 | >Glyma18g03650.1 | >Glyma18g04080.1 |
| >Glyma18g03220.1 | >Glyma18g03660.1 | >Glyma18g04090.1 |
| >Glyma18g03220.2 | >Glyma18g03670.1 | >Glyma18g04110.1 |
| >Glyma18g03230.1 | >Glyma18g03680.1 | >Glyma18g04120.1 |
| >Glyma18g03240.1 | >Glyma18g03690.1 | >Glyma18g04130.1 |
| >Glyma18g03250.1 | >Glyma18g03700.1 | >Glyma18g04140.1 |
| >Glyma18g03260.1 | >Glyma18g03710.1 | >Glyma18g04150.1 |
| >Glyma18g03270.1 | >Glyma18g03720.1 | >Glyma18g04160.1 |
| >Glyma18g03280.1 | >Glyma18g03730.1 | >Glyma18g04170.1 |
| >Glyma18g03290.1 | >Glyma18g03740.1 | >Glyma18g04180.1 |
| >Glyma18g03300.1 | >Glyma18g03750.1 | >Glyma18g04190.1 |
| >Glyma18g03310.1 | >Glyma18g03760.1 | >Glyma18g04200.1 |
| >Glyma18g03320.1 | >Glyma18g03770.1 | >Glyma18g04210.1 |

FIG. 8 (cont.)

| | | |
|---|---|---|
| >Glyma18g04220.1 | >Glyma18g04670.1 | >Glyma18g05120.1 |
| >Glyma18g04230.1 | >Glyma18g04680.1 | >Glyma18g05130.1 |
| >Glyma18g04240.1 | >Glyma18g04690.1 | >Glyma18g05140.1 |
| >Glyma18g04250.1 | >Glyma18g04700.1 | >Glyma18g05150.1 |
| >Glyma18g04260.1 | >Glyma18g04710.1 | >Glyma18g05160.1 |
| >Glyma18g04270.1 | >Glyma18g04720.1 | >Glyma18g05170.1 |
| >Glyma18g04280.1 | >Glyma18g04730.1 | >Glyma18g05170.2 |
| >Glyma18g04290.1 | >Glyma18g04740.1 | >Glyma18g05180.1 |
| >Glyma18g04300.1 | >Glyma18g04750.1 | >Glyma18g05190.1 |
| >Glyma18g04310.1 | >Glyma18g04760.1 | >Glyma18g05200.1 |
| >Glyma18g04320.1 | >Glyma18g04770.1 | >Glyma18g05210.1 |
| >Glyma18g04330.1 | >Glyma18g04780.1 | >Glyma18g05220.1 |
| >Glyma18g04340.1 | >Glyma18g04790.1 | >Glyma18g05230.1 |
| >Glyma18g04350.1 | >Glyma18g04800.1 | >Glyma18g05240.1 |
| >Glyma18g04360.1 | >Glyma18g04810.1 | >Glyma18g05250.1 |
| >Glyma18g04370.1 | >Glyma18g04820.1 | >Glyma18g05260.1 |
| >Glyma18g04380.1 | >Glyma18g04830.1 | >Glyma18g05270.1 |
| >Glyma18g04390.1 | >Glyma18g04840.1 | >Glyma18g05280.1 |
| >Glyma18g04400.1 | >Glyma18g04850.1 | >Glyma18g05290.1 |
| >Glyma18g04410.1 | >Glyma18g04860.1 | >Glyma18g05300.1 |
| >Glyma18g04420.1 | >Glyma18g04870.1 | >Glyma18g05310.1 |
| >Glyma18g04430.1 | >Glyma18g04880.1 | >Glyma18g05320.1 |
| >Glyma18g04440.1 | >Glyma18g04890.1 | >Glyma18g05330.1 |
| >Glyma18g04450.1 | >Glyma18g04900.1 | >Glyma18g05340.1 |
| >Glyma18g04460.1 | >Glyma18g04910.1 | >Glyma18g05350.1 |
| >Glyma18g04470.1 | >Glyma18g04920.1 | >Glyma18g05360.1 |
| >Glyma18g04480.1 | >Glyma18g04930.1 | >Glyma18g05370.1 |
| >Glyma18g04490.1 | >Glyma18g04940.1 | >Glyma18g05380.1 |
| >Glyma18g04500.1 | >Glyma18g04950.1 | >Glyma18g05390.1 |
| >Glyma18g04510.1 | >Glyma18g04960.1 | >Glyma18g05410.1 |
| >Glyma18g04520.1 | >Glyma18g04970.1 | >Glyma18g05420.1 |
| >Glyma18g04530.1 | >Glyma18g04980.1 | >Glyma18g05430.1 |
| >Glyma18g04540.1 | >Glyma18g04990.1 | >Glyma18g05440.1 |
| >Glyma18g04550.1 | >Glyma18g05000.1 | >Glyma18g05450.1 |
| >Glyma18g04560.1 | >Glyma18g05010.1 | >Glyma18g05460.1 |
| >Glyma18g04570.1 | >Glyma18g05020.1 | >Glyma18g05470.1 |
| >Glyma18g04580.1 | >Glyma18g05030.1 | >Glyma18g05480.1 |
| >Glyma18g04590.1 | >Glyma18g05040.1 | >Glyma18g05490.1 |
| >Glyma18g04600.1 | >Glyma18g05050.1 | >Glyma18g05510.1 |
| >Glyma18g04610.1 | >Glyma18g05060.1 | >Glyma18g05520.1 |
| >Glyma18g04620.1 | >Glyma18g05070.1 | >Glyma18g05530.1 |
| >Glyma18g04630.1 | >Glyma18g05080.1 | >Glyma18g05540.1 |
| >Glyma18g04640.1 | >Glyma18g05090.1 | >Glyma18g05570.1 |
| >Glyma18g04650.1 | >Glyma18g05100.1 | >Glyma18g05580.1 |
| >Glyma18g04660.1 | >Glyma18g05110.1 | >Glyma18g05590.1 |

FIG. 8 (cont.)

>Glyma18g05600.1
>Glyma18g05610.1
>Glyma18g05620.1
>Glyma18g05630.1
>Glyma18g05640.1
>Glyma18g05650.1
>Glyma18g05660.1
>Glyma18g05670.1
>Glyma18g05680.1
>Glyma18g05690.1
>Glyma18g05700.1
>Glyma18g05710.1
>Glyma18g05720.1
>Glyma18g05730.1
>Glyma18g05740.1
>Glyma18g05750.1
>Glyma18g05760.1
>Glyma18g05770.1
>Glyma18g05780.1
>Glyma18g05790.1
>Glyma18g05800.1
>Glyma18g05800.3
>Glyma18g05810.1
>Glyma18g05820.1
>Glyma18g05830.1
>Glyma18g05830.3
>Glyma18g05840.1
>Glyma18g05850.1
>Glyma18g05860.1
>Glyma18g05870.1
>Glyma18g05880.1
>Glyma18g05890.1
>Glyma18g05900.1
>Glyma18g05910.1
>Glyma18g05920.1
>Glyma18g05930.1
>Glyma18g05940.1
>Glyma18g05950.1
>Glyma18g05960.1
>Glyma18g05970.1
>Glyma18g05980.1
>Glyma18g05990.1
>Glyma18g06000.1
>Glyma18g06010.1
>Glyma18g06020.1

>Glyma18g06030.1
>Glyma18g06040.1
>Glyma18g06050.1
>Glyma18g06060.1
>Glyma18g06070.1
>Glyma18g06080.1
>Glyma18g06090.1

FIG. 8 (cont.)

| | | |
|---|---|---|
| >Glyma08g05580.2 | >Glyma08g05960.1 | >Glyma08g06410.1 |
| >Glyma08g05580.3 | >Glyma08g05970.1 | >Glyma08g06420.1 |
| >Glyma08g05580.4 | >Glyma08g05990.1 | >Glyma08g06430.1 |
| >Glyma08g05590.1 | >Glyma08g06000.1 | >Glyma08g06440.1 |
| >Glyma08g05590.2 | >Glyma08g06010.1 | >Glyma08g06450.1 |
| >Glyma08g05590.3 | >Glyma08g06010.2 | >Glyma08g06460.1 |
| >Glyma08g05590.4 | >Glyma08g06020.1 | >Glyma08g06470.1 |
| >Glyma08g05600.1 | >Glyma08g06030.1 | >Glyma08g06480.1 |
| >Glyma08g05610.1 | >Glyma08g06040.1 | >Glyma08g06490.1 |
| >Glyma08g05610.2 | >Glyma08g06050.1 | >Glyma08g06500.1 |
| >Glyma08g05620.1 | >Glyma08g06060.1 | >Glyma08g06510.1 |
| >Glyma08g05630.1 | >Glyma08g06070.1 | >Glyma08g06520.1 |
| >Glyma08g05640.1 | >Glyma08g06080.1 | >Glyma08g06530.1 |
| >Glyma08g05650.1 | >Glyma08g06090.1 | >Glyma08g06540.1 |
| >Glyma08g05660.1 | >Glyma08g06090.2 | >Glyma08g06550.1 |
| >Glyma08g05670.1 | >Glyma08g06090.3 | >Glyma08g06560.1 |
| >Glyma08g05680.1 | >Glyma08g06100.1 | >Glyma08g06570.1 |
| >Glyma08g05690.1 | >Glyma08g06110.1 | >Glyma08g06570.2 |
| >Glyma08g05700.1 | >Glyma08g06120.1 | >Glyma08g06580.1 |
| >Glyma08g05700.2 | >Glyma08g06130.1 | >Glyma08g06590.1 |
| >Glyma08g05710.1 | >Glyma08g06140.1 | >Glyma08g06610.1 |
| >Glyma08g05720.1 | >Glyma08g06150.1 | >Glyma08g06610.2 |
| >Glyma08g05730.1 | >Glyma08g06160.1 | >Glyma08g06610.3 |
| >Glyma08g05740.1 | >Glyma08g06170.1 | >Glyma08g06620.1 |
| >Glyma08g05750.1 | >Glyma08g06180.1 | >Glyma08g06630.1 |
| >Glyma08g05760.1 | >Glyma08g06190.1 | >Glyma08g06640.1 |
| >Glyma08g05770.1 | >Glyma08g06200.1 | >Glyma08g06650.1 |
| >Glyma08g05780.1 | >Glyma08g06210.1 | >Glyma08g06650.2 |
| >Glyma08g05790.1 | >Glyma08g06220.1 | >Glyma08g06660.1 |
| >Glyma08g05800.1 | >Glyma08g06230.1 | >Glyma08g06670.1 |
| >Glyma08g05810.1 | >Glyma08g06240.1 | >Glyma08g06680.1 |
| >Glyma08g05820.1 | >Glyma08g06250.1 | >Glyma08g06690.1 |
| >Glyma08g05830.1 | >Glyma08g06260.1 | >Glyma08g06700.1 |
| >Glyma08g05840.1 | >Glyma08g06270.1 | >Glyma08g06710.1 |
| >Glyma08g05850.1 | >Glyma08g06280.1 | >Glyma08g06720.1 |
| >Glyma08g05860.1 | >Glyma08g06290.1 | >Glyma08g06730.1 |
| >Glyma08g05870.1 | >Glyma08g06300.1 | >Glyma08g06740.1 |
| >Glyma08g05870.2 | >Glyma08g06300.2 | >Glyma08g06750.1 |
| >Glyma08g05880.1 | >Glyma08g06310.1 | >Glyma08g06760.1 |
| >Glyma08g05890.1 | >Glyma08g06310.2 | >Glyma08g06770.1 |
| >Glyma08g05900.1 | >Glyma08g06320.1 | >Glyma08g06780.1 |
| >Glyma08g05910.1 | >Glyma08g06330.1 | >Glyma08g06780.2 |
| >Glyma08g05920.1 | >Glyma08g06340.1 | >Glyma08g06780.3 |
| >Glyma08g05930.1 | >Glyma08g06350.1 | >Glyma08g06790.1 |
| >Glyma08g05930.2 | >Glyma08g06360.1 | >Glyma08g06810.1 |
| >Glyma08g05940.1 | >Glyma08g06370.1 | >Glyma08g06810.2 |
| >Glyma08g05940.2 | >Glyma08g06380.1 | >Glyma08g06820.1 |
| >Glyma08g05940.3 | >Glyma08g06390.1 | >Glyma08g06830.1 |
| >Glyma08g05950.1 | >Glyma08g06400.1 | >Glyma08g06840.1 |

FIG. 9

>Glyma08g06850.1
>Glyma08g06860.1
>Glyma08g06870.1
>Glyma08g06880.1
>Glyma08g06890.1
>Glyma08g06890.2
>Glyma08g06890.3
>Glyma08g06900.1
>Glyma08g06910.1
>Glyma08g06920.1
>Glyma08g06920.2
>Glyma08g06930.1
>Glyma08g06940.1
>Glyma08g06950.1
>Glyma08g06960.1
>Glyma08g06970.1
>Glyma08g06980.1
>Glyma08g06990.1
>Glyma08g07000.1
>Glyma08g07010.1
>Glyma08g07020.1
>Glyma08g07030.1
>Glyma08g07040.1
>Glyma08g07050.1
>Glyma08g07060.1
>Glyma08g07070.1
>Glyma08g07080.1
>Glyma08g07090.1
>Glyma08g07100.1
>Glyma08g07110.1
>Glyma08g07120.1
>Glyma08g07130.1
>Glyma08g07140.1
>Glyma08g07150.1
>Glyma08g07160.1
>Glyma08g07170.1
>Glyma08g07180.1
>Glyma08g07190.1
>Glyma08g07190.2
>Glyma08g07190.3
>Glyma08g07200.1
>Glyma08g07210.1
>Glyma08g07220.1
>Glyma08g07230.1
>Glyma08g07230.2
>Glyma08g07240.1
>Glyma08g07250.1
>Glyma08g07260.1
>Glyma08g07260.2

>Glyma08g07260.3
>Glyma08g07270.1
>Glyma08g07290.1
>Glyma08g07300.1
>Glyma08g07310.1
>Glyma08g07320.1
>Glyma08g07330.1
>Glyma08g07340.1
>Glyma08g07350.1
>Glyma08g07360.1
>Glyma08g07370.1
>Glyma08g07380.1
>Glyma08g07390.1
>Glyma08g07400.1
>Glyma08g07410.1
>Glyma08g07420.1
>Glyma08g07430.1
>Glyma08g07440.1
>Glyma08g07450.1
>Glyma08g07460.1
>Glyma08g07470.1
>Glyma08g07480.1
>Glyma08g07490.1
>Glyma08g07500.1
>Glyma08g07510.1
>Glyma08g07510.2
>Glyma08g07520.1
>Glyma08g07530.1
>Glyma08g07540.1
>Glyma08g07550.1
>Glyma08g07560.1
>Glyma08g07570.1
>Glyma08g07580.1
>Glyma08g07590.1
>Glyma08g07600.1
>Glyma08g07610.1
>Glyma08g07620.1
>Glyma08g07630.1
>Glyma08g07640.1
>Glyma08g07650.1
>Glyma08g07660.1
>Glyma08g07670.1
>Glyma08g07670.2
>Glyma08g07680.1
>Glyma08g07690.1
>Glyma08g07700.1
>Glyma08g07710.1
>Glyma08g07710.2
>Glyma08g07720.1

>Glyma08g07730.1
>Glyma08g07740.1
>Glyma08g07750.1
>Glyma08g07760.1
>Glyma08g07770.1
>Glyma08g07780.1
>Glyma08g07790.1
>Glyma08g07800.1
>Glyma08g07810.1
>Glyma08g07820.1
>Glyma08g07830.1
>Glyma08g07830.2
>Glyma08g07840.1
>Glyma08g07850.1
>Glyma08g07860.1
>Glyma08g07860.2
>Glyma08g07870.1
>Glyma08g07880.1
>Glyma08g07890.1
>Glyma08g07900.1
>Glyma08g07910.1
>Glyma08g07920.1
>Glyma08g07930.1
>Glyma08g07940.1
>Glyma08g07950.1
>Glyma08g07950.2
>Glyma08g07960.1
>Glyma08g07970.1
>Glyma08g07980.1
>Glyma08g07990.1
>Glyma08g07990.2
>Glyma08g08000.1
>Glyma08g08010.1
>Glyma08g08020.1
>Glyma08g08030.1
>Glyma08g08040.1
>Glyma08g08050.1
>Glyma08g08060.1
>Glyma08g08070.1
>Glyma08g08080.1
>Glyma08g08090.1
>Glyma08g08100.1
>Glyma08g08110.1
>Glyma08g08120.1
>Glyma08g08130.1
>Glyma08g08140.1
>Glyma08g08150.1
>Glyma08g08160.1
>Glyma08g08170.1

FIG. 9 (cont.)

>Glyma08g08180.1
>Glyma08g08180.2
>Glyma08g08190.1
>Glyma08g08190.2
>Glyma08g08190.3
>Glyma08g08200.1
>Glyma08g08210.1
>Glyma08g08220.1
>Glyma08g08230.1
>Glyma08g08240.1
>Glyma08g08250.1
>Glyma08g08260.1
>Glyma08g08260.2
>Glyma08g08270.1
>Glyma08g08280.1
>Glyma08g08280.2
>Glyma08g08290.1
>Glyma08g08300.1
>Glyma08g08310.1
>Glyma08g08310.2
>Glyma08g08310.3
>Glyma08g08310.4
>Glyma08g08320.1
>Glyma08g08330.1
>Glyma08g08330.2
>Glyma08g08340.1
>Glyma08g08350.1
>Glyma08g08360.1
>Glyma08g08370.1
>Glyma08g08380.1
>Glyma08g08390.1
>Glyma08g08400.1
>Glyma08g08410.1
>Glyma08g08420.1
>Glyma08g08430.1
>Glyma08g08440.1
>Glyma08g08450.1
>Glyma08g08460.1
>Glyma08g08470.1
>Glyma08g08480.1
>Glyma08g08490.1
>Glyma08g08500.1
>Glyma08g08510.1
>Glyma08g08520.1
>Glyma08g08530.1
>Glyma08g08540.1
>Glyma08g08550.1
>Glyma08g08560.1
>Glyma08g08570.1

>Glyma08g08580.1
>Glyma08g08580.2
>Glyma08g08590.1
>Glyma08g08590.2
>Glyma08g08600.1
>Glyma08g08610.1
>Glyma08g08610.2
>Glyma08g08610.3
>Glyma08g08610.4
>Glyma08g08620.1
>Glyma08g08630.1
>Glyma08g08650.1
>Glyma08g08660.1
>Glyma08g08660.2
>Glyma08g08670.1
>Glyma08g08680.1
>Glyma08g08690.1
>Glyma08g08700.1
>Glyma08g08700.2
>Glyma08g08700.3
>Glyma08g08710.1
>Glyma08g08720.1
>Glyma08g08730.1
>Glyma08g08740.1
>Glyma08g08750.1
>Glyma08g08760.1
>Glyma08g08770.1
>Glyma08g08770.2
>Glyma08g08780.1
>Glyma08g08790.1
>Glyma08g08800.1
>Glyma08g08810.1
>Glyma08g08820.1
>Glyma08g08830.1
>Glyma08g08840.1
>Glyma08g08850.1
>Glyma08g08860.1
>Glyma08g08870.1
>Glyma08g08880.1
>Glyma08g08890.1
>Glyma08g08890.2
>Glyma08g08900.1
>Glyma08g08910.1
>Glyma08g08910.2
>Glyma08g08920.1
>Glyma08g08920.2
>Glyma08g08930.1
>Glyma08g08940.1
>Glyma08g08950.1

>Glyma08g08960.1
>Glyma08g08970.1
>Glyma08g08970.2
>Glyma08g08970.3
>Glyma08g08980.1
>Glyma08g08990.1
>Glyma08g09000.1
>Glyma08g09010.1
>Glyma08g09020.1
>Glyma08g09030.1
>Glyma08g09040.1
>Glyma08g09050.1
>Glyma08g09060.1
>Glyma08g09070.1
>Glyma08g09080.1
>Glyma08g09080.2
>Glyma08g09080.3
>Glyma08g09090.1
>Glyma08g09100.1
>Glyma08g09110.1
>Glyma08g09120.1
>Glyma08g09130.1
>Glyma08g09140.1
>Glyma08g09150.1
>Glyma08g09160.1
>Glyma08g09170.1
>Glyma08g09170.2
>Glyma08g09180.1
>Glyma08g09190.1
>Glyma08g09200.1
>Glyma08g09200.2
>Glyma08g09210.1
>Glyma08g09220.1
>Glyma08g09230.1
>Glyma08g09240.1
>Glyma08g09250.1
>Glyma08g09260.1
>Glyma08g09260.2
>Glyma08g09260.3
>Glyma08g09260.4
>Glyma08g09270.1
>Glyma08g09270.2
>Glyma08g09280.1
>Glyma08g09290.1
>Glyma08g09300.1
>Glyma08g09310.1
>Glyma08g09310.2
>Glyma08g09320.1
>Glyma08g09330.1

FIG. 9 (cont.)

>Glyma08g09340.1
>Glyma08g09350.1
>Glyma08g09360.1
>Glyma08g09370.1
>Glyma08g09370.2
>Glyma08g09380.1
>Glyma08g09390.1
>Glyma08g09400.1
>Glyma08g09410.1
>Glyma08g09420.1
>Glyma08g09430.1
>Glyma08g09440.1
>Glyma08g09450.1
>Glyma08g09460.1
>Glyma08g09470.1
>Glyma08g09470.2
>Glyma08g09480.1
>Glyma08g09490.1
>Glyma08g09500.1
>Glyma08g09510.1
>Glyma08g09520.1
>Glyma08g09520.2
>Glyma08g09530.1
>Glyma08g09540.1
>Glyma08g09550.1
>Glyma08g09560.1
>Glyma08g09570.1
>Glyma08g09580.1
>Glyma08g09590.1
>Glyma08g09600.1
>Glyma08g09610.1
>Glyma08g09620.1
>Glyma08g09630.1
>Glyma08g09640.1
>Glyma08g09640.2
>Glyma08g09650.1
>Glyma08g09660.1
>Glyma08g09670.1
>Glyma08g09680.1
>Glyma08g09690.1
>Glyma08g09700.1
>Glyma08g09710.1
>Glyma08g09720.1
>Glyma08g09730.1
>Glyma08g09740.1
>Glyma08g09740.2
>Glyma08g09750.1
>Glyma08g09760.1
>Glyma08g09770.1

>Glyma08g09780.1
>Glyma08g09790.1
>Glyma08g09800.1
>Glyma08g09810.1
>Glyma08g09810.2
>Glyma08g09820.1
>Glyma08g09830.1
>Glyma08g09840.1
>Glyma08g09850.1
>Glyma08g09860.1
>Glyma08g09860.2
>Glyma08g09870.1
>Glyma08g09880.1
>Glyma08g09880.2
>Glyma08g09890.1
>Glyma08g09890.2
>Glyma08g09900.1
>Glyma08g09900.2
>Glyma08g09910.1
>Glyma08g09910.2
>Glyma08g09920.1
>Glyma08g09930.1
>Glyma08g09940.1
>Glyma08g09950.1
>Glyma08g09960.1
>Glyma08g09970.1
>Glyma08g09980.1
>Glyma08g09990.1
>Glyma08g10000.1
>Glyma08g10010.1
>Glyma08g10020.1
>Glyma08g10020.2
>Glyma08g10020.3
>Glyma08g10030.1
>Glyma08g10040.1
>Glyma08g10050.1
>Glyma08g10060.1
>Glyma08g10060.2
>Glyma08g10070.1
>Glyma08g10070.2
>Glyma08g10080.1
>Glyma08g10090.1
>Glyma08g10100.1
>Glyma08g10100.2
>Glyma08g10110.1
>Glyma08g10120.1
>Glyma08g10130.1
>Glyma08g10140.1
>Glyma08g10150.1

>Glyma08g10160.1
>Glyma08g10170.1
>Glyma08g10180.1
>Glyma08g10190.1
>Glyma08g10200.1
>Glyma08g10210.1
>Glyma08g10220.1
>Glyma08g10230.1
>Glyma08g10240.1
>Glyma08g10250.1
>Glyma08g10250.2
>Glyma08g10260.1
>Glyma08g10270.1
>Glyma08g10280.1
>Glyma08g10290.1
>Glyma08g10300.1
>Glyma08g10310.1
>Glyma08g10320.1
>Glyma08g10330.1
>Glyma08g10340.1
>Glyma08g10350.1
>Glyma08g10360.1
>Glyma08g10370.1
>Glyma08g10380.1
>Glyma08g10390.1
>Glyma08g10400.1
>Glyma08g10410.1
>Glyma08g10420.1
>Glyma08g10430.1
>Glyma08g10440.1
>Glyma08g10450.1
>Glyma08g10460.1
>Glyma08g10470.1
>Glyma08g10480.1
>Glyma08g10490.1
>Glyma08g10500.1
>Glyma08g10510.1
>Glyma08g10520.1
>Glyma08g10530.1
>Glyma08g10540.1
>Glyma08g10550.1
>Glyma08g10550.2
>Glyma08g10560.1
>Glyma08g10570.1
>Glyma08g10570.2
>Glyma08g10580.1
>Glyma08g10590.1
>Glyma08g10590.2
>Glyma08g10600.1

FIG. 9 (cont.)

>Glyma08g10610.1
>Glyma08g10610.2
>Glyma08g10620.1
>Glyma08g10620.2
>Glyma08g10630.1
>Glyma08g10640.1
>Glyma08g10650.1
>Glyma08g10660.1
>Glyma08g10680.1
>Glyma08g10690.1
>Glyma08g10700.1
>Glyma08g10710.1
>Glyma08g10720.1
>Glyma08g10730.1
>Glyma08g10740.1
>Glyma08g10750.1
>Glyma08g10760.1
>Glyma08g10770.1
>Glyma08g10780.1
>Glyma08g10790.1
>Glyma08g10790.2
>Glyma08g10800.1
>Glyma08g10810.1
>Glyma08g10810.2
>Glyma08g10820.1
>Glyma08g10830.1
>Glyma08g10840.1
>Glyma08g10850.1
>Glyma08g10860.1
>Glyma08g10870.1
>Glyma08g10870.2
>Glyma08g10880.1
>Glyma08g10890.1
>Glyma08g10890.2
>Glyma08g10890.3
>Glyma08g10890.4
>Glyma08g10900.1
>Glyma08g10910.1
>Glyma08g10910.2
>Glyma08g10920.1
>Glyma08g10930.1
>Glyma08g10940.1
>Glyma08g10950.1
>Glyma08g10960.1
>Glyma08g10960.2
>Glyma08g10970.1
>Glyma08g10980.1
>Glyma08g10990.1
>Glyma08g10990.2

>Glyma08g11000.1
>Glyma08g11010.1
>Glyma08g11020.1
>Glyma08g11030.1
>Glyma08g11030.2
>Glyma08g11040.1
>Glyma08g11050.1
>Glyma08g11060.1
>Glyma08g11060.2
>Glyma08g11070.1
>Glyma08g11080.1
>Glyma08g11090.1
>Glyma08g11100.1
>Glyma08g11110.1
>Glyma08g11120.1
>Glyma08g11130.1
>Glyma08g11140.1
>Glyma08g11150.1
>Glyma08g11160.1
>Glyma08g11170.1
>Glyma08g11180.1
>Glyma08g11190.1
>Glyma08g11200.1
>Glyma08g11210.1
>Glyma08g11220.1
>Glyma08g11230.1
>Glyma08g11240.1
>Glyma08g11250.1
>Glyma08g11260.1
>Glyma08g11270.1
>Glyma08g11280.1
>Glyma08g11290.1
>Glyma08g11300.1
>Glyma08g11310.1
>Glyma08g11320.1
>Glyma08g11330.1
>Glyma08g11340.1
>Glyma08g11350.1
>Glyma08g11360.1
>Glyma08g11370.1
>Glyma08g11380.1
>Glyma08g11390.1
>Glyma08g11400.1
>Glyma08g11410.1
>Glyma08g11420.1
>Glyma08g11430.1
>Glyma08g11440.1
>Glyma08g11450.1
>Glyma08g11450.2

>Glyma08g11460.1
>Glyma08g11470.1
>Glyma08g11480.1
>Glyma08g11490.1
>Glyma08g11490.2
>Glyma08g11500.1
>Glyma08g11510.1
>Glyma08g11520.1
>Glyma08g11530.1
>Glyma08g11540.1
>Glyma08g11550.1
>Glyma08g11550.2
>Glyma08g11550.3
>Glyma08g11560.1
>Glyma08g11570.1
>Glyma08g11580.1
>Glyma08g11590.1
>Glyma08g11600.1
>Glyma08g11610.1
>Glyma08g11620.1
>Glyma08g11630.1
>Glyma08g11630.2
>Glyma08g11630.3
>Glyma08g11640.1
>Glyma08g11650.1
>Glyma08g11660.1
>Glyma08g11670.1
>Glyma08g11680.1
>Glyma08g11680.2
>Glyma08g11680.3
>Glyma08g11710.1
>Glyma08g11720.1
>Glyma08g11730.1
>Glyma08g11740.1
>Glyma08g11760.1
>Glyma08g11770.1
>Glyma08g11770.2
>Glyma08g11770.3
>Glyma08g11780.1
>Glyma08g11790.1
>Glyma08g11790.2
>Glyma08g11800.1
>Glyma08g11810.1
>Glyma08g11820.1
>Glyma08g11830.1
>Glyma08g11840.1
>Glyma08g11850.1
>Glyma08g11850.2
>Glyma08g11860.1

FIG. 9 (cont.)

| | | |
|---|---|---|
| >Glyma08g11870.1 | >Glyma08g12250.1 | >Glyma08g12690.1 |
| >Glyma08g11880.1 | >Glyma08g12260.1 | >Glyma08g12700.1 |
| >Glyma08g11890.1 | >Glyma08g12270.1 | >Glyma08g12710.1 |
| >Glyma08g11900.1 | >Glyma08g12280.1 | >Glyma08g12720.1 |
| >Glyma08g11910.1 | >Glyma08g12290.1 | >Glyma08g12730.1 |
| >Glyma08g11920.1 | >Glyma08g12300.1 | >Glyma08g12740.1 |
| >Glyma08g11930.1 | >Glyma08g12310.1 | >Glyma08g12750.1 |
| >Glyma08g11940.1 | >Glyma08g12320.1 | >Glyma08g12760.1 |
| >Glyma08g11940.2 | >Glyma08g12330.1 | >Glyma08g12770.1 |
| >Glyma08g11950.1 | >Glyma08g12340.1 | >Glyma08g12780.1 |
| >Glyma08g11960.1 | >Glyma08g12350.1 | >Glyma08g12790.1 |
| >Glyma08g11970.1 | >Glyma08g12360.1 | >Glyma08g12800.1 |
| >Glyma08g11980.1 | >Glyma08g12370.1 | >Glyma08g12810.1 |
| >Glyma08g12000.1 | >Glyma08g12380.1 | >Glyma08g12820.1 |
| >Glyma08g12000.2 | >Glyma08g12390.1 | >Glyma08g12820.2 |
| >Glyma08g12010.1 | >Glyma08g12400.1 | >Glyma08g12830.1 |
| >Glyma08g12020.1 | >Glyma08g12410.1 | >Glyma08g12840.1 |
| >Glyma08g12030.1 | >Glyma08g12420.1 | >Glyma08g12850.1 |
| >Glyma08g12030.2 | >Glyma08g12430.1 | >Glyma08g12860.1 |
| >Glyma08g12040.1 | >Glyma08g12440.1 | >Glyma08g12870.1 |
| >Glyma08g12050.1 | >Glyma08g12450.1 | >Glyma08g12880.1 |
| >Glyma08g12060.1 | >Glyma08g12460.1 | >Glyma08g12890.1 |
| >Glyma08g12070.1 | >Glyma08g12470.1 | >Glyma08g12900.1 |
| >Glyma08g12080.1 | >Glyma08g12480.1 | >Glyma08g12900.2 |
| >Glyma08g12090.1 | >Glyma08g12490.1 | >Glyma08g12910.1 |
| >Glyma08g12090.2 | >Glyma08g12500.1 | >Glyma08g12920.1 |
| >Glyma08g12100.1 | >Glyma08g12510.1 | >Glyma08g12930.1 |
| >Glyma08g12110.1 | >Glyma08g12520.1 | >Glyma08g12940.1 |
| >Glyma08g12120.1 | >Glyma08g12520.2 | >Glyma08g12940.2 |
| >Glyma08g12130.1 | >Glyma08g12530.1 | >Glyma08g12950.1 |
| >Glyma08g12140.1 | >Glyma08g12540.1 | >Glyma08g12960.1 |
| >Glyma08g12140.2 | >Glyma08g12550.1 | >Glyma08g12970.1 |
| >Glyma08g12140.3 | >Glyma08g12560.1 | >Glyma08g12980.1 |
| >Glyma08g12150.1 | >Glyma08g12560.2 | >Glyma08g12980.2 |
| >Glyma08g12150.2 | >Glyma08g12560.3 | >Glyma08g12990.1 |
| >Glyma08g12160.1 | >Glyma08g12570.1 | >Glyma08g13000.1 |
| >Glyma08g12170.1 | >Glyma08g12580.1 | >Glyma08g13010.1 |
| >Glyma08g12180.1 | >Glyma08g12590.1 | >Glyma08g13020.1 |
| >Glyma08g12190.1 | >Glyma08g12600.1 | >Glyma08g13030.1 |
| >Glyma08g12200.1 | >Glyma08g12610.1 | >Glyma08g13040.1 |
| >Glyma08g12210.1 | >Glyma08g12620.1 | >Glyma08g13040.2 |
| >Glyma08g12220.1 | >Glyma08g12630.1 | >Glyma08g13050.1 |
| >Glyma08g12220.2 | >Glyma08g12640.1 | >Glyma08g13060.1 |
| >Glyma08g12220.3 | >Glyma08g12650.1 | >Glyma08g13070.1 |
| >Glyma08g12220.4 | >Glyma08g12650.2 | >Glyma08g13080.1 |
| >Glyma08g12220.5 | >Glyma08g12650.3 | >Glyma08g13090.1 |
| >Glyma08g12220.6 | >Glyma08g12660.1 | >Glyma08g13090.2 |
| >Glyma08g12230.1 | >Glyma08g12670.1 | >Glyma08g13100.1 |
| >Glyma08g12240.1 | >Glyma08g12680.1 | >Glyma08g13110.1 |

FIG. 9 (cont.)

>Glyma08g13110.2
>Glyma08g13120.1
>Glyma08g13130.1
>Glyma08g13130.2
>Glyma08g13140.1
>Glyma08g13150.1
>Glyma08g13160.1
>Glyma08g13170.1
>Glyma08g13180.1
>Glyma08g13180.2
>Glyma08g13190.1
>Glyma08g13200.1
>Glyma08g13210.1
>Glyma08g13220.1
>Glyma08g13220.2
>Glyma08g13230.1
>Glyma08g13240.1
>Glyma08g13240.2
>Glyma08g13240.3
>Glyma08g13250.1
>Glyma08g13260.1
>Glyma08g13270.1
>Glyma08g13280.1
>Glyma08g13290.1
>Glyma08g13300.1
>Glyma08g13300.2
>Glyma08g13300.3
>Glyma08g13300.4
>Glyma08g13310.1
>Glyma08g13320.1
>Glyma08g13330.1
>Glyma08g13340.1
>Glyma08g13340.2
>Glyma08g13350.1
>Glyma08g13360.1
>Glyma08g13370.1
>Glyma08g13380.1
>Glyma08g13390.1
>Glyma08g13400.1
>Glyma08g13410.1
>Glyma08g13420.1
>Glyma08g13430.1
>Glyma08g13440.1
>Glyma08g13440.2
>Glyma08g13450.1
>Glyma08g13450.2
>Glyma08g13460.1
>Glyma08g13470.1
>Glyma08g13480.1

>Glyma08g13490.1
>Glyma08g13500.1
>Glyma08g13510.1
>Glyma08g13520.1
>Glyma08g13520.2
>Glyma08g13530.1
>Glyma08g13540.1
>Glyma08g13550.1
>Glyma08g13560.1
>Glyma08g13560.2
>Glyma08g13570.1
>Glyma08g13580.1
>Glyma08g13590.1
>Glyma08g13600.1
>Glyma08g13610.1
>Glyma08g13620.1
>Glyma08g13630.1
>Glyma08g13630.2
>Glyma08g13640.1
>Glyma08g13650.1
>Glyma08g13660.1
>Glyma08g13670.1
>Glyma08g13680.1
>Glyma08g13690.1
>Glyma08g13700.1
>Glyma08g13720.1
>Glyma08g13730.1
>Glyma08g13740.1
>Glyma08g13740.2
>Glyma08g13740.3
>Glyma08g13740.4
>Glyma08g13750.1
>Glyma08g13760.1
>Glyma08g13770.1
>Glyma08g13780.1
>Glyma08g13790.1
>Glyma08g13800.1
>Glyma08g13810.1
>Glyma08g13820.1
>Glyma08g13830.1
>Glyma08g13840.1
>Glyma08g13850.1
>Glyma08g13860.1
>Glyma08g13870.1
>Glyma08g13880.1
>Glyma08g13890.1
>Glyma08g13900.1
>Glyma08g13910.1
>Glyma08g13910.2

>Glyma08g13910.3
>Glyma08g13920.1
>Glyma08g13930.1
>Glyma08g13930.2
>Glyma08g13940.1
>Glyma08g13950.1
>Glyma08g13960.1
>Glyma08g13970.1
>Glyma08g13980.1
>Glyma08g13980.2
>Glyma08g13990.1
>Glyma08g14000.1
>Glyma08g14010.1
>Glyma08g14020.1
>Glyma08g14030.1
>Glyma08g14040.1
>Glyma08g14050.1
>Glyma08g14060.1
>Glyma08g14070.1
>Glyma08g14080.1
>Glyma08g14090.1
>Glyma08g14100.1
>Glyma08g14110.1
>Glyma08g14120.1
>Glyma08g14130.1
>Glyma08g14130.2
>Glyma08g14140.1
>Glyma08g14150.1
>Glyma08g14160.1
>Glyma08g14170.1
>Glyma08g14180.1
>Glyma08g14190.1
>Glyma08g14200.1
>Glyma08g14210.1
>Glyma08g14220.1
>Glyma08g14230.1
>Glyma08g14240.1
>Glyma08g14250.1
>Glyma08g14250.2
>Glyma08g14260.1
>Glyma08g14270.1
>Glyma08g14280.1
>Glyma08g14280.2
>Glyma08g14280.3
>Glyma08g14280.4
>Glyma08g14280.5
>Glyma08g14290.1
>Glyma08g14300.1
>Glyma08g14310.1

FIG. 9 (cont.)

| | | |
|---|---|---|
| >Glyma08g14320.1 | >Glyma08g14690.1 | >Glyma08g15000.3 |
| >Glyma08g14330.1 | >Glyma08g14700.1 | >Glyma08g15000.4 |
| >Glyma08g14340.1 | >Glyma08g14710.1 | >Glyma08g15000.5 |
| >Glyma08g14350.1 | >Glyma08g14720.1 | >Glyma08g15000.6 |
| >Glyma08g14360.1 | >Glyma08g14720.2 | >Glyma08g15010.1 |
| >Glyma08g14370.1 | >Glyma08g14720.3 | >Glyma08g15010.2 |
| >Glyma08g14380.1 | >Glyma08g14730.1 | >Glyma08g15020.1 |
| >Glyma08g14390.1 | >Glyma08g14740.1 | >Glyma08g15030.1 |
| >Glyma08g14400.1 | >Glyma08g14740.2 | >Glyma08g15040.1 |
| >Glyma08g14410.1 | >Glyma08g14750.1 | >Glyma08g15050.1 |
| >Glyma08g14420.1 | >Glyma08g14750.2 | >Glyma08g15060.1 |
| >Glyma08g14430.1 | >Glyma08g14750.3 | >Glyma08g15070.1 |
| >Glyma08g14440.1 | >Glyma08g14760.1 | >Glyma08g15080.1 |
| >Glyma08g14440.2 | >Glyma08g14770.1 | >Glyma08g15090.1 |
| >Glyma08g14440.3 | >Glyma08g14780.1 | >Glyma08g15090.2 |
| >Glyma08g14440.4 | >Glyma08g14780.2 | >Glyma08g15100.1 |
| >Glyma08g14440.5 | >Glyma08g14790.1 | >Glyma08g15100.2 |
| >Glyma08g14440.6 | >Glyma08g14790.2 | >Glyma08g15110.1 |
| >Glyma08g14450.1 | >Glyma08g14800.1 | >Glyma08g15120.1 |
| >Glyma08g14450.2 | >Glyma08g14810.1 | >Glyma08g15130.1 |
| >Glyma08g14460.1 | >Glyma08g14820.1 | >Glyma08g15140.1 |
| >Glyma08g14460.2 | >Glyma08g14830.1 | >Glyma08g15150.1 |
| >Glyma08g14460.3 | >Glyma08g14830.2 | >Glyma08g15160.1 |
| >Glyma08g14470.1 | >Glyma08g14830.3 | >Glyma08g15170.1 |
| >Glyma08g14480.1 | >Glyma08g14830.4 | >Glyma08g15180.1 |
| >Glyma08g14490.1 | >Glyma08g14830.5 | >Glyma08g15210.1 |
| >Glyma08g14500.1 | >Glyma08g14830.6 | >Glyma08g15210.2 |
| >Glyma08g14510.1 | >Glyma08g14840.1 | >Glyma08g15210.3 |
| >Glyma08g14520.1 | >Glyma08g14840.2 | >Glyma08g15220.1 |
| >Glyma08g14530.1 | >Glyma08g14850.1 | >Glyma08g15230.1 |
| >Glyma08g14540.1 | >Glyma08g14850.2 | >Glyma08g15240.1 |
| >Glyma08g14550.1 | >Glyma08g14860.1 | >Glyma08g15250.1 |
| >Glyma08g14560.1 | >Glyma08g14870.1 | >Glyma08g15260.1 |
| >Glyma08g14570.1 | >Glyma08g14880.1 | >Glyma08g15270.1 |
| >Glyma08g14580.1 | >Glyma08g14890.1 | >Glyma08g15270.2 |
| >Glyma08g14590.1 | >Glyma08g14900.1 | >Glyma08g15280.1 |
| >Glyma08g14590.2 | >Glyma08g14910.1 | >Glyma08g15290.1 |
| >Glyma08g14600.1 | >Glyma08g14920.1 | >Glyma08g15300.1 |
| >Glyma08g14610.1 | >Glyma08g14930.1 | >Glyma08g15310.1 |
| >Glyma08g14620.1 | >Glyma08g14940.1 | >Glyma08g15310.2 |
| >Glyma08g14630.1 | >Glyma08g14940.2 | >Glyma08g15320.1 |
| >Glyma08g14640.1 | >Glyma08g14950.1 | >Glyma08g15330.1 |
| >Glyma08g14650.1 | >Glyma08g14960.1 | >Glyma08g15340.1 |
| >Glyma08g14660.1 | >Glyma08g14970.1 | >Glyma08g15350.1 |
| >Glyma08g14670.1 | >Glyma08g14980.1 | >Glyma08g15360.1 |
| >Glyma08g14670.2 | >Glyma08g14980.2 | >Glyma08g15370.1 |
| >Glyma08g14670.3 | >Glyma08g14990.1 | >Glyma08g15370.2 |
| >Glyma08g14680.1 | >Glyma08g15000.1 | >Glyma08g15370.3 |
| >Glyma08g14680.2 | >Glyma08g15000.2 | >Glyma08g15370.4 |

FIG. 9 (cont.)

>Glyma08g15380.1
>Glyma08g15390.1
>Glyma08g15400.1
>Glyma08g15410.1
>Glyma08g15420.1
>Glyma08g15430.1
>Glyma08g15440.1
>Glyma08g15450.1
>Glyma08g15460.1
>Glyma08g15460.2
>Glyma08g15460.3
>Glyma08g15470.1
>Glyma08g15480.1
>Glyma08g15490.1
>Glyma08g15500.1
>Glyma08g15510.1
>Glyma08g15520.1
>Glyma08g15530.1
>Glyma08g15540.1
>Glyma08g15550.1
>Glyma08g15560.1
>Glyma08g15570.1
>Glyma08g15580.1
>Glyma08g15590.1
>Glyma08g15600.1
>Glyma08g15610.1
>Glyma08g15620.1
>Glyma08g15630.1
>Glyma08g15640.1
>Glyma08g15650.1
>Glyma08g15660.1
>Glyma08g15670.1
>Glyma08g15680.1
>Glyma08g15690.1
>Glyma08g15700.1
>Glyma08g15730.1
>Glyma08g15740.1
>Glyma08g15740.2
>Glyma08g15750.1
>Glyma08g15760.1
>Glyma08g15780.1
>Glyma08g15790.1
>Glyma08g15800.1
>Glyma08g15810.1
>Glyma08g15820.1
>Glyma08g15830.1
>Glyma08g15840.1
>Glyma08g15850.1
>Glyma08g15860.1

>Glyma08g15870.1
>Glyma08g15880.1
>Glyma08g15890.1
>Glyma08g15910.1
>Glyma08g15920.1
>Glyma08g15930.1
>Glyma08g15940.1
>Glyma08g15950.1
>Glyma08g15960.1
>Glyma08g15960.2
>Glyma08g15970.1
>Glyma08g15980.1
>Glyma08g15990.1
>Glyma08g16000.1
>Glyma08g16010.1
>Glyma08g16020.1
>Glyma08g16020.2
>Glyma08g16020.3
>Glyma08g16030.1
>Glyma08g16040.1
>Glyma08g16050.1
>Glyma08g16060.1
>Glyma08g16070.1
>Glyma08g16080.1
>Glyma08g16090.1
>Glyma08g16100.1
>Glyma08g16110.1
>Glyma08g16120.1
>Glyma08g16130.1
>Glyma08g16130.2
>Glyma08g16130.3
>Glyma08g16140.1
>Glyma08g16150.1
>Glyma08g16160.1
>Glyma08g16170.1
>Glyma08g16180.1
>Glyma08g16190.1
>Glyma08g16200.1
>Glyma08g16210.1
>Glyma08g16220.1
>Glyma08g16230.1
>Glyma08g16240.1
>Glyma08g16250.1
>Glyma08g16260.1
>Glyma08g16270.1
>Glyma08g16280.1
>Glyma08g16290.1
>Glyma08g16300.1
>Glyma08g16310.1

>Glyma08g16320.1
>Glyma08g16330.2
>Glyma08g16340.1
>Glyma08g16350.1
>Glyma08g16360.1
>Glyma08g16370.1
>Glyma08g16380.1
>Glyma08g16390.1
>Glyma08g16400.1
>Glyma08g16410.1
>Glyma08g16420.1
>Glyma08g16430.1
>Glyma08g16440.1
>Glyma08g16450.1
>Glyma08g16460.1
>Glyma08g16470.1
>Glyma08g16480.1
>Glyma08g16490.1
>Glyma08g16500.1
>Glyma08g16510.1
>Glyma08g16520.1
>Glyma08g16530.1
>Glyma08g16540.1
>Glyma08g16550.1
>Glyma08g16560.1
>Glyma08g16570.1
>Glyma08g16580.1
>Glyma08g16590.1
>Glyma08g16600.1
>Glyma08g16610.1
>Glyma08g16620.1
>Glyma08g16630.1
>Glyma08g16630.2
>Glyma08g16640.1
>Glyma08g16650.1
>Glyma08g16660.1
>Glyma08g16670.1
>Glyma08g16670.2
>Glyma08g16670.3
>Glyma08g16680.1
>Glyma08g16690.1
>Glyma08g16700.1
>Glyma08g16710.1
>Glyma08g16730.1
>Glyma08g16740.1
>Glyma08g16750.1
>Glyma08g16760.1
>Glyma08g16770.1
>Glyma08g16770.2

FIG. 9 (cont.)

| | |
|---|---|
| >Glyma08g16780.1 | >Glyma08g17200.1 |
| >Glyma08g16790.1 | >Glyma08g17210.1 |
| >Glyma08g16800.1 | >Glyma08g17220.1 |
| >Glyma08g16810.1 | >Glyma08g17230.1 |
| >Glyma08g16820.1 | >Glyma08g17240.1 |
| >Glyma08g16830.1 | >Glyma08g17240.2 |
| >Glyma08g16840.1 | >Glyma08g17250.1 |
| >Glyma08g16850.1 | >Glyma08g17260.1 |
| >Glyma08g16860.1 | >Glyma08g17270.1 |
| >Glyma08g16870.1 | >Glyma08g17280.1 |
| >Glyma08g16870.2 | >Glyma08g17290.1 |
| >Glyma08g16870.3 | >Glyma08g17300.1 |
| >Glyma08g16870.4 | >Glyma08g17310.1 |
| >Glyma08g16880.1 | >Glyma08g17320.1 |
| >Glyma08g16890.1 | >Glyma08g17330.1 |
| >Glyma08g16900.1 | >Glyma08g17340.1 |
| >Glyma08g16900.2 | >Glyma08g17350.1 |
| >Glyma08g16910.1 | >Glyma08g17360.1 |
| >Glyma08g16920.1 | >Glyma08g17370.1 |
| >Glyma08g16930.1 | >Glyma08g17380.1 |
| >Glyma08g16940.1 | >Glyma08g17390.1 |
| >Glyma08g16950.1 | >Glyma08g17400.1 |
| >Glyma08g16960.1 | >Glyma08g17410.1 |
| >Glyma08g16970.1 | >Glyma08g17420.1 |
| >Glyma08g16980.1 | >Glyma08g17450.1 |
| >Glyma08g16990.1 | >Glyma08g17460.1 |
| >Glyma08g17000.1 | >Glyma08g17460.2 |
| >Glyma08g17010.1 | >Glyma08g17460.3 |
| >Glyma08g17010.2 | >Glyma08g17470.1 |
| >Glyma08g17020.1 | >Glyma08g17480.1 |
| >Glyma08g17030.1 | >Glyma08g17490.1 |
| >Glyma08g17040.1 | >Glyma08g17500.1 |
| >Glyma08g17050.1 | >Glyma08g17510.1 |
| >Glyma08g17060.1 | >Glyma08g17520.1 |
| >Glyma08g17070.1 | >Glyma08g17530.1 |
| >Glyma08g17080.1 | >Glyma08g17540.1 |
| >Glyma08g17090.1 | >Glyma08g17550.1 |
| >Glyma08g17100.1 | >Glyma08g17560.1 |
| >Glyma08g17110.1 | >Glyma08g17570.1 |
| >Glyma08g17120.1 | >Glyma08g17580.1 |
| >Glyma08g17120.2 | >Glyma08g17590.1 |
| >Glyma08g17130.1 | >Glyma08g17600.1 |
| >Glyma08g17140.1 | >Glyma08g17610.1 |
| >Glyma08g17160.1 | >Glyma08g17620.1 |
| >Glyma08g17170.1 | >Glyma08g17630.1 |
| >Glyma08g17180.1 | >Glyma08g17640.1 |
| >Glyma08g17180.2 | >Glyma08g17650.1 |
| >Glyma08g17180.3 | >Glyma08g17660.1 |
| >Glyma08g17190.1 | >Glyma08g17670.1 |

FIG. 9 (cont.)

>Glyma18g46750.1
>Glyma18g46760.1
>Glyma18g46780.1
>Glyma18g46790.1
>Glyma18g46800.1
>Glyma18g46810.1
>Glyma18g46820.1
>Glyma18g46830.1
>Glyma18g46840.1
>Glyma18g46850.1
>Glyma18g46860.1
>Glyma18g46870.1
>Glyma18g46880.1
>Glyma18g46890.1
>Glyma18g46900.1
>Glyma18g46910.1
>Glyma18g46920.1
>Glyma18g46930.1
>Glyma18g46940.1
>Glyma18g46950.1
>Glyma18g46960.1
>Glyma18g46970.1
>Glyma18g46980.1
>Glyma18g46990.1
>Glyma18g47000.1
>Glyma18g47010.1
>Glyma18g47020.1
>Glyma18g47030.1
>Glyma18g47040.1
>Glyma18g47050.1
>Glyma18g47060.1
>Glyma18g47070.1
>Glyma18g47080.1
>Glyma18g47090.1
>Glyma18g47100.1
>Glyma18g47110.1
>Glyma18g47120.1
>Glyma18g47130.1
>Glyma18g47140.1
>Glyma18g47150.1
>Glyma18g47160.1
>Glyma18g47170.1
>Glyma18g47180.1
>Glyma18g47190.1
>Glyma18g47200.1
>Glyma18g47210.1
>Glyma18g47220.1
>Glyma18g47230.1
>Glyma18g47240.1

>Glyma18g47250.1
>Glyma18g47260.1
>Glyma18g47270.1
>Glyma18g47280.1
>Glyma18g47290.1
>Glyma18g47300.1
>Glyma18g47310.1
>Glyma18g47320.1
>Glyma18g47330.1
>Glyma18g47340.1
>Glyma18g47350.1
>Glyma18g47360.1
>Glyma18g47370.1
>Glyma18g47380.1
>Glyma18g47390.1
>Glyma18g47400.1
>Glyma18g47410.1
>Glyma18g47420.1
>Glyma18g47430.1
>Glyma18g47440.1
>Glyma18g47450.1
>Glyma18g47460.1
>Glyma18g47470.1
>Glyma18g47480.1
>Glyma18g47490.1
>Glyma18g47500.1
>Glyma18g47500.2
>Glyma18g47510.1
>Glyma18g47520.1
>Glyma18g47530.1
>Glyma18g47540.1
>Glyma18g47550.1
>Glyma18g47560.1
>Glyma18g47570.1
>Glyma18g47580.1
>Glyma18g47590.1
>Glyma18g47600.1
>Glyma18g47610.1
>Glyma18g47620.1
>Glyma18g47630.1
>Glyma18g47640.1
>Glyma18g47650.1
>Glyma18g47660.1
>Glyma18g47670.1
>Glyma18g47690.1
>Glyma18g47700.1
>Glyma18g47710.1
>Glyma18g47720.1
>Glyma18g47730.1

FIG. 10

>Glyma18g47740.1
>Glyma18g47750.1
>Glyma18g47760.1
>Glyma18g47770.1
>Glyma18g47780.1
>Glyma18g47790.1
>Glyma18g47800.1
>Glyma18g47800.2
>Glyma18g47810.1
>Glyma18g47820.1
>Glyma18g47830.1
>Glyma18g47840.1
>Glyma18g47850.1
>Glyma18g47860.1
>Glyma18g47870.1
>Glyma18g47880.1
>Glyma18g47880.2
>Glyma18g47890.1
>Glyma18g47900.1
>Glyma18g47910.1
>Glyma18g47920.1
>Glyma18g47930.1
>Glyma18g47940.1
>Glyma18g47950.1
>Glyma18g47960.1
>Glyma18g47970.1
>Glyma18g47980.1
>Glyma18g47990.1
>Glyma18g48000.1
>Glyma18g48010.1
>Glyma18g48020.1
>Glyma18g48030.1
>Glyma18g48040.1
>Glyma18g48050.1
>Glyma18g48060.1
>Glyma18g48070.1
>Glyma18g48080.1
>Glyma18g48090.1
>Glyma18g48100.1
>Glyma18g48110.1
>Glyma18g48120.1
>Glyma18g48130.1
>Glyma18g48140.1
>Glyma18g48150.1
>Glyma18g48160.1
>Glyma18g48170.1
>Glyma18g48180.1
>Glyma18g48190.1
>Glyma18g48200.1

>Glyma18g48210.1
>Glyma18g48220.1
>Glyma18g48230.1
>Glyma18g48240.1
>Glyma18g48250.1
>Glyma18g48260.1
>Glyma18g48270.1
>Glyma18g48280.1
>Glyma18g48290.1
>Glyma18g48300.1
>Glyma18g48310.1
>Glyma18g48320.1
>Glyma18g48330.1
>Glyma18g48340.1
>Glyma18g48350.1
>Glyma18g48360.1
>Glyma18g48370.1
>Glyma18g48380.1
>Glyma18g48400.1
>Glyma18g48410.1
>Glyma18g48420.1
>Glyma18g48430.1
>Glyma18g48440.1
>Glyma18g48450.1
>Glyma18g48460.1
>Glyma18g48470.1
>Glyma18g48480.1
>Glyma18g48490.1
>Glyma18g48500.1
>Glyma18g48520.1
>Glyma18g48520.2
>Glyma18g48530.1
>Glyma18g48540.1
>Glyma18g48550.1
>Glyma18g48560.1
>Glyma18g48570.1
>Glyma18g48580.1
>Glyma18g48590.1
>Glyma18g48600.1
>Glyma18g48610.1
>Glyma18g48620.1
>Glyma18g48630.1
>Glyma18g48640.1
>Glyma18g48650.1
>Glyma18g48660.1
>Glyma18g48670.1
>Glyma18g48680.1

FIG. 10 (cont.)

>Glyma10g34810.2
>Glyma10g34810.3
>Glyma10g34820.1
>Glyma10g34830.1
>Glyma10g34840.1
>Glyma10g34850.1
>Glyma10g34860.1
>Glyma10g34870.1
>Glyma10g34880.1
>Glyma10g34890.1
>Glyma10g34900.1
>Glyma10g34910.1
>Glyma10g34920.1
>Glyma10g34930.1
>Glyma10g34940.1
>Glyma10g34950.1
>Glyma10g34960.1
>Glyma10g34970.1
>Glyma10g34980.1
>Glyma10g34990.1
>Glyma10g35000.1
>Glyma10g35010.1
>Glyma10g35010.2
>Glyma10g35020.1
>Glyma10g35030.1
>Glyma10g35030.2
>Glyma10g35040.1
>Glyma10g35040.2
>Glyma10g35050.1
>Glyma10g35060.1
>Glyma10g35070.1
>Glyma10g35080.1
>Glyma10g35090.1
>Glyma10g35090.2
>Glyma10g35100.1
>Glyma10g35110.1
>Glyma10g35120.1
>Glyma10g35130.1
>Glyma10g35130.2
>Glyma10g35130.3
>Glyma10g35140.1
>Glyma10g35160.1
>Glyma10g35160.2
>Glyma10g35160.3
>Glyma10g35160.4
>Glyma10g35160.5
>Glyma10g35160.6
>Glyma10g35170.1
>Glyma10g35180.1
>Glyma10g35180.2

>Glyma10g35190.1
>Glyma10g35190.2
>Glyma10g35210.1
>Glyma10g35210.2
>Glyma10g35220.1
>Glyma10g35230.1
>Glyma10g35230.2
>Glyma10g35230.3
>Glyma10g35240.1
>Glyma10g35250.1
>Glyma10g35260.1
>Glyma10g35270.1
>Glyma10g35270.2
>Glyma10g35280.1
>Glyma10g35280.2
>Glyma10g35290.1
>Glyma10g35300.1
>Glyma10g35300.2
>Glyma10g35300.3
>Glyma10g35310.1
>Glyma10g35310.2
>Glyma10g35320.1
>Glyma10g35320.2
>Glyma10g35330.1
>Glyma10g35340.1
>Glyma10g35350.1
>Glyma10g35360.1
>Glyma10g35370.1
>Glyma10g35380.1
>Glyma10g35390.1
>Glyma10g35400.1
>Glyma10g35410.1
>Glyma10g35430.1
>Glyma10g35440.1
>Glyma10g35450.1
>Glyma10g35450.2
>Glyma10g35460.1
>Glyma10g35470.1
>Glyma10g35480.1
>Glyma10g35490.1
>Glyma10g35490.2
>Glyma10g35500.1
>Glyma10g35510.1
>Glyma10g35520.1
>Glyma10g35520.2
>Glyma10g35530.1
>Glyma10g35540.1
>Glyma10g35550.1
>Glyma10g35560.1
>Glyma10g35560.2

FIG. 11

>Glyma10g35570.1
>Glyma10g35580.1
>Glyma10g35590.1
>Glyma10g35600.1
>Glyma10g35610.1
>Glyma10g35620.1
>Glyma10g35630.1
>Glyma10g35640.1
>Glyma10g35650.1
>Glyma10g35660.1
>Glyma10g35660.2
>Glyma10g35670.1
>Glyma10g35680.1
>Glyma10g35680.2
>Glyma10g35680.3
>Glyma10g35680.4
>Glyma10g35690.1
>Glyma10g35690.2
>Glyma10g35690.3
>Glyma10g35700.1
>Glyma10g35710.1
>Glyma10g35720.1
>Glyma10g35730.1
>Glyma10g35740.1
>Glyma10g35740.2
>Glyma10g35740.3
>Glyma10g35740.4
>Glyma10g35740.5
>Glyma10g35750.1
>Glyma10g35760.1
>Glyma10g35770.1
>Glyma10g35800.1
>Glyma10g35810.1
>Glyma10g35810.2
>Glyma10g35820.1
>Glyma10g35820.2
>Glyma10g35830.1
>Glyma10g35830.2
>Glyma10g35830.3
>Glyma10g35830.4
>Glyma10g35830.5
>Glyma10g35840.1
>Glyma10g35850.1
>Glyma10g35860.1
>Glyma10g35870.1
>Glyma10g35870.2
>Glyma10g35880.1
>Glyma10g35890.1
>Glyma10g35890.2
>Glyma10g35900.1
>Glyma10g35900.2
>Glyma10g35900.3
>Glyma10g35910.1
>Glyma10g35920.1
>Glyma10g35930.1
>Glyma10g35930.2
>Glyma10g35940.1
>Glyma10g35950.1
>Glyma10g35950.2
>Glyma10g35950.3
>Glyma10g35950.4
>Glyma10g35960.1
>Glyma10g35960.2
>Glyma10g35970.1
>Glyma10g35980.1
>Glyma10g35990.1
>Glyma10g36000.1
>Glyma10g36010.1
>Glyma10g36020.1
>Glyma10g36030.1
>Glyma10g36040.1
>Glyma10g36040.2
>Glyma10g36050.1
>Glyma10g36060.1
>Glyma10g36070.1
>Glyma10g36080.1
>Glyma10g36090.1
>Glyma10g36100.1
>Glyma10g36100.2
>Glyma10g36110.1
>Glyma10g36120.1
>Glyma10g36130.1
>Glyma10g36140.1
>Glyma10g36150.1
>Glyma10g36160.1
>Glyma10g36170.1
>Glyma10g36180.1
>Glyma10g36190.1
>Glyma10g36200.1
>Glyma10g36210.1
>Glyma10g36220.1
>Glyma10g36230.1
>Glyma10g36240.1
>Glyma10g36250.1
>Glyma10g36260.1
>Glyma10g36270.1
>Glyma10g36280.1
>Glyma10g36290.1
>Glyma10g36290.2
>Glyma10g36290.3

FIG. 11 (cont.)

>Glyma10g36300.1
>Glyma10g36310.1
>Glyma10g36320.1
>Glyma10g36330.1
>Glyma10g36340.1
>Glyma10g36350.1
>Glyma10g36360.1
>Glyma10g36370.1
>Glyma10g36380.1
>Glyma10g36390.1
>Glyma10g36400.1
>Glyma10g36410.1
>Glyma10g36420.1
>Glyma10g36420.2
>Glyma10g36430.1
>Glyma10g36440.1
>Glyma10g36450.1
>Glyma10g36460.1
>Glyma10g36470.1
>Glyma10g36480.1
>Glyma10g36490.1
>Glyma10g36490.2
>Glyma10g36500.1
>Glyma10g36500.2
>Glyma10g36510.1
>Glyma10g36520.1
>Glyma10g36530.1
>Glyma10g36540.1
>Glyma10g36550.1
>Glyma10g36560.1
>Glyma10g36570.1
>Glyma10g36580.1
>Glyma10g36580.2
>Glyma10g36580.3
>Glyma10g36590.1
>Glyma10g36600.1
>Glyma10g36600.2
>Glyma10g36610.1
>Glyma10g36610.2
>Glyma10g36610.3
>Glyma10g36620.1
>Glyma10g36630.1
>Glyma10g36640.1
>Glyma10g36650.1
>Glyma10g36670.1
>Glyma10g36680.1
>Glyma10g36690.1
>Glyma10g36700.1
>Glyma10g36710.1
>Glyma10g36720.1

>Glyma10g36730.1
>Glyma10g36740.1
>Glyma10g36750.1
>Glyma10g36760.1
>Glyma10g36770.1
>Glyma10g36780.1
>Glyma10g36790.1
>Glyma10g36800.1
>Glyma10g36810.1
>Glyma10g36820.1
>Glyma10g36830.1
>Glyma10g36840.1
>Glyma10g36850.1
>Glyma10g36860.1
>Glyma10g36870.1
>Glyma10g36880.1
>Glyma10g36880.2
>Glyma10g36880.3
>Glyma10g36890.1
>Glyma10g36900.1
>Glyma10g36910.1
>Glyma10g36920.1
>Glyma10g36930.1
>Glyma10g36940.1
>Glyma10g36940.2
>Glyma10g36950.1
>Glyma10g36960.1
>Glyma10g36970.1
>Glyma10g36980.1
>Glyma10g36990.1
>Glyma10g36990.2
>Glyma10g37000.1
>Glyma10g37010.1
>Glyma10g37020.1
>Glyma10g37030.1
>Glyma10g37040.1
>Glyma10g37050.1
>Glyma10g37060.1
>Glyma10g37070.1
>Glyma10g37070.2
>Glyma10g37080.1
>Glyma10g37090.1
>Glyma10g37090.2
>Glyma10g37100.1
>Glyma10g37100.2
>Glyma10g37110.1
>Glyma10g37120.1
>Glyma10g37130.1
>Glyma10g37140.1
>Glyma10g37140.2

FIG. 11 (cont.)

>Glyma10g37150.1
>Glyma10g37160.1
>Glyma10g37180.1
>Glyma10g37190.1
>Glyma10g37200.1
>Glyma10g37210.1
>Glyma10g37220.1
>Glyma10g37230.1
>Glyma10g37240.1
>Glyma10g37250.1
>Glyma10g37260.1
>Glyma10g37270.1
>Glyma10g37280.1
>Glyma10g37290.1
>Glyma10g37300.1
>Glyma10g37310.1
>Glyma10g37320.1
>Glyma10g37330.1
>Glyma10g37340.1
>Glyma10g37350.1
>Glyma10g37360.1
>Glyma10g37370.1
>Glyma10g37380.1
>Glyma10g37390.1
>Glyma10g37400.1
>Glyma10g37410.1
>Glyma10g37420.1
>Glyma10g37430.1
>Glyma10g37440.1
>Glyma10g37450.1
>Glyma10g37460.1
>Glyma10g37470.1
>Glyma10g37480.1
>Glyma10g37490.1
>Glyma10g37500.1
>Glyma10g37510.1

FIG. 11 (cont.)

QTL 1 Sat_210 Gm18:1621167..1621420 (SEQ ID No. 1)
QTL 1 Satt610 Gm18:2664941..2665159 (SEQ ID No. 2)
QTL 2 Sat_212 Gm08:9166013..9166312 (SEQ ID No. 3)
QTL 2 AW132402 Gm08:11868922..11869071 (SEQ ID No. 4)
QTL 3 Satt665 Gm11:36229108..36229369 (SEQ ID No. 5)
QTL 3 Satt484 Gm11:38707994..38708296 (SEQ ID No. 6)
QTL 4 GMGLPSI2 Gm20:41872927..41873044 (SEQ ID No. 7)
QTL 4 Sct_189 Gm20:45550533..45550697 (SEQ ID No. 8)
QTL 5 Sct_187 Gm18:60463046..60463189 (SEQ ID No. 9)
QTL 5 Sat_372 Gm18:61095349..61095649 (SEQ ID No. 10)
QTL 6 Satt294 Gm04:40154806..40155092 (SEQ ID No. 11)
QTL 6 Sat_207 Gm04:42773904..42774138 (SEQ ID No. 12)
QTL 7 Satt565 Gm04:511086..511274 (SEQ ID No. 13)
QTL 7 Satt194 Gm04:2402304,2402538 (SEQ ID No. 14)
QTL 8 Satt163 Gm18:998312..998557 (SEQ ID No. 15)
QTL 8 Satt217 Gm18:4692233..4692481 (SEQ ID No. 16)
QTL 9 Sat_406 Gm08:3987571..3987785 (SEQ ID No. 17)
QTL 9 Satt341 Gm08:13199923..13200142 (SEQ ID No. 18)
QTL 10 Satt612 Gm18:56453661..56453904 (SEQ ID No. 19)
QTL 10 Satt472 Gm18:58136158..58136436 (SEQ ID No. 20)
QTL 11 Satt592 Gm10:42983781..42984021 (SEQ ID No. 21)
QTL 11 Sat_038 Gm10:45480355..45480599 (SEQ ID No. 22)

FIG. 12

QUANTITATIVE TRAIT LOCI ASSOCIATED WITH SOYBEAN CYST NEMATODE RESISTANCE AND METHODS OF THEIR USE

RELATED APPLICATIONS

This application claims priority of U.S. Provisional Application No. 61/278,233 filed on Oct. 2, 2009, the contents of which are hereby incorporated into this application by reference.

GOVERNMENT INTERESTS

This invention was made with government support under grant number 2006-34113-17139 by USDA/CSREES. The government has certain rights in the invention

SEQUENCE LISTING

This application is accompanied by a sequence listing both on paper and in a computer readable form that accurately reproduces the sequences described herein.

BACKGROUND

1. Field of the Invention

The present disclosure relates to identification of quantitative trait loci (QTLs) and gene(s) that confer upon a soybean plant resistance to soybean cyst nematode (SCN) and methods to use these loci and genes to obtain soybean strains that are resistant to SCN.

2. Description of the Related Art

Soybean cyst nematode (SCN), *Heterodera glycines*, is one of the most destructive pests of soybean in the United States and worldwide. Although nematocides may be used to reduce the population of nematodes, the use of nematocides is neither economical nor environmentally friendly. Host plant resistance is an effective approach to control this pest; however, continuously growing the same resistant cultivar(s) may result in SCN population shifts and loss of SCN resistant phenotype.

Since the discovery of SCN in the United States in the 1970s, extensive efforts have been made to identify new SCN resistance sources by screening *Glycine max* plant introductions (PIs) of the USDA soybean germplasm collection (Anand et al. 1988; Arelli et al. 2000; Arelli et al. 1997; Young 1995). Chen et al. (2006) used bioassay to characterize over 120 SCN resistance soybean accessions with SCN races 3, –5, and –14 and reported many PIs including PI 437654, PI 438489B, PI 90763, PI 89772, PI 404198A, and PI 567516C with high resistance levels to multi-races.

Although several SCN resistance quantitative trait loci (QTLs) have been discovered in PI 437654 (Concibido et al., 2004, U.S. Pat. No. 6,096,944 issued to Vierling et al. and U.S. Pat. No. 6,538,175 issued to Webb), many SCN resistance QTLs remain to be identified. More SCN sources of resistance have been evaluated extensively to identify novel QTLs and epistatic effects between QTLs (Wu et al 2009). Among soybean PIs evaluated for SCN resistance, PI 437654, PI 467312, PI 438489B, and PI 567516C have been reported to be highly resistant to multi-races (also known as HG types) of SCN. In addition, PI 567516C is also resistant to a synthetic nematode population LY1 and genetically unique from most other SCN resistant sources, including Peking and PI 88788 that are widely used in current SCN resistant varieties.

SUMMARY

The instrumentalities described herein overcome the problems outlined above and advance the art by providing novel quantitative trait loci (QTLs) which may contain SCN resistance genes. Markers associated with these QTLs may also be used to obtain new soybean strains that are SCN resistant using molecular breeding or transgenic approaches.

More particularly, the disclosure relates to the identification of quantitative trait loci (QTLs) responsible for resistance to multi-SCN races in four soybean plant introductions, PI 437654, PI 467312, PI 438489B, and PI 567516C. These QTLs are mapped to genomic regions on Chrs. 4, 8, 10, 11, 18, and 20 (Table 1). Among the QTLs listed in Table 1, SCN QTLs 4, 5, 6, 7, 10, and 11 have not been previously reported in cultivated soybeans, *Glycine max*. Genomic loci that are proximate to or overlap with SCN QTLs 1-3, 8-9 have been reported in other soybean PIs but not in the PIs used in the present disclosure.

TABLE 1

QTLs underlying SCN resistance identified in new resistant soybean PIs and mapped on different soybean chromosomes (LGs).

| | QTLs | | | | | | |
|---|---|---|---|---|---|---|---|
| Source | 18 (G, rhg1) | 8 (A2, Rhg4) | 11 (B1) | 20 (I) | 18 (G, 2$^{nd}$ locus) | 10 (O) | 4 (C1) |
| PI 437654 | Sat_210-Satt610 (1621167-2665159bp) 134 genes (SCN QTL1) | Sat_212-AW132402 (9166013-11869071bp) 460 genes (SCN QTL2) | Satt665-Satt484 (36229108-38708296bp) 378 genes (SCN QTL3) | GMGLPSI2-Sct_189 (41872927-45550697bp) 505 genes (SCN QTL4) | | | |
| PI 467312 | Sat_210-Satt610 (1621167-2665159bp) 134 genes (SCN QTL1) | | | | Sct_187-Sat_372 (60463046-61095649bp) 93 genes (SCN QTL5) | | |

TABLE 1-continued

QTLs underlying SCN resistance identified in new resistant soybean PIs and mapped on different soybean chromosomes (LGs).

| | QTLs | | | | | | |
|---|---|---|---|---|---|---|---|
| Source | 18 (G, rhg1) | 8 (A2, Rhg4) | 11 (B1) | 20 (I) | 18 (G, $2^{nd}$ locus) | 10 (O) | 4 (C1) |
| PI 438489B | Satt163-Satt217 (998312-4692481bp) 457 genes (SCN QTL8) | Sat 406-Satt341 (3987571-13200142bp) 1421 genes (SCN QTL9) | | | | | Satt565-Satt194 (511086-2402538bp) 295 genes (SCN QTL7) Satt294-Sat__207 (40154806-42774138bp) 207 genes (SCN QTL6) |
| PI 567516C | | | | Satt612-Satt472 (56453661-58136436bp) 194 genes (SCN QTL10) | | Satt592-Sat__038 (42983781-45480599bp) 336 genes (SCN QTL11) | |

In addition, the disclosure provides candidate genes underlying these QTL regions defined by markers flanking the QTLs. Some of these genes may be introduced by marker-assisted selection (MAS) from a resistant plant using gene identification, marker development, transformation, and molecular breeding methods. Preferably, the resistant plant comprises a homozygous genomic fragment of the resistant PI lines. Examples of such resistant PI lines include but are not limited to, PI 437654, PI 467312, PI 438489B, and PI 567516C. The markers may also be utilized for introgressing SCN resistance into non-resistant soybean germplasm.

It is disclosed herein genomic regions (i.e., QTLs) responsible for resistance to multi-SCN races (HG types) in four soybean plant introductions, PI 437654, PI 467312, PI 438489B, and PI 567516C. These QTLs were mapped in genomic regions on chromosomes 4, 8, 10, 11, 18, and 20, respectively. Some of these QTLs have been previously reported, while some have not been reported in other SCN-resistant sources of cultivated soybeans, G. max. In addition, markers developed from these regions may facilitate the development of near-isogenic lines (NILs) using the marker-assisted backcrossing (MAB) approach leading to fine-mapping.

Candidate genes underlying these QTL regions may be cloned by utilizing comprehensive approaches that combine genomics, proteomics and metabolic tools. In one embodiment, these genes, either alone or in combination, may be introduced into a host soybean plant known to be susceptible to SCN. The genes may be placed in a construct and introduced into the host soybean plant by transformation. Transformation may be performed as a number of known soybean transformation methods. In another embodiment, the identity of the gene(s) that may be responsible for nematode resistance may be obtained by a series of deletion experiments wherein a portion of a QTL is removed and tested to determine if the truncated QTL fragments still confer upon nematode resistance to a soybean strain that is otherwise susceptible to nematode infection.

In another embodiment, the present disclosure provides a method of introgressing SCN resistance into non-resistant soybean germplasm. Loci associated with SCN resistance in soybean lines known to be resistant to SCN are used in marker-assisted selection (MAS) during introgession of SCN resistance into elite soybean germplasm. Examples of soybean lines known to be resistant to one or more races of SCN include PI 437654, Peking, PI 90763, PI 467312, PI 438489B, and PI 567516C. The method of the present invention can be used to breed soybeans resistant to all SCN races. The SCN races of particular commercial importance are races 1, 2, 3, 5, 6, 9, and 14.

The present disclosure also provides a number of markers associated with the QTLs which may be useful for plant breeding. It is disclosed here a method for generating a soybean plant by performing a step (a) of determining the presence or absence of a marker gene or a fragment thereof. In one aspect, the marker gene may be one or more of the polynucleotide molecules of SEQ ID Nos. 1-22. Step (a) may be performed using DNA hybridization or PCR. In another aspect, the method may further include a step (b) of introgressing the trait of SCN resistance into an SCN sensitive soybean germplasm, with the step (b) preceding step (a). In yet another aspect, the nucleic acid markers as disclosed herein may be used in soybean lines known to be resistant to one or more SCN races or in lines whose susceptibility to SCN is unknown. For example, the markers may be used in genetic mapping of soybean lines to be used in and/or which have been developed in a breeding program, allowing for marker-assisted selection during introgression of SCN resistance into elite germplasm.

It is also disclosed a number of recombinant inbred lines (RILs) that are resistant to single or multi-race of SCN. These RILs are genetically homozygous lines and are listed in Table 2.

BRIEF DESCRIPTION OF THE DRAWINGS

FIG. 1 lists the genes (SEQ ID Nos. 23-156) identified within SCN QTL1.

FIG. 2 lists the genes (SEQ ID Nos. 157-616) identified within SCN QTL2.

FIG. 3 lists the genes (SEQ ID Nos. 617-994) identified within SCN QTL3.

FIG. 4 lists the genes (SEQ ID Nos. 995-1499) identified within SCN QTL4.

FIG. 5 lists the genes (SEQ ID Nos. 1500-1592) identified within SCN QTL5.

FIG. 6 lists the genes (SEQ ID Nos. 1593-1799) identified within SCN QTL6.

FIG. 7 lists the genes (SEQ ID Nos. 1800-2094) identified within SCN QTL7.

FIG. 8 lists the genes (SEQ ID Nos. 2095-2551) identified within SCN QTL8.

FIG. 9 lists the genes (SEQ ID Nos. 2552-3972) identified within SCN QTL9.

FIG. 10 lists the genes (SEQ ID Nos. 3973-4166) identified within SCN QTL10.

FIG. 11 lists the genes (SEQ ID Nos. 4167-4502) identified within SCN QTL11.

FIG. 12 shows the 22 flanking markers (SEQ ID Nos. 1-22) found to be associated with the 11 QTLs: QTL1-11 as listed in Table 1.

DETAILED DESCRIPTION

Previous studies have suggested that multiple genes with quantitative inheritance patterns may be responsible for soybean resistance to SCN and that different soybean germplasm may contain different SCN resistant genes (Anand and 1Rao Arelli 1989; Guo et al. 2005; Guo et al. 2006b; Mansur et al. 1993; Yue et al. 2001a). This disclosure provides novel QTLs that are associated with SCN resistance in various plant introductions (PIs). SCN resistance genes underlying these QTL regions discovered from these soybean plants may be introduced into other soybean varieties or germplasm using transgenic approaches or by marker-assisted selection (MAS) with genetic markers.

It is to be understood that the materials and methods in this disclosure are taught by way of example, and not by limitation. The disclosed instrumentalities may be broader than the particular methods and materials described herein, which may vary within the skill of the art. It is also to be understood that the terminology used herein is for the purpose of describing particular embodiments only, and is not intended to be limiting. Further, unless defined otherwise, all technical and scientific terms used herein have the same meaning as commonly understood by one of ordinary skill in the related art. The following terminology and grammatical variants are used in accordance with the definitions set out below.

Among several PIs with multi-race resistance, PI 567516C, originating from China (http://www.ars-grin.gov/) has been reported to be resistant to SCN races 1, 2, 3 (Arelli et al. 1997; Xie et al. 1998). PI 567516C is also genetically unique from most other SCN resistant sources, such as Peking and PI 88788 (Chen et al. 2006). In addition, PI 567516C is the only PI identified to be resistant to SCN race LY1 (Young 1998, Arelli and Young 2005, Arelli et al. 2009). Although several SCN resistant PIs have been utilized for the genetic characterization of QTLs associated with SCN resistance, limited information has been gained on quantitative resistance of PI 437654, PI 467312, PI 438489B, and PI 567516C, exotic soybean accessions with broad-based resistance to multiple SCN races.

In this disclosure, different genetic populations are developed by crossing four SCN resistant PIs, namely, PI 437654, PI 467312, PI 438489B, and PI 567516C, with susceptible cultivars, such as Essex, Hutcheson, and Magellan. F2 lines and recombinant inbred lines (RILs) from each of these genetic populations were phenotyped and molecularly genotyped. Genetic linkage analysis and QTL analysis have mapped 12 QTL regions to Chromosomes 4, 8, 10, 11, 18, and 20 (Table 1). Some of these 12 QTLs are unique and have not been reported from other SCN-resistance sources.

More specifically, to identify QTL/gene(s) underlying SCN resistance in these PIs, F2:3 progenies and F6/F7 recombinant inbred lines (RILs) derived from the crosses of Essex×PI 437654, Hutcheson×PI 467312, Magellan×PI 438489B, and Magellan×PI 567516C have been developed using the single seed descent (SSD) method, respectively. These RILs were molecularly genotyped with the simple single repeat (SSR) markers and bio-assayed in greenhouse to identify and map quantitative trait loci (QTL) associated with resistance to different races of soybean cyst nematode (SCN). Greenhouse bioassays may be used to characterize the phenotypes of these mapping populations for six SCN races (PA1, −2, −3, −5, −14, and LY1). Based upon the genetic marker profiling and female index (FI) of equal or less than 10%, several RILs in each cross (listed in Table 2) have been shown to be highly resistant to single or multi-race of SCN. The lines from each cross are from the same generation. Based on a 1-100% scale, a FI of ≤10% is used as a threshold value to select a RIL resistant to either single or multi race of SCN. These SCN resistant inbred lines (germplasm) can be employed for the development of new soybean variety using the marker-assisted breeding (MAB) or conventional breeding methods.

Simple sequence repeats (SSR) and single nucleotide polymorphism (SNP) markers may be used for genotyping these genetic populations. Following genetic linkage analysis using the JoinMap 3.0 program, permutation tests and composite interval mapping (CIM) were performed to identify and map QTL using the MapQTL 5.0 or QTLNetwork 2.0 programs. Performing primary QTL mapping using 250-300 progenies, 12 putative QTL regions on Chromosomes 4, 8, 10, 11, 18, and 20 (corresponding to LGs C1, A2, O, B1, G, and I, respectively) have been detected and mapped. The identity of these QTL has been confirmed by analyzing the F6 or F7 RIL mapping populations and comparing to the sequence information of soybean physical and genetic maps (http://soybase.org/gbrowse).

TABLE 2

Recombinant inbred lines (RILs) with high levels of resistance (FI < 10%) to either single or multi-races of soybean cyst nematode (SCN).

| No | Essex × PI 437654 | | Hutcheson × PI 467312 | | Magellan × PI 437489B | | Magellan × PI 567516C | |
|---|---|---|---|---|---|---|---|---|
| | RIL | Race | RIL | Race | RIL | Race | RIL | Race |
| 1 | EP011 | 1, 2, 3, 14 | 195-007 | 5 | MPB0002 | 5 | MPC0102 | 5 |
| 2 | EP013 | 1, 3 | 195-023 | 3 | MPB0011 | 3, 5 | MPC0136 | 3 |
| 3 | EP015 | 1, 3, 5 | 195-033 | 14 | MPB0461 | 3, 5 | MPC0143 | 2, 5 |

TABLE 2-continued

Recombinant inbred lines (RILs) with high levels of resistance (FI < 10%) to either single or multi-races of soybean cyst nematode (SCN).

| No | Essex × PI 437654 RIL | Race | Hutcheson × PI 467312 RIL | Race | Magellan × PI 437489B RIL | Race | Magellan × PI 567516C RIL | Race |
|---|---|---|---|---|---|---|---|---|
| 4 | EP034 | 2, 3, 5, 14 | 195-037 | 14 | MPB0502 | 3, 5 | MPC0341 | 5 |
| 5 | EP038 | 1, 3 | 195-040 | 14 | MPB0530 | 3, 5 | MPC0373 | LY1 |
| 6 | EP044 | 2, 3, 5 | 195-046 | 14 | MPB0580 | 2 | MPC0422 | 5 |
| 7 | EP049 | 1, 3 | 195-048 | 14 | MPB0663 | 3, 5 | MPC0460 | 5 |
| 8 | EP056 | 1, 3, 5 | 195-052 | 3 | MPB0731 | 1, 5 | MPC0626 | LY1 |
| 9 | EP102 | 1, 2, 3, 5 | 195-060 | 3 | MPB0787 | 2 | MPC0671 | 3 |
| 10 | EP110 | 2, 3 | 195-066 | 3, 14 | MPB0809 | 1, 5 | MPC0711 | 5 |
| 11 | EP117 | 2, 3, 5 | 195-074 | 14 | MPB0816 | 1, 3, 5 | MPC0724 | LY1 |
| 12 | EP139 | 1, 2, 3, 5 | 195-078 | 3 | MPB0819 | 3, 5 | MPC0777 | LY1 |
| 13 | EP155 | 1, 2, 3, 5 | 195-088 | 5 | MPB0855 | 3, 5 | MPC0824 | 5 |
| 14 | EP158 | 1, 3, 5 | 195-094 | 3 | MPB0920 | 3, 5 | MPC0840 | 5 |
| 15 | EP163 | 2, 3, 5, 14 | 195-106 | 5 | MPB0923 | 14 | MPC0960 | 5, LY1 |
| 16 | EP167 | 1, 3, 5 | 195-121 | 3 | MPB0931 | 14 | MPC1004 | 5 |
| 17 | EP194 | 1, 3 | 195-123 | 14 | MPB0990 | 3, 5 | MPC1017 | 5 |
| 18 | EP213 | 1, 3 | 195-150 | 3 | MPB1030 | 1, 3, 5 | MPC1046 | LY1 |
| 19 | EP219 | 1, 3, 5 | 195-155 | 5 | MPB1059 | 5 | MPC1259 | LY1 |
| 20 | EP220 | 2, 3, 5, 14 | 195-162 | 3, 5 | MPB1061 | 1, 3, 5 | MPC1270 | 5 |
| 21 |  |  | 195-168 | 14 | MPB1091 | 5, 14 | MPC1680 | 3 |
| 22 |  |  | 195-194 | 14 | MPB1117 | 3, 5 | MPC1785 | 5 |
| 23 |  |  | 195-198 | 14 | MPB1136 | 3, 5 | MPC1854 | 1, 5 |
| 24 |  |  | 195-200 | 14 | MPB1188 | 3, 5 | MPC1959 | 5 |
| 25 |  |  | 195-207 | 14 | MPB1219 | 1, 3, 5 | MPC2059 | LY1 |
| 26 |  |  | 195-210 | 3, 5 | MPB1288 | 3, 5 | MPC2090 | 5 |
| 27 |  |  | 195-220 | 14 | MPB1376 | 3, 5 |  |  |
| 28 |  |  | 195-223 | 3 | MPB1382 | 5 |  |  |
| 29 |  |  | 195-239 | 14 | MPB1500 | 1, 3, 5 |  |  |
| 30 |  |  |  |  | MPB1532 | 3, 5 |  |  |
| 31 |  |  |  |  | MPB1547 | 2 |  |  |
| 32 |  |  |  |  | MPB1561 | 3, 5 |  |  |
| 33 |  |  |  |  | MPB1594 | 3, 5 |  |  |
| 34 |  |  |  |  | MPB1652 | 5 |  |  |
| 35 |  |  |  |  | MPB1660 | 5 |  |  |

The present disclosure also provides a marker selection method that may prove useful in a soybean breeding program. This marker selection method allows the use of markers-associated selection for one or more loci at any stage of population development in a two-parent population, multiple parent population, or a backcross population. Such populations are described in Fehr, W. R. 1987, Breeding Methods for Cultivar Development, in J. R. Wilcox (ed.) Soybeans: Improvement, Production, and Uses, 2d Ed., the disclosures of which are hereby incorporated herein by reference.

In one aspect, the marker-assisted selection may be performed by in a step-wise fashion whereby different SCN resistance loci are selected in more than one generation. Alternatively, the marker-assisted selection may be performed in a simultaneous fashion whereby one or more loci are selected in the same generation. Marker-assisted selection for SCN resistance may be done before, in conjunction with, or after biological testings, assays and selection for other traits such as seed yield, seed composition, among others.

The DNA from target populations may be obtained from any plant organs, and each DNA sample may represent the genotype of single or multiple plant individuals (including seed).

The present disclosure provides a system and a method for expressing a protein that may enhance a host's capability to resist SCN infection. Although soybean plants are the most preferred host for purpose of this disclosure, the genetic constructs described herein may be introduced into other eukaryotic organisms, if the traits conferred upon these organisms by the constructs are desirable.

The term "transgenic plant" refers to a host plant into which a gene construct has been introduced. A gene construct, also referred to as a construct, an expression construct, or a DNA construct, generally contains as its components at least a coding sequence and a regulatory sequence. A gene construct typically contains at least on component that is foreign to the host plant. For purpose of this disclosure, all components of a gene construct may be from the host plant, but these components are not arranged in the host in the same manner as they are in the gene construct. A regulatory sequence is a non-coding sequence that typically contribute to the regulation of gene expression, at the transcription or translation levels. It is to be understood that certain segments in the coding sequence may be translated but may be later removed from the functional protein. An example of these segments is the so-called signal peptide, which may facilitate the maturation or localization of the translated protein, but is typically removed once the protein reaches its destination. Examples of a regulatory sequence include but are not limited to a promoter, an enhancer, and certain post-transcriptional regulatory elements.

After its introduction into a host plant, a gene construct may exist separately from the host chromosomes. Preferably, the entire gene construct, or at least part of it, is integrated onto a host chromosome. The integration may be mediated by a recombination event, which may be homologous, or non-homologous recombination. The term "express" or "expression" refers to production of RNAs using DNAs as template through transcription or translation of proteins from RNAs or the combination of both transcription and translation. The term "chromosome(s)" may be referred to as "chrs" or "chr."

A "host cell," as used herein, refers to a prokaryotic or eukaryotic cell that contains heterologous DNA which has been introduced into the cell by any means, e.g., electroporation, calcium phosphate precipitation, microinjection, transformation, viral infection, and/or the like. A "host plant" is a plant into which a transgene is to be introduced. A "parental plant" is the original plant into which genetic changes are to be introduced in order to create a genetically altered plant.

A "vector" is a composition for facilitating introduction, replication and/or expression of a selected nucleic acid in a cell. Vectors include, for example, plasmids, cosmids, viruses, yeast artificial chromosomes (YACs), etc. A "vector nucleic acid" is a nucleic acid vector into which heterologous nucleic acid is optionally inserted and which can then be introduced into an appropriate host cell. Vectors preferably have one or more origins of replication, and one or more sites into which the recombinant DNA can be inserted. Vectors often have convenient markers by which cells with vectors can be selected from those without. By way of example, a vector may encode a drug resistance gene to facilitate selection of cells that are transformed with the vector. Common vectors include plasmids, phages and other viruses, and "artificial chromosomes." "Expression vectors" are vectors that comprise elements that provide for or facilitate transcription of nucleic acids which are cloned into the vectors. Such elements may include, for example, promoters and/or enhancers operably coupled to a nucleic acid of interest.

"Plasmids" generally are designated herein by a lower case "p" preceded and/or followed by capital letters and/or numbers, in accordance with standard nomenclatures that are familiar to those of skill in the art. Starting plasmids disclosed herein are either commercially available, publicly available on an unrestricted basis, or can be constructed from available plasmids by routine application of well known, published procedures. Many plasmids and other cloning and expression vectors are well known and readily available to those of skill in the art. Moreover, those of skill readily may construct any number of other plasmids suitable for use as described below. The properties, construction and use of such plasmids, as well as other vectors, is readily apparent to those of ordinary skill upon reading the present disclosure.

When a molecule is identified in or can be isolated from an organism, it can be said that such a molecule is derived from said organism. When two organisms have significant difference in the genetic materials in their respective genomes, these two organisms can be said to be genetically different. For purpose of this disclosure, the term "plant" means a whole plant, a seed, or any organ or tissue of a plant that may potentially develop into a whole plant.

The term "isolated" means that the material is removed from its original environment, such as the native or natural environment if the material is naturally occurring. For example, a naturally-occurring nucleic acid, polypeptide, or cell present in a living animal is not isolated, but the same polynucleotide, polypeptide, or cell separated from some or all of the coexisting materials in the natural system, is isolated, even if subsequently reintroduced into the natural system. Such nucleic acids can be part of a vector and/or such nucleic acids or polypeptides could be part of a composition, and still be isolated in that such vector or composition is not part of its natural environment.

A "recombinant nucleic acid" is one that is made by recombining nucleic acids, e.g., during cloning, DNA evolution or other procedures. A "recombinant polypeptide" is a polypeptide which is produced by expression of a recombinant nucleic acid. An "amino acid sequence" is a polymer of amino acid residues (a protein, polypeptide, etc.) or a character string representing an amino acid polymer, depending on context. Either the given nucleic acid or the complementary nucleic acid can be determined from any specified polynucleotide sequence.

The terms "nucleic acid," or "polynucleotide" refer to a deoxyribonucleotide, in the case of DNA, or ribonucleotide in the case of RNA polymer in either single- or double-stranded form, and unless otherwise specified, encompasses known analogues of natural nucleotides that can be incorporated into nucleic acids in a manner similar to naturally occurring nucleotides. A "polynucleotide sequence" is a nucleic acid which is a polymer of nucleotides (A,C,T,U,G, etc. or naturally occurring or artificial nucleotide analogues) or a character string representing a nucleic acid, depending on context. Either the given nucleic acid or the complementary nucleic acid can be determined from any specified polynucleotide sequence.

A "subsequence" or "fragment" is any portion of an entire sequence of a DNA, RNA or polypeptide molecule, up to and including the complete sequence. Typically a subsequence or fragment comprises less than the full-length sequence, and is sometimes referred to as the "truncated version."

Nucleic acids and/or nucleic acid sequences are "homologous" when they are derived, naturally or artificially, from a common ancestral nucleic acid or nucleic acid sequence. Proteins and/or protein sequences are homologous when their encoding DNAs are derived, naturally or artificially, from a common ancestral nucleic acid or nucleic acid sequence. Similarly, nucleic acids and/or nucleic acid sequences are homologous when they are derived, naturally or artificially, from a common ancestral nucleic acid or nucleic acid sequence. The homologous molecules can be termed homologs. Homology is generally inferred from sequence identity between two or more nucleic acids or proteins (or sequences thereof). The precise percentage of identity between sequences that is useful in establishing homology varies with the nucleic acid and protein at issue, but as little as 25% sequence identity is routinely used to establish homology. Higher levels of sequence identity, e.g., 30%, 40%, 50%, 60%, 70%, 80%, 90%, 95% or 99% or more can also be used to establish homology. Methods for determining sequence identity percentages (e.g., BLASTP and BLASTN using default parameters) are described herein and are generally available.

The terms "identical" or "sequence identity" in the context of two nucleic acid sequences or amino acid sequences of polypeptides refers to the residues in the two sequences which are the same when aligned for maximum correspondence over a specified comparison window. A "comparison window", as used herein, refers to a segment of at least about 20 contiguous positions, usually about 50 to about 200, more usually about 100 to about 150 in which a sequence may be compared to a reference sequence of the same number of contiguous positions after the two sequences are aligned optimally. Methods of alignment of sequences for comparison are well-known in the art. Optimal alignment of sequences for comparison may be conducted by the local homology algorithm of Smith and Waterman (1981) *Adv. Appl. Math.* 2:482; by the alignment algorithm of Needleman and Wunsch (1970) *J. Mol. Biol.* 48:443; by the search for similarity method of Pearson and Lipman (1988) *Proc. Nat. Acad. Sci U.S.A.* 85:2444; by computerized implementations of these algorithms (including, but not limited to CLUSTAL in the PC/Gene program by Intelligentics, Mountain View Calif., GAP, BESTFIT, BLAST, FASTA, and TFASTA in the Wisconsin Genetics Software Package, Genetics Computer Group (GCG), 575 Science Dr., Madison, Wis., U.S.A.); the CLUSTAL program is well described by Higgins and Sharp (1988) *Gene* 73:237-244 and Higgins and Sharp (1989) *CABIOS* 5:151-153; Corpet et al. (1988) *Nucleic Acids Res.* 16:10881-10890; Huang et al (1992) *Computer Applications in the Biosciences* 8:155-165; and Pearson et al. (1994) *Methods in Molecular Biology* 24:307-331. Alignment is also often performed by inspection and manual alignment.

In one class of embodiments, the polypeptides herein are at least 70%, generally at least 75%, optionally at least 80%, 85%, 90%, 98% or 99% or more identical to a reference polypeptide, e.g., those that are encoded by the genes responsible for SCN resistance. Sequence similarity may be measured by BLASTP (or CLUSTAL, or any other available alignment software) using default parameters. Similarly, nucleic acids can also be described with reference to a starting nucleic acid, e.g., they can be 50%, 60%, 70%, 75%, 80%, 85%, 90%, 98%, 99% or more identical to a reference nucleic acid, e.g., those that are set forth by any one of the candidate genes disclosed herein or a fragment thereof, e.g., as measured by BLASTN (or CLUSTAL, or any other available alignment software) using default parameters. When one molecule is said to have certain percentage of sequence identity with a larger molecule, it means that when the two molecules are optimally aligned, said percentage of residues in the smaller molecule finds a match residue in the larger molecule in accordance with the order by which the two molecules are optimally aligned.

In another embodiment, DNA sequences that are substantially identical to the candidate genes may be used to generate a transgenic plant that is more resistant to SCN than the host. The term "substantially identical" as applied to nucleic acid or amino acid sequences means that a nucleic acid or amino acid sequence comprises a sequence that has at least 90% sequence identity or more, preferably at least 95%, more preferably at least 98% and most preferably at least 99%, compared to a reference sequence using the programs described above (preferably BLAST) using standard parameters. For example, the BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff, *Proc. Natl. Acad. Sci. USA* 89:10915 (1989)). Percentage of sequence identity is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Preferably, the substantial identity exists over a region of the sequences that is at least about 50 residues in length, more preferably over a region of at least about 100 residues, and most preferably the sequences are substantially identical over at least about 150 residues. In a most preferred embodiment, the sequences are substantially identical over the entire length of the coding regions.

The term "polypeptide" is used interchangeably with the terms "polypeptides" and "protein(s)", and refers to a polymer of amino acid residues. A 'mature protein' is a protein which is full-length and which, optionally, includes glycosylation or other modifications typical for the protein in a given cellular environment.

The term "variant" or "mutant" with respect to a polypeptide refers to an amino acid sequence that is altered by one or more amino acids with respect to a reference sequence. The variant may have "conservative" changes, wherein a substituted amino acid has similar structural or chemical properties, e.g., replacement of leucine with isoleucine. Alternatively, a variant may have "nonconservative" changes, e.g., replacement of a glycine with a tryptophan. Analogous minor variation can also include amino acid deletion or insertion, or both. Guidance in determining which amino acid residues can be substituted, inserted, or deleted without eliminating biological or immunological activity can be found using computer programs well known in the art, for example, DNASTAR software.

As used herein, the term "resistant" or "resistance" means that the FI (%) between a subject plant and a control plant is 50% or less. More preferably, the transgenic plant or progeny thereof has a FI (%) of 20% or less, even more preferably, at 10% or less. The FI (%) may be calculated as a percentage of number of female cyst nematodes on a subject plant divided by the average number of female nematodes on a control plant, such as Hutcheson (susceptible control) or a host plant after said subject plant and the control plant are grown under comparable condition for a given period of time.

A variety of additional terms are defined or otherwise characterized herein. In practicing the instrumentalities described herein, many conventional techniques in molecular biology, microbiology, and recombinant DNA are optionally used. These techniques are well known to those of ordinary skill in the art. For example, one skilled in the art would be familiar with techniques for in vitro amplification methods, including the polymerase chain reaction (PCR), for the production of the homologous nucleic acids described herein.

The markers that are genetically linked to the QTLs disclosed herein, or other similarly placed markers, may be used in soybean breeding for marker-assisted selection of resistance to different races of SCN, including but not limited to races 1, 2, 3, 5, 14 and LY1.

Selection for resistant strains based on two markers that flank a QTL is generally more reliable than selections based on one marker linked to the QTL. Flanking-marker selection relies on two markers thereby reducing the number of false positive due to recombination between one marker and the QTL, and consequently, reducing the probability selecting a line that is susceptible. It is to be recognized, however, that when markers are closely linked to a QTL, results from single-marker selections may be acceptable.

According to another aspect of the present disclosure, a new phenotypically superior SCN-resistant soybean plant may be produced which possesses desirable traits but is substantially free from undesirable characteristics currently associated with SCN-resistant soybean lines. The first step for producing such an improved soybean line may involve providing one or more plants from a parental soybean plant line which comprises in its genome one or more molecular markers disclosed above that are genetically linked to SCN resistance. Preferably, the parental plant line is purebreeding for one or more of such molecular markers.

The second step in this method comprises introgressing SCN resistance into a recipient soybean plant line which is not resistant or less resistant to SCNs by performing marker-assisted selection based upon the one or more molecular markers in the parent mentioned in the first step. The progeny thus obtained may be backcrossed to obtain a new improved plant having the one or more molecular markers in their genome which are associated with SCN resistance.

Plants thus selected may then be used to develop new SCN-resistant recombinant soybean plant lines, for example, by single seed descent. Alternatively, the plant may optionally be further treated to selective breeding by performing additional backcrosses and selections, based upon the presence of one or more of the markers, for multiple generations. The presence of one or more of the markers may be readily determined by single nucleotide polymorphism (SNP) analysis of the plant's genomic DNA.

Marker-assisted selection may also be used to confirm previous selection for SCN resistance or susceptibility made by challenging plants with SCNs in the field or greenhouse and scoring the resulting phenotypes. Alternatively, plants can be analyzed by SNP analysis to determine the presence of the molecular markers disclosed herein in order to confirm the presence of a genomic locus associated with SCN resistance. This method can be applied to a soybean plant, soybean seeds or other tissues.

With the completion of the soybean genome sequencing project, genes within each QTL may be identified using the genomic information that are publicly available, for example, at the website maintained by NCBI. These genes may be cloned using genomic library or by PCR using genomic DNA, or cDNA as templates.

Alternatively, markers linked to each of the mapped QTL may also be used in positional cloning of genes that reside within those QTL. Positional cloning first involves creating a physical map of a contig (contiguous overlapping of cloned DNA inserts), in the genomic region encompassing one or more marker loci and the target gene. The target gene is then identified and isolated within one or more clones residing in the contig. Having a clone of a gene allows it to be used in genetic studies, transformation, and the development of transgenic plants and novel phenotypes.

It is to be recognized to that resistance to one race of SCN, or to multiple races, is likely to be controlled by more than one gene or more than one genomic locus. Genes found to be associated with SCN resistance can also be introduced into a parental plant by transformation in order to create a transgenic plant carrying the SCN resistance gene(s). Transformation of a plant cell can be accomplished by a variety of different methodology. Methods that have general utility include, for example, *Agrobacterium* based systems, using either binary and/or cointegrate plasmids of both *A. tumifaciens* and *A. rhyzogenies*, (See e.g., U.S. Pat. No. 4,940,838, U.S. Pat. No. 5,464,763), the biolistic approach (See e.g, U.S. Pat. No. 4,945,050, U.S. Pat. No. 5,015,580, U.S. Pat. No. 5,149,655), microinjection, (See e.g., U.S. Pat. No. 4,743,548), direct DNA uptake by protoplasts, (See e.g., U.S. Pat. No. 5,231,019, U.S. Pat. No. 5,453,367) or needle-like whiskers (See e.g., U.S. Pat. No. 5,302,523). Any method for the introduction of foreign DNA or RNA into a plant cell and for expression therein may be used within the context of the present disclosure.

EXAMPLES

The following nonlimiting examples report general procedures, reagents and characterization methods that teach by way of example, and should not be construed in a narrowing manner that limits the disclosure to what is specifically disclosed. Those skilled in the art will understand that numerous modifications may be made and still the result will fall within the spirit and scope of the present invention.

Example 1

Methods and Materials

The following genetic populations were generated using the Single Seed Descent method (RILs stands for Recombinant Inbred Lines):

205 F7:9 RILs of Essex×PI 437654
250 F7:8 RILs of Magellan×PI 437654
230 F7:8 RILs of Hutchison×PI 467312
250 F2:3 progenies of Magellan×PI 4384898
250 F2:3 progenies of Magellan×PI 567516C
250 F6:7 RILs of Magellan×PI 4384898
250 F6:7 RILs of Magellan×PI 567516C Single Seed Descent is a common method to generate recombinant inbred lines (RILs) in genetics study. By way of example, to obtain F6:7 RILs, one would start from a genetically segregating F2 population of a biparent cross. At maturity, one single seed of each F2 plant was harvested and individually recorded, i.e., labeled with an ID. These F2 seeds were grown to produce F3 plants. Again, one single seed of each F3 plant was harvested. The process was repeated until F6 generation was reached. The F6 plants were grown and harvested in bulk. These F6 were grown in row and harvested to generate F7 RILs. At this F7 stage, most of the genes in the genome are homozygous as a result of several generations of genetic recombination.

DNA extraction and molecular marker analysis were performed as described below. Briefly, genomic DNA was isolated from young leaf tissue of the parents, F2 plants, or RILs using an automated DNA extraction instrument AutoGen 960 (AutoGen Inc., Holliston, Mass.) following the CTAB protocol as described by the manufacturer. The DNA concentration was quantified with a spectrophotometer (NanoDrop Technologies Inc., Centreville, Del.) and diluted to concentration of 20 ng/ul for polymerase chain reaction (PCR) amplification of SSR marker analysis and 50 ng/ul for the GoldenGate assays of SNP marker genotyping.

For fluorescent-labeled SSR markers, PCR amplifications were performed in 12.5 ul final volume on Eppendorf 96- or 384-well thermal cyclers (Eppendorf AG, Germany). Each reaction contained 40-50 ng of, genomic DNA, 0.13 uM of forward primer (labeled) and 0.2 uM of reverse primer, 0.2 mM of each dNTP, and 1 unit of Taq DNA polymerase (GenScript Corp., Piscataway, N.J.). The thermal cycler program was performed at 94° C. for 5 min, followed by 35 cycles of denaturation at 94° C. for 30 sec, annealing at 47° C. or 52° C. for 30 sec, and extension at 72° C. for 45 sec. A 10-min extension at 72° C. followed the last cycle. The PCR products were separated using an ABI3100 or 3730 DNA sequencer (ABI Applied BioSystems, Foster City, Calif.).

The allele of each marker was analyzed with GeneMapper 3.7 software (ABI Applied BioSystems, Foster City, Calif.). For SNP markers, the universal soy linkage panel (the USLP 1.0) containing 1,536 SNP loci that were discovered and mapped onto the integrated molecular genetic linkage map as previously described (Hyten et al. 2008) was utilized to genotype F6:7 RTL mapping populations using the Illumina GoldenGate assay (Fan et al. 2006).

A total of 5 ul of 50 ng/ul of RNase-treated genomic DNA sample was activated by biotinylation, followed by the oligonucleotide/target annealing step, in which the SNP-specific oligonucleotide annealed to the activated DNA by ramping the temperature from 70° C. to 30° C. over 2 h. Three oligonucleotide sequences, two allele-specific oligos (ASO) and one locus-specific oligo (LSO) designed for each SNP, contain regions of genomic complementary and universal PCR primer sites. The LSO also contained a unique IllumiCode sequence complementary to a particular bead type. Following the assay oligonucleotide hybridization, wash steps to remove excess and mis-hybridized oligos, and adding a master mix of extension and ligation, the assay of oligonucleotide extension and ligation were implemented at 45° C. for 15 min.

DNA polymerase was used to extend the ASO and fill the gaps between the ASO and LSO; and a DNA ligase was employed to seal the nick between the extended ASO and LSO to form PCR template that can be amplified with three universal PCR primers. These universal primers were 5'-labeled with Cy3, Cy5, and biotin. The PCR amplification was then performed following a thermal cycler program: 10 min at 37° C. followed by 3 min at 95° C.; 34 cyclers of denaturation at 95° C. for 35 sec, annealing at 56° C. for 35 sec, and extension at 72° C. for 2 min. A 10-min extension at 72° C. followed the last cycle.

The resulting double-stranded PCR products were immobilized onto paramagnetic particles followed by steps of washing and denaturing. The released single-stranded DNAs were then hybridized to their complementary bead type through their unique IllumiCode sequence of the Sentrix array matrix (SAM) under a temperature gradient program from 60° C. to 45° C. for at least 12 h. The hybridized SAM was rinsed and dried for 20 min in dark. The array imaging was performed using the Illumina BeadStation (Illumina, San Diego, Calif.).

The allele calling for each SNP locus was conducted with the BeadStudio 3.0 software (Illumina, San Diego, Calif.) based on the intensities detected from the two channels, Cy3 and Cy5, for the two respective alleles of each SNP. The clusters of homozygote and heterozygous genotypes for each SNP were manually checked and identified for polymorphisms between the two parental lines. The polymorphic SNP loci were then employed for the genetic linkage analysis and QTL mapping.

Soybean cyst nematode (SCN) bioassays were performed in the greenhouse at the University of Missouri-Columbia according to established methods (Arelli et al., 1997). All SCN races 1, 2, 3, 5, 14, and LY1 (corresponding to HG types 2.5.7; 1.2.5.7; 0; 1.2.7, 1.3.6.7, and 1.2.5.6.7, respectively) (Niblack et al. 2002) that were used in this Example have been maintained for many generations at the University of Missouri-Columbia (Arelli et al. 1997; Arelli et al. 2000). The population purity of each race and the success of a phenotyping experiment were monitored and evaluated by SCN reaction to indicator lines, Peking, Pickett, PI 88788, PI 90763, PI 437654, PI 209332, PI 89772, PI 548316 and Hutcheson (susceptible control).

More particularly, soybean seeds were germinated for three days in germination pouches and then seedlings were transplanted into micropots (one plant in each micropot) filled with steam-pasteurized sandy soil. Five plants of each indicator lines and five single-plant replications per RIL (two independent experiments for all races) were planted together in random way. Twenty four micropots each were placed in a plastic container and maintained at 27±10° C. in a thermal-regulated water bath. Two days after transplanting, roots of each plant were inoculated with 2000±25 SCN eggs. Thirty days after transplanting, roots were harvested and washed to collect female nematode. Nematode cysts were then counted under a stereo-microscope. The female index (FI) was calculated to evaluate SCN response of each individual seedling of all plants, including parents, F2:3 progenies, RILs, and indicator lines. The FI (%) was calculated as a percentage of number of female cyst nematodes on a given individual divided by the average number of female nematodes on cultivar Hutcheson.

Data processing and analysis were performed as described in the following text. Female index (FI) of F2:3 progenies and RILs were tested for normality using the UNIVARIATE procedure of SAS 9.1 (SAS Institute, Cary, N.Y.). The Shapiro-Wilk (W) statistical method was used to test the null hypothesis that FI (%) were normally distributed among F2:3 progenies or RILs (Elliott 1999). Linkage analysis was performed with the computer program JoinMap 3.0 (van Ooijen and Voorrips 2001) to construct a genetic linkage map using the Kosambi mapping function. A likelihood of odds (LOD) threshold score of 3.0 and a maximum distance of 50 cM were used for initial linkage grouping of markers. Chromosome numbers (Chr.) were assigned according to the designation of the soybean linkage groups (LGs) described in the SoyBase website (http://www.soybase.org) and the soybean composite map (Song et al. 2004). Composite interval mapping (CIM) was performed to identify QTL controlling FI using the MQM method with the program MapQTL 5.0 or QTLNetwork 2.0 and the appropriate cofactor selection (van Ooijen and Voorrips 2001). The permutation test (Churchill and Doerge 1994) was performed with 1000 runs to determine the P=0.05 genome-wide significance level for declaring QTL for FI significant. The proportion of the phenotypic variance explained by the QTL effects was estimated by CIM at the QTL peaks. The total phenotypic variance explained by the significant QTL was determined using a multivariate ANOVA model of SAS.

Molecular genetic linkage analysis was performed using the methodology described below. Nearly 600 fluorescent-labeled SSR markers were surveyed for DNA polymorphisms between two parental lines of each genetic population. Of these, from 250 to 300 markers, which produced mainly co-dominant loci, were polymorphic. These markers were utilized for genotyping of the F2:3 or RIL mapping populations. For each genetic population, a molecular genetic linkage map encompassing 20 soybean chromosomes and fragments was constructed. These chromosomes and fragments covered approximately 1,600 to 2500 cM. Overall, marker order and genetic distance between markers in the constructed genetic map had a linear relationship with the composite linkage map (Song et al. 2004).

Example 2

Identification of QTLs Associated with SCN Resistance in PI 437654

Four major QTLs associated with SCN resistance have been identified in PI 437654 (Table 1). These QTLs may be defined by flanking markers on the genome sequence. The genomic regions encompassed by these QTLs contain many genes encoding proteins or metabolites that may play a role in SCN resistance. These genes may also include networking regulators or transcription factors.

The first QTL ("SCN QTL1") is located on LG G (Chromosome 18) from Sat_210 to Satt610 (i.e. from 1620984 by to 2664659 bp), which contains 134 predicted genes. The gene identifiers of these genes are listed in FIG. 1. The second QTL ("SCN QTL2") is located on LG A2 (Chromosome 8) from Sat_212 to AW132402 (i.e. from 9166105 by to 11868971 bp), including 460 predicted genes. The gene identifiers of these genes are listed in FIG. 2. The third QTL ("SCN QTL3") is located on LG B1 (Chromosome 11) from Satt665 to Satt484 (i.e. from 36229108 by to 38708296 bp). This QTL includes 378 predicted genes, whose identifiers are listed in FIG. 3. The fourth QTL ("SCN QTL4") is located on LG I (Chromosome 20) from GMGIPSI2 to Sct_189 (i.e. from 41872927 by to 45550697 bp), including 505 predicted genes. The gene identifiers of these genes are listed in FIG. 4.

In addition, about 160 genetic markers have been identified within this region which may be used for fine mapping the QTLs with NILs.

Example 3

Identification of QTLs Associated with SCN Resistance in PI 467312

Two QTL regions have been identified for PI 467312 (Table 1). One QTL is identical to the SCN QTL1 as described above. The other QTL ("SCN QTL5") is located on the same Chromosome 18 but is located in a different region, from Sct_187 to Sat_372 (i.e. from 60463046 by to 61095649 bp), including 93 predicted genes. The gene identifiers of these genes are listed in FIG. 5.

Example 4

Identification of QTLs Associated with SCN Resistance in PI 438489B

For 438489B, based on the results of primary QTL mapping in F2:3 progenies and confirmation study in F7 RIL population derived from the Magellan×PI 438489B population, two new QTLs were detected which are associated with resistance to two SCN races, 5 and 14. These two QTLs were mapped to two distinct genomic regions of Chr. 4 (corresponding to LG C1) (Table 1). The first QTL ("SCN QTL6") responsible for resistance to race 5 (also called "R5-QTL") was flanked by the SSR markers Satt294 and Sat_207 with LOD score of 7.5. A favorable allele from PI 438489B conferred greater resistance and had an additive effect on the race 5 SCN female index (FI). In reference to the soybean physical map (http://soybeanphysicalmap.org) and the 8× assembly sequence information of the soybean genome (http://www-.phytozome.net), the R5-QTL was in the supercontig 111 and was physically positioned between 40154806 and 42774138 bp. At least 207 soybean genes were predicted to exist within this genomic location, based on gene annotation (Table 1 and FIG. 6).

The second QTL ("SCN QTL7") is also on chromosome 4 and is for resistance to race 14 (tentatively designated R14-QTL). This QTL was flanked by the SSR markers Satt565 and Satt194 with LOD score of 8.5. A favorable allele from PI 438489B conferred greater resistance and had an additive effect on FI. The R14-QTL was in the supercontig 170 and is physically positioned between 511086 and 2402538 bp. 295 soybean genes were predicted to exist within this genomic location based on gene annotation (Table 1). The gene identifiers of these genes are listed in FIG. 7.

Also from this population, two previously identified QTLs were detected and mapped on Chrs. 18 and 8 (corresponding to LGs G and A2, respectively). The first of the two previously identified QTLs ("SCN QTL8") was concurrently responsible for resistance to three races 1, 2, and 3 with LOD scores of 8.0, 7.5, and 16.0, respectively, and flanked by the SSR markers Satt163 and Satt217. A favorable allele from PI 438489B conferred greater resistance and had an additive effect on all SCN female index (FI). The "SCN QTL8" was in the supercontig 110 and physically positioned between 998312 and 4692481 by (http://www.phytozome.net). This genomic region contains 457 soybean genes predicted according to gene annotation. The gene identifiers of these genes are listed in FIG. 8.

The second of the two previously identified QTLs ("SCN QTL9") was also concurrently associated with resistance to races 1 and 3 with LOD scores of 4.7 and 10.2, respectively, and flanked by the SSR markers Sat_406 and Satt341. A favorable allele from PI 438489B conferred greater resistance and had an additive effect on all SCN female index (FI). The "SCN QTL9" was in the supercontig 5 and physically positioned between 3987571-13200142 bp by on Chr. 8 (http://www.phytozome.net). Within the genomic region, 1421 genes were predicted based on gene annotation. The gene identifiers of these genes are listed in FIG. 9.

Example 5

Identification of QTLs Associated with SCN Resistance in PI 567516C

Based on the results of primary QTL mapping in F2:3 progenies and confirmation study in the F7 RIL population, two new QTLs were detected in PI 567516C which were significantly associated with resistance to multi-races of SCN and were mapped to Chrs. 18 and 10 (corresponding to LGs G and O, respectively) (Table 1). The first QTL ("SCN QTL10") was located on a new genomic region flanked by the SSR markers Satt612 and Satt472 on Chr. 18 (LG G) with LOD scores of 6.5, 7.2, 3.8, 10.3, and 6.3 for races 1, 2, 3, 5, and LY1, respectively. Favorable alleles from PI 567516C conferred greater resistance and had an additive effect on FI. In reference to the soybean physical map (http://soybeanphysicalmap.org) and the 8× assembly sequence information of the soybean genome (http://www.phytozome.net), this QTL was located in supercontig 8 and was physically positioned between 56453661 and 58136436 bp, in which six SNP loci of the USLP 1.0 soybean array were found to be closely associated with the QTL. In addition, 194 soybean genes were predicted to lie within this genomic region based on gene annotation data (Table 1). The gene identifiers of these genes are listed in FIG. 10.

The second QTL ("SCN QTL11") was mapped to a new genomic region flanked by the SSR markers Sat_038 and Satt592 on Chr. 10. Between these two markers, the marker Sat331 was closely associated with the QTL peak, with LOD scores of 6.6, 8.2, 4.2, 7.0, and 11.7 for races 1, 3, 5, 14, and LY1, respectively. A favorable allele was inherited from PI 567156C and had an additive effect on FI. In reference to the soybean physical map (http://soybeanphysicalmap.org) and the 8× assembly sequence information of the soybean genome (http://www.phytozome.net), this QTL was in the supercontig 124 and was physically positioned between 42983781 and 45480599 bp, in which five SNP loci of the USLP 1.0 soybean array were found to be closely associated with the QTL. In addition, 336 soybean genes were predicted to exist within this genomic region based on the gene annotation (Table 1). The gene identifiers of these genes are listed in FIG. 11.

Example 6

Characterization of the QTLs to Identify Individual Genes Responsible for SCN Resistance All QTLs identified in the Examples above are summarized in Table 1. Gene identifiers of those flanking markers (SEQ ID Nos. 1-22) associated with these QTLs are listed in FIG. 12. Many other markers may also exist within each QTL which may be useful in fine-mapping the loci responsible for SCN resistance.

A series of different soybean populations may be developed to facilitate fine mapping. An integrated approach may be applied to these fine mapping populations to pinpoint candidate genes associated with SCN resistance and narrow down the QTL regions until resistance genes underlying these QTL regions are cloned. Individual genes shown to be responsible for SCN resistance are introduced into soybean strains that are susceptible to SCN infection.

All genes encompassed by the QTLs listed in Table 1 and described in the Examples above are listed by their gene identifiers in FIGS. 1-11. The sequences of these genes may be obtained from publicly available databases and are hereby incorporated expressly into this disclosure by reference. Examples of such databases include by are not limited to GenBank maintained by NCBI, as well as soybean specific databases at the following link: http://soybase.org.

While the foregoing instrumentalities have been described in some detail for purposes of clarity and understanding, it will be clear to one skilled in the art from a reading of this disclosure that various changes in form and detail can be made without departing from the true scope of the invention. For example, all the techniques and apparatus described above may be used in various combinations. All publications, patents, patent applications, or other documents cited in this application are incorporated by reference in their entirety for all purposes to the same extent as if each individual publication, patent, patent application, or other document were individually indicated to be incorporated by reference for all purposes.

REFERENCES

In addition to those references that are cited in the text, additional information for those abbreviated citations is listed below. The content of all patents, patent applications or other publications cited in this disclosure are incorporated by reference into this disclosure.

1 Anand S C, Gallo K M, Baker I A, Hartwig E E (1988) Soybean plant introductions with resistance to races 4 or 5 of soybean cyst nematode. Crop Sci 28:563-564.
2 Anand S C, Rao Arelli A P (1989) Genetic analyses of soybean genotypes resistant to soybean cyst nematode race 5. Crop Sci 29:1181-1184.
3 Arelli P R, Sleper D A, Yue P, Wilcox J A (2000) Soybean reaction to races 1 and 2 of *Heterodera glycines*. Crop Sci 40:824-826.
4 Arelli P R, Wilcox J A, Myers J, Gibson P T (1997) Soybean germplasm resistant to races 1 and 2 of *Heterodera glycines*. Crop Sci 37:1367-1369.
5 Arelli P R, Young I D (2005) Genetics of resistance in soybean PI 567516C to LY1 nematode population infecting cv. Hartwig. Crop Sci Soc Am p. 234 (Abstracts).
6 Arelli P R, Young I D, Concibido V C (2009) Inheritance of resistance in soybean PI 567516C to LY1 nematode population infecting cv. Hartwig. Euphytica 165:1-4.
7 Caldwell B E, Brim C A, Ross J P (1960) Inheritance of resistance of soybeans to the cyst nematode, *Heterodera glycines*. Agron J 52:635-636.
8 Chen Y, Wang D, Arelli P R, Ebrahimi M, Nelson R I (2006) Molecular marker diversity of SCN-resistant sources in soybean. Genome 49:938-949.
9 Churchill G A, Doerge R W (1994) Empirical threshold values for quantitative trait mapping. Genetics 138:963-971.
10 Concibido V C, Denny R I, Boutin S R, Hautea R, Orf J H, Young N D (1994) DNA marker analysis of loci underlying resistance to soybean cyst nematode (*Heterodera glycines* Ichinohe). Crop Sci 34:240-246.
11 Concibido V C, Denny R I, lange D A, Orf J H, Young N D (1996) RFIP mapping and marker-assisted selection of soybean cyst nematode resistance in PI 209332. Crop Sci 36:1643-1650.
12 Concibido V C, Diers B W, Arelli P R (2004) A decade of QTL mapping for cyst nematode resistance in soybean. Crop Sci 44:1121-1131.
13 Cregan P B, Mudge J, Fickus E W, Danesh D, Denny R, Young N D (1999) Two simple sequence repeat markers to select for soybean cyst nematode resistance conditioned by the rhg1 locus. Theor Appl Genet 99:811-818.
14 Elliott R J (1999) learning SAS in the computer lab (2nd Ed.) Duxbury Thomson learning, USA:39-48.
15 Fan J, Gunderson K, Bibikova M, Yeakley J, Chen J, Garcia E W, lebruska l, laurent M, Shen R, Barker D (2006) Iliumina universal bead Methods 410:57-73.
16 Guo B, Sleper D A, Arelli P R, Shannon J G, Nguyen H T (2005) Identification of QTLs associated with resistance to soybean cyst nematode races 2, 3 and 5 in soybean PI 90763. Theor Appl Genet 111:965-971.
17 Guo B, Sleper D A, Nguyen H T, Arelli P R, Shannon J G (2006b) Quantitative trait loci underlying resistance to three soybean cyst nematode populations in soybean PI 404198A. Crop Sci 46:224-233.
18 Hyten D, Song Q, Choi I, Yoon M, Specht J, Matukumalli L, Nelson R, Shoemaker R, Young N, Cregan P (2008) High-throughput genotyping with the GoldenGate assay in the complex genome of soybean. Theor Appl Genet 116: 945-952.
19 Mansur L M, Carriquiry A L, Rao-Arelli A P (1993) Generation mean analysis of resistance to race-3 of soybean: Icyst nematode. Crop Sci 33:1249-1253.
20 Matson A L, Williams L F (1965) Evidence of a fourth gene for resistance to the soybean cyst nematode. Crop Sci 5:477.
21 Meksem K, Doubler T W, Chancharoenchai V N, Njiti V, Chang S J C, Rao Arellj A P, Cregan P B, Gray L E, Gibson P T, Lightfoot D A (1999) Clustering among loci underlying soybean resistance to *Fusarium solani*, SDS and SCN in near-isogenic lines. Theor Appl Genet 99:1131-1142.
22 Niblack T L, Arelli P R, Noel G R, Opperman C H, Orf J H, Schmitt D P, Shannon J G, Tylka G L (2002) A revised classification scheme for genetically diverse populations of *Heterodera glycines*. J Nematol 34:279-288.
23 Rao-Arelli A P (1994) Inheritance of resistance to *Heterodera glycines* race 3 in soybean accessions. Plant Dis: 78:898-900.
24 Schapaugh W T, Owen P A, Clark K M, Sleper D A (1998) Registration of 'Magellan' soybean. Crop Sci 38:892.
25 Song Q J, Marek L F, Shoemaker R C, Lark K G, Concibido V C, Delannay X, Specht J E, Cregan P B (2004) A new integrated genetic linkage map of the soybean. Theor Appl Genet 109:122-128.
26 van Ooijen j h, Voorrips R E (2001) JoinMap 3.0 software for the calculation of genetic linkage maps. Plant Research Internation, Wageningen, the Netherlands.
27 Vooriips R E (2002) MapChart: software for the graphical presentation of the linkage maps and QTLs. J Hered 93:77-78.
28 Wang D, Arelli P R, Shoemaker R C, Diers B W (2001) Loci underlying resistance to Race 3 of soybean cyst nematode in *Glycine soja* plant introduction 468916. Theor Appl Genet 103:561-566.
29 Webb D M, Baltazar B M, Rao-Arelli P A, Schupp J, Clayton K, Keim P, Beavis W D (1995) Genetic mapping of soybean cyst nematode race-3 resistance loci in soybean PI 437654. Theor Appl Genet 91:574-581.
30 Winter S M J, Shelp B J, Anderson T R, Welacky T W, Rajcan 1 (2007) QTL associated with horizontal resistance to soybean cyst nematode in *Glycine soja* P1464925B. Theor Appl Genet 114:461-472.
31 Wu X, Blake S, Sleper D A, Shannon J G, Cregan P, Nguyen H T (2008) QTL, additive, and epistatic effects for SCN resistance in PI 437654. Theor Appl Genet (accepted).
32 Xie M, Arelli P R, Sleper D A (1998) Genetic relationships among soybean plant introductions with resistance to *Heterodera glycines* using RFLP's Soybean Genetics Newsletter 25:157-163.
33 Young L D (1995) Soybean germplasm resistant to race 3, 5, and 14 of soybean cyst nematode. Crop Sci: 35:895-896.
34 Young L D (1998) *Heterodera glycines* populations selected for reproduction on Hartwig soybean. J Nematol 30:523
35 Yue P, Sleper D A, Arelli P R (2001a) Mapping resistance to multiple races of *Heterodera glycines* in soybean PI 89772 Crop Sci 41:1589-95.

SEQUENCE LISTING (4502 sequences)

SEQ ID NO: 1 - DNA, 254 bp, Glycine Max
gcgcatgcaaatgaaataataaagataatcttatgatatctataactctttttttttattatcaaatgataatatatatatatatatatatatatatatatatatatatatatatatgtgtgtatataatgttcaatttgtaacataatcctagtttgttgataaacccttacattttggatgtcagatttgaaggacacaatcaatctacgagcggaggacatggattttgtcaggaactttgttgctggatt

SEQ ID NO: 2 - DNA, 219 bp, Glycine Max
ccctccgcaagcaataattaatcttcgttgggactatgctaccacaaggaatgaatcatgttaaaaataaatattcagcttgtgtatttataattatcaataaagattagtcactacttcctacaataaatactttgtatcaatataataataataataataataataataatttagtgtaaaataatcataacaatatataaaatggaagcattcaaa

SEQ ID NO: 3 - DNA, 300 bp, Glycine Max
aaagacaattttttatcaataatttattttttttaatttaaacaatatatatatatatatatatatatatatatatatatatatatatatatgtattactgaagataattttatttgaatcagattaaattattataaacgataaaatttttcattttaatacttaatacaattacatttccataacctaaactcaatatcactgattaaactaaaacaactcacgctaattagtgcatggatcaactatctatacctaaaactaattggataagtgatcataggaaaagtaagcatgta

SEQ ID NO: 4 - DNA, 150 bp, Glycine Max
cctccctcctctcctttcttggatactatttgcagttctaagccatgattgatatatatatatatatatatatatatatatatatgtgtgtgtgtgcatgataatttggaaaagaaatgaagggaaacaaatgatagaatatgtgggaaa

SEQ ID NO: 5 - DNA, 262 bp, Glycine Max
taacatgacttaattttacaccctttatttgtaacaatatttaaatatatattttgatattataagtaaaagatttctttttcatcttataagttataaaatattgtttttgttattgaaaattgtatttaattattttatatttacattattattattattattattattattattattattattattattattattattataccgaaatatatatttaatcattatcctttaactaggattaaaccagcgaattcaacaa

SEQ ID NO: 6 - DNA, 303 bp, Glycine Max
tttttccctttctctcctttctttcttaggttgacgtaaataaaactatttttcctaaaataattacatgtactctaaaaaaattacattatttagtttattgcatttgtatctttatttctcaaatttagttctccattttttatattaatagataactaaaaaaatatcattaaaatagtggtgcgaccaaatttataaataacaaattaaaaaaaataaaataacaaaatgaaaataataataataataataataataataataataataaagtacaattaaattagttttattaaataa

SEQ ID NO: 7 - DNA, 118 bp, Glycine Max
ttcgaagcattcaaggcaaacattcatcaatacaatgttgtgttctacacctcgtaagtttttttttttttttttttctctctaaatacgtgtcttttatagtatgtttttgtctttt

SEQ ID NO: 8 - DNA, 165 bp, Glycine Max
cttttcctggcaatgatattttgaagtctgtacagcttctgggtatgcctctagtagaaaactacaaaaataaatggaaaattgaatattctctctctctctctctctctctctctctctctctttatggttagtttagttataatactaaggttttgcgatttt

SEQ ID NO: 9 - DNA, 144 bp, Glycine Max
catgctcccattctctctctctctctctctctgcaccaacatttatgtggcatcaaccaccaagataagtggtcggccattgaattaagcaaaattaacaaataatagtaatgtttaggtgatgctaagtaaaaagccaatgtt

SEQ ID NO: 10 - DNA, 301 bp, Glycine Max
attagtttggtaacatcgagtattgattaaaataattaaggcagctaaaaatttcttttgattgaattcctatttttttaaaaaaataataagttgatttaatatgcattacaaaataaaatacacgtaagaaaaaaaaaaaatatatatatatatatatatatatatatatatatatatatatatatatatatataagaatgattctgcttccgagaatgaaactcggacttataatataaaagtgaatttacaaaaaaaaaaatattaaaaagataaatagataattacctcgagaaca

SEQ ID NO: 11 - DNA, 287 bp, Glycine Max
tttggtcaaatgcaaattatttttaaaggcatatacaactattattattattattattattattattattattattattattattattattattattattattattattttccataattttagagtttaatttgaatattgttaatataatttttttatactgtcaacaattaaaactattttatatatgaattttaatacaattattaaaaatcaattatttttaattatatgacaatatttgtaattgaatgaaaatatatagaaacaactttcacactgagaat

SEQ ID NO: 12 - DNA, 235 bp, Glycine Max
cgctccttaagaattactacttttttactgtaccttttttttaaaaaaattcgcatgtcaattattttaaagcactaagaatctaaattttaggacgaatatttgaaatattgaaaataaagaatagcaatatatatatatatatatatatatatcaattctcctcaattctcaccaaccaatttcaatcttgtgagtgtatccaaaacacaaagagcaatatgttcagatccgg

SEQ ID NO: 13 - DNA, 189 bp, Glycine Max
gtacccggaacttgtaataacctaatgtagatttagtatgatttctgaataataataataataataataataataataataataataataataataataataataagatctttttaaccaatatcattatgacattagttaagagaataaaaagaaaaaatatttattatgaacatcataagagagtgt

SEQ ID NO: 14 - DNA, 235 bp, Glycine Max
aactgatatttaattgtaaatcataaattgtcaatttttttggttgataatgtaaattttattaaattgtataaaaattagactttatttatttatatattattattattattattattattattattattattattattattattattattattattattattattccccgagactctctgaatagtgaatactctcggtgcgtcattatcgcaatcaaaatcggaacacaaag

SEQ ID NO: 15 - DNA, 246 bp, Glycine Max
gtgtatgtgaaggggaaaaactatgttctgtgtgtatatagttggatttttatgttgtttttaaatctaagttttgaaggataaaatgatttaataaaaatagagataaaaaataattattgaattggatattccttttatctattattattattattattattattattattattattattattattattatatataaaagatgtaattaacacatttttctctctctccttttctcgtgctatt

SEQ ID NO: 16 - DNA, 249 bp, Glycine Max
aatgattttgcgtatgtaagatgattaaagtaatcaaacaaataataatttgttgcatgaattaatattattttcaccgtagtaatctatggattgttggattaaatttgaatcaataataataataataataataataataataataataataataataataataataatagatattgtaactgtaaaaaaaaaaaaaaagtggtcttgtaacataatctaattctaaaaactattaatgtcatccgc

SEQ ID NO: 17 - DNA, 215 bp, Glycine Max
ggatttgcagccatttccatttacatcaccggcctctctgatccttttgtatgtatgtatgtatatgtatttttaccgtatatatatatatatatatatatatatatatatatatatatatatatatatatatatatatatatatatattattctaactgcgtcagttttgttcttctgtcttgaatctaacaataatgtaaccaccacacgcgc

SEQ ID NO: 18 - DNA, 220 bp, Glycine Max
gttgtccaacattgaggcaagaatactccagcactaaaaaataataataataataataataataataataataataataataataataataaataacatatgttaattggtgatatttataaaatgattcaattgatatgttaaaatgttaattacattgaaatagtaacatttttcataacttaataatattaagtttttttatgttggtaagctcaat

SEQ ID NO: 19 - DNA, 244 bp, Glycine Max
agtcatactggtgtttcatttatgactataaaatagtgatttaaaataaatatataacttttttatttttgtacttgacaaatattttttatttaattttcatcactataaataattgttatcactgtaaattaatgtcagttattattattattattattattattattatgctaatagtaatttatatgtagcatgagatttaattataaatttaaaaatactttcagagactaaaaggata

SEQ ID NO: 20 - DNA, 279 bp, Glycine Max
tttaatacataaaactcaaattcaaatcataacttaaaaaaattgaatcatattatatcactttaccaacaacttattattattattattattattattattattattattattattattattattattattattattattattattattattattattattattattattattattattattatacgatcattagtgacatattttataacacattttcattatttattaaaatttattcgaataatattgaaactatgaatgaaatttatagaaaaa

SEQ ID NO: 21 - DNA, 241 bp, Glycine Max
aataagattggtcttttatgtcaaatgcaagtgtactaagaaatttgcttttttattttaaatattcaattcaatttgtattattattattattattattattattattattattatataaccattgaagtttatatttttatattctataaagtttcagatgataagttcaacttcttaaggttactgtttagctataaaaatattgtattattttgaatagagacttgtattcctctat

SEQ ID NO: 22 - DNA, 245 bp, Glycine Max
actagttcttttaacaacactcacttttggaagtattaatataatatatatatatatatatatatatatatatatatatatatatgtaagaagaattaattaagagtctcaaattggaagacgtactgaccttcatattgtcactgtacgaagtttgtgagagctaaaataggggagtgttagtgaaaactacgaaaaaggtaaaagagagttgaaaagtaagaaaaatgaaaaagttgcgattt

SEQ ID NO: 23 - DNA, 267 bp, Glycine Max
aaacaagaaaaacggtgcgtttttgtcagggaaatgggtctttggactttacttgaggggtttcttcttcttgcaaatgcgctagcaatattaaatgaggaccgctttcttgcacctagaggatggggcttccaagatttctcaggtggaaggactaagtcgttcaaaggccagcttataggcctcatttatgcaactcagtacctcagagttcctctcatacttctcaattccatctgcatttttctgaagttggtgtctggctga

SEQ ID NO: 24 - DNA, 136 bp, Glycine Max
aacgattgctgcgccacgcaactcatcgacggcgacggcgagttcaacatcgtcggcctcgacaacttcatcagaaccctcaatctcacctcctgcggcctctcctacacagttgtcgcaatcatggaacctcaga

SEQ ID NO: 25 - DNA, 1449 bp, Glycine Max
acagaagttgacatgatgaaggagaggtttgcaaaattgttgcttggtgaagatatgtcaggttctggaaaaggggtttgcactgctttggccatctctaatgccattactaatctgtgcgcaactgtatttgggcaattatggagactagaacccttaccttctgagaagaaagaaatgtggcagagagagatggaatggcttgttagtgttagtgattacattgtcgagttgatgccttcttggcaaacatatcctgatgggagtaagctcgaggtaatgacttgcaggcctagggcagatatttttaccaatcttccagctcttcgcaaacttgacaacatgcttctcggaattttagacagtttcactgctacagagttttggtatgtagaccaaggaattgtagccccagatgcagatggttcggtctcttttcggaaaacaattcagcggcaagaagagaagtggtggcttcccgtacctcgtgttccccctgcaggactcggtgaagactcaagaaaacagttgaatcactctcgagaatgtgcaaaccaaatactaaaagcagccatggctatcaacagcattgctttggctgaaatggaagttcctgagtcatatttggaagttcttcctaagaatggaagaacttgcttgggggattttgtttaccgttacataacatcagatcaattctccccggagtgccttcttgattgcttagacatatcctctgaacatgttgcactagagattgcaaaccgtgtggaagcagcaatttatgtatggcgccgaagagctcactctaggtcctcaccaaaccccaaccgttctaccacaaaatcatcatgggaaatagtcaaggacttcatggttgacggagataagagagaactactagcagatagagctgagaacattctagtttccttgaagcagcggttcccaggcttaagtcaaactacccttgataccagcaagatccagtgcaacaaggatgttggaaaatccgtgctagagagctactcaagagttttggagagcatggcttttaacattgtggcccgcattgatgatttgctatatgtggatgacttgacaaaacattcagagaggtttgcattggttcctaccactacagttaacgtggtttctcagcaaaagaaggttacacgtccactctcagtgtctgtctcaggcactactccacacaaagcatcagttggcacacctagcttttcacctgcggcgagaactcctttcctccacaacatcaacatcaacaacaacaacaacatcaaaccccatcgtcgcggctttggggtgaggagagtgttgtcaaattatcttggagtagagacaaagactactaagatatgcagcaactcaactgaggtgaattgttcaaacccaagcagcaagaaaacggaacaacaacatcagaag

SEQ ID NO: 26 - DNA, 1470 bp, Glycine Max
atcaatcatctttctcacccttgtatatacgagagaaagtctggttttatgaaatggtttggtaagattttcaacattgggtccagtagaggaaggggtggtggtcgccatctgcagcagcctgtagaggaaaacatggtttggccagctccagctaaatccttggatgattgtgctagatctcggaaggaggaagaggatctagatcatgcaattgcactttctttaggcgaaaattttaagagaccaactggatatagatggcgaacaggaactgatgaagattatgcaaaggctcttcaagatcgcatgttctcatctgcccatccaccatatgcccctgtacctttttatacccggggatatggaacatgtggagggtgcaaccaagagatactctatggcaattgtttaggagttggtcataattattttcatccagactgctttcggtgtcactcttgtcgttaccccattactgagcgtgagttttctttgtcagggaagcatccatatcacaaaacctgttttaaggaattgacacaccctaaatgtgaagtttgccatcaatatataccaataaatgctgctggtttgattgagtatagatgccacccctattggaatcaaaagtattgtccatctcatgaatatgataatacagctcgctgctgtagttgtgaaagattagagtcacgggatgaaagatactatagattggaagatggaaggattttgtgctttgagtgcatggaatctgctataacggacactggtgaatgtcaacccctttatcatgctatcagagactattatgaaggaatgaatatgaaaattgatcaacaagtcccaatgcttctcgttgggagagaagcacttaatgaagccattgttggggagaagaatggcttccatcacttaccagaaacaaggggattatgcctttcagaagagcaaactgtcacaagtgtatatagatggccaaaaattggaggccatcgattaataggcatgagatctcaagctcaacggctgcctagaaagtgtgaagttacagctattcttgttctgtatggtcttccaaggttactcacaggtgctatacttgcacatgagttgatgcatgcttggttacgcctcaaaggttaccaaaaccttagtcctgaagtagaggaaggtatttgtcaggttctttcttacatgtggcttgatgcagaggtcatgtcatgtgctagaaccatgtcatcaacatcagcagcagcttcttcctcctcctactctagttcatcaaagaaaggtgtgaaatctcatgttgaaaataaattgggtgagtttttcatgaaccagattgccaatgattcttccccagcttatggtggtggctttagagcagccaatgaggctgtgaataaatatggtttgcgttgcactctggagcatattcgtttgactggtcatttcccactgtaa

SEQ ID NO: 27 - DNA, 660 bp, Glycine Max
atgaaaaagaaatttcaatgtagccaattcaccgttaacctaagaaagagaagtagctgtagtaataggaagaggatgatcggcgtcggaaagatcaagcagtacagtaacgtcctcgacaagcccctcaccaagggcaagcaagaggttagtttgagtgcattcgcgttcttgttctcggagcttgttcagtacaaccaaacgcaggtcgacaacattggcgagctcgaacgaaggctggaggatgctggatatgcggttggggctcgagttcttgagctgctttgccacagagataagggaaacagaagagagacacggctgttgaatattctttcttttgtacacagtacagtgtggaaagtattatttggaaaggtagctgattcactggagaaaggaactgaacatgaagatgaatacatgatcagtgaaaaggagctcctagtaaacaagttcatttctatcccaaaggacatgggaacgtttaactgtggagcatttgttgctggaatagtacggggcgttttggatggtgccgggtttccagctgttgtaacagctcattttgtccccatggaaggtcaacaacgaccacggacaacaattttgataaaatttgctgaagaggtgttacgaagagaagcaagattaggctga

SEQ ID NO: 28 - DNA, 2043 bp, Glycine Max
atgaaaacaccaccttcctcctccgtcaacctctgtctcgccgtcgccgtcgccgcagtactcatactctctctggtaccctcatcccatggttttggctccggcgccaccctggccctctccgactcctcttccaccgtgtgcgccgtcgtagcatccgagtccacgcgccgcattgagtgttaccgtcaggggcaggtagttcccatcgctcccaacgttagtttttcgtcaatttccggtgggaggaactacttctgcggcataaggtccagcaactcgaatctgctttgctggaacacaagctcttccttcgagaggagaaggctttacaacgacagttctgttccattggagaatctcgccgtcggggacacccacgtttgcgccaccgcggtgggtgatggcacggtgcggtgctggagaaccggtaacacgtttcaaattgtatctgggtctgatcaattcgcttcaatttcatctgggtctggcttctcttgcggaattttgaagaatggttctcgggttcggtgctggggagacactaattattctgggttggcacttggtgctgagcatggttgtgcgattagagagtcgaatggttcggttgtgtgttggggtggaaatgggcaattctcggtgagtaatgttacagaaggagtttcctttgaggtaattgtttctggttctaactttgtttgtggattgacaacaaacaatttgacagtggtgtgttggggtcctggttggtctaatggttcaaggtttgagcttcctttgcctcgtgttcttccagggccttgtgttcaatcttcttgtggagagtgtggttcgtatcttaattctgaatttctatgctctggctctggtaacatttgtaagccaatgacatgtaggcctcaaacaacgaccttgacaagggggttattggcttttgctattattggttcagtgggagcttttgctggaatatgcacaatagtttattgcctgtggagtggagtttgttttgggaagaagaaagtccacaattctgtgcagcctacaatcacaagagacagggctgaggagttcactctagctgagcttgcggcagccaccgacaatttctcacatgaaaacaagattggtgctggaagctttggtgttgtgtacaaagggaaactcacggatggtcgcgaggtggcaatcaagaggggtgaaaccgggtccaagatgaagaagtttcaagagaaagagagtgcatttgagtctgaattggccttcttgtcgcgtctgcaccataagcacttggttgggctggttgggttctgtgaagagaaagatgagaggctcttggtgtatgagtacatgaagaatggggctttgtatgatcatttgcatgacaagaacaatgtggagaaggaaagcagtgtgttgaataattggaaaatgaggatcaaaattgctttggatgcttcccggggaatagaatatcttcacaattatgcagttccgtctattattcacagagatatcaagtcttccaacattcttctcgatgctacttggacggcaagagtatctgattttggattgtctttgatgagtccagaacctgaccgtgatcaccgaccaatgaaggcagcgggaaccgttggatacattgatcccgagtactatggtctaaatgtgttgacggcaaagagtgatgtgtatggtcttggagttgtattgcttgaacttttaacaggaaagagagctatattcaagtatggagaagatggaggcaccccattgagtgtggtggactttgcagtgccttctattttggccggagaattagtgaaacttttggatccaagggttgaaccacccaacgtgactgagtccgaggcagtggaattagtcgcctacacagccattcattgtgtgaatttggaagggaaagatagaccaaccatggctgacattgtgtccaatttggagagggctttggctatttgtgagagtagccatgacagcatttccagcggtactatctctgttgtttcagaatga

SEQ ID NO: 29 - DNA, 1320 bp, Glycine Max
atgaagaagctgtgtcccaatcttgatcgtgaggatgggctcgaaaccgtgcttgaggtccctatcccggaggagattctcacccacaagagtggaaccaccaaagcttggcacaacatgaagaattggatgaaaccacacgctgaatcgagatcaaattcagcttccatggcagcagttttcggagggaaaaacactgagattcagcttttgttaggcgttgttggagcgccgttaattccttcacctatcgcccctgacaaccaacccatcactcgcagcattaaagaccaacacattgaggtttcaatggctaaatacatagtgaagcagtacgtggcagcggtgggaggagagcgtgctttgaatagtgtggacagcatgtatgctatggggcaggtgaagatggcagcatcagagttttcagcaggggaagggagtgtgaatagtaagaagatggtgaaggtgaagaacttgcagatgaagggggaggtggggggttttgtggtgtggcagaagaggccagagttgtggtgtttagagcttgtggtttctggctacaagatcactgccgggagtgatggtaaagtggcatggaggcaaaccccttggcatcattctcatgcctctcgaggcccaccaagacctctcagacgtttcttacagggtcttgatccaaggtccactgctaatctgttcagcaactccatatgcattggagagaagacagtgaacaacgaggactgcttcatactgaaactcgaagcggagtcgtccacactgcgagcaaggagcaacagcaacgtagagatagttcgccacacggtgtggggctacttcagccaaagaacgggcttattagtgcaactagaagactcacacttgctcaaacttaagtctcacgaaagcgagagcatatactgggaaaccaacatggagtccctaatccaagactacagaagcgtggatgggatccaagtagcacacgctgggaagacacgggtgtccttgttcaggtttggtgggggacccgagacacattccaggacgagaatggaagaggtttggcaagttgaggaagtggactttaacgttaaagggttgtccatagactgttttttgcctcctagtgatttgaagagagaggaagaagagaatgaagaatcatgtggtggtggggtggttgcaagcaataataataataatgccaagttgccctacaagattcgttcggcttcttttaggattagtgcttccaaagtagctgctgtgaacttggatgattcttgtaccagcagcgagagtgatgaagatttgtaa

SEQ ID NO: 30 - DNA, 1758 bp, Glycine Max
atgaagcaggaaatggagaagagaaagggaggtagaattgaagaaagtgatgaagagaaatgggtccatgatgcatctgtggattacaagggaagaatccctctccgtgcttccacgggtgtatggaaagcttcgctttttgtccttgcaattgaatttagtgaaaggatagcccactttgggatatccagtaatcttatcatgtatctgactgaagtgatgcatgaagacctaaagacagcaaccaataatgcaaacttgtggaaaggagcaacaaccttgttgcctatgattgggggatttcttggtgatgcctacaccggtcgatttcgtatggtagtcttttcttccctcgtatacttcaagggattaagcctcttgaccatgtctcaattcattccaaatctaaaaccatgcaacaatgatatatgtcatcagccaagaaaggttcatgaagtggttttcttccttgctctttactgtatcgccttgggaactggaggattcaaaccatgcttagaaagttttggaggtgatcaatttgatggtgacaaccttgaagaacgaaagaagaagatgtctttcttcaactggtggacctttacattcagcattgctttgttgctagcgacaacggtggttgtttatgttcaggacttcgttagctggggagttgcttatctcatcctcgctatgttcatggctctcactatcattgctttctatgtggggatacctttttacaggtacagaatgaggccaaacgcaaatcctttcataccaattctacaagtcctaattgcatccataaggaaaaggaatttgtcttgtccttcaaatcctgctttattatgtgaagtcccaatgtcagagaattcccaaggaaggcttctaaaccatactagcaggctcaggtttcttgacaaggctgcaatagttgaagaaaagtatattgagaagaaagctggcccatggagattagcaacagtgacaagagtggaggagacaaagcttattctaaatgttgttccgatatggctaacttcattaatgattggtgtatgcatagcacaaggttcgacactctttgtcaaacaagcagctgctatgaacttaaagataagcgacaacttcaaaattccaccagcttccatggcgtccctttcagcctttagcaccataatatctgtcccaatatatgatagaattattgttccaattctaaggaaagtcagaggtaacgaaagaggcatcagcatccttgggaggattggcattggcttaatattcttagtcatactcatggttgttgctgccttagtagaaaatatgagattaagaatgcctggtcatgagacaatgagtgtgatgtggttgataccccaatacttgatccttggcattggaaattcattttatctaattgctttgcaagagtatttctatgatgaagttcctgactcaatgagaagcgtaggaatggctttgtatcttagtgtgattggaataggattcttcttaagcagctttctaataataattgtggaccatgtcacagggaagaatggcaaaggttggattgccaaggatgtaaactcaagtcgtctagataagttttattggatgttggctgtcataagtgctttaaatttgtgtctcttcctattcttggcaaagaggtttacttataagaccgcacggaggaaagctacggaaattgattgttctaactgtgatggggtggatacagtggcatga

SEQ ID NO: 31 - DNA, 2244 bp, Glycine Max
atgaagccccacactccggcttcttctttcgtcactcgtctcccgcacgtgccttacttccgcggcgccactgccgcacgtgccgcgccatcggaccctcctcatgacgcccccggaggcctcgaattccgccgcgtctcgaccgccaaacgccgccgcgtcagcctttccgtctgccacgcgagtcgcgtcaccgccgcctcgaatcccggtggttccgacggcgacggcgatactcgagctcggagcagccggcgcggcgtgctgatggcgccgttcttagtcgccggcgcatcaatcctgctctcggcggcgacggcgagggcggaggagaaggcagcggaatctcctctggcttcggcgccgaagccggaggagccgccgaagaagaaggaggaggaggaagtgataacttcgaggatttacgacgcgacggtgataggagaaccgttggcgatagggaaagagaaagggaaagtgtgggagaagttgatgaatgctcgagtggtgtatttaggtgaagcagagcaagttccggttcgagacgatagggaattggagcttgagattgtgaagaatttgcataggcgctgtttggagaaggaaaaactattgtctctggcgcttgaagtttttcccgctaatcttcaggaaccgctcaatcagtatatggataagaagatagatggagacaccttgaagtcttacacgttgcattggccgcctcaaagatggcaggagtatgaacctattctgagctactgtcgcgaaaatggaattcatcttgttgcttgtggtacaccactgaagatcttaagaactgtccaagcagaaggaattcgtgggcttacaaaggatgaacgtaaactatatgcacctccagctggttcaggcttcatatctggctttacttctatctcacgcagatcttctgttgatagtactcaaaatctgtctattccttttggtccaagctcatacctttctgcacaggctcgagtagttgatgagtattctatgtcccagattatcttacaaaatgtgcttgatggaggggtcactggtatgttaatagttgtcactggtgcaagccatgttacatatggatctagaggaactggagtgccagcaagaatttcaggaaaaatacaaaagaaaaaccatgcagttatattacttgaccctgaaagacaattcattcgcagagaaggagaagttcctgttgctgattttttgtggtattctgctgcgagaccctgtagtagaaattgctttgaccgtgctgagattgctcgggttatgaatgctgctgggcggaggcgagatgccctcccacaggatcttcaaaagggaattgatcttggtttagtatcaccagaggtattgcagaacttctttgatctggagcagtatcctctaatttcagagctcactcaccgtttccagggattcagggaaagattgttggcagatcccaaattcttgcacagattagccatagaagaagctatatcaataacaactacattattggcccagtatgaaaagcggaaagaaaattttttccaagagattgactatgttattacggacactgtcagaggatcagttgttgatttctttacagtgtggcttcctgcaccaactttgtcattcctttcatatgctgatgagatgaaagcacccgacaacattggttctctaatgggacttcttggctccatcccggacaatgcatttcaaaagaatcctgcagggataaactggaatctcaatcataggattgcatcagttgtatttggtggtttaaaacttgctagtgttggatttatttcaagcataggagctgtggcttcatcaaattctctatatgcaattcgtaaagtccttaatccagcagttgtcactgaacaacggattatgaggtccccaatactcaaaactgcatttatatatgcatgctttcttggaatatctgcaaatctccgttatcagataattgctgggatagtggagcatcggatttctgaacagtttgcttctcaaacattctttgtaaatatgctttcttttgtagcacggacagtcaattcatattggggaacccagcaatggattgacctagcgcgctttactggcctacaagttagaaagacagagccatcagcatcagatcctccgaatcctgctgcaattttatgcaacgaaacagaagaagccagcattgatgagagagaaaaataa

SEQ ID NO: 32 - DNA, 1086 bp, Glycine Max
atgaaggcactaattcttgttggagggtttggaacaaggttgaggccattgacactcagtgttcccaagcctcttgttgattttgctaacaagcccatgattctgcatcagatagaagctctcaaggccattggcgtcaatgaagtggtactagctatcaattaccaaccagaggtcatgttgaatttcttgaaggagtttgaggcaaaacttggtatcaaaatcacttgttctcaagaaactgaaccgctaggtactgcaggccccttggctcttgcgagggataagctaatagatgactctggagagccattttttgttctcaacagtgatgttatcagtgagtacccacttaaagaaatgattgaattccacaaaacccatggaggagaggctaccataatggtgacaaaggtcgatgagccatcaaaatatggtgtggttgtgatggaggagactaccgggcaggttgagagatttgtagagaaaccaaagttgtttgttggcaacaaaatcaatgctggaatctacctattgaacccctcagttttggatcgaattgaactgaggcccacttctatcgagaaagaggtgtttccaaagattgcagcagagaaaaagctatatgcaatggtcctgccaggattctggatggacattggacaaccaaaggactatatttctggcctgacactttacctggactcgctgaggaaaaagtctccttctaaactggccagtggtcctcactttgtggggaatgtcattgtgcatgaaactgccactattggcgagggatgtctcgttggacctgatgttgcaatcggtcctggctgtgttgttgagtcaggtgtcaggctttcacgctgcacagttatgcgaggagttcggattaaaaagcatacttgcatatctaacagtatcattgggtggcattccactgttgggcaatgggcccgtgtggagaatatgactatccttggagaagatgtccatgtttgtgatgaagtttatagcaatggtggtgtagttttgccccacaaggagatcaagtcaaacattctaaagccagagattgtcatgtga

SEQ ID NO: 33 - DNA, 540 bp, Glycine Max
atgaagggttatgagccccgttcaagctcttcatgtgcagcttgcaagctattgaagagaagatgcataccaaattgtatttttgcaccttactttaggtctgatgagtgcaagaagtttgcaaaggtgcacaaggtgtttggagccagcaatgtgagcaagattctgattgaagtgccagaagagcagagagaggacacggtgaattctctggcttatgaggctgaggcaaggctgagagacccggtttatggatgcattggtgccatagctctgttgcaaaggaagatggtggagcttcaacatgatctggcaattgcaaaggatcgtcttgcgcgttgtcacgctgctgctgctgctgctactactactatcccttctcctgatatcttgcatgccaatgttagccttcccccattccctgacttttgcacttcttcaagtgatttcaatgatatcttttgccacagttcttcgtctcaattattaggccgacatgaaacggtggatgatttcaatcaaatcccatatatattttga

SEQ ID NO: 34 - DNA, 924 bp, Glycine Max
atgaagggttcgaacaaccggttcttcacggtggcgctggtggcggcgtggtactcctcaaacattggggtgcttctcctgaacaagtacttgctcagcaactacggcttcaagtacccaatcttcctcaccatgtgccacatgacggcgtgctccttgctcagttacgtcgccatagcgtggatgaaggtcgtgcctttgcagagcattcgatccagggtgcaattcttcaagatctctgctctcagcctcgttttctgcgtctccgtcgtgttcgggaacatttccttgcgctacctccccgtgtcgtttaaccaggctattggcgccaccacgcccttcttcaccgccgttttcgcttaccttatgaccttcaagagggaggcttggctcacttacctcacccttgttcctgttgttactggagtcatcattgccagtgggggggaaccgagtttccatctgtttggatttattatatgtgttgcggctacagctgcaagggctctgaaatcagtgctacaagggattttgctttcttctgaaggggagaagctgaattctatgaaccttctcctttacatgtctccaatggctgtggttttccttcttcctgcaacacttataatggaagagaatgtggttggcatcacgttggctcttgccagagatgattccaagatcatttggtatctgctgtttaattcagcacttgcatattttgtcaacctgaccaactttttggtcacgaaacataccagtgctctaacccttcaggtactaggaaatgctaaaggggcggtagcagtagtagtttctattctaatattcagaaacccagtgtcagtcactggaatgatgggttactcactcacagtctttggagttatactctacagtgaagccaaaaagagaagcaagtga

SEQ ID NO: 35 - DNA, 1806 bp, Glycine Max
atgaatcggagtttcagggctcaggaatcgcaaatgctcgctgctttaaagcagagggagcagcaatttgggggtttgagggcttccgtgatgaaggagaaggaggaggaactcgcattgtttctggagatgaagaagcgcgagaaagagcgcaatgaccttcttcttaacagctccgaggagttcgatgcacctctcgggtcaaatgggggtgctaatcccatttttaacatttcgtcttctacgccggctcctgtacggaagactggcgttgatgattttctcaattcagaaaatgataagaatgactatgactggcttctaacgcctcctggtactcctctttttccttctttggaaatggaaagtcgaaagactgttatgagtcagcttggtactccaaccacacgtcctgtagcattaaaatccaggttggcaaatcatcaatcagagcctgctgggaggactaatttagtatctaaacaacctacttcctctcctgggttgagctcttcaagtggtgggactaggaggccttcatcatcagggggtccaggatcacgacctgcaacacctactggacgtcctacattgactacatcttcaaaatcatcaagaccttcaacacctacattaactgcagcttcgaaatcatcacgatctgcaactcctactaggtccatggtaacatccaagaccacaacttccacaatcaaaccggcagtttctgctactaagcatttggcttctgccactaagactccggtccctgcaactaaaccagcaattccatcaagatcctctacacctttgtcaagatctgctgcaagatcttcaactccaactagcaggcctactttacctccttccaggcccacatcaagagcaactactccaacccggcgaccgtctttatcatcgaatgaacccagtatatatgcttcttcagttaaagcttcttcaagccccaagccagcttctgtgacatcaaggcagccaactcctgtgacagtaagaaagcaagctcctgtgaactcaaggcagccagcatcaccatcacgtggcacttcaccaacagtgagatcaagaccatggaagccatctgagatgccaggtttttcacttgatgccccacctaatttgagaacaacattacctgacaggccactgtcagcaactaggggcaggcctggagcacccacttcccggtcttcatctgtcgagccttcttctagtggaagacccaggcgacaatcatgctcaccttcaagaggacgggcttccaatggcagtgttcatatcagtggaaactctatgccggcagttagccgggggcactccaaagtaaatgacaatgtcagtcccgttgtaatgggcaccaaaatggttgagagggtaataaatatgcgaaaactagtgcctccaatgattgaagacaaaaactctccccgtagtaatctgtctggcaagtcagcttcatctccagatagctcaggttttggaagaacactttcaaagaagtccttggatatggctattaggcatatggatatacggagaaccattcctggcaatttacggcctttgatgacaaatattccagcatcttctttgtatagcgtgaggtctggatctcatcacggccgaacaattagtgtttcaggctctcctcatgccacaagcagtaatgctagttctgaactgagcgtaaaccaaaatggcatttgtttagatagcagtgaggtagatgatgatattggcagtgagagatgtggtcaatcccctgccagtgtacggggtaggtaa

SEQ ID NO: 36 - DNA, 2634 bp, Glycine Max
atgacatcaccatggaataagattcacattcaccactctcatccttccccttccccgtcaccgccaccgccaccgccaccgctactctccgactccgactccgacggcggcgattcctcttcctccgcccccctccgccactcggacctctccgactccatctttaagccctacctcgaactctccggccactccggcaccgacctctcgaagatccaatccttcctaacctcttcctccgccggcgccctctcgtgcctgatctgcctcgaacgcatcaaaccctccgacgccacctggtcctgctcctccctctgcttcgccgtcttccacctcttctgcatccagagctgggcccggcaggcctccgacctcgctgccgcacgcgccgtcacacgcctctccatctcctccgccagcgcctccgacacggccctctggaactgccccaaatgcagatcggaatacaacaaatcacacattcccaaaacctacttttgcttctgcggcaaaatagagaaccctcccaatgatccatggattttacctcactcttgcggcgaggtttgtggaagacagctgaagcacaattgcggccaccattgtttgcttctctgccaccccgggccgtgcccctcttgccccaaactggttaaagttcgatgcttttgcgggtgccttgaagatgttcgacgatgtggcttcaaggagttttcatgtaataaaccctgttccaagtttttggattgtggggttcaccgttgcattgaactttgccaccctggcgcttgccctccttgccggacacgtggcgtgtacacgtgccggtgtgggaaggtcaaggaggagagggagtgctttgatcgtggttttcagtgtgagaatccgtgtgagaagaggcttggctgtgggaagcatgtttgtgagagagggtgccattctggtgagtgtggtgagtgtccccttaaggggaagagaacgtgcccttgtgggaaaagggtttatgaaggaatgccttgtgatgctcctctgcagctttgtggggctacctgtgataagatgttgccctgtggctaccacaggtgccctgagcggtgccaccgtgggcagtgcgttgagacttgcagggttgttgtgaagaagtcttgtcgatgcgggagcctcaagaaagatgttccttgctatcaagatttggcgtgcgaaaggaagtgtcagaggatgcgtgactgcggtcgacatgcttgtaagcgccgctgctgtgatggggattgccctccttgctctgagatatgcggcaggaagcttcgatgtaagaaccataaatgtccttctccatgccatagaggtccttgtgctccttgcccaataatggtgacaatttcatgtgcatgtggagagacacgttttgaggttccatgtggtactgaaatggaccaaaagcctcctagatgtcctaagccatgtcctatcactcctttatgccggcatgcatcaaatatcaagccacataaatgccattatggagcctgccatccttgtcgcctaccttgtgccgaagagtaccaatgtggtcatacatgcaaattaaggtgtcatggtgctaggcctcctcctaatccagagttttctcttaaaccaaagaaaaagaaggttatacaacaaagtgaaggtgttcctggcactccatgccctccttgcccagaacttgtgtggagatcatgtgttgggcaacacattggagctgagagaatgatggtctgctctgataaatcacagttctcctgtgaaaatttatgtggtaatcctctaccatgtgctaatcattattgtacaaaaacctgccatgccttggagaaccagttacaagggagcgaaccttgtgaagactgttatcttccttgccaaaaggaaagagagccagcatgtccacatcactgccctaggcgatgccatcctgaagactgtcctccatgcaaggtgctcattaaacggtcatgtcactgtggtgcgatggtccatgtgtttgagtgcctatattacaacagcttgtctgcaaagggtcaagagactgtccgttcatgtggtgggccatgtcacagaaagttgccaaattgtacacatctatgcccagagacatgtcatcctggtcaatgcctaaatgctgagaaatgctgtaaaaaggtcactgttcgatgcaaatgcaaaacattgaaaaaggagtgggtttgtcaagatgttcaagcagcatatcatcttgctggttgccatccaatggatattccaaaaattcaatttggagttggactcattccttgcaattctgattgtcagagtaaagtgcaggttgttgagtcagaactacagttacgtaaaactagagttacggaggtacaagagccagatgcagaaaaatcagttcggaagtggcgaaaaaggcgggaacaggttctagaatccaaggaagcatcaaaactacagaaaattatttccagaatgaagcggtttcttctatttgtctttattttggtcatacttcttgctgctacatattatgggtacaagggacttttatggctcaatgattggatgaatgaagtggacgaacgaagacaaatatattctcgaatcaaatga

SEQ ID NO: 37 - DNA, 756 bp, Glycine Max
atgaccatatctttaaaccccatcgtgagcttcagctcaacgaagttggaaacaaagtatcaggatgcatcaagatattctgttggagcttctttaccaaaggcaactcagtttacacctttgttgatagtgtctagatcgagaaagcttgtcaaggaaagaagatttggtcattgcttttcagtggcagatagtgatcagcttgccgcagacaacagtagcagtaaggattttgacaatgttgaaagttcagcaaccaatgatcagttagcattcatgaatcctccagatgaaaatttccaattgcaaactgaagtaaatgctgagtcaggatctccaacattagaggcttccaatggttcaattaaccaagagcaagggtcagaagcatctcctaagtcacaatctgcaaccaaacgacctaacctgactgcaagagagaggttaaaggcagctcgatccctcaaccgatacgccgaatcaaaagcatctaaacaagacctgagcagcagggtgttggaggcttcaaaacaaagtgacaaagggtcagggaagaaaaaatctggacttccggaggcccctactaatctgtttgatgatagcaaacgagggttatcaacaggcttcactttccaatttcctggaggttctgatctctttttcattatcttctcatttgtttttatcagcacagtgatgtttgcaacaacttacattgtgtggaaagttggtgcaatccatttcaatgagtactga

SEQ ID NO: 38 - DNA, 849 bp, Glycine Max
atgacgacaatggtggctcaacgcatcatcatcgtcactttcttcacgcttcttcttcttcaacacctaaccttcgccaccgctactgcactttgccaattctcttttctcgacggaaacacgctctacaattacaccctctcttctcccattcgcaacttccctcacggcatcctcagcgaagatggattttacaaagtggcagtaaatgataccacactttggtttcagctttgcgatggaatgattttcaatcacgatcctccaatatgtgctgactgctgggattgtggagggccaaaacattgtgggatgaagtgcaatgcacttgtggcaaacaacgttggaggttatcatgtatgcacagccataggacgtggccctaaaatagatgttgatattattgataagaaaaacccccacactggtgtcattgttaaaatgtcaaacagtggccctaagtacaactgttcgctagctgtgtctgttctttgcaatttaaatggagtgcaaggaccgcaagctctggagagattaggggcctgtgattatgttactgagctaaagcacccatctggctgtgccatcattataaatgttcatggaggagggtgggggtggtttggcaccttactgatcattgttttgtgcctttttgctgcatatctcttggctggtatagtttaccgatttttcttcctcgggattcgtggtatagatattatccctaaccttgacttctgggttagcttgcctaggagaacacagagtctgtgtacatctttggtgaggaagtttaagggaccgtctgaaggttaccggagctcttattctcctgtgaacttctga

SEQ ID NO: 39 - DNA, 1773 bp, Glycine Max
atgacggaggaacggaacgtgcggaagacacgtgtggtcgacgtggtcctcgactgcgtcatcccttacatcgacgaccccaaggaccgcgacgccgtttcccaggtgtgtcgacgctggtacgagctcgactcgctcacccgcaagcacgtcaccatcgcgctctgctacaccaccaccccggctcgcctccgccgccgcttcccgcacctcgagtcgctcaagctcaagggcaagccccgagccgcaatgttcaacttgatacccgaggattggggcggacacgtcactccctgggtcaaagagatttctcagtacttcgattgcctcaagagcctccacttccgccgcatgattgtcaaggattccgatcttcagaatctcgctcgtgaccgcggtcacgtgcttcacgctctcaagcttgacaagtgctccggtttcaccaccgatggtcttttccatatcggtcgcttttgcaggagtttaagagtcttgtttttggaggaaagctcaattcttgagaaggacggagaatggctacacgagcttgctttgaataatacagttcttgagactctcaatttttacttgacagacattgctgttgtgaagattgaggaccttgaacttttagctaaaaattgccccaacttagtgtctgtgaaacttactgactgtgaaatactggatcttgtgaacttctttaagcatgcctctgcgctggaagagttttgtggaggcacctacaacgaggaaccagaaagatactctgctatatcattaccagcaaagttatgtcgattgggtttaacatatattggaaagaatgagttgcccattgtgttcatgtttgcagccgtactaaaaaaattggatctcctctatgcaatgctagacacggaggatcattgtatgttaatccaaaggtgtccaaatctggaagtccttgagacaaggaatgtaattggagatagagggttagaggttcttggtcgttgttgtaagaggctaaaaaggcttaggattgaaaggggcgatgatgatcaaggaatggaggatgaagaaggtactgtgtcccatagagggctaatagccttgtcacagggctgttcagagcttgaatacatggctgtttatgtgtctgatattacaaatgcatctctggaacatattggaactcacttgaagaacctctgtgattttcgccttgtgttgcttgaccatgaagagaagataactgatttgccacttgacaatggggtgagggctctactgaggggctgtgacaagctgaggagatttgctctatatctcaggcgtggcgggttgactgatgtaggccttggttacattggacaatacagtccaaatgtgagatggatgctgcttggttatgtgggggagtctgatgcagggcttttggagttcgctaaggggtgtcctagtcttcagaaacttgaaatgagagggtgtttatttttcagtgaacgtgcacttgctgtggctgcaacacaattgacttctcttaggtacttgtgggtgcaaggttatggtgtatctccatctggacgtgatcttttggtaatggctcgacccttttggaacattgagttgattccttctagaaaggtggctacgaataccaatccagatgagactgtagttgttgagcatcctgctcatattcttgcatattattctcttgcagggcagagatcagattttccagatactgttgtgcctttggacactgccacatgcgttgatacctag

SEQ ID NO: 40 - DNA, 900 bp, Glycine Max
atgacgtcatcgcgtccccctccgtcgaaatccgtggatctggacctaacaatcgtgtcggcgaagcacctgaagaacgtgaactggaagaacggcaatctgaaaccctacgtggttttctgggtggacccggagcggcgcctcgccacgaaatccgacgactccggcaacacctcccccgtctggaacgagcgtttcgccctccctctccctctccccctccacgactccttcctcaccctcgagatctttcactccaaaccctccgacacccccaaacccctcgtcgccaccctccgcctccccctcaaagacctccacgacctccacgactccacgcgcctccgcaagttccccctctctcgcccctctggccgcccccacggcaagatccacctcaaactcggcctcctcggccgcccccaattcgattacgcctcccccaaccctaaccctaaccctaaccctagtcctaatttcgtctgctacagaggatacaccccttccccttcccattcccattctcactccccttctccaccaccttctccttacacctcttacaccgactcctattctggttactaccccggttactattctggcgcacctccccctccccctcctagacccttcttcgaccgttacgctgggtctagtgggccttctgctccgcttgattactcctccacttatgactccaagcccaaggctcccaaaatgggcctcggcgctggcctcgccgttggcgctgttgctggggctctcggcgggcttgctctcgaagaggggcttaattacgaagaggacaaaatcgcggagagggttgagaacgacgtcactgctgctaatgttgctgctgcgcgcgacaattacagcgattaccgagtggattattga

SEQ ID NO: 41 - DNA, 1509 bp, Glycine Max
atgactgcaagcgcagagagaagaatgaacaactctattatggcttttgttctgctaatattactttcggcgttacgctactcaagcgccgaacaagctttcgatgttcgcaaacatctttccactgtctccagatatggagttgtgaaagacatcgctgacactaacttcgtgccttctaaaatccccgagggatgtgttccgatccatttgaatctcgtggcgaggcatggaactcgatctcctacaaagaaaaggataaaggagttagataatttgtcagagcgtctggaagttcttgtaagggattcaaaagagcgaaatttgcctttccagagagttccttcctggctaaatggatggaaatctccttggcatggaaggcgtaagggcggtgaactaattaccaaaggagaggaagaattatatgatcttggaatcagaattagagaaaactttccaaatttgtttgatgaggaataccatccagacatatatcctattaaggcaactcaggttccccgggcatctgctagtgcagtcgcatttggaatggggcttttcagtggaaatggaagtcttggacctgggcatcaccgagcctttgctgttacaagcgaaagccgtgctagcgacattgtgctgagatttcatgattgctgtcataattacaaggcttatcggaaaagccaggaatctgcagttagtaaacttaaggaacctatcttggatgagattacatctgccttaattgggcgccatgggctgaattttacgaggcaggatacatcttctctctggtttttgtgtaagcaggaagcatccttgttggatataactaatcaagcgtgtagtcttttcagccctcttgagattgaattgctggagtggacagatgatttggaggtgtttattttgaagggttatggtaaatcactaaactatagaatgggactgccattacttgaagatgttgttcaatccatggaacaggctatcatggctgaagaagaaagacatgttcctggaagctttgaaaaggcaagacttcggtttgcgcacgctgaaactgtagttccattctcatgcctgcttggtttatttcttgaaggatctgagttaaaaaaaattcagaaggagcaacctttgcagcaccctccgaagcctccacagaaaagaaaatggcggggtagcactgtggccccttttgctggtaacaacatgttgatcttgtatagttgtcctgctccagacaaatctaccagcaagcactttgtacaagtgttacacaacgaacaccctgttccattgccaggttgtgatggctccgatttctgtccatttgaagtattcaaggaaaaaatagttgcacctcatcagaagcatgattaccatacagtctgtaatgaaaagctagagcaggagccctcgggcaacaaggtttttcaaatatttcagtggcttttctcaccaaggaaaggtgataagtaccctaaaaatgaactttag

SEQ ID NO: 42 - DNA, 2526 bp, Glycine Max
atgagaatcacgttggagccgagctcggagccgagcccaagccgctcccaaactcccaaagaagaactccagtgggtcccacttcccaaacaccctctcttcaccgctcacggcggtgccaccaccgccgctgattcccggaacctccttgcctgggacggagcctcgcgcctctacttatgggactcaaacaaccgctgcctccaccgcctctctctccgtctcggcgaccccgatccctcttccgtcctcgccgcttctccctctaaggtgttgcaagcggacgcggtgcttgatttcgatgtccgcaaaatctcaatcaacaggaacagaacagcgatactccttttcggttccgagacactctctgttatgtacctctacggacgcgcctctaagaaggacgtgaacttgatttgcaggactattactgttggttctcagatgtattccaccggtggcaatgatattcgtgtgctacaagcattatggtacccttacagtgatactcatttgggaatcctttcttctgactccgttttccgacttttcaactttgccgtggatcctttgcaacctgagcaagaatattatttacagcctgttgagcctggtagatctagaaatgcctcatcattgtgtccagttgatttttcttttgggggagaccacttatgggaccggttcagtgtttttattttgtttatggggctttctatgtactttgcccagttgttccatttggaagatttctttactacattgatgtcttggccatttgtaatgatcgttggtttcatgccagatgcagttattttctttaaagttctcttcaaatgtgagtctttggtagaaatattcaatgatgctcacacatttggaataatatcaatcaactctgttgcggcaagtaattcaaagttggccatctcctggagacggcctgtctttgctaaagctcatgcttatgctttatttgatgcacctcttgtcttgcagggacctctgcgaagagtaggtcagggtgggaatgaagattcagttggtcgtagtgcagaatgtgaaggtcgtgcagttagttttctctacaatttagtcagcaaagactctattttggtgactgcctggagtggggggaaattacagattgatgctctagccgatgagatccaacctgtctggagtgttggtagtccacctcgtcttcgtgttgattcccatgaccaaattcttggccttgctatgatttgtgagtcaattgccagcagcagtttgtggaagcttgatcataatgcctggttgggtaattcaccccctttgctgagactggctattgttgatttggctctgccacaaagagcagaaagtggttatattatttcattgttcattgatacacttatgccagaaagaatatattcccttcatgacggaaggattgactcaatagttttacattttcttccatttacaagtcagacaaatggcaaggatgatacaatgaaaacaccatctgtgcaccctgttctaaatacttgccagagtggattcacctcagaaccgtcactttgtggctttgtgtcattatcagattcatttggatattcatggattgtagctattactctttctctagagtgtgttgtgcttgagatgaaaagctggaacctcttgcttccagtaagcattgatatggagaagaaaaccatttcatcagagggggaaccaaaagagagagatataccaacaataattagcaaggaactacttagagggaccagggaggtacttgttcctcaggcctctccaagtttacaatctgttgcagctgattcaattgaaggtcgatcaacattacatcagtatttcaagctgtttcatgaaacctatgtggagtatgcacataaggtgtacctggagctcaagcatcacgcacctcagttgaagaaaatcattaatgaccaacattctcgattaggtgatgcacaaaagaaacttttgaaaattgaggagcaagaggctatattaccgaaaaggatagatcgtgcaattcaaactcaattctttggaagagcgcttgcaacatttaaggaacttaccttatgctcacaaaaaaccactgtccagagcagagcgacatttctgagaaagttagatgagagttatgtaagtcaactgcacaggttgattttagcttataagagaagctcaattcattttactttcttattttcttctcttgcaaaccattttaaggaagttgagttggatgctttgcattcttctgttgatgcgctaagtgcaaggctgagaaggcacttgcaagcttcaaaagctaatcaccaacaacagaaaacaccagggaagaaaagttgtgcaggagatgatcagatgtccatgctcaaatcatcgcttgaaaaactttcacttgtaaatactgaaaattcaaagaaagttaaacttgtggagtctacattgagaaacaaagaaagaagcagcagagaatcaagcctgcctattctctaa

SEQ ID NO: 43 - DNA, 1935 bp, Glycine Max
atgagcaaaaactggaaatctagctgcttcagggatcctgggggagttctcttccttctggcgttgtgtttattgtttcagaactttagtttgtgctgctctttgaatgaagaaggtaaagctcttttgaagttcaagcatggaatagtaaacgacccttttgatgctttgtccaattgggttaatgatgaagtagcagttaacccctgtaattggtttggagttgagtgttctgatggaagagtagtggtctggaatttgaaagacctttgtcttgaaggaaatctggtacctgagcttgcaaaccttgttcacataaagtccagaattttgcggaacaattctttttatggaatcatccctgaaggaattgcacacttgaatgaattggaggttttggatttgggctacaacaacttcagtggaccactacctagagatcttgggaataatatttcgttaacaatccgtttgctggacaacaatgatcatctttgtggtttctctcctgaaattaatgaattgaagatgctttctgaatatcaagtagatgaaaaccaactaatccgtgcagaaaaagtgccagcttgtagaagatccatcaaacagcaatcaaggcatgttggccaaaataaaaatggtgttcagaggctactgcaaactcgtactcacgaaggtggaagtccttttaatcgtgtttttcctgttagtcctgctccatttccttcagctcccccacctgccccagcaacgccaccagtggttcagaagccagctcctgttgaccgaaataattctgcttctccttctcccctgcctggaccacgatctgcaccgctatataaaagtagctcatcaaagaaccatgtagttgttattttggctggagttatgggtggtgctgtatttcttctcatttcaatcattggcctatatctctgtaaaacaaacaaggtagctactgtaaaaccttgggccacaggattaagcggacagcttcagaacgcatttgtaacaggtgtgccaaagctaaagagatcagagcttgaagcagcatgtgaagattttagtaatgtaattggtacttcatccattggtacagtgtacaaagggactttatctagtggtgttgaaatagctgtggcatctgttgcagcgacatcatccaaagattggtcaaagactttagaagcccaatttaggaacaagatagatacattatcaaaagtgaaccacaagaattttgtaaatcttcttggacattgtgaagaagatgagcctttcaccagaatggtggtttttgagtatgccccgaatggaacactctttgagcatttacacataaaagaatctgagcacttggattggggaacaagacttagaattgccatgggcatggcttactgcctacaacatatgcaccagttggagcctcctttggtccttagcaacctgaattcttcagctgtccaactcactgatgattatgctgccaaaatctctgatttgagtttcttaaatgaaatagcttcagctgtgataaaatctcctgctagaaaaaacactgacatgacaccagcaagtaacatttacagctttggtgttatattatttgaaatggtaactggcagactcccttattcagtggacaatgatggctcacttgatgactgggcttcacactatttacaaggggatcagcccctcaaagaaatggtggatccgactctagcatccttccaagaagaacaactagaacaagtcgatgctttgattaaatcttgtgtccatcctgatcaaaagcaaagaccaacaatgaaagaagtttgtgtgagattaagagagataacaaaaataacacctgatgcagctgttccaaagctttctccactttggtgggcagagcttgagattgcttctgtaaatgcaagctga

SEQ ID NO: 44 - DNA, 321 bp, Glycine Max
atgagcaagttcgtggggttgcttttgctgcttttgatcactgtggccattgctgaatacgatcaccatcctgaacatgagaaacatggtccatgtgggaagttcagcacacaaagaatgttgacacataagcttcgccactgcgaaaaggctgcacgaagcataagggctcctgtttcttcacaatgctgcaaagacctcgctaaggtcagcatcccttgcttgcatgctgtcttctcttccgatgccttcaagaaagttggtgttgatcccaaaatcgcaatcaccattccccatcgttgccattttgccaagccataa

SEQ ID NO: 45 - DNA, 333 bp, Glycine Max
atgagcaagttcgttggtgtgttcctgctgcttttgatcactgtgaccgttgctgaatacgaccacagttatcctgaacatgaaaacgagaaaaatggtccatgcggcaagtttagcacacttagaattttgacgcataaactgcgtcactgcgaaaaggctgcacgaaatgcatgggctcctgtttcttcacagtgctgcaatgaccttgtagaagtaagcatcccttgcctctatgctgttttctcctccgatgctttcaagagagttggtgttgatcccagagtcgcaatcaccattccccatcgttgccatttctccaacaagccatag

SEQ ID NO: 46 - DNA, 333 bp, Glycine Max
atgagcaagttcgttggtgtgttcctgctgcttttgatcactgtgaccgttgctgaatacgaccacagttatcctgaacatgaaaacgagaaaaatggtccatgcggcaagtttagcacacttagaattttgacgcataaactgcgtcactgcgaaaaggctgcacgaaatgcatgggttcctgtttcttcacagtgctgcaatgaccttgtagaagtaagcatcccttgcctctatgctgttttctcctccgatgctttcaagagagttggtgttgatcccagagtcgcaatcaccattccccatcgttgccatttcgccaacaagccatag

SEQ ID NO: 47 - DNA, 333 bp, Glycine Max
atgagcaagttcgttggtgtgttcctgctgcttttgatcactgtgaccgttgctgaatacgaccacagttatcctgaacatgaaaacgagaaaaatggtccatgcggcaagtttggcacacttagaattttgacgcataaactgcgtcactgcgaaaaggctgcacgaaatgcatgggttcctgtttcttcacagtgctgcaatgaccttgtagaagtaagcatcccttgcctctatgctgttttctcctccgatgctttcaagagagttggtgttgatcccagagtcgcaatcaccattccccatcgttgccatttctccaacaagccatag

SEQ ID NO: 48 - DNA, 333 bp, Glycine Max
atgagcaagttcgttggtgtgttcctgctgcttttgatcactgtgaccgttgctgaatacgaccacagttatcctgaacatgaaaacgagaaaaatggtccatgcggtaagtttagcacacttagaattttgacgcataaactgcgtcactgcgaaaaggctgcacgaaatgcatgggctcctgtttcttcacagtgctgcaatgaccttgtagaagtaagcatcccttgcctctatgctgttttctcctccgatgctttcaagagagttggtgttgatcccagagtcgcaatcaccattccccatcgttgccatttcgccaacaagccatag

SEQ ID NO: 49 - DNA, 333 bp, Glycine Max
atgagcaagttcgttggtgtgttcctgctgcttttgatcactgtgaccgttgctgaatacgaccacggttatcctgaacatgaaaacgagaaaaatggtccatgcggcaagtttagcacacttagaattttgacgcataaactgcgtcactgcgaaaaggctgcacgaaatgcatgggctcctgtttcttcacagtgctgcaatgaccttgtagaagtaagcatcccttgcctctatgctgttttctcctccgatgctttcaagagagttggtgttgatcccagagtcgcaatcaccattccccatcgttgccatttctccaacaagccatag

SEQ ID NO: 50 - DNA, 1179 bp, Glycine Max
atgagcagcagtagtgctgcaccattttcacaactggaaacgtctccttctcctgtccagagtcttgcttcggcagtgcccagtgcaatgagcaggagtaaagctgcaccattttcacaactggaagtggtgcccaacgccactagacatgttcctgcacgattattcacctgggctgagcttaaagcagccaccaacaatttctcacctcacaaccggattcgtcattttggaacctttggctttgggtacagaggcaaactcgttgatggtcgtgaggtcgcaatcgttaagggaacccagtttggtaagtctgaatttgccatcttttcccgtttagaccataggaacttggttgggctggttgggtactgtgaaaacagagatgaaaggctgtcagtttacgagtatatgaagaatgggttgttgcgtgattgcttgcatgataagaacaatgtggacaaggatagcagtgtgttgaattcgtggaaaatgaggatcaagattgcttgggatgcttccttgggaatacaatatctgcataattatgcaaatccatctattattcacagggatatcaagtcttccaatattcttcttgatgccagttggacggctagagtatttgattttgaattgtcgttcatatgtccagaacctgacgatgaatacgatgagattataatgggaaccatgggatacatgtgccctgagtacatgactcgaggtgtgttgacagcaaagtgtgatgtgtacgggcttggagttgtattgcttgaacttttaacgggtaagagagctatactactcgagtctgaggaagatggacctccattttatttggtggactttgcagtgcctcctattttggctggagatttggtcgaaattttggattcaagggttggaccacccgatttgaaagaagcagaggcactgaagatcctggcccatacagctatacgttgtgtggaagaggaaccgaggcaaagaccaaccatgaatgacattgtggtcgatttggatcgggcttttgctatttgtggtagtagcctatatgatgagaacttttcctattccattgcattaccatcacatgagtccaatcatatgactccggatcctcttgatacggactcatgtgatattccaatctacgaagagaatacgaactcatga

SEQ ID NO: 51 - DNA, 1086 bp, Glycine Max
atgagtgacgccggcctctgccttccgccgcagttcctcgccggagacacccacagaaccctttcgaactccgatttcagcttcccttcggagttcccttacgagttccgagtgtcttctccgccctccacggagaccgagagcagcgacggcgaagaggacttcctcgccggcctcactcgccgactcagtcagacctcgcttcacgaagctcgcaagcagttctctactgtttcggagattccaaggaagacccgtcagggtttggtcggttcccctcagtcgacgctcgccggaatcggcagctggtccggtcggagcaccatttccggcgaaggaagccccaacgggtacacgcgtgtcccctcgccctcgacgatgccgtttgacgaaaacaacgacccctgggaagtgatttacgcagtagcaggacaaatcgcaaggatgaagataaacagcaacaaccaagttccaccacagtttgattttcacaacaatagagggttactcactcatcatcgccctaaccagagtttcaatcagcttaaccaagttgtgagagcaaagcaacagtgtggttcggtttggggaaggccaactaagccaaactatttggtgcagcagcaacaggttcaggttcaggttcagaacagagcgcgtgagtttggacacgatagtgtgaatgtgaaatgcactcgtccatctgcgtggccccctttgcaagttgagcaacagaataaccgggtacagcttggcggatcgcgggttgttatacccggtgggggtgggtcttctgtgaaaaaggggtgtggtggaactggggtgttcttgcctcgccattatgaaaccccttctgagccacctcgcaagaaaactggttgtgcgcctgttttgttaccagcaaaggtggttcatgctttgaacttgaatattgatgacttgaacgggactacccaaccgcgtttctcgaatgcttttgctgtagattatggtgcgattttagcgaggagaaacgcgcttctgatgcaacagcgagaagaggcagctaactatgaaattcgcctccctcaagagtggacttactga

SEQ ID NO: 52 - DNA, 2118 bp, Glycine Max
atgattccttggcttctgggagcagcctatataaatcgccaattcttaataaacgtccgacacatcctacgtttctttgttggagcaattcagatactgtacccattcgtgatcatgtccaaccccaaatcagagtcagtagtgtctgaaccctctgcttcggaaccttcaatacccatttcatatccaataaaaactcttgaggacttggagtctcgctcctatttcgagtcctttcactaccctttcaacaaagcttcttcttcggtcaacaattcttcttcttcttcgttgcccaacaggcgcagattgcttgtgtgccatgacatggctgggggctacttggatgataagtggattcaaggtggcactaaccctgatgcttatgccatctggcattggcatttgatcgatgtctttgtctacttttcacactccctcgttactcttcctcctccttcgtggaccaacgctgctcatcgccatggtgttaaggtgttggggactttcatcactgaatgggatgagggaaaggctgtctgtgatacactgctttcgacaaaggaaactgcacatatgtatgcagaacgtctggcagagcttgctgctgatctaggctttgatgggtggctaataaatatggaagtaaatttggatctcggtcaaatttctaatttgaaagagtttgtagagcacttatcgttgagaatgcattcttctgtgcctggatcattagtgatatggtatgacagtgttacacttgatggtaaattgaattggcaagatcaactaaatgaacataataagcccttctttgatatatgtgatggaatatttgtgaactatacatggaaggaagactatccaaggctctctgctgctgttgccagtgatcggaagtttgatgtgtacatgggcattgatgtatttggaaggaacacatatggtggtggacagtggaatgtaaatgttgctcttgatgtaataagaaagaatgatgtctctgctgcaatatttgctcctggctgggtctatgagacaaagcaaccaccaaattttgagactgctcagaatagttggtggggtcttgtggaaaagtcatggggaatactgcaaaaacttcctggagtactaccattctacactaattttgatcagggacgtggttatcatatttcagtcgatggcgataatgtatcagatgccacttggtgcaacatttcttgccaaggctttcagccactccttgagtcttctgatccaacaaattctattcaagtttctgtagacttgaaggaggcatcatatagtggaggaggaaacattacattcaaaggatcccttgaagagcaaacttactatgagagcaaaatctttcaaggagagtttcttctgaccaatttgcctatccactttatttattctgtgaaatctgatggcaattcttcattgggacttaagcttgagttcacttccggcgaccaaagagcatctgtgcttctcacatcccgggcagtgaatcgtttctcaagcaaattcagcaaagtaatcatgacacgtgagcacaagggattatcctctggatgggttataaatgaaggtgtagttgcaatgaatggatacactttaacagaaattcatgcagcgtgctatagatcaaatggcaacgatgaaactgtggcttccccatcagattattttgcacttcttggccatatcacaatcaagacttctgactataagtcagattttcctgtgtcttcttcctggctagttgatggcagctacataaaatggacatcagaccctctgggttcaaagacccttgatcttaaaatttcttggaaactaaaaaatggacagaattttctatttctgaagtacaacgtgtacttggtgaaattatcaaaacaagcagatggtaatccaggtacaacattagaggatgtgaaggagtaccttggagtagcacaagtaaactgtttttatgtttctgacctcgaagttccttctgacacttctagtctcaaatttataatacaagcctgcggtgtagatgggacatttcaagaattggatgagtctccatattatcaattggaggttgaagatccctaa

SEQ ID NO: 53 - DNA, 630 bp, Glycine Max
atgcaaaaaatgatgaagccaccttcaaactcttccttcccttcctttctcagagtgaagcctcgtctctcttcttacctcttcaccctcttagctttcattctcttcgctgccatcctctatggccatgacttcgtcttcatatttcgtccacacctctactccaacgagcacacagcacaaacactcttcttctccacacccgtcgatgtgagatctccaccaaccgaagaaaacaagacggtgttgacgaaaacgaaaagggaggaagaagaacaagagtgtgacgtgttcagcggaaggtgggtacgcgacgagttgactcggccactgtacgaggaatcggagtgtccgtacatacagccacaattaacatgtcaagaacacggtcggcccgaaaaggagtatcagcggtggcgatggcagcctcacggttgcaatcttcccacattcaatgccagattaatgttggaaaagcttcgtgggaagagaatgatatttattggagactccctcaaccgaagtcaatatgtctctttgatatgccttctccatcaaatcattcctgaaaatgccaaatccatggaaacctttgattcactcactgtctttacagcaaagggtaactga

SEQ ID NO: 54 - DNA, 291 bp, Glycine Max
atgcaagaaagaccacaattttttttgcaactacattatagcaattcacacaacacaacacaggcaaataatcttcaaccattcttctttttctttcttctttatctcaattgtttgtggttactgtgcagattaatggggaggttgtttgtggtgaatctggaagggaagatctatagctgcaaacactgccatacccatcttgcgctttacgatgacatctactccaggacattccattgcagacatgggaaagcttatctcttcaataagggaaccgtatttggatga

SEQ ID NO: 55 - DNA, 2136 bp, Glycine Max
atgcagagctacattgtctacactggcaatagcatgaatgatgaggcttctgcgttgactctttattcaagcatgctacaagaagttgcagacaggctacaatgtaactgcattacaccatcctcagtgggcaagcctattttttgcttgcaaagctttgttagcaatgctgagcccaagttagtacaacaccacttcaagcgtagtttcagtggctttgttgctatgctaacggaggaggaggccgatagaatggctagacatgatagagttgtagctgtctttcctaataaaaagaagcaactccatacaacaagatcatgggattttattggctttccactacaagcaaatagagcaccagctgaaagtgatgtcatcattgcagtacttgactctggaatttggcccgaatctgagagcttcaatgacaaaggattcggtccaccacctagtaaatggaagggcacctgccaaacttctaaaaatttcacatgcaataataaaatcattggggctaagatttacaaagctgatggattttttagcgatgatgatccaaaatctgtgagggatatagatggtcatggcactcatgtagcatcaacagcagctgggaacccagttagcacagctagcatgttaggccttggtcagggaacagcaagaggtggcgcgacaaaagcacgcattgctgtgtataaagtgtgttggtttgatggttgttctgatgcagacatacttgctgcatttgatgatgcaattgcagatggggttgacataataacagtttctcttggagggttcagtgatgaaagctactttagagatgtaatagccattggagcatttcatgctgtgagaaatggagcattaacagtaacttcagcaggaaacggtggtccaagaccttcctccctatccaacttttcgccttggtcaattactgtggctgctagtaccatagacaggaagtttgttaccaaggttgaattaggtaacaaaatcacctatgagggagaattgtatcctataatttatggtggagatgcaccaaacaaaggcgtaggcatagatggatcgtcatcaaggttttgcttcagcggttcgttggacaaaaagttagttcatggtaaaattgttctctgtgatagcagaagccaagtgtcaggcccttttgatgctggtgctgttggggcattggtacaaggtcaaggttttagagatattcctctctcttttccattgcctggatcttaccttgccttgcaggatggtgtctctgtatatgactacataaactctacaaggactccaactgcaaccatatttaagactgatgagacaaaagatacaatagctcctgttgtggcctctttctcttcaaggggcccaaacattgttacacctgaaattctcaagccggatttagtggctcccggagtttcgattctagctagttggtctccagtttcccctccttctgacattgaaggtgacaacagaacattgaatttcaatataatctcaggaacttcaatggcttgtccacatgtttctggagccgcagcgtatgttaaatcatttcatccaacatggtctcctgctgctattcgttcagctctaatgacaacagctaaacaacttagtccaaagactaaccttcaggcagaatttgcatacggctcaggccaaattgatccttccaaggctgtgtaccctggtttagtatatgatgctggtgaaatagactattacaaggacttacaactcatcacaggagataacagtagctgccctgaaacaaagaatggttcagcaagggatctaaactacgcttcatttgcactctttgtcccaccctccaactccaatagtataagtggcagttttaacaggactgttataaatgttgggtcaccaacgtccacatataaagctactgtcacttctcctgagggactgaaaattaaggtgaaccccagtgttctaccattcacttctcttaaccaaaagcaaacatttgtgctcacaattgagggacaactaaaaggacctatagtgtcaggctctttggtttggggtgatggtaagtaccaagtgaggagccccattgttgtgttcaatacagcatga

SEQ ID NO: 56 - DNA, 1422 bp, Glycine Max
atgcagcctcctcgccgcaagaacaataatcttcccaactcagaaacctcaacaacaatgaaaggcaaaaggaacagcagcatcagcatctccattgttgtggtggtgttctccatattcctctttggggtcttcatgtacaacgaggacgttaagtcaatggccgagttcactttcttgaggcctaaggctcaagaaatccaagaagaaacggtttccaacaacaattcaagaactcaaccagagagaaaccgggtcgaggactccgaggaatctcaagaaccgattgatttgaaagccgttgtggcagaagagaagatagtggaagagtatgaggaagaaaatgaagaggttgtgttgcccccagaagagtgtgacttgttcacaggagagtgggtttttgataacttgacacaccctttgtacaaagaagaccaatgcgaattcctcacttcacaagtcacctgcatgaggaatggaagaagtgattctctctatcagaattggagatggcagcccagagattgctctttgcccaagttcaaaccaagacttttgcttgagaagcttagagggaggaggcttatgtttgttggagactcactgaacaggaaccagtgggaatcaatgatttgtctggtccagtctgttgttcctcaaggcaaaaaaagtttgagcaagaatggttctctttctatcttcacaattgaggattacaatgctacggtggagttctactgggcaccgttccttgtggagtcaaactcagatgatccaaagatgcacagcatattgaaccgtattatcatgccggaatcaattgagaagcatgctgtgaattggaagaatgtggactatctgatcttcaacacctacatatggtggatgaatactgccactatgaaagtcttgcgagggtcgtttgatgaaggatccacggagtacgatgaagtccctcggccaatagcatatggaagagtcctcaacacatggtctaaatgggtggaagacaacattaatccaaatcgcaccaaagttttcttctccagcatgtctcctcttcatattaagagtgaggcttggaacaatccagatggtataaaatgtgctaaggagaccataccaattctgaatatgtcaacaacattacaagttggcacagatcgtcgactttttgtggttgccaacaatgtgacgcaatcaatgaaggtggtgccagtgaacttccttaacatcacaaccttatcagaatttagaaaagatgcacatacatctgtttacaccatacgccaaggcaaaatgttaactccagaacaacaagccgaccctgcaacttatgcagattgtattcattggtgtctacctgggttacctgatacatggaatgaatttctttacacacgtatcatctctcaatcttga

SEQ ID NO: 57 - DNA, 762 bp, Glycine Max
atgcatggtttaagaggagagaagttgcaattttcaagtgtaaggttctgtctcaagcataaagtttcctgcaaacttactgaagtgggaaatgattcaagctcatctaaggagcttggaaagtgtcaaccttttgttaagatgtgtggcattgcttcagctaaagatgctgcaatggcagctgaagctggtgcaaattttattggaatgatcatgtggcctaactcaaaacgttctgtttcgctttctgttgcaatggagatatcaaaagttgcaagagattatggagcagagcctgtgggtgtatttgtggatgatgattctgaaacaattctaagagcttctgatgcagcaaaccttgaatttgttcagcttcatggacatggttctcggttagcttttccgtccttaattcaggaaaatcgtgtaatatatgttctccatgtaaatgaggatggaagccttttaaacacaatttctgatgaagagtgctctctagttgattgggtccttgtagatagtgcaaagggtggcaggggtaaagcattcaattgggaccagttgaaactgccaaacattaaaagcaagtatggttggctcttagcaggagggatccatcctgagaatgtttctgaggctctatctactctcaggcctgaaggggtggatgtcagcagtggcatttgtgcatcagatggtatccgtaaggatcaatcaagaatagcttctttcatgaatgcagtgcattcttttcagtattga

SEQ ID NO: 58 - DNA, 1515 bp, Glycine Max
atgccaaaagggatggcttcagtcaccacattttcactaatgttacagtttctgttctttatactatgttcttcgtttggtcagctaagcttagctttcacgtcgcaagagtaccatgaggctcttgagaaatccattctcttcttcgagggacaacgatctgggaaattgccttccaaccagcaacaaacatggaggggagattctggattgtccgatggctcttcctatcatgtggacttagtaggcggttattatgatgctggagacaacgtcaagtttgggttgccaatggcctttaccactacattgttagcatggagtgtgattgaatttggaagctcaatgcaggaccaacttgaaaatgccagagctgctattcgttggagcacggattaccttcttaaggcagccaccaccacccctgacacattatatgtccaagtaggagagccgaacatggatcataggtgctgggaaagggctgaagatatggacactccacgcaacgtgtataaagtatcagctacaaacccaggttcggatgtagcagcagagacggcagctgcattggctgcttcttcaatagtattcagagattcagatccaagctattcctccaaattgcttcaagcagccatcaaagtattcaattttgcagaccgttacaggggttcttatagtgattctcttaattcggttgtctgtccattctactgctcttactctggataccatgatgagcttctgtggggtgcatcatggatttataaagcatcaggaattaacacttatatacaatatatacaatccaatggccacatattaggggctgatgatgatggttacacattcagttgggatgacaagcgacctggaacaaaaatcctgctttccaaggaattcctagaggaaaattctgaagagttccaactatataaggcacatgcagacaattacatttgttcgctaatgtcgggaacacccggtttccaggctcagtacacccgaggggggcttctgtacaaagggagcgagagcaatttgcagtacgtaacatcaactagcttccttctcttgacatacgccaaatatctgaacacaaacggcggtaatgtagttcgatgtgggacttcagcagtcacgggcgaaaacctagtaacactagctaaagcacaagtggactacattctgggcaacaatccaacaaagatgtcttatatggtgggttttggagagaggtatccaaagcatatccaccacaggggttcctctctgccttccatccacgcacacactcaacacatttcatgcaacgacggctttcagtttttccattctgcctcgcccaaccctaatatccttgttggagccatcgtaggtggtcctgataacaatgacaacttctctgatgatcgacataactatcagcagtctgagccagcaacatacatcaatgcgccgtttgtaggtgctcttgcctatttctctgccaacccaccaacaacctattag

SEQ ID NO: 59 - DNA, 2835 bp, Glycine Max
atgccgacgcccgtggcagccgcgcgccaatgcctaacccccgacgccgcccgcgccctcgacgaggccgtctccgtcgctcgccgccgcggccacgcccaaacgacgtcgctccacgccgtctccgccctcctctccctccccctcctccgcgacgcctgctcccgcgcccgaaactgcgcgtactccccacgcctccagttcaaggccctcgacctctgcctctccgtctccctcgaccgcgccccgtcctctcacaaccacgcctcctccgaccacgaccctcccatctcgaactctctcatggccgcaataaaacgctctcaagccaaccaacgccgccaccccgataacttccacttttaccctcaccaccaaactcagcagcaaccgttttctgtttcttctgtcaaagtagagcttcagcatttgatcttgtcaatcctggacgaccccgtggtgagtcgcgttttcgccgaagccggttttcgaagctccgatattaagctcgccatcctccgccctctccgcccccgcggcccgccgattttcctctgcaacttatccgagccgccgcgaaggttccccttctttttcggcggtgttcaatatgacaagttatggttgatgggtgctgctgctagttacgataattacttgaatttcgtggggaagtttccttctatagagaaagattgggatttgcagcttctgcctattacctctgttaagcctctttccgaatcctatcaccgtcccaggtccagcttaatggattcatttgtaccgtttggtggcttcttttcgtcacagtctgatttgaaagctccactgagtggctcgttttattgtgttccccactgtcaccagtgtggtggggaaaggtgtgaacatgaagtccttgcttcgtccaaggaaaggttttctgcttcttcagctgctgatccgcatcaatctaacttgcctccgtggttgcagattgcagaatttggctcaacaaaggggttgaatgttaagaccaaagataatggtgttttgctcgatagtagtgaatctgggtcactgcataagaactttgacaagttatcccagcatctgcaccagcgagatgcaattacttttccaactgttgtggggtttcattgtggtgctgaaaagaaaaaggaagatactgacaattgcagcagcaaatcacctagtgaatacatcaatctcaactcccgtgtacctgttggcatgcaaatgatgcctacatcacaatcaagtagtccttttcctgcagttttcatggcaaagcaggagaaatataattcaaaacttgctgagatgttccagaaagtggaagatcacgagtcaggtgaccaaagatcatgcaacatgtccaattcaagtgtgtgtgatggtagtcaaatgtctcccacatctgtaacttctgtaaccacagatcttgggttaggaatatactcttctcctaccagcaataaattgaagaaacccgctgttcaatatacaatggagcctccaaaggaaatcccaagtcgattttctcaaaactttaatttggctgatgggaatatcttgaagcattcatcccagtcttcatcctgcttaagttttgactattgtggacaagttgatgcaaaaaatcccaaaattctttttgaagttctttccaaggaggtaacctggcaagatgaagctttacgggctatcatcaaaacaattgtttgcagcccaacaaagagggttaaacaccgtggaccaaatcagcctggggacatctggatgaattttgttggatctgatagacttggtaaaaagaaaattgctgtttctctagctgagctattgtatggtagccgtgaaagctttatttttgtggatctaagttctgaagaaatgaaaggatgcgatgtgaaattcagagggaagactgcccttgattttattgtaggggagtgttgcaagaaacccctgtctgtggttttccttgaaaatgtagaaaaggcagatattctagctcaaaatagtttgtctctagccatcaagacaggaaaaatttcagactcacatggacgagaagttagtgtaaacaatacaatgtttgttttttctttctcagattaccaaaatagtttgatgccaagaggggaaccttccaactattctgaggaaagaatactgagggcaaaagggggaggtatcaagataaaagttgaacatgtgattggagacatcagaagccaaagcatcagtgtaactaacaattcaatacatgcggttcctaatctaaatatcctaaacaaacgaaagttgattggtgacgataaatttcatgatctgcattttctctctgatacagctaaaagggcacatacaacatcaaattggctgttagatttgaatctcccagcagaagagaatgaacagaaacaaacaaatgatggaaactctgatcatgtctcaactgagaaccaaaacctttggttgcaagatttgtgtgatctggttgatgaaacagttgtttttaaaccttatgattttgaagcacttgcggatagagtgttgaaagtgatcagaagtaacttcaacaaaattcttggatccgagtgtgcattgcagatccagacagaagtcatggaccaatttcttgcagctcaatatgtttcagaccgggatagggaggtggagaactgggtggaggaagttctatgtgaaggatttacagaagtacagagaaggtacaacctcactgctagttctattgtaaaactttttacgtgtcctgagcaagctgctggtgtacaccttcccccaaggataattttagactga

SEQ ID NO: 60 - DNA, 1779 bp, Glycine Max
atgcctagcaaacagacttatagcttttgcttctgcttccgccggcgtttcaggctccccgtgtcggaggccccgccggagataaggacccttttcgaccgttactccgatcagaatggcgtcatgacagccactcacctccgaagtttcctggctgaggtgcagagggaagacaatgccactgaggaggaagcacaaaccatcatcgatggccacaagcatctcagtatctttcaccgaagaggtctcaatctcgagagtttcttcaactatctttttagtcaccataataacccacctctctcgccctctattggggtgcaccaagatatgtcttcacctttgtctcattacttcatttatactggtcataattcctatctaactgggaaccagcttagcagtgactgcagtgacatccccatcatcaatgcactgcagaagggcgtaagggtgattgagttagatatatggcctaatgaatcaaaggataatgtggatgttcttcatggaaggactttgacatctcctgtggcactcatcaaatgtttgaggtctattaagcagcatgcctttgttgcctcagaatatccagttgtaataaccttagaagaccatctaactcccgaccttcaggccaaagtggctgagatgattactcgaacatttggagacatattatttgctcctacctcaaaaagcttgaaggaatttccttctcctgaatcacttaaaaggagggttattatatcaaccaaaccacctaaggagtaccttgaggcaaaagaagtacaggaaacagaggagggaccacaacaggaaaagcctgcagatgatgaagaagcatgggggaaggaagtccctagtttgagaggtggaactatctctgattacaagaacattgaggatgatgatgttcttgatgatgaggaagatattgatgaagcagagaagtcacgtcaagatgcagcagatgaatacagacgtttaattgccattcatgctgggaagcctaaaggtggattaacggaatgtctcaaagtggatcctgataaagtgagacgtctaagtttaagtgagctacagcttgaaaaggctgctgaaactcatggaaaagaaattgtcagatttactcaacggaatatactgagagtgtatccaaaaggtactcgcattacttcgacaaattataacccattgattgggtggatgcatggagctcagatggttgcatttaacatgcaggggtatggtagatctctttggttgatgcagggaatgttcaaagccaatggcggatgcggttatgttaaaaaaccagattttctattaaaggttggtcaaaataatgaggtctttgatcctaaagctcatttgcctgtgaagacaaccttgaaggtgactatatatatgggggaaggatggtttcatgatttcaagcatacacactttgataaattctcacccccggacttctatgcaagagtgggaattgctggagtccctaatgatactgttatgaaaaaaactgagaaagtagaggataattggtcaccttcgtggaatcaagtatttgagttcccacttgctgttccagaactggctctgcttcgcgtagaagttcatgagtatgacatgtctgagaaggatgactttggtggccaaacgtgcttacctgtgtgggaactaagaagtggaattcgagcagttccactgtattcccgcaatggagataagtatgccaatgtgaagcttctcatgcgctttgaattcatttga

SEQ ID NO: 61 - DNA, 324 bp, Glycine Max
atgcgcatgctcaccggcgactccgccgccgacaactccttccgattcgttccgcagtccatcgccgccttcggctccaccgtcatcgtcgagggctgcgactccgcccgcaacattgcctgggtccacgcctggaccgtcactgatgggatgatcactcaaatcagagagtacttcaacaccgccctcaccgtcactcgcatccacgattccggcgagattgttccggccagatccggcgccggccgtttgccctgcgtctgggagagcagcgtctccggtcgggtcgggaaatccgtccccggtttggttctcgcaatataa

SEQ ID NO: 62 - DNA, 576 bp, Glycine Max
atgcgcgccctagcagctcagttctctaattatttatgcagaagaaaagttggggtcaatctgcgatctcgtaatttttcatcatataacagtaaagatgagctaaccatcgaggaagaagctgagagaaaagttggatggctattgaagacgatattttttgtcactgcaggggtagcaggataccatttctttccttatatgggagagaatttgatgcaacagtctgtttcgcttttgcgtgtcaaggatcccttgttcaaaaggatgggagcttctagattggctcgttttgcagtagatgatgaaagaaggaagaagatagttgagatgggtggagctcaagaactcttaaatatgttaagcactgctaaagacgaccgtacacggaaagaagcattgcatgctcttgatgcactgtcacaatcagatgaagctcttgcatccttgcatcatgctggggccatttcagtaattaggtctgcaccaaattcacttgaggatgcagaagttgagggattcaagttgagcttgatgaaaagatttcaagatctcagatatgatgtgccatcatga

SEQ ID NO: 63 - DNA, 2574 bp, Glycine Max
atgcttcactccacttctctccttccccataataaccgcttcgtcttctccttccgctccaaaccttctttttttcattcccactctctctctttctccaaatttctctctcttccatcttcttctcaatcctcatgttgccacgtgtctcgaatctccaccgagaccttggaggtctcgccgccgccgcctcccgacttcaacttccgccgcgaaatcgcgcgcctcgccgacctccgcgacaggctctccgcgtgctctactttaaacgagaagctccgcgtgatcgacgccgactccagagtgaagcgcttcttccgttcccgccgcggcctcgctggggttttggcatcgctgcaattgagctccgaccaactgttcctgctcaagtgcgtggttgccgccggacaagagcacgtgctgtgtttgggcgaaacggaatcgttggaatcctccgtcgccacgagtgcagtgaagagcgcgctttacactctggcggatatgattgagaatatggattcctttaacggcaatggcggagcgggttttgggatggctttgggggatcacgagattgcggagttgaacaatttgttagagattttggcagaaattgagcgattctatgactgtattggaggaattgttgggtatcagataacagtactggaacttcttgtacaaaaattgttcgagatgcagaatataagctgggcccaccagaggcatgacgtgaaagaatgccaaattttgggaattaatgcacctaatgggcttaacctttctgaagacacagagtatgcatctcaagcagctctatggggtatagagggtttgccagacctaggtgaaatttatccgttgggaggctctgccgacagacttggtttggttgatcctaacacaggtgaatgcctgcctgctgcaatgctaccatattgtggaaggactttgttggaaggtcttataagagatcttcaggctagagaattcttgtacttcaagttatatgggaaacaatgcatcacacctgttgcaataatgacaagttccgcaaagaacaaccacaaacatgtcacctctctgtgtgaaagactttcatggtttggaagaggtcgatcaactttccaattttttgaacagcctcttgttccagttgttggtgcagaagaaggccagtggctggtcaccaaaccattcagtcccttgagtaagcctggtggtcatggtgtcatatggaaacttgctcatgacaaaggcatcttcacatggttttactgtcaaggaagaaaaggtgcaactgtgcgccaagtcagtaatgtggtggcagccacagatttaaccctcctagccttagctgggattggcttacgtcaaggaaagaaactgggatttgcatcttgtaagcggatcttgggtgccacagaaggagttaatgtgctcatggagaagaaaagtcttgatgggaactgggaatatggtgtgtcttgtattgaatacactgaatttgacaagtttggaattactaccggacctcttgctccaaaaggtttgcagacagagttcccagccaatacaaacatcttatatattgatttgccttctgcggagctagttggatcaagtaagagtgaaactagtttacctggaatggtgctaaatactagaaagccaatagtttacacagatcagtttggaagacgtcatagtgtctctggtggtagacttgagtgcacaatgcaaaatatagctgacaattattccaattcatattcatccagatgttataatgatgtggaagataagctagatacatatattgtatacaatgaaagaagaagggttacctcctctgctaagaaaaaaagaagacatggagacaagtctttacatcagacacctgatggcgctctattagatatcttacgaaatgctcatgatcttctttcacaatgtgatataagacttcctgagattgaagctaacgagaactatgttgattcgggaccaccatttctcatccttctgcatcctgctctcggtcctctttgggaagtcactaagcaaaaattttatggtggttccatatcagagggctccgagttacaaatagaggttgcagagtttttctggaggaatgttcagctcaatggaagcctgatcataatatctgagaatgttatgggctcaatgaagattaatgagaacggtgaatccatactacattatggccaaaggtgtggaagatgcaaattgcaaaatgtcaaggtattgaacaagggaattgattggacttgcggtgaaaacatatactggaaacacgatgtgcagcgatctgaggtgctgcagatcatactgcatggaaatgctgaatttgaggctactgatgttgtcttacagggaaatcatgtgtttgaagttccagatggctacaaactgaaaatcacgccaggaagcccaggtttagcaatcaagttggatccaattgatcaagatatgatggagagtggaagctggcactgggattacaagatagaaggttctcacattcagctagaattagtagaatcataa

SEQ ID NO: 64 - DNA, 606 bp, Glycine Max
atgcttcttagaacagcgtcctctttctctctcttcaacgccaacggcgaccatatactactcccttcctctgttcgctactctcagggcaaacacttggttccatgcgctaccaagaactccaataaccggcccttaaccggcgtcgtatttgaaccctttgaagaggtcaagaaggagctcgaccttgttcccactgtcccacaagcttcccttgctcgccagaagtacaccgatgagtctgaggctactatcaacgaacagatcaatgtggagtacaatgtttcgtacgtttatcatgcgatgtttgcctacttcgatagggacaatgttgcgctcaagggtcttgccaagtttttcaaggagtcaagcgaggaggaaagggagcatgctgagaaattgatggaatatcagaacaagcgaggtggaaaggtgaagttacaatctatagtgatgcctcttactgagtttgaccatgaggaaaagggagatgcgctatatgcaatggaacttgccctgtcgttggagaagctgacaaatgaaaagctgcttaacttgcacagtgtaagatatcaagattgtttggtcctagttttggattcatag

SEQ ID NO: 65 - DNA, 747 bp, Glycine Max
atgcttcttagaacagcgtcctctttctctctcttcaacgccaacggcgaccatatactactcccttcctctgttcgctactctcagggcaaacacttggttccatgcgctaccaagaactccaataaccggcccttaaccggcgtcgtatttgaaccctttgaagaggtcaagaaggagctcgaccttgttcccactgtcccacaagcttcccttgctcgccagaagtacaccgatgagtctgaggctactatcaacgaacagatcaatgtggagtacaatgtttcgtacgtttatcatgcgatgtttgcctacttcgatagggacaatgttgcgctcaagggtcttgccaagtttttcaaggagtcaagcgaggaggaaagggagcatgctgagaaattgatggaatatcagaacaagcgaggtggaaaggtgaagttacaatctatagtgatgcctcttactgagtttgaccatgaggaaaagggagatgcgctatatgcaatggaacttgccctgtcgttggagaagctgacaaatgaaaagctgcttaacttgcacagtgttgcctcaaagaacaatgatgtgcaattggcagattttattgaaagcgagtttttgggtgaacaggtggaagccataaaaaaaatctctgaatacgttgctcaactcagaagagttggcaaaggacatggtgtgtggcactttgatcagatgctactccatgaggaaggagttgctgcttga

SEQ ID NO: 66 - DNA, 1593 bp, Glycine Max
atggaaaactcagacgagcaacttcccttctctccacaaaaccctaacaatgccgaagaagaagacgacgacatcgaagagccagaagacgaagacgaagaagaggaggaggaggacgacgacgacgacgacgtcgtttcgcaggagcaatccccattgtcgcggctgcgcgagcagcgttcgaagctggaaaccctgtcccggcgattggcgtcggagctggtcccaatccgagtccacgacgtgctgattcgcggcaacacgaagacaaaggagtgggtgatcgaggcggagctcaagctcctcgaggaggccaccaacgtgcaggagctcattcgcgcctccgaaatcgccctcgccaggctccgcggcctcgagattttcgacaccgccgagctcacgctccaggccggtccgccggagctgcctcacaccgccaatgtcgtcgtcgacgtcgtcgagtccgccaacagaatctccggcgatttcggcgtttacaccaaacccgcgactagttcttggtctgctgaaggtggtcttaagtacaaaaacttattaggttatggtgatctatgggatgcctcgttggcctatggtgccaaccaaacaacagaggtaagtgtaggagtgtatgcccctcgactgaaaggattgttaaccccctttgtagcacgactatccatgctttctcaagattggcaagagttttcttcatataaagagcagttgctaggcttgtctctaggcttaatctcaacaaggcaccatgacttagtctacactcttggatggcgtaccttgactgatccatcacaaatgtcatccaggtctataaggaggcaacttgggcatggtttactatcatccttgaagtatacatttaaaattgacaggagaaactcaccaattaggcctacaaatggatatgcttttctttctaccactcactttggtggccttacaccagatcatcggagcttgcgatttctgcgccaggaatttgatgttcgttgtgccatcccctttgggttttataatacggcacttaaccttgggatttctgccggtgctgtttttccatgggggcatggcttcatgaacaagccatctccgcttcctgaaaggttttatttgggtggtgatttctctccagtttgcacccttggaggaccaataacattgtggggatttaaaactaggggattaggtcctactgaaccacgaagacgaagtagagatggaattattgatgacagtgatgattcctctagatgggacttcattggaggagatctagctgttactgcatttgcagacctgtcttttgatcttccaattaggtggttgagagatcatggaattcatggtcatgtttttgctggtgctgggaatactgctaaattaactcagaatgaatataagcacttttcacctcggaagttcttagaatcctttcgaacatctgtgggatgtggatttgttgttcccactagactttttcgcctagagggtaatttctattacatactcaagcagaatgagcatgatcgtgggaaaactggatttaggttcagcttctcggctccttcttag

SEQ ID NO: 67 - DNA, 1164 bp, Glycine Max
atggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatacttttggggacgagcagcttgcagtggatttgctagctaatcagcttctttttgaggccttaaattactctcatttctgcaagtatgcttgctctgaagaaaatcctgagctcctggacatgggaggtccagttgaaggtggatttagtgtcgcatttgatccccttgatggctccagcattgtggacacaaatttcacagtaggcaccatctttggtgtgtggcctggagataagttgactgggatcaccggaagagatcaagttgctgcagccatgggggttttgggtcctagaacaacatatgtgcttgctctaaaagacttccctggcacccatgaatttcttctgcttgatgaaggaaaatggcagcatgtcaaagagaccacagaaattggtgaaggaaaactgttctccccaggaaatttgagagccacatctgacaaccccgattatgctaaggtgatcgattactatgtcaatgaaaagtacacattgagatacactggaggaatggtgccagacgtcaaccaggttattgtaaaagaaaaaggaatcttcaccaacgtgtcatcaccatcagccaaagccaaactgagactgttgtttgaggtagctcctttggggttcttgattgaaaaagctggaggttacagcagtgatggtcatcagtctgtgctagacaaagtcatcagtaacattgatgacagaactcaagttgcttatgggtccaagaatgagataatccggtttgaagaaaccctgtatggtaaatccaggctcaagggtggtgtagctgttggagcagctgcttaa

SEQ ID NO: 68 - DNA, 1815 bp, Glycine Max
atggaaacatgcataatcaaggtgttaaatttctccaccaaaaaaggtgatgtctacaaggcagaaccacccctggaccttaaggaagccttttccaagtttgccagaggagagaatcaaatgaagaaggatcagctacttcggttcatggtggaacaccagggagaaaatatcagtaccatagaggatttggataaaattgttgaaaagtttttgcaactgggaagttcttgttctagcaccaaaactagctccacaagaattgtggatgtttataggaaacaaggattaagcctcaatgacttcatcgattttctgcttcttggtgatttcaatggtcccttgaaagacgaggtacatcatgatatggatgctcccttgtcacattatttcatgtatacgggacacaattcctatctgactgggaatcaactcaccagtgagagcagtgacgagccaattattgaggctttgaaacaaggtgtacgagtaattgaactagatttatggccatccaaatcttcaaataatgatggaattaaagtggttcacggaaggacttttaccacttcagtcccggtatccaaatgtctacaatccataaaggattatgcatttcataaatctgattatccagtaattctaactttggaagaccacctaacaccaaaacatcatgataaatttgcaaaaatggcaactgaaatatttggagaaacgctttactttcctgagacagatcatttgacagaattcccctcaccagaatcattgaaaaaacggataattatatcaaccaaaccaccaaaggaatgtcgacaatctgctattatcagtaaacctgtgccaaatggaagagaaccatctgaagaagaatcacgaggtcttgaattgccaagttctgtggctaaactgaaaactgaggacagggattctagtgatgaagatcaggaagatgtaaatacaagtgataacaaaccaaaccaacaagatgcgcgtcaatacaaacacttgattgcaatccatggtgggaaatcaaaaggttctatgaagaatcggctgaaagatgatattaaagttagacgtctaagtttgagtgagaagaaactgaaaagtgcttccgagtctcatggagccgaccttattaggttcacacagagaaatatcctcagagtttttcctaaaggagaacgtgtccaatcctcaaatttcaggccatatttagggtggttgtatggagttcagatggttgcattcaatatgcaggggcatggcaaatcactccggttgatgcggggtatgttcaaagcaaatggagggtgtggttacgttaagaagcctgaatttctgatccgaacacttccacatgaagaggtgtttgatccaaaaaaaccaccttcagtgaagcagatattaaaagtaaaagtatacaaaggagatggctggagtttagatttcagtccaacagattttgatcgattctctccacccgacttttacacagaggtcagtattgttggagtgccagctgattgtgacaagaacaaaacaagagtaaagacggatacatggtatcctgtttgggatgaagaatttgaattcaaattgagggttccagagcttgctttgcttcggatagaagtaaaggacaaagataagggaaaaaaggatgactttgccggacaaacttgtttgccaatatcagagctaagaaatggatttcggtcagtccctctctatgacagaaagggaaagaaatataaatctgtgacgcttctaatgcggtttaagcttgaaactttaaataaattgtag

SEQ ID NO: 69 - DNA, 1017 bp, Glycine Max
atggaacttgtttcatgtttgatctcagatgctttgtgttacttcactcaagcggttgccgacagccttcagctgccgaggattgtgttgagaactggtggagtttcttcctttgttgctttcaccgcttttccattacttagagaaaaaggttacgtacccatacaagaatgcaaattggaggagccagtggaagagctaccaccactcagagtgaaagacttacctatgattaagacagaggagccagaaaaatactatgaactattacgcatgttcgtcaaagagactaagggctccttaagagtgatttggaactcctttgaagagttggaatcatctgcactcacaactctgagccaagaattttccataccaatgttcccaataggcccttttcacaacctaatatcacaagaccaaagttgcatatcttggttagacaaacacacaccaaaatccctggtctttactgagttcatagagatagcttggggtttagtcaataataagcacccatttttgtgggtggttcgaccgggcctaatcaagggctcggaatggcttgaaccattgccaagtgggttcatggagaatttggaagggagaggcctaatagtgaaatgggcccctcagctagaagtgttggctcattcaacaataggtgcattttggactcataatggttggaattcaaccttggagagtatttgtgaaggggttcctatgatatgcatgccttgtttcactgatcaaaaagtgaatgctaggtatgtgagccatgtttggagggttggattgcagctagagaagggagtggacagaggggaaatagagaggaccattagaagattgatggatgccaatgttgaacggaaggagattagaggtagagcgtggaagttgaaggaagtggcaaagatttgcttgaaacaaggtggttcctctttctcttctttggaatttttggttgcttacattttgtcattggagtcatttacttttgaagcctcctga

SEQ ID NO: 70 - DNA, 1293 bp, Glycine Max
atggaatcaccgtcaccaccttccccgttccgagaccttcttctccgtttatcgaccggaatcgcggagtctctggccaccgttccctacactccacaccaatcctccaacgtctccgtcaaagcctttctcgaacccctcctcgttcccaccgccaccgtcagagacttcgctctcgcgtgcgctctcatttcctcttccaccgccgtcgactcctccggcattctctcatggatccccagcaacctctcctctctcgcaacctcgtccttctccgacctctcccgcgcttacctcggaaatcgcgacctcgctgttccgccggagaagaggctcgtgctggaattgatgccagaggttttgccttttctgaaagagaggattaaggagagctcgattgatgtgtcggatgagaccgacgagttctccgcggcgacggcgagagtccccgttgggttcgccattctcgctgcttttcagtttagatggtttgttacgcaggttgattatcctcatttgggcaagttgtgtggattggtgattccttgtgcactgactgctgttgatcattggtctccggtagttaagggacagggcatgattagccttatgcatgttggaaaaaatgtggatgctgctcagcttggtgggtatgtggatgtgattctggatgcctgctgccagaacacggcttctgatgatgagatatggcaccatgttgttgaggcatctgtagtgcttgtgactcttactcagagaagtaatccacgtagtccatggtttgaaagaatgctaaatgagatgttaagtcacttggagcgccagcctagaaacaaagagcgccgcatcgcatggcttaaatctgctgattcactatttaatggagttggtatcatgcttttagctcacttcaggcgcattttcccattattttttcagtggatgcatgctgacgacaatgagactattattttggttctaaaatgtacatatgtaattttgagactgacgtggataaggaactcaccatttgttgcaagattggtagataaacttgctcttgtgtataaggaggctgcattaagaacagctcgggaagagattagagcaaatatatgtcagatactgatcctacttcaaggaagcaaaggactgtattttaatgcagcctgggacaagcatcgatccgatccagacttgaccactcttgatttttcattaagtggaagaagtaatactaatactgtgccttcagaggattgtcctcagcagggtttagtacccgttcaatga

SEQ ID NO: 71 - DNA, 876 bp, Glycine Max
atggaatcctcgcctgccattcgttcctttcactatcccatgggcactatgtcccatgtgcgagcctgccttgagaagcaagctgtacttcccatccataatgccagatggaactctaaacgtaggcttttcatccagcatttggcatatggtcagaagcacattaattcccacatgaaggggaaaagcacactagtttcatctgcaaaaacagctgaagctatcaacacatccaattctgatgcttcttcagataacaccccccaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccgactacaccaccacctatcccaagtaaacctatggatgaatcagcacccaatagcctgccaccatcaccaccaaaatcatctcctgaaaagaacaacccatttgcaaatgtttccaaagagaaatcaccaaaattggcagcattggaggcttctgggaccaatacctatgtcttagtaacatctcccacggttggcttattccgaagaggtagaacagtgaaagggaagaagcaacctcctatctgtaaagagggtgatgtaatcaaagaagggcaagtcatagggtatttggatcagtttggcactggacttcctatcaggtctgatgtggctggagaagtgttgaagctacttgttgaggatggagagcctgttggttatggagaccgtcttattgctgtcttgccttcttttcatgatatcaagtga

SEQ ID NO: 72 - DNA, 870 bp, Glycine Max
atggaattcgagactccacatcaaacttgttttatccactacacagaatggacaagagaagagaataagaagtttgaaagtgcccttgccatatatgataaggataccccagacagatggctgagggttgcagccatgctacctggaaaaactgtctatgatgtcatcaaacaatacagagaattggaagaagatgtttgtgaaatagaagcagggaggattccagttcctggataccctacctcttctttcacattgaagatggttgacaaccaatgttatgatgcatgcagaaagaagcctgcaactctcaggagttctgatcaggagaggaagaaaggggttccttggacagaagaggaacacaggcgttttctgatgggacttttaaagtatggtaaaggggattggagaaacatttctcgtaattttgtggtcacaaaaactcccacccaagtggcaagccatgctcaaaagtattacataaggcaaaagctttctggagggaaagacaataaaaggaggcctagtatccatgatatcaccattgttaatcttacatcagatcaagagaagcctcttttactcaatgatgagtctcacatgacttttgagcaacagaagctaactagcatgccaaaagtacaactagaatggattaatcaccacgacaatgggtcacgtatggttgtcaacccaaattatgatatgttcatgtcaccttcatctggcatctcttccaagaccctcaagttgcaagggcaagatttctatgaatgtgcctttcatgagacttatgctaagcttaaaaattcgggtttcaggacaacttctagagacttcaacaaggaaggtattcatgcactctga

SEQ ID NO: 73 - DNA, 477 bp, Glycine Max
atggagaacaacaaaaagaaagtgggaggaggttcttcctcatcatcattcaccaactttgatcatctttttggtcccaaggacccctccaccacttcatcttcatccaccagcatctttggctccattttcccacctccttccactgttggagggagagattcaacaaaacaggacacgggatgcaaaaattatggagcaccaggaaattacagttacaaaggtgaaagcagcgctagcggtgtctccaacaacaataatactactagtaccaattatcatcagaatgagacagtggagcccagctactacagttcatcaatccattatggtggtcaagaaaattattccccaagaaccaggaccactgaatcccaccatattgttaagaaagataaggatgatgatgatccaaatggtaatgattcaaacagtgcttcaagggggaactggtggcaaggttctctttattattaa

SEQ ID NO: 74 - DNA, 2157 bp, Glycine Max
atggagaacacagatccttgtagacattttctcaaggatgttaagcgcatcataatcaaggttgggactgctgtggtcactcgccaagatggaaggttagctgttggaaaattaggggcactctgtgagcagattaaggagctgaattctcttggttatgagattattttggtgtcatcaggtgctgttggccttggtcgccaaaggcttagatacagaaaattaattaacagcagctttgctgaccttcagaagccgcaagttgaacttgatggcaaggcttgtgctgctgttggacaaaacagccttatggctctttatgatgttttgtttagtcagctggatgtgacatctgctcagcttcttgtgacggacaatgattttagagacaaagatttcagaatgcagctcagcgaaactatgaaatcattgttagcattaaaagttattcccatattcaacgagaacgatgcagttagtactaggaaagctccatatgaggattcttctggcatattttgggataatgacagtttatcagctttattggcattggaattaaaagctgatcttcttattttgttgagtgatgtagagggtctctatagtggccctccaagtgatccacgttcaaaacttattcatacatacattaaggaaaagcatcaaagtgaaattacttttggagacaagtctagagtgggaagaggtggaatgactgctaaagtaaaggcttctattcatgcagctgaagctggcattcctgttatcattactagtggttatgcagctgaaaatatcattaaagttctccaaggacaacggattggaaccctcttccataaagatgcacataaatgggccccggtaaaagaggttgatgctcgtgagatggcagttgcagctagggactgttccagacggcttcaggccttatcttcagaagagaggaaacaaattttgctaaaaatagctgatgccctggaagcacatcaaaatgagatcaggattgaaaatgaagctgatgttgctgatgcaaaagaagcaggatatgaaaaatccttggttgctagactgcttgcaagccttgctaacaacattcgaattattgcaaacatggaagatccaattggtcgagtgttaaaacgaactgagcttgcagaggggctgattttggagaaaacatcatcttctttaggagttcttttaattgtttttgagtctcgccctgatgcactagtacagatagcttctttggcaatccgaagtgggaatgggcttctcttgaaaggaggcaaggaggctaagcgatcaaatgcaattttgcacaaagtaattactgaagccataccagatattgttggctcaaaacttattggacttgtgacatcaagagcagaaattcctgagctacttaagttggatgatgtaattgatctagtgattccaagaggcagcaacaaacttgtcactcagatcaagagttccactaaaattcctgtcctgggtcatgcagatggaatttgtcatgtctatgttgataaatctgctgatctggagatggcaaggcggattgtactagatgcaaaaatagactatccagcaggctgcaatgccatggaaactcttcttgttcacaaggacttggtagagaaaggttggctcaatagtattattattgacctacggacagaaggtgttacattgtatggaggacccaaggcaagtcctttgttaaatattccaatggctcgtatgttacatcatgagtacaattcgttggcatgcacagttgaaattgtggatgatgtttatgcagctattgatcatataaatctttatggaaggcatgccactctttatttcttgataattgcacatactgattccgttgttgcagaagatcatgaagtagccaatgtgtttctacgccaagtagacagtgctgctgttttccacaatgctagtacaagattcagtgatggggcacgatttggactaggtgcagaggttggaataagtacaagcaggattcatgctcggggtccagtaggagttgatggattgttaacaaccagatggattctcaaaggaagtggacaaatagtggatggtgacaaagcagttaactacactcacagagacctttctatatga

SEQ ID NO: 75 - DNA, 1776 bp, Glycine Max
atggagaagagaaagcgtggaaaaagtgaagaaaaaggagaagagaaatgggtgcatgatgcatctgtggattataagggcagagttcctctccgtgcttccacaggtgtatggaaagcgtcgctttttgtccttgcaattgaatttagtgaaaggatatgccactttgggatagccactaatcttatcatgtacctgactaaagtaatgcatgaagatctcaaaacagcgaccaagaatgtaaactactgggtaggagcaacaactttgatgcctctaattggaggatttgttgctgatgcctacactggtcgatttcgtatggtcctcttttcttccctcttatacctcaagggattaagcctcttgaccatgtctcaattcattccaagtctaaaaccatgcaacaatgagatatgccattggccaaggaaggttcatgaagtggttttattccttgccctttactgtgtcgccttgggaactggaggattcaaaccgtgcttacaaagctttggagcagatcaatttgatgatgaccaccttgaagaaaggaagaagaagatgtcattcttcaactggtggaattttacactttgcacggcaatgctgcttggggcaacagtgattgtttatgttcaagactttgtcagctggggagtatcttatctcatcctcagcatgttcatggctctcactatcattgctttctatgaggggaagcgtttttacaggtacaggagcacagaaggtaaccctttcatgctaattctacaagtactaattgcagcaataaggaaaagcaacttgtcctgtccttcaaatcccgattcattgtatgaattcccaaagtcagagaagtcacaaggaaggcttctaagccatacttgcaggctcaggtttcttgacaaggctgcaatagttgaagggaagtatactgagcatagagaccagaatccatggagattagcaacagtgacaagagtggaggagacaaagcttattctgaatgttattcccatatggctaacttcattaataattggtatatgtatagcgcaaggctcgacactctttgtcaatcaagcagcttctatgaacttaaagataatcaacagcttcaaaatcccaccagcttccatgacatctgtttcagctattagcccaataatagctatcccaatatatgataagattatagttccaattatgaggaaagtcaaaggtaacgaaaggggcatcagcgtcctttggagggttggcattggcttagcattcttagtcatagccatggtggttgctgccttagtagaaacaaagagattaagaatggttgaacatgatgaagtgataacagtaggggggactaggcatgagacaatgagtgtgttgtggttgataccccaatacttgatccttggaattggagcagattcattgtctctaattggtttgcaagagtatttctatgaccaagttcctgactcagtgagaagcttaggagtgggtttgtatcttagtgtggttggagtaggattcttcttaagcagttttctgatcatcactgtggatcatgtcacggggaagaatggaaaaagttggattgcgaaggatataaattcaagtcgtctagataaattttattggatgttggctgtcataaatgctttcaatttgtgtttctttctattcttggcaaaggggtacacttataaaaccgtgcaaaggaaaactagggaaatttgtagtgatggggtggagacaatggaatcatga

SEQ ID NO: 76 - DNA, 1773 bp, Glycine Max
atggagaagagaaatggaggcagaattgaagaaaataaagagaaatgggtgcatgatgcatctgtggactataaaggaagagttcctctccgtgcttccactggtgtatggaaagcctccctctttgtcctcacaattgaatttagtgaaagggtaagctactttgggatagccagcaatcttatctcgtacctgactaaagtgatgcatgaagaccttagtacagcaagcaagaatgtaaactactggtcaggaacaacaacccttatgcctctggttgggggatttgttgctgatgcttacactggtagattttatatggtcctgttttcttcatttgtatacctcatgggattaagcctgttgaccatgtctcaattcatcccaagtctaatgccatgcaacactaagatgtgccaacagcctaggaaggttcataaagtggttttcttgcttgccctttactgcatctcctttggtactggaggatacaaaccatgcttggaaagttttggagctgatcaatttgatgatgatcacttggaagaaaggaagaagaagatgtctttctttaactggtggagctttgcactgtgctttgcgttgctgcttggtgcaacggtggttgtttatgttcaagattttgtcagctggggagtagctactcttatcctagctattcttatggctctcactgtcatagctttctgtgtgggaaaacctttttacaggtacaggagggcagaaggaaaccctttaacaccaattttacaggtcttaattgcagcaataaggaaaaggaatctaacttgtccatcaaatcctgctttattgcatgaggtccctgagtcagagaggtcccaaggaaggcttctgagccacactaacaggctcaggtatctatcacacatggaccttaagtacaatccatggagattagcaacagtgactagagtggaggaaacaaaacttgttctaaatataattcccatatggctaacttcattaacagttggagtatgcgtgggacaaggacagacactctttgtcaaacaagcagccgctaccaacttaaagataagcgacagtttcaaaatcccaccagcttccatggcctctgttgcagcagttggtaccttaatagctgtcccaatatatgatagggttgttgttccaattctgagaaaagtcactggcaatgaaagaggcatcagcatccttaggaggatcagcattggcatgacattatcagtcttactcatggttgttgccgctttagtagaatcaaagaaactaagaatggctgcacatgaagtcctcacggtaggggaaactaggcatgagactatgagtgtgatgtggttgataccccaatacttgattcttggcattggagattcattttctctggttggcttgcaagagtatttctatgaccaagttcctgactcaatgagaagcataggaatggctttgtatcttagtgtgcttggagtaggatttttcttatgcagctttttaatcatcatcgtggaacatatcacgggtaaaactggcaatagttggattgggaaggacataaattcaagtcgtttggataagttttattggatgttagctgtcataaatgctttggttttgtgtgtctttctcttagtgtcaaaaaggtacacttataaggccgtacagagaagagctatggaaactgattgttttattgttgcagattactcaaatgtgggatctaataaaactcaaaagggcaattcctag

SEQ ID NO: 77 - DNA, 165 bp, Glycine Max
  misc_feature (83)..(165): n is a, c, g, or t
atggagaatattaaaagtatgaatttgctaatagaattgttgtgtactatgtatatgtacaagtgtgtgttaagttgcttccnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 78 - DNA, 1890 bp, Glycine Max
atggagcaagaaatggaaaagagaaatgtagtcagaattgaagaaaatgaagagaaatgggtgcatgatgcatctgtggattataaaggcagagttcctctccgtgcttccactggtgtatggaaagcctccctctttgtcctcacaattgaacttagtgaaagagtaagctactttgggatagccactaatcttatctcgtacctgactaaagtgatgcatgaagaccttcaaacagcggccaagagtgtaaactactggtcaggaacaacaaccctgatgcctcttgttgggggatttgttgctgatgcctacactggcagattttatatgatactgttttcttcatttgtatacctcatgggattaagcctgctgactatgtctcaattcatcccaagtttaaaaccatgcaacaatggggtatgccatcggccaaggaaggttcatgaagtggttttcttccttgccctttactgcatctcctttggtactggaggatacaaaccatgcttggaaagttttggagctgatcaatttgatgatgatcacttggaagaaaggaagaagaaaatgtctttttttaattggtggaatttcgctatgtgctttgcattgctgcttggtgcaacagtggttgtttatgttcaagactttgttagctggggagttgctactcttattgtcactattcttatgactctcactgtcatagctttctgtatgggaaaacgtttttacaggtacaggaggacagaaggaaaccctttaacaccaattttacaggtcttaattgcggcaatgaggaaaaggaatctatcttgtcgttcaaaccctgctttgttgcatgaggtcccagagtcagagaggtctcaaggaaggcttctgagccacactaacaggctcaggtatctatcacacatggaccttgtcagattgacactaatatttttattgatacaatttaatggaataaataatacaaaagataagtacaatccatggagattagcaacagtgacaagagtggaggaaacaaaacttgttctaaatataattcccatatggctaacttcattaacagttggagtaaccgtgggacaaggacagacactctttgtcaaacaagcagccgctaccaacttaaagataagccacagtttcaaaatcccaccagcttccatggcctctgttacagcagttggtaccttaatagctgtcccaatatatgataggattactgttccaattatgaggaaattcactggcaatgaaagaggcatcagcatccttaggaggatcagcattggcatggcattatctgtcatagtcatggttgttgctgccttagtagaaggaaagagactaagaatggctacacatgaagtcctcactgtaggggaaactaggcatgagactatgagtgtggtgtggttgataccccaatacttgattcttggcgttggagattcattttctctagttggcttgcaagagtatttctatagccaagttcctgactcgatgagaagcttaggaatggctttgtatcttagtgtgcttggagtaggattcttcttaagcagctttctaatcatcattgtggaccgtgtcacggggaaaactggcaatagttggattgggaaggacataaattcaagtcgtttggataggttttattggatgttggctgtgattaatgctttggttttgtgtgtctttctcttggtgataaaaaggtacacttataaggccgttcagagaagagctattgaaactgattgttgcaagagtggagatgcggtaacgggaacagatgttgggaccggtaattcaaacatgctcttgtacctctcactactatattttcagctgaacaaaatgtcgtag

SEQ ID NO: 79 - DNA, 1770 bp, Glycine Max
atggagcctgccaaaaccattcacaacaatgtcaaatactcccccatcttcttagccatctttgttctgatcttagcttcagcattgtcttcagcaaatgccaaaattcacgagcacgagtttgttgttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggcacggtgttaggcaaatgagaacagggtgggcagatggaccagaatttgtgactcagtgcccgattcgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcacgagacacccattcttcttggggaatggtgggacgcaaaccctattgatgttgtgaggcaggccacacgaactgggggagccccaaacgtgtctgatgcatacactatcaatggtcaacctggtgatctttacaagtgctccagcaaagacaccaccattgtcccaatacatgccggcgagaccaaccttcttcgtgtcatcaatgctgcactcaatcaacctctcttcttcaccgtcgcaaaccacaaactcacagtggttggtgccgacgcctcctacctcaaacccttcaccaccaaagtcctcatgctgggccccgggcaaaccaccgacgtcttaatcaccggcgaccagccaccttcccgctactacatggcggcgcgtgcgtaccaatccgcccaaaacgctgccttcgacaacaccaccacaaccgccatactcgaatacaaatcaccgaatcaccacaataagcattctcaccatcatgccaaaggagtaaagaacaaaaccaaacctataatgcctccactccctgcttacaacgacacaaacgcagtcactgccttcagcaaaagcttcagaagccctagaaaagttgaagtacccactgaaattgaccagagcctcttcttcactgtgggtttaggtatcaagaagtgccccaaaaacttcggaccaaagaggtgtcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttgaagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtgcatggcttttgcattgtcacttggacgttcacattggatggggtttggctacggtgttgttggtggagaatggagttgggaagttgcaatccatagagcctcctcctgtggatcttcctctttgttag

SEQ ID NO: 80 - DNA, 876 bp, Glycine Max
atggaggaggagaaatcgagactgttgctgatgccatcaccgttacaaggccacataacaccatttctccacctcggtgacattctctactcaaagggcttctccatcaccattctccacactatcttcaagaacggttggcttcttcggtgctgtctcggtctcaacatgaacctcttgcttcatttccaatgctgcacttcacttcactcaacctgtttgcgactaattgaagctcctacgccttgtgctcagaactggtggagcctcttcttttcttgtttttgcctccctctggtgtatctcccaccactcaaggtgaaagatcttcctaagtttcagtcgcaggatcctgaggaatgcaaggcgtcttcaggggttatttggaacacctttaaagagttggaatcatctgtttatgtgagttttgggagtattgcagcaataagcaagactgagttcttggagatagcttgggggttagccaacagcaagcagctgtttttgtgggtgattcgacctgggttaatccatggctcagaatggcttgaaccattgccaagtggattcctagagaatttgggaggaagaggctacattgtcaaatgggagagcatatgtgaaggggttccaatgatttgtatgccttgttttgcagaccaaaaggtcaatgccaaatatgcaagcagtgtttggaaggttggggtgcaattacagaataagctagagagaggagaggtagagaagaccattaaaaaactaatggttggggatgaagcgaatgagattagagagaatgccttaaatttgaaggaaaaggcaagtgatttcttgaaagaaggtggttcgtcttactgtttcctggatagcttgtga

SEQ ID NO: 81 - DNA, 396 bp, Glycine Max
atggaggctggcattgatatacagtgcaggtcaattagtgcagaagagatttctattctcatattgtctgggaaatatgttgctattgcattagttgatcacaacaaattgagtcatgttttgcaagatgttcctgtgcctggtgttttcagcaacaactctggctacacaggtcactatgtgttgatatgtggctatgatgctggagcagatatgtttgagattagagatcctggcagctctaagaaacataagaggatttcttcaaagtctttagaagaagctcgcaaagcctttggaactgatgaggatcttcttttgatatctttggagaaaagcagtaaccatcatcaaccttttatgcaactatccaatgatgtcaataccgattcttga

SEQ ID NO: 82 - DNA, 384 bp, Glycine Max
atggagggaaaggagcaaaatgtttcattgggagccaacaaattctcagagaggcaaccaattggaactgcggtgttggctgccacctttattcttgtctacaccgttttctcagccaccgatgccaagtgtaacgctagagactcacacgtccctattttggcacccttgccaattgggttcgctgtgttcttggtgcacttggccacaatcccaatcactggaactggtattaaccctgcacgtagtctcggtgctgccatcatcttcaacaaagaccttggctgggatgatcactggattttctgggttggacctttcgttggtgcagctcttgcggcactttaccaccaagttgtaatcagagccattcccttcaaataa

SEQ ID NO: 83 - DNA, 930 bp, Glycine Max
atggatgtgataaagacgcagcaaatctcttctcgaccaatcgagaaagtggtggttcatcctctcgtgcttctcagcatcgtcgacaactacaacagagtcgccaaagacactcgcaagcgcgtcgtcggcgtcttgctcggctcctccttcaaaggcaccgtcgacgttaccaacagctacgccgtgccctttgaagaagatgacaaggatcctagcatctggtttcttgaccacaattaccatgaatcgatgttttccatgtttaaaagaataaatgcaaaggagcatgttgtggggtggtatagcactggtccaaagctgcgtgaaaatgaccttgacattcatggcttatttaatggctatgttccaaatcctgtcttggttataattgatgttgaacctaaggaattgggaatcccaacaaaagcatattatgctgttgaagaggttaaagagaatgccactcaaaaaagtcaaaaggtgtttgtgcatgtgccatcagagattgctgctcatgaagttgaggaaataggagtggaacacttgcttagagatgtgaaggatacaaccattagcacccttgccacagaggtaagtgcaaaactcacagccttgaagggtttggatgcaagacttaaagagatcaggggttaccttgaccttgttattgatggaaagcttccattaaaccatgagatcctgtaccatctgcaggacgtgtttaacctgctaccaaatctcaatgttgctgatcttatcaaggcttttgcagtgaaaacaaatgatatgatgctggtaatatacctctcatctctcattagaagtgtaattgcactccacaacttgattaacaacaagatgcttaacaaggaacatgagcgggcagaagattcgaaatcagttacggtgccaggtgcagctgcttaa

SEQ ID NO: 84 - DNA, 1770 bp, Glycine Max
atggattcggagttccccaacaaagcgttaacgagcacgcgtttttccgacctgaatccaccactctctgaaccggttctccaagccctatcacactctggcttcgagttctgcacccctgtccaagctgccactattcctctgctctgcagcttcaaggacgtcgccgtcgacgccgccaccggttccggcaaaactctagcttttgtcgttcctctcgtcgagattctacgccgctcctcttctcatcccaagcctcaccaggtgctaggaataattatatcccctacaagggagctatcaactcaaatatatcatgttgcacaacctttcatttcaacattggctaatgttaagtccatgctccttgttggtggagcagaagtaaaagcagacctaaagaaaatagaggaggaaggagcaaacatattgattggcacgcctgggcggctatatgacataatgaatcggatggatgtcttggatcttaaaaaccttgagattttgattttggatgaggctgatagactcttagatatgggattccagaagcagataacttctattataactctcttgcctaagcttcggagaactggtctgttctctgctactcaaactgaggctattgaagagcttgctaaggcaggattgaggaacccagtgagggttgaagttcgagcagaaacaaaatcagaaaatggtcctgcatcatcaaaacaaccagaatcttccaaaacaccttcaggacttcacattgagtacttggaatgcgaggcagataagaagccatcacagctagtacatatcctgataaagaatctctcgaaaaaaattattatatatttcatgacttgtgcttgtgttgattattggggagctgtccttccttgtctttctgttttgaaaggcttctccttgattcccctgcatggaaagatgaagcagtctgccagggagaaagcactagcttcatttacatccctttcaaatggaattcttctatgtacggatgttgcagcacgtggactggacataccaggtgtagattgtatagtgcagtatgatcctcctcaagatccaaatgttttcatacatagagtaggtcgaactgctcggctgggtaaacaaggtcatgctgttgtcttcttattaccaaaggaggaatcttatgtagaattcctgcgtataagaagagttcctcttcaagagagaatatgtgctgatgaagcatctgatgttgttcctcagattcgttctgctgcaaaaaaagatcgcgatgtcatggaaaagggaattaaggcctttgtctcttacatccgtgcttataaagagcatcactgttcctatatttttaggtggaaagaacttgaaattggtaaattggccacaggatttggcttattacaacttccttcaatgccagaggtaaaacaccactcactttccattgatggatttgaaccagttgaagatatcaatttgggggacattaagtacagggataaatcacgggagaaacaaaggaagaagaaccttcaagcaaagaaagaagccaaagagaaagagccaaaacctcaaaaaccgaagaaaaccccaaatgcacccactgacatgcggaagaaaacagcccgacagagacgtgctcagcagacaatggaagacgaggaagagttgatgcatgaataccgcttgttgaagaaattgaagaaagggaccatagatgagaatgaatatgccaagttgacaggcactgaggaattactttga

SEQ ID NO: 85 - DNA, 225 bp, Glycine Max
atggcaaatgttgtggaagtgaaagtcggtttgcactgtgatgattgtatcaagaaaatcctcaaggccatcaagaaaattgaagatattgaaacttataacgtggacacaaagctgaacaaggtcattgttacgggaaacgtgacaacagatcaagtgatcaaagtccttcaaaaaattggcaagaatgcaactgccggggaagatactcaaaccaataagtga

SEQ ID NO: 86 - DNA, 954 bp, Glycine Max
atggcaaggaaactgacgaaagcgcagaagaagatagcatacgatgcgaagctgtgcaagcttctggacaactacacccaaattctggtggtggctgcggacaacgtcggatcgaaccagcttcagaacattcgacacggtctgcgtggcgactcggtcattctgatgggaaagaacaccatgatgaagcgaactattaagatccatgcccagaacaccggcaacaccaccatcctcaaccttattccccttcttgtcggtaacgtggggctgattttcaccaaaggtgacgtcaaggaggttaaggaagtggtttccaagtacaaggtggcagctcctgctcgtgtaggtttagttgcacctattgatgttgttgttcccccaggcaacacagggctggatccctctcagacctctttctttcaggtgcttaacatccctaccaagattaataagggtactgtggaaattatcacccctgtggaactcattatgaagggagacaaggttggctcttctgaagctgctttgctttccaagcttgcgataaggcccttctcatatgggcttgctgtcgtttctgtttatgagaatggttcagtttttagccctgaggttcttgatctcactgaagatgacctcgttgtgaagtttgctgagggtgtctgtatggtgtcttcactttccttggctatctcctacccatccattgcagctgctccacacatgtttgtcaattcctacaagaacatcctggctgttgcagtggcaaccgaatattcgttccctgaggcagacaaggttaaggagtacttgaagctaaaatcacctgttgttgccgcacctgctactaagtctggcgctgctccagctgcagcatccaaggtggaggataagaaggaagaagccgcagatgaatccgatgatgacatgggcttcagtttgtttgattaa

SEQ ID NO: 87 - DNA, 1671 bp, Glycine Max
atggccagccataactacaaagtcttcagctgcttcaacaggaagttcaccgtcaccgagccgggcccaccgccggacgtccaaaaagcgttttctgaatttgccgacggagcctcctccctgtccggcgatcacctcctccgatttctggcgaagcaccagggcgaagtggactgcaccgcagtggattcggagcggatcctccagcaatcgcggaaagaggatcgggaaagtggactggatctccacgacttcttccgtttcctgctacatgacgatttcaatagccccatcaaatctcaggtacatcatgatatgactgctccattgtcacattatttcatttatactgggcacaattcctatcttaccgggaatcaactgagcagtgactgcagtgatgtgccaatcataaaggctttgcaacgaggtgtgagagtaattgaactagatttatggccaaattcagacgaagatgatatcgaagtagttcatggaaggactcttaccactcctgtctcactcatccaatgtttgaagtccataaaagagtatgcttttgttaaatctcattacccactcattataactttagaagatcaccttactccagatcttcaagctaaagctgcagagatggcaactcaagtatttggagaattgctttattatcctcagacagattctctgatggaattcccctcaccggaatcattgaaaggccgaattcttatatcaaccaaaccaccaaaagaatttcttgaatccaaagaatatgatgacaaggacaatgaaaaggaatcagctgacgagctttcatcattgccagatcaaactagtgaacaggaaactgatgataagagtgcacctgagtacaaacacttgattacaatccatgctgggaaaccaaagggtgatatacaggatgaattaaaagctgctggagcagttaggcgcttaagcttaagtgaacaagcacttgaaaaggcttctgaatcttatggagctgatattgttaggtttacacagaacaatattctcagagtatatccaaagggaacacgtctcaattcctcaaattacaagccacacatagggtggacgtatggagctcagatggttgcgtttaacatgcaggggtatggcaaatcactttggtacatgcaaggaatgtttagagcaaacggacgatgcggttatgtgaaaaaacctgaatttcttattgagaaaggtccacataatgaggtttttgatcctagaagaacattgcctgtgaagaaaacattaaaggtaaaagtctatatggggactggttggagcttagatttcagccaaacagactttgatacttactcgccaccagatttttatgttaaggtttgtattgttggagttcctgctgatatggccaagaagaaaacaagtgtaatttcaaataactggtttcctgtttgggatgaagagtttgatttccctttgactgttccagaactggctttgctccgcatagaagttcgagagaatgataagagtcagaaggatgactttggtggacagacatgtttgcctgtctcagagctaaaatctggattccgatcagtccctctccatgatgaaaagggtgacaaattaaaatctgtgaagcttctgatgtggtttcagtttagatga

SEQ ID NO: 88 - DNA, 870 bp, Glycine Max
atggccgatcagttatcgaagggagaggaattcgagaaaaaggctgagaagaagctcagcggttggggcttgtttggctccaagtatgaagatgccgccgatctcttcgataaagccgccaattgcttcaagctcgccaaatcatgggacaaggctggagcgacatacctgaagttggcaagttgtcatttgaagttggaaagcaagcatgaagctgcacaggcccatgtcgatgctgcacattgctacaaaaagactaatataaacgagtctgtatcttgcttagaccgagctgtaaatcttttctgtgacattggaagactctctatggctgctagatatttaaaggaaattgctgaattgtacgagggtgaacagaatattgagcaggctcttgtttactatgaaaaatcagctgatttttttcaaaatgaagaagtgacaacttctgcgaaccaatgcaaacaaaaagttgcccagtttgctgctcagctagaacaatatcagaagtcgattgacatttatgaagagatagctcgccaatccctcaacaataatttgctgaagtatggagttaaaggacaccttcttaatgctggcatctgccaactctgtaaagaggacgttgttgctataaccaatgcattagaacgatatcaggaactggatccaacattttcaggaacacgtgaatatagattgttggcggacattgctgctgcaattgatgaagaagatgttgcaaagtttactgatgttgtcaaggaatttgatagtatgacccctctggattcttggaagaccacacttctcttaagggtgaaggaaaagctgaaagccaaagaacttgaggaggatgatcttacttga

SEQ ID NO: 89 - DNA, 630 bp, Glycine Max
atggccgattccaaggagaagaatcgcaaatttgtggagaccatcgaactccaaatcgggttgaaaaactacgatccacagaaggacaagcgtttcagtggctctgtcaagctgccccacatccctcgccccaagatgaaaatttgcatgcttggtgatgctcagcatgttgaagaggcggagaagataggactggactggatggatgtggaagccctgaagaagctaaacaaaaataagaagttggtgaagaaactagctaaaaagtaccatgcctttttagcttctgaagcagtcattaagcagattcctcgtcttttgggtcctggtctcaacaaggcaggaaagttccctacacttgttactcaccaggaaactcttgagtcaaaggttaacgagtccaaggccatggttaaatttcaacttaagaaggtgctctgcatgggagtagctgtggggaatgttagtatggaggaaaagcaaatcttccaaaatgttcaactgagtgttaatttccttgtctctttgttgaaaaagaactggcaaaatgtgcttgtatctgaagagtacaatggggaaatcttaccgtgtcttttgaggaattttttttttaatccggtgaatttgtga

SEQ ID NO: 90 - DNA, 708 bp, Glycine Max
atggccttcagaggaactggaacgctgattttggtgagtctcttatggcttttcttcctctgcgccaccattgctttctttcagctccacttggtagacaaccgaaccagcaacccttcctctcgcagtaacttcattgcaactcaacatgatcgctcggatacccctttggaacaggatttggagggtgtcactcacaaggtgtattttgatattcagatccatggcaaagtagcaggtcgcatagtcatgggcctttttgggaacacagtaccaaaaactgcagaaaactttcgggcgctttgtacaggagagaaaggagtgggaagaagtgggaagtctcttcattataaagggagcacattccataggattatgccgagctttatggtccaggggggtgatttcacccgtggtgatggaagaggtggagaatcaatctatggtgataagtttgccgatgaaaactttaagctgaagcatactgggccaggatacttatccatggcaaattctggggaagacaccaacggctcccagttcttcataacaacagttaaaaccagctggctggatggacaccatgtcgtattcggcaaggtactttccggtatggacgttttgtacaagattgaagcagaaggaagtgaaaatggctcgccaaaaaacaaggttgtcatattagacagcggagaattaacttcatga

SEQ ID NO: 91 - DNA, 1569 bp, Glycine Max
atggcgaacgtggatgaacttttatcttccttaatctcagacgtccacgcctacaccggcaaagaccctcttcttccatggcttcgggcgatccgaaaggtgaaggacactcttcctcccaaaaccctaaaggaaaagttacccgcgttcctgcagaaatgcgcacacaccttcgagctcgatcggcgttacagaaacgacatgcgctatcttcgggtttggctccacctggtggattttgtggatgatccaaaaacacttttgagaacgatggagactaatcacattgggacaaaacgttgtgaattctaccaagcgtatgctctttactacgagaaaagcaagaagagcgatgaggcagagaaaatgtaccatctgggagtgaagaagcttgcagagcctctagataaattgcagaaatcatatgaacaatttcttcaacggatggagcgaaaaaataataagagaatccaggatcaggaagcaaaagcttccaggaggcctctgtctttaaagagcttcccttctcttgacaacaaaactgagggaagcaaaagcaatggagtagactgtgttgagggtgtgcaaaagggaccccgaattgataattatgcagctaaaggtgtggctgatgataaaaacataaagactaagaaggatgagcgcaagagattttgtggtgatgatacagttgtagtcaagtttgttgacactgccatggttggaaagtctgaagcagaagatgcatgccatcatggattagtggatcctacaataaatatgaaggaggccatgaatgccattaacagcatgttccgggagccattggagactgttccattaggcaagaaatcacataaaaaccattcaaaagaagatcgtagtacaaagaacgagtttgaggttttggttgatgaaaacttggacaatggaatcaaaccatccggttccttgtcacttcggaacaggactgaagctagccaacctcaccaagaaccgctccagatatacattgatgatgaagagacttctgagaccagtgatgtgaatttgtttgaaggtggttgtacttcatcggcttcacaaccaaatggctttgtttttctacgctccaaggatattccttctaaaaaatctagtgatatggatgctgatagcgatcgtaattcaaagttcagagaggatacagtcgtttgcagatttgttggttccgccattttggatgaaccagaggtggaaaatgtttgccaccacggtttagtagaccccaccatcaacttgaaagaagctatggatgacataaataacatgtttgggaagccaatagattttgttaggagaagaaccaccaccaagcaggagaaggcccaccagagcattaggggaaatgacattggtgggttttcaatccttgctgatgatgagctccaggaacaagaagttccacctccaccaccaccaaaattgctaggaaagtccaaggaatctgatttgtttgagccaactatcctcacaaaggaagccatagatgatataaacaagatgtttaacatgcctctggatttttag

SEQ ID NO: 92 - DNA, 1839 bp, Glycine Max
atggcgagtagcagcagcaacactccgaaggaaagcgttgttgtcgactgcggaaggcgtcgaacctcttgcggctattgcagatcctctcgtcacaatagcatctctcatggcatgtgggcacatagccttactgtggatgactaccaaggtcttcttgatcgtggctggagaaggtctggatgttttctttataaaccagagatggaaaggacatgctgcccttcttatacaattcgcttgaaagcaagtgactttgttccttctaaggagcaacttcgtgtatctagacgaatgcaaaggtttttagatggaaccttggatgtaaaaaaagttgatgttatggaggacccaaccaaatcgggaatcttcactagacctatgtcagaagaatccttagctgctggcagtgaaaacaaggatgaagttgaaaaatctttgcattatttatcaaaccaaattgataatgttatacacatcctcattgagaagggggaatttccctctggtattcaattaccaaatgcttcagtaaaaagagtttcacagggaaaaagaaagttactagtcaatggatcagaagatctcttatatagtagcaatatagcctttcaaattgcagcatctataaaacgagcacaatcatgtgacaaggttgtcgatgattccaaaccagcaagagtctgtgaaaaggagaatgattcatctcctaaaattattgcagaaaagctagtagcttctttagatccaactgtgaaaaattctgatttgtctatcagggcttgcaatggacatatcaatttttatgcttctagtaagcaagtgtccctgaacagaagtgttcaaaatgctccagttcctaaaatttctagaatgaagcatgacagtggaggaaattgtttgattggtcaggtaaaaaggcaaaagcttgagatccgtttaaacagatccagttttgatccagaagaatttgctttgtacagaagatatcagctcaaagtacataatgataaaccacaaaatgtcacagagaactcatatcgtaggtttttggttgatactccattaatacaagtttctcccactggtgatagcacagttcctccttgtggttttggctctttccatcaacaatatctaatagacggccagttagtggcagttggtgttatagatatccttcctaaatgtttgtcaagtaaatatttgttctgggatccagactttgcctttctatcactaggcaagtactcggcttttcaagaaataggttgggtgaaagaaaaccaggtttattgtcctagtctacaatactattatcttggctactatattcactcttgcagcaagatgagatacaaagctgcatatcgtccttcagagcttttatgccctcttcgctatcagtgggttccatttgacattgcaaggcctctgcttgacagaaaaccttatgttgtcttatcagattcttccattttacaaaatggagagtcatccctacctcaaactacggaagatgtaatgagaaggggttttgatgatgttggccaagaagatgcaaatgatgttccaatgcttgatgatgaagaaatggttgagtctgaatcagaatgctctgatgatgaacctgacctagaaaccacttcagatgatgatccagaaattgctgatgtcagcaaggttttgctagggataaagggatctcatgtgaaatacaaggatctgcgggttgtctttggtcctgagcagcagagttacttggagtcacaattgcggagatacaggaaggttgtgggtccattgctatccgagcgaatcgtctattcgctcggataa

SEQ ID NO: 93 - DNA, 870 bp, Glycine Max
atggcggcgagcgatcgcacagtgttgcaattctcttcatcatcttcttcttcttcgcagatcttgtccgcgaaggtccaccctctggtcatcttcaacatctgcgattgctatgttcgacgccctgaccaagccgaccgcgtcatcggaaccctactcggctccgtccttcccgacggaaccgtcgatatccgaaattcctatgctgttcctcacaacgagtctatcgaacaggttgcattggatatagagtaccaccacaatatgttaatatcccaccaaaaagtgaatccaaaggaaatcatagtaggatggtattcaaccggtcttggagtaactggtggtagtgcattaatccacgagttttattctcgagaagtgcccaatcccatacacttgactgttgatacaggatttacaaatggagcgggtacgattaaagcatacgtgtctaacaatttatctcttggagaacgtcaaattgctgcacagtttcaagaaattccattagatcttcgtatggtggaagctgagcgaattggagttgatatgctgaaggcaactgcagttgacaaaattccctcagatttagaagggatggaagcatcaatgcaacatctgctagtcttgattgatgacatctacaaatatgttgacgatgttgtggaaggacgagtggcaccagacaacaaaatcgggagatttatatcagaagctgtaggttcccttcccaaattgtccccatcagtttttgataagcttgtgaatgacagtttgcaggatcacttgcttttgctgtatttatctagtatcacaagaacgcagcttagcttggctgaaaaattgaacacagctgctcagattctgtga

SEQ ID NO: 94 - DNA, 5103 bp, Glycine Max
atggcggctgccaacgctccgatcgccatgagagaagctctcaccttgccaagcattggcataaatccgcagttcatcactttcacgcatgtgacgatggagtccgataagtatatatgcgttcgagaaacggctccgcagaatagtgtggttatcattgatatgaacatgccgaatcagcctttgaggaggcctattacggcagattccgctcttatgaatccaaattccagaatccttgctttgaaagctcaactccaaggaacaactcaagatcacctacaaatttttaacattgaaatgaaagcaaagatgaaatcttatcagatgcccgagcaggtggtcttttggaagtggattacccccaagttgttgggtcttgtaacacagacctctgtataccattggtcaattgaaggtgactctgaacctgtaaagatgtttgagagaacagcaaatttggcaaacaatcaaataattaattatagatgtgatccttctgagaaatggttggtcttgattggtattgctccaggttcccctgagaggccacaattggttaaaggaaacatgcaactcttctctgtggatcaacagcggagccaggctcttgaagcacatgcggcatcatttgctcaattcaaagttcctgggaatgaaaatccttctactttgatttcttttgccactaaaacacttaatgctggccaaattatatccaagttgcatgttattgagctgggtgcacaaccagggaagccatcatttacaaagaaacaagcagatcttttctttcccccagattttgctgatgattttccagttgccatgcagatatcccacaaatacagtttgatttatgtgataacgaaacttggtctcctatttgtctacgatttggagacagctacagctgtatataggaacagaattagtccagatcctatatttttgacatcagaagctacatctgttggaggcttttatgccattaataggagaggccaggtgttgttggctactgttaatgagcaaacgatcgtgaattttgtcagtggtcagttaaacaatttggagctagcagttaatcttgccaagcgaggaaatcttcctggtgctgagaaactggtggtagaacgtttccatgaactgtttgcccaaacaaagtataaagaagcagctgaacttgctgctgagtctccgcaaggaatccttcgcacacctgatacagttgccaaatttcagagtgttcctgtgcaagctgggcaaactcctccactattgcagtattttggaacacttctaacaagaggaaagctgaatgcctttgagtcattggaattgtcaaggctggttgtgaaccagaacaagaaaaatcttttggagaattggttggcggaggataagcttgaatgcagtgaggagctaggagatcttgtaaagactgtggacaatgatcttgctttaaaaatatacatcaaagccagagctactccaaaagttgttgctgcttttgctgagagaagggagtttgacaagattctaatatactctaagcaggttgggtacacacctgactatctcttccttttgcaaacaattctccggacagatcctcagggtgctgttaattttgcattaatgatgtcgcaaatggagggaggttgcccagttgattacaacaccataactgatctgtttcttcagagaaatctgatccgtgaggcaacagcctttctgctagatgttctgaaaccaaatctaccagaacatgggtaccttcaaacaaaggtgttggagataaatctggttactttcccaaatgttgctgatgcaattttggctaatggaatgttcagccattatgaccgtcctcgtattgctcaactttgtgaaaaagctggtctttatgtgcgagctttgcaacattacacagagttgccagatataaaacgtgtgattgtaaatacacatgcaattgagccacagtcactcgttgaattttttggtactctgtcaagagaatgggcattagagtgtatgaaagacctattgctggtcaatcttagaggcaacctacagattattgtgcaggttgctaaagaatattgtgaacaattgggcgttgatgcttgcataaagctttttgagcagttcaggtcatatgaagggctgtattttttcctgggatcatatttgagctccagtgaggatcctgacattcacttcaagtacattgaggcagcagcaaagactggacaaatcaaagaggttgagcgtgtgactagagaatcaagtttttatgatcctgagaaaacaaagaactttctaatggaagctaagcttccagatgcacgacctctgattaatgtttgtgaccgatttggatttgttccggatctaacacactatctatacacaaacaacatgcttcgttacattgaaggttatgttcagaaggtgaacccagggaatgctcctttagtcgttgggcagcttttagatgatgaatgtccagaagattttatcaaaggcttgattctctctgttcgttccttactgccagtggagccccttgtggaggagtgtgagaagaggaatcggcttcgtttgcttacacagtttttggaacatcttgtaagtgagggaagccaggatgtacatgttcacaatgcactgggtaaaatcatcattgatagcaacaacaatccggaacattttctcactaccaacccatactatgattctcgggttgtgggcaaatattgtgagaaacgtgatcccaccttggcagttgtagcttataggcggggacaatgtgatgacgagcttatcaatgtgacaaacaaaaattctttgttcaaactgcaagcaagatatgttgttgagaggatggatggtgatctttgggagaaagttcttaaccctgataatgcctacagaaggcaacttattgatcaggttgtatctacagctcttcctgaaagcaagagccctgaacaagtatctgcagctgttaaggctttcatgactgctgatctacctcacgaattgattgagcttcttgagaagattgtgcttcagaattctgcattcagtgggaactttaatcttcagaatctgcttattttaacagcaataaaggctgatccgtccagagttatggattatattaatagactggataattttgatgggccagcagttggagaaatggctgttgaggctcaattatatgaggaagcatttgcaattttcaagaagttcaacttaaatgtccaagcagtcaatgtcttgctagatcatattcatagcattgatagagctgtggagtttgctttccgagttgaagaagatgctgtttggagtcaggtagccaaggctcaactaagggaagggctagtaagtgatgccattgagtcctttatacgagcagacgatgccacacagtttttggatgttatccgtgctgctgaagatggaaatgcttaccatgacttggtgagatacttgttgatggtaaggcataagacaaaagaacccaaggtggacagtgagctcatttacgcgtatgcaaagattgatcggctcagtgacattgaggagttcattcttatgccaaatgtagccaatcttcaaaatgttggtgaccgattatatgatgaagaactatatgaggctgctaaaatcatatttgcttttatatctaactgggccaagttagcagttacacttgtgaagttgaaacaattccaaggtgcagttgatgcagcaaggaaagctaacagtgcaaaaacatggaaggaagtttgctttgcatgtgttgacgcggaggagtttcgtttggcccagatatgtgggcttaatattattattcaggtggatgacttggaagaggtcagtgaatattaccaaaatagaggttgcttcaatgagctaatatcgcttatggagagtggtttaggattagaacgggcacatatgggtatctttacagagttaggagttctgtatgctagatatcgtcatgagaagcttatggagcatatcaaactatttgcgacccgactcaatattccaaaactcataagagcttgtgatgaacaacaacattggaaggagctgacatatttgtacatccaatatgatgagttcgataatgctgcaacaaccatcatgaaccattcacctgaagcatgggatcacatgcaattcaaagatgttgttgtcaaagttgctaatgtagagttgtattacaaggctgttcatttctatttacaagagcatccggatcttatcaatgatgttttgaatgtccttgcacttcgtgttgatcatgcacgtgttgttgacatcatgcgaaaggctggtcatctccgtcttgtcaagccatacatggttgcagttcagagtaacaatgtgtctgctgttaatgaagcccttaatgaaatatatgttgaggaggaagactatgatagattgcgcgagtcgattgatttgcacgataacttcgaccaaataggcctagcacagaagattgaaaagcatgagcttcttgagatgagacgtgttgctgcttatatttacaagaaggcaggtagatggaagcagtccattgccttgtcaaagaaggataacctttacaaagatgccatggagacagcctcgcaatctggtgaccgtgaacttgctgaggagttgcttgtttatttcattgatcagggaaagaaagaatgctttgcctcgtgtctatttgtttgctatgatttgatccgggcagacattgctcttgaattggcctggatgaacaatatgattgactttgccttcccatatctcctgcaggttatccgtgagtacaccggcaaagttgatgaactggtgaaggataaaattgaagcgcagaaccaagtgaaggctaaagaacaagaagagaaggaagtaattgctcaacaggatatgtatgctcagttgttgcctcttgctttgcccgcaccaccaatgcctggaatgggaggaggctttgcgcctccccctccaatgggtggattggggatgcctccaatgcctccttttggaatgccacccatgggcagctactga

SEQ ID NO: 95 - DNA, 489 bp, Glycine Max
atggctaagtactatgatattgatgatattatcgtcgaggaagagattgaaacaggttccaaagttgaactgcctttttggcttgctcatgagttacagttgagacaagcagtatcagtcaatgttcctccttgtttcaatcaaaagacaaggcaggaactccatgctgattctgcaggtgtggatctgaggtccagatgtccatttttctatgaatttggttgcaagatagcacccatagttggcgaccgaaccattgggtttctgttgttgtctgcatttaagagtaggtacaaggaaattctcaccaaggcacattctgtagcatttgcagctggttccaaattttggactatactgacaaaagaagagatatacttgtatgagacagctcaatccgcaatggcatccttcaagaagtggcgaatgggggggcccagatttcagatagcttctgtactgggaagaaagagaaaatctaaggaatag

SEQ ID NO: 96 - DNA, 1428 bp, Glycine Max
atggctcaaggagataatgggtcctccaaatcttcgtcagtgactccgtatgaagaagcattggatgccttgtcatctctgatcactaaacgcactcgtgtcggtgatgtcaatatggaggaacgattcaacgtgctttataagtacctaaagatgcttgatttggaggaggcgatttcaaatatgaagattatccatgttgctggcaccaaagggaagggatctacatgcaccttcacagaatctatattacgcaactgtggatttcgcactgggcttttcacttctcctcacctaattgatatccgagaaaggtttcgtttagatggtgtggaaatctctgaagagaaatttttagtttatttttggtggtgttatgatagactaaaggaaaatactgatgacaatgttccaatgcctacattttttcacttccttgctttacttgccttcaagatatttgcagcagagcaggtagatgtttctataatggaggttggattaggtggaaaatatgatgcaacgaatgtggtcccaacacctattgtgtgtggtataacctcccttgggtatgaccacatggagattcttgggaatactcttggagaaattgctggtgagaaagctggtatcttcaagcatcggattccagcatttactgtgcctcaacctgatgaagcaatgcatgtactcagagagaaggcttctcagttaaaggtacctcttcaagtggtaaccccattagatgccaaattgctaaatggttcaagactagcgcttggaggtgaacaccaatatataaatgctggtcttgctattgcattatgctctacgtggctgaaaatgaatgggcatcttgaagactcgtacttgaaacatatgcaacacactttaccagagaagttcataaaagggttaacaactgcaagtttgcaaggaagggctcagattgttcctgatcagttcatcaatgatgaaataccaaatgaacttgtcttctttttagatggggctcatagtcctgaaagcatggaagcatgtgccaggtggttttctcttgctattaaagatcaagaccagattttgtttcatcagaaacttgataattctaacttctcaaaccaagtagtgaagatgcacaatggtgaaactgtacagaagaaatccacacagattttgctgttcaattgtatgtctgagcgaaaccctcagttgcttcttccccacttgatgaaaacatgtgctgatcatggtgtctacttcaagaaggcactctttgtacctggtttatcagtgtatcacaaagttggatcccatgctttaccagcgacagattctgatgttgacctgtcgtggcagcttactctacaaagagtgtgggaaaatctcatgcaagggaacaaagagcctactttagaatttcattga

SEQ ID NO: 97 - DNA, 1023 bp, Glycine Max
atggctccgaaccttgaatgtcgtatgtacgaagcgaagtacccggaggtggacatggcggtgatgatacaggtgaagaacatagcggacatgggggcgtacgtgtcgctgctggagtacaacaacatcgagggcatgatcttgttctcggagctctctcgccgtcgtattcggagtgtgagcagcctcatcaaggttggccgcatcgagccggtgatggtgctccgtgtcgacaaggaaaagggttacatcgatctcagcaagcgcagggtctccgaagaggacatccaggcctgcgaggagaggtacaacaagagcaagctcgtccactccatcatgcgccacgtcgctgaaaccctcaacatcgatttggaggagctctatattcacattggatggcctttgtatcgcaaatatggtcacgctttcgaggctttcaaaataattgtgactgatcctgatactgttttaagtactctcactcgtgaagttaaggaagttggccctgatgggcaagaggtgactagtgtggtgccagctgtatcagaagaagtgaaggactctcttgtgaagaatattagaagacgaatgaccccccaacccttgaaaattagggcagatattgaaatgaaatgttttcaatttgatggagttcttcacattaaggaggcaatgcgtaaggctgaagctgtgggaaatgatgactgccctgtcaaaattaaacttgttgctcccccactttatgttcttaccacccagacactggacaaggagcaaggaatattggttctcaacaatgccatagcttcttgcactgaagcaatagaacaacacaagggtaaacttgtggttaaggaggcagctagagcagtgagtgaacgtgatgataaattgcttgccgagcacatggctaagctacgccaagataatgaagaggtcagtggtgatgaagacagtgaggaggaagaagatacaggaatgggcgaggttgatgtggataatggtgccgggataacagagtga

SEQ ID NO: 98 - DNA, 471 bp, Glycine Max
atggctctttcaccactcagcatgcttgtggtcattgccaccatcttcctcccatccgttgctgtggccaaggaattcgtagttggtgatggtcatggatggacaataggctttgattatgcagcttgggctgcagataagaccttccaagttggggatgtacttgtattcaattatgctgttggagaacacaatgtgttcaaagtgaatggaactgcattccagagctgcacgattcctccagcaagtgaagcattgtctactggaaatgaccgtattgtattggcaattcctggcagaaaatggtacatatgtggtgttgaagatcactgcagtgctggccaaaagcttgttatcacagttcaaccccaaacactgcctccaactctaccaccatcacctactcctgcaccttcgcctcgtcaacatcgtcctcattttggtcgatgggtgcctaatatttttcattaa

SEQ ID NO: 99 - DNA, 837 bp, Glycine Max
atggctgccaccaccgccaccgccacgtcatacttttttggcacccgcctcaacaacccgacaaccttaaacaacggaagattccacgcgctcctcaacttcggcaaaaagaaggcggcggcgccgccaccgaagaaaaaggaagtgaaagtgaaaccctccggcgaccggctggtgtggtttcctaatgcggagccgccggagtggctcgacggaagcatgatcggcgaccgcgggttcgacccgttcggtttcgcgaagcccgcggagtacctgcagttcgacctggactcgctggaccagaacctcgcgaagaacgtcgccggcgatgtgatcggaaccagggtggaggtcgccgacgttaaaccaacgccgtttcagccctactcggaggttttcgggattcagaggttccgcgagtgcgaactcattcatggaaggtgggcaatgctgggtgctctcggtgctttggtcgttgaggctctcaccggagtcgcgtggcaagacgccggaaaggtagagctggtggaaggatcatcttacctggggcttcctcttccattttcattgaccacactgatctggattgaggtgatagtgatagggtacatagaatttcaaagaaatgcagaacttgacccagagaaaaggttgtacccaggtggcaggttctttgatcctctgggtttggccaacgaccctgaagaaaaggccagacttcaacttgctgagatcaagcattctcgcttagccatggtggtcttcctcatctttgcaattcaagctgctgtaacaggaaaaggccctatcagttttcttgctaccttcaacaagtga

SEQ ID NO: 100 - DNA, 837 bp, Glycine Max; identical to SEQ ID NO: 99

SEQ ID NO: 101 - DNA, 498 bp, Glycine Max
atggctgggaattctccatgtgcttcatgcaagctgctgagacgcaggtgtaccaaggactgcatctttgctccctatttcccttccaatgatcctcaaaagttcgccttagttcacaaggtttttggtgctagcaatgttagcaaaatgcttcaggaacttccggctcaccagagaggggatgctgtgagtagtttggtgtatgaagcacatgcaagagttcgggacccggtgtatggttgtgttggagccatatcccatctgcaaaaccaggtttctgagcttcaaatgcagcttgcagtggctcaagcagagatactctgcatccagatgcaacaggagccactgatgccaaacccagaaatggaagacccagatcagaaatcttaccttctccaaaatgaactccctcagtacctcaactatgcctcttctagcaacgtaatttatgattctttctcaagagagagcatttttggacatgacatggtttcttga

SEQ ID NO: 102 - DNA, 525 bp, Glycine Max
atggctggtatgcacttcagtatcctttctctactgctacttctggtggccttctcttacacagaagccagtgcagatgttccaaaaacaacagacaagaaaatagaggtggtggtggaagccacggtctactgtcagagctgtgaccactttggaacgtggtctttgattggagccaagcccattccttcagccaaagtgagtgttacctgcaaaagccacaatggtcatgtgagctactataaggtctttgagacagacaagaatggttacctttatgcaccacttgaagggttcaaaatgcagcattatatacttgaccaccccctccactcttgctacgtgaagcctgtttggtctcctcttgaaagttgcagcctcctctccaatgtcaattatggtctgaatggggctccacttcgttatgagaacaagaaattgcatggaagcaagtatgaggctgtcatatatgctgctggacccttagctttccgtccttctgaatgctcacagactcaccactaa

SEQ ID NO: 103 - DNA, 823 bp, Glycine Max
atggctgtgatacccacgaaagcggagaagaaggtgtcgtacgatgtgaagctgtgccaacttctagaggattacacccaaattctggtagtggctgcggacaacgttggatcaaaccaacttgagaacattcgaaaggatctacgtggcgactcggtggattctttccgagaccaccggcaacaaaccattcctcaaccttattccccttctagtggtcacaattggtgtaatttgaaggaggttagcgaagaggttgccaggtacaagttggtagctcctgctcgtgtagggttggttgcacctattgatgttgttgttcctcctggcaacacagggctggatccctctcaaacctctttctttcaggttaatttctgcaatcttgttattaataagggtactgtggaaatcatcacccctgtagaactcattaagaagggagacaaggttggctcttctgaagctgtgttgctttccaagcttgcgataaggcccttctcttatgggcttgttgtcgtttctgtttatgacaatggttcattttttagccctgaggttcttgatctcactgaagatgacctcattgacaagttttctgttggtgtctccatgaacgtccttgctgttgcagtggcaacagaatattcattcccagaagcagacaaggttaaggagtacttgaaggatcctaaatatttgctgtggctgctgttgccgcacctgctattgattctagcactgctccagctactgcctccaaggaggaggaaaagaaggaagaaccagcagaagaatctgacgatgacatgggtttcagttt

SEQ ID NO: 104 - DNA, 1692 bp, Glycine Max
atggcttggttatggcgcgcaggtgccaagctatctcttgtggcctccgccgtgggcggtggcgccacggcggcgcttattgccacctccgacgaccccgaaatggcgctcaagcttttcgccaccgtcccccatcgcctcttccgtggcgccgccaccgccgccaacattgctttcgattatgaatattcactgcggggattcccggaagggagtagtgagagggagagaatcaagcatgaagttcaccttcggtctgctcaaaaacttcaagacctatgtttcaagaatggaggggtttatataaagcttgggcaacatcttgggcagttggaatatttggttcctgaggaatatgttcagacaatgagggagtctatgctaaatagatgtccagtttcttcgtatgagcaagtatgcaatgtattcaagaaagagcttggagacaccccagataaaatattttccgagttcgatccagtccctatagcaagtgcttccctggctcaagttcatgtagctcgcacgcatgacggccaaaaagttgccgtgaaggttcagcatactcacatgactgatactgcagctgccgatcatgccactgtggaattggttgtgaacacattgcatagattttttcctagttttgattataggtggttgattgatgagattagtgaaagtttgcccaaggcaatcatcattcttggattctgttttattttctccttccatgttttccttgtttgctacgtgatttatgattttgtttttttgatagcaaagaacagtgagaggtgtgtggagaacttccacaagttgtctcctcatattgcgaattatgtatatgcaccaaacgtatattggaatttgagtacctcaaagcttctgacaatggaattcatggatggtgcttatgtaaatgatgtaaagaccattcggaaacttgggatcaacctgcatgaactttcaacattggttagtcaaacttttgctgaaatgatgttcaagcatgggtttgtacactgtgatccacatgctgctaacttattggttcgtccattgccttccagcaaagctagcatttggggcaggagaaaaccacagttgatccttttagaccacggactctataaagagcttgacttccaaacaagaactaattatgcttcactatggaaggcattggtatttgctgatgctaatgcaatcaaggaatacagtacaaagttgggagctggggaggatttatatgcactttttgctggagttctgacgatgaggccatggaatagagttgttgatccatctatggatcatttagtaatacagggaaatgagagtgatcgattagaactgcaggtgtatgcttctcagtatttccatcaaatctcggagcttctaaggagattaccacgagtgattcttctaatgctgaagacaaatgactgtttacgagcagtcaataattctctggtgcagggatcatctttggagacattttttgtaattggaaaggtttcttcggaggctgtcattgaggcaaagatgttgcaaagcaaatcacttttaacttggctaaacattaaattggataagattttgctggaagtacgactttggggaatgcaggtggccttgtggcttttacaactaagaaaatctttgtcttggtataaccaagcattgtag

SEQ ID NO: 105 - DNA, 1332 bp, Glycine Max
atgggaaaaggaaacatggaactcgagacaaacaaggtctatgactacgaggatgcacgaggggacgttgaagtcccagataccgctcatcagataagcactggttcatggtttcaagtggcttttatcctcacaaccggaatcaacagtgcctttgttcttggatatccagggaccgtcatggttcccctgggttggatcgggggtgtgattggtctaattcttgctaccatggtgtcactctatgcaaatgctctaattgcttatctccatgaattaggaggccaaaggcacattaggtatagagatcttgctggatttatatacggtaagaaagcgtataatctcacatgggttctgcagtatatcaatcttttcatgataaatactggctacatcattttggccggttcagccttgaaagctacttatgttctattcagggatgatgggctgctgaaacttccatattgtattgccataggtggatttgtgtgtgcaatgtttgccatctgcattcctcatctttcagctctgggaatttggctaggattttcaacagtcttcagcctggcatatattgttatatcatttgtgttgtcgcttaaagatggattacaatcaccgcctcgagattacgagattccaggagatggtgtaagcaaaatctttacaataattggagcatctgctaaccttgtgtttgcatttaataccggcatgcttcctgagatacaggcaacaattaggcaaccagttgttaagaacatgatgaaagccttgtactttcagtttaccgttggagttctaccattgtacctggttgcctttacaggatactgggcttatggatcttccacagaagtgtatttgctgaatagtgtgaatggtccagtttgggtgaaggcttctgccaacatcacagcctttcttcaatcagtcattgcattgcatgtttttgcaagtccaatgtacgagtttttggatactaaatatgggatcaaaggaagtgcactgaatgctaaaaacttgtcattccgagtcgtggtaagaggtggctacctagcctttaacacatttgtggcggctttcctgccattccttggagatttcatgagcctcacaggggcgatcagcacatttccccttacgtttattcttgcaaaccacatgtaccttaaggcaaagaaggacaaactaaacagctcacaaaagctctggcaccggttcaatattggtttctttgccattatgtctctggcagcaacaatttcagccatacggctcatttctgtagactccaaaacataccatgtttttgctgatttgtga

SEQ ID NO: 106 - DNA, 480 bp, Glycine Max
atgggaaaatatcttgaatctgcggcgaggctggcggagctatcgcggattgtgtcatctgctgcgaagcccaacaggccaaagagagcgctacccagatcgcccaaccgtgtggcgactcctcgaagtgcgaacccatttggtgttaaggtcgaacctgcgaaaaagatggaacctttggaagaagaacaacaatgtcggacacccctcgccaaggttgtctcagattgctccaagcgctggttccaggacaccctcaaggaggctaaggctggggacactaccatgcaggttttggttggtcaaatgtattactctggatatggtgttgcgagggatccccaaaaggggcatgcttggattagtaaagcatcaaggaaccgaaattcagtttggaaattgtgcggtaaacggccaggttacagagcaagtgattctgattcatgtgaactggaggaaaaagataaatattttccttaa

SEQ ID NO: 107 - DNA, 828 bp, Glycine Max
atgggagataaaaggctcagaaatcatggaagaaactttagaatggtttccattgtgactatggaaaattactatgattctggctggcacatgggcaacagcagctgggctcaatgcagtgatcattcttcttcttcctttgcagtgcctatacaaatactccctcatcatgtcactgactctgcctctcttcagtttggtgagtttcattcatggccacttcccattgaaggggctgcagaagaaagagcaataagtgcttccaagagtcacagccaagcagagaaaaggcgcagagacaggatcaacgcacagcttgcaactcttagaaaacttattcccaagtctgataagatggacaaggcagctttactagggagtgtgatagaccaagtgaaagatctaaagcgaaaagccatggatgttagcagagccttcacagttccaacagaaattgatgaagtatcaattgactatgaccatgttcaagacgaaagctgcactaaagtgaacaaactgaaggacaatattgtgatcaaagcttctgtttgctgcgatgatcgaccagaactgttccctgaactcatccaagtcctcaaaggcttgagactcacagcagttaaagctgacatagccagtgttggtggcagaatcaaaagcatattggtgctttgttctaaggatagagaagacagtgtttgccttgccactctcaaacagtccctcaaatctgctgtcaccaaaattgcttcatcatccatggcttctagttgtcccgctagaagtaagaggcagagattcttcttgccttctcactgcctacagtaa

SEQ ID NO: 108 - DNA, 620 bp, Glycine Max
atgggatgcatcaataagagtctcctgtgtgtgggatatctcattgacactcttttttctgtttttcttttgattttcttccttaatgtcgacgagccttttcgtgagagaatcttcggcttcaggcgcgaagcgattcagaagctgaatgccatcctgaacaataatcaagcaccggagatatcttatgtctcgttgtgcgtgacgaagacgcgaaatctccaggggtcaaaagcaacgacattggtaaatgttcggccacgcatggagctcaagttgcaaaagcaggagcttcgctggtgtgcggagcagctgaacaaaagcgtgaaggcgttcgatagtgctacggtgaaccgcaacgtggaaaattgggagcgccagccaaagtgcttcgagctggggaaccacgacggcgcctctgtgcagatgggaagctcgccgaggtttccgatgtacgacaatgatttcggatgggggcggctcttggccgtgcgcagcggcggagcgaacaagtttgacggcaagatgtcggcgtttcccgggaggaatggcggtggcaccgttgatttggagttgttttcggcgtcgaacaaaatggcgcgactcgagtctgattctga

SEQ ID NO: 109 - DNA, 333 bp, Glycine Max
atgggcaagtttgttgggttgttcctgctggttttggtcagtgtggccgttgctgaatacgacaacggttatcctgaacatgaaaacgagaaaaatggcccatgcggcaagtttagcacacttagaattttgacgcataaactgcgtcactgcgaaaaggctgcacgaaatgcatgggttcctgtttcttcacagtgctgcaatgaccttgtagaagtaagcatcccttgcctctatgctgttttctcctccgatgctttcaagagagttggtgttgatcccagagtcgcaatcaccattccccatcgttgccatttcgccaacaagccatag

SEQ ID NO: 110 - DNA, 333 bp, Glycine Max; identical to SEQ ID NO: 109

SEQ ID NO: 111 - DNA, 333 bp, Glycine Max
atgggcaagtttgttgggttgttcctgctggttttggtcagtgtggccgttgctgaatacgacaacggttatcctgaacatgaaaacgagaaaaatggcccatgcggcaagtttagcacacttagaattttgacgcataaactgcgtcactgcgaaaaggctgcacgagatgcgtgggctcctgtttcttcacagtgctgcaatgaccttgtagaagtaagcatcccttgcctctatgctgttttctcctctgatgctttcaagagagttggtgttgatcccagagtcgcaatcactattccccatcgttgccatttcgccaacaagccatag

SEQ ID NO: 112 - DNA, 333 bp, Glycine Max; identical to SEQ ID NO: 111

SEQ ID NO: 113 - DNA, 333 bp, Glycine Max; identical to SEQ ID NO: 111

SEQ ID NO: 114 - DNA, 369 bp, Glycine Max
atggggagggtgaaggtgaagatgtgggtagtttgggtatttccttgtgaagagaaaaaagagaaggaaatctcgtatatagagattaggtttgttttgccttatatacacgggagaatagaaactctaggacgactgcttcgatgccatgacaactttggaaacaagcactctctcctttttcttttcttttcatcattggatcaactttatatttttgtgctagaatggccagaagaagtatatcctccttatgcaaatgggcctgcatatataatttctagtgatattctgtttaaatttaaaatggaagatgtgagcatgggaatgtgggttgagcgctataacaatactaatgacaacagtaaa

SEQ ID NO: 115 - DNA, 420 bp, Glycine Max
atggggatgagcaaaaactcgtgtcacacgtccactggttgttttaaaatgcaggtaatttgctttcagtttgaggtaggtctatctttttcggtacagagggggaaatcacaagaaaaaacccatagtagatcctacttttcacgtcaatttccaacttcattggcattaatatgcatgcccaactcgcatcgtctgcagtttgatgtagttcaaccactcatgactcgtgagtcaatcattgcagggagatatttcaatagcttccaagataacctagtatgtactaattattacgagtcaacaatatgtagttttccctttactcccagagaacccaaattcttgttgcatagatatttacccagtgttatgttatttgcaaaccaaatttcacgaaataccttctcacttatctga

SEQ ID NO: 116 - DNA, 1029 bp, Glycine Max
atgggtgttatagcatgtgattgcgatgtacgtgatggaaatggggatggtgactcagattccatggttcggtacaatgtgtccaatttccttgcacatgagcctttacatcacgttaacttaaatgaaaagataacatttgagctaacggtgaagcagttgatgagctttgacccagatgaatggactgagaatctaagaaaagagtatgttcttgtgattgaaggattcttcactctcccttttcctctcttctccaccacataccgcagagccatcaaggcaagaacaaaggtggcagaggcactaacgttggtagtaaggcagaggagaaaagagtatgatgaagacaaagagaaaaagaatgacatgcttggggcactgttggcctccggcgaccacttttccgacgaggaaatagtggattttttgttggctttgctcgtcgccggttatgagaccacctctaccataatgactcttgcgatcaagttcctcactgagactcccctggccttggcacagctcaaggaagagcatgaccaaatcagagcaagaagtgacccagggacaccactggaatggaccgattacaagtcaatggcgtttactcaatgtgttgtgaatgagaccttgagagtggcaaacataattggtgggatttttaggagagcaaggacagacattgacataaaaggttacactattcctaagggatggaaagtctttgcatcatttcgtgctgtacatctgaatcctgaacattacaaagatgcccggtccttcaatccctggagatggcagagtaactcatcagaagcaacaaaccctggtaatgtttatacaccatttggaggagggccacggttgtgccctggctataagctagccagagttgtactttccgtcttccttcaccgcattgttacccgcttcagttgggttcctgctgaggaagataagttggtgtttttcccaactactaggacgcagaagaggtatccaattattgtgcagcgtagagactag

SEQ ID NO: 117 - DNA, 510 bp, Glycine Max
atgggtttttcctcaaaagaagagaagtccaaaagaatattgaggggcttgaagactctgttcttcttgatcactatggttatatcgcttcttcttttctctgccccggttctccttgttattgccgatgcacttgttccttctgctttgctctccacgctatctccttcttctttctccttggaaactctcgcttcccatttccacaactacgattttagatactctctcattgatattccccttgtgtcaataatacgatccttcatcatcttctgtgtttatagtttgtgtgatggaccaaggcttttcccgtggaccttatttggccgaccatccgtttacatcttcagtgtttcgggtattgatcgaagtgggtatgttcgtgccaccgaaatagctctgttcgtgtgctcttgtgcgttggccgtggggcatgttgtggtggcctacagaacaagttgcagggaaagaagaaagcttttggtctacaaaattgacattgaagct

SEQ ID NO: 118 - DNA, 1098 bp, Glycine Max
atggtgaattcgggagcttcccctgtccatagttttgcttcggcagtggacaatgcgatgggtagtattgatggagatttgggagcatttcacgtgcatgcattacctgtgcatggtttttcttcggctgtggacaatgctataagaagtagaagtagagcagatttgggacgatccagttcccccgtgcatggttttgctatggaagatgtttgtggttcattcagactggcagagcttgtagcagcaaccaacaatttctcacgtgacaacatgattagccatggcagaattggctttgtgtacaaaggcaaactctttgatggtcgtgaggtggctatcaagagggctggaaccagtacttcaaacattaaggagtttcaaagcattacacttgggcctttattcttgaccaattgtctacaccacaagcacttggttcggcttcttgggttgtgtgaagagaaaagtgaaaggctcttggtgtatcagtacatgaagaatagagcgctgtatgatcatttgcatgacaagaacaatgtggagaagggtagcactatgttgaattcgtggaaaatgaggatcaaaatttctttggacgcttcccgtggaatagaatatatacataatcatttatattctattcacggaaatatcaagtcctccaacattcttcttgatgccacttggacggcaaaagtatctgattttgggaaggtatcagcaggaactagacatgtattgacagaaaagagtgatgtgtgtgggtttggagttgtactgctagagcttttaacgggaaagaaacctatactcaagaatgaggaagatggaagcacccgattacatgtgatagactttgcagagcctgctattttggctggagaactggtgaaaattaaggacccaagggttggaccacccggtgtgaatgaagcaaaggcactggagttagtggccgatacagctatccattgtgtgaaaagggaagggaaagatagaccaaccatggctgacattgtgctcaatttggagagggctttggctacttgtggtagtgaccatctactttctacatggtatatgcctcaagcctag

SEQ ID NO: 119 - DNA, 198 bp, Glycine Max
atggtgcagcactactgctgctcattgcattggccactgccgaagcaagactatggacaggggaaggagatgttcccaaatctgatgcagtcctactccttatggcattgtccactacggaacaaaaactatggattcgggattctcccaaaattgacgcagtctcactctttatcgcactgtccactgcccaactaa

SEQ ID NO: 120 - DNA, 189 bp, Glycine Max
atggtgctgaactcatccacaacttcggaaattttcatttttttggtgcactctaagtgcaagaagctcttcttcatcaccaacagtttctgggaattgcagattcaatatgttgaagagttccgatcattgggaatttttgtgttacaagtttgctctttgttcgttccctttcgatttgaactttga

SEQ ID NO: 121 - DNA, 1668 bp, Glycine Max
atggttagtcacatccttgctgatctcaagctcctctacccaggacttggcaaagtggccttagcaacagccatgatcagtgacttctataattgggtcatgtttgcattgttggttccatttgccattaacggtggaagcatcatctactctgtgctgagcaccttagcttttgtgcttttctgcttcattttagcaaaaccccataaaaatgagtgggacaattacggtttgttttttgtgatcatgggggcttatacttctgcacttgttactgatctcctaggggacacaccctgtggttggggctctgatgctcatagagaagtcagaggattttggctggctccattgttcttaggtagcattggaataagattcagaatagtatatgttgtaaacactcaaggtttgggcctggtgcttttagttttgctcctctcattcatcccaaagattttaagcactgttatagcgagtcagttttatggcatgtctgttcttgatggtgtctctattggacttcttatgaacacgaagggcatcttaccaatattaatgctcaacaatgcctgggacaagcagattttgagtgtggagtccttctcaattttgaccgtagctgttgttatgatgaccatgacggtgcctctaatcatcaatgccatatacaagctaagaaagttatacaaacaaagcaaactgaagaccatacagaatttgaaggccgaaatagagctgagaatactagcttgtgtccacaaccctcggcaagccacaggaatgatcaacatcctcgatgcatgccacactacaaaactctcccctctgcgcgtgtttgcacttcagcttgttgaactaagtggaaacaccacttcccttttcaaccaacagcgaagtggtggtgcacaagccctcaccaaagcacaagaagacttggagagcatcaccaacattttccaaacatacacaggtgcaaatgagaacactagtgtggagacttttgctgctgcgtcaacttactcaaacattcacgaggacatatacaacgtgtcgcaggagaagcaagcaagcttgatgagggatgcaccatgttctgttggaatcattgtcgaccgtggactagggtcattgttcaaggtgaacctgcgtgtgctcgtgcttttcatcggtggccctgatgaccgcgaagccttggcggttgcgtggaggatgtcaaagcatcaaggggtgcaactatcagtgatgaggatccttatgtatggtgaggctgcagaagttgatgttctgtcccatgtcgatgagaagcaaaagaaattggatgaagagtatgtgagtgcctttaggctcaaggcagtgagcaatgaggactctataaagtattcagagaaagaagttcgttgtcgtgatgatattcctcaagtgcttaaagagatggacgaaattggatatgatttgaactctttgatcttgtcagagttgatacaatgggctcattgccctgaacttggtgttataggggacatggtggcatcaaataattttggttcaagctcttcagtgcttgttggacagaaatatgggtatgggggagtgcaacctagggaagtaatgcctgcagatgatgataatgatgattctggggcacttgctgtcaagatagaatag

SEQ ID NO: 122 - DNA, 1356 bp, Glycine Max
atggttgatttacattggaaatcaaagatgcctagttccaaaacaccaaaactctctctctccgacaacaagtccttaccctctttgcaactacccttccgcaccacagatatctctcccgccgctccttccgtttgcgccgcttacgactactatctccgtcttcctcaactcagaaagctttggaactccactgattttcctaattggaacaacgaaccgattctaaaaccaattttgcaagctctcgaaatcacgttccgctttctttccattgttctctccgatcccagaccttactccaaccacagagaatggactcgccggatagagtctctcatcatgcatcaaattgaaatcattgccatactttgtgaagaagaggaacaaaattccgacacacgtggcactgcaccaaccgctgatctcagcagcagcaatagcagcgtgagcagaagctacagcgaggcgagcctgcttcctcggcttgccacgtggtacaaatccagggacgtggcgcagaggatccttctctccgtggaatgccaaatgaggaggtgctcctacacgcttggtttgggcgagccgaacctagcggggaagccgagcctgctctacgacctcgtgtgcaagccgaatgagatccacgcgctgaagacgacgccgtacgacgagcgcgtggagaaccacgagaaccacgcggtgcacgccacgcaccagatcgcggagtcgtggattcacgcgtcgcggaaggttctggagagaatcgcggacgcggtgctctccagaaccttcctgaaagcagcagaggactgctacgccgtggagaggatctggaagcttctcgcggaggtggaggacctccacctgatgatggatccggacgatttcttgaggctaaagaatcaactctcggtgaaatcctcgagcggcgaaacggcatcgttctgcttcagatcgaatgagttagtggaactgacgaagatgtgcagagatctgaggcacaaggtgccggagatattggaggtggaggtggatccgaagggaggaccgaggattcaagaggcggcgatgaagctctacgtttcgaagagcgagttcgagaaggttcacttgttgcaggcgatgcaggcgattgaggcggcgatgaagagattcttctacgcgtataagcaggtgttggcggtggtgatgggaagttcagaggctaacggtaaccgagttgggttgagttgcgactcggctgactcgttgactcagattttccttgaaccgacgtattttccaagcttggatgccgccaagacttttcttggatacctgtgggataataacgataataacaaatggatatga

SEQ ID NO: 123 - DNA, 771 bp, Glycine Max
atggttgcacctgcgaggccacagttcgttctcttcggatcctccatcgttcagcttagtttcagccatggcggttggggttcccatctttctgacatctactctcgtaaggcagacatattgttgcgaggatactatggatggaactcacgacgtgccctccaaatcctttatcaagtttttccaaaggatgctgcaacacagccttctcttgtgattgtttattttggaggtaatgattccatgggtcctcatttttctggcctaggccctcatgtgcctcttcatgaatatattgaaaacatgagaaagattctgattcatattcagggtctctctgaaaagacacgtatcattgttctcagttgtcctccagtcaatgaggaaaaagtgcgtgcaaacactagtggaatttttagtgagctggtaagaacaaatgaattgtgccaaagctactcagaagcttgtattaagctatgcaaggaactggatgtcaaagttgttgatctttttaatgcactacagaagagggatgactggatgaatgtttgtttcactgatggtatccatttggcagccgagggaagcaaaattgtggtgaaggagatactgagagtgcttaaggaggctgactgggagccatgcctccattggaaatccttgcccactgaatttgcagaagactcaccatatgatcttgttgctgctgatgggaaaactacactgaatccttccgagtggactttttacagagagattcagtgggattag

SEQ ID NO: 124 - DNA, 978 bp, Glycine Max
atggttgcattctccctcttcatcctctgttccttaatcctcctcgttcagccttcttcttcttcgacccaacaaccccccaatttagaccccgacagcatctacctcctcggcgacgcccacgttgtcaccgccgccgacgccgactcccacgtgcggctcacgcgccccgcgccttcctcctccggcatcctccgccgccgggagccactcgccttcgcggaccccacgtcgctctccacggagttctccttctccgtcaccggccacggccacggcctcctcctcgtcctcgccgccggcggcaacctctcgaattacgtcggcgtggagttcgacacgtccaaggacgacaacgtcggagacccgaacgcgaaccacgtcggcatcgacgtcggaagccacgtgtcggtcgccgtcgcgaatgtttccgacgtgcatttggttctcaacaacggggaaaagttgaacgcttgggttgattacgaagccagttctaaggttttggaagttaggttaagcaaatggggtgcacaaaagccttctgatcccattgtttctcatgacattgatttttccaagatttggggtgcgaatcctgtgattgcgggcataagctcttccaatggggcccactcggttcaggttgttagtgtctattcatggaagcttagtttgaagaaggtttcagtttcaaatgggttgcattctctacctgcggatcctcatggtaataataataataagtttgaggatgagcataagaagctgtgtcccttgacggttctcgctggggttatttttggaactgggtgtgttgcgatggtgacgttcgtggtgctttttatgtgggtgattttcttccaaaagggtgaagaggagtctcttgtgaaaatccctaatcacccttcttcggatgtcaggtatgagagaattgatgtggctgttgacaagaatgcgcatggtgatgagagttag

SEQ ID NO: 125 - DNA, 1611 bp, Glycine Max
atggtttcggttgatgatgggattgtgaatcccaatgatgaaattgagaaatctaacgggagtaaagtgaatgagtttgcatctatggatatttcagcaactcaaaaatcatatctgaacagtgaagatcctcagagaaggcttcagggaaccttaataagttcttctgttactaataggataaactttcttaaatttggttctgcatctgccaaattcaaaaggcttgctactgagagagaccaggtttctatatctgtgccttctcctcgttcaaagagcctaagatcacgtttcagtggcatgtttgctcagaaacttgactgggcttcagtcaagaaaatgtgcatggaatggattagaaatccagtgaacatggccctttttgtgtggatcatttgtgtcgcggtttcgggtgctattctgttccttgtcatgacaggcatgttgaatggtgtgctaccaagaaagtctaagagaaatgcatggtttgaagtaaacaaccaaatactcaatgcagtgtttacactcataccaaatgacatctctagccttaggaaggtatattgcaagaatgtcacttacaagccccatgagtggacacatatgatggtagttgtcattctccttcatgttaactgttttgctcaatatgcactttgtggtctaaacttagggtataaaaggtccgagagacctgccattggagttggaatatgcatatcttttgcaattgctggtttgtacaccattcttagcccacttgggaaggactatgattgtgagatggatgaagaagcacaggttcaaattacagcttctcaagggaaagagcagctgagagagaaaccaactgagaagaaatattcatttgcatccaaagatcaacaaagggttgttgaaaatagaccaaagtggagtggaggaatacttgacatttggaacgatatttccttagcatatctctcacttttctgcaccttttgtgtgcttgggtggaatatgaagaggcttggctttggaaacatgtatgttcacattgccatttttatgctgttctgtatggctcctttctggatttttcttttggcttccgttaacatagatgatgacaatgttaggcaggctctagcagctgttggaatcattctttgttttcttggtttattgtatggtggattttggaggatccaaatgagaaagaggttcaatttaccagcctatgacttctgttttggcaaaccttcagcttctgattgcacactttggctaccctgttgctggtgctctctcgctcaagaagcgcgtaccaggaataactatgatcttgtagaagataaattctcaaggaaagaaactgatactagtgatcaaccatcaatttcacctttggctcgtgaagatgtagtgtcaaccagatctggcacaagttctcctatgggtagcactagcaactcttccccttatatgatgaaaacatctagttctccaaattcaagcaatgtcttaaagggatattacagtccagataagatgctatcaactttgaatgaagacaattgtgaaagaggtcaagatggaacaatgaaccccttatatgcacaaaaataa

SEQ ID NO: 126 - DNA, 474 bp, Glycine Max
atggtttctagagagcaaaagagagcaacactgaatgagaagctgcaacttcttcgttctataaccaactctaatgctctagacaaaacctcgatcataatagatgcatcaaagtatatcgaagagttaaaggaaaaagtagaaagactgaaccaagacgtagccaacgcacaaacttccagtgaccaaaatactttgcctatggttacagtagaaaccttagagaagggatttcttataaatgttttttcagcaaagagctgccccggtctgcttgtttccatattggagtcatttgaagagatgggtcttcatgtgcttgaagctagggttacttgtaaggacacctttcgatttcatgctgttggaggaaaaaatgaagaacaaggtgatgaggacattgatgcacaagctgtgaaacaggcaatgggacaagcaataaagaactggagccaaaatgctgaccaaaagtaa

SEQ ID NO: 127 - DNA, 723 bp, Glycine Max
atgtatttgattttggaaatcattttccattggggcagctggtctcgggtggtgtcgggtgttggaagcatggcatacaaagtggaccatgaatacgactatctcttcaagatcgtactcattggagactctggtgttggaaaatccaacattctctctaggtttacccgaaatgagttctgcttggagtctaagtctaccattggggttgaattcgcaaccagaaccttacaggtagaggggaagactgtgaaggcacaaatatgggacacagcgggtcaagagaggtaccgagctataacaagtgcatactacagaggagcagtgggtgccttattggtgtatgacataaccaagaggcaaacatttgagaatgtacaaaggtggctccgtgaactgagggaccatgcagactccaacattgttattatgatggctggaaacaagtctgatctcaaccatctcagagcagtctctactgatgatgctcagaatttggctgagagagaggctctctcattcctagagacttcagcattagaggccttcaatgttgagaaagcatttcaaaccattttgtttgacatataccaaattatgagtaaaaaggcactggctgcacagggagcagcttccactactagccttcctcatgggactaccataaatgtctcaaatatgtcaggtagtgtggagaagaaatcagcttgttgctccaattaa

SEQ ID NO: 128 - DNA, 816 bp, Glycine Max
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgatgatgagaaatagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 129 - DNA, 636 bp, Glycine Max
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggtatgcagcttcctacatatctaataaaccattgagaagcactaatataaatgctcactag

SEQ ID NO: 130 - DNA, 516 bp, Glycine Max
atgtcagagttttgtattagaggtggtaacagtggcagtgccactggcaccaagtgtgggcgatggaatcccactactgaacaggttaaggttctgactgatcttttcagttctggactccgcacccctagcactgatcagattcaaaagatctctaatcagcttagtttttatggtaagattgagagcaagaacgtgttctattggtttcagaaccataaggctagggagagacaaaagcgtcgcaaggttgataacgatgtgattcgtagtgaaaactctatctccatcaattcttttacacaaacagattttactcagctatatcaggtttctgagcccgagagggtgatggagactcttcagctcttccccttgaactcctttggtgaatcagaatcaaagaatatgagggtccatgcaagtgatcaatgcagggataacactatgttttcatacacagttggggaacaaatggatcatccaccattagatcttcgcttgagttttatgtga

SEQ ID NO: 131 - DNA, 1911 bp, Glycine Max
atgtccaatccagcttcaaaagccacttggacacctgggttccatagagtatttgttgatttatgccttggagaaatgctgaagaatgagcccgggtcaacacgaattaccaaggcaggttggaggaacattgttggatccttttatgcgaagactggtgtgagatatgacaagaagcagtttaagaatcactatgattctaccagaaaactatggaaagtctgggtcaagttgactgaagatagcaacatgaagtgggatccagaaacgggggcatttggtgcttccgaggaagactggcaaaattatgtaaaggcaattccagaagctgcccagtttcagtctaaggaaatccagtttaaagacaaactggatatcatctttgatggagggaatcgaattgaggaagtgaaaaggtgggccagtctcaagtggcagaatgattcttcaactacatctcccttgtgtggaagagagcgagagaagaaacgcaagaattttgatagggattgtgaattagatagtacgattgtggttgactattcgccaacaccaaaagcttcttggtcacctgcataccataaaatgtttgttgacttatgcatcgaagaaacattgaaggggaacaagtctgcgacgcattttaccaaggagggctggaggaatattgttggatcctttaatgcaaagactggtatgagatatgacaaaaaacaaattaagaatcactatgattcaacccggaaactatggaaaatctgggctaagttgactggtgatgacaacatgaaatgggacccccaaaccaatacttttggtgcttctgaggaagactggcacaattgtataaaggcattcccagaagctgcacaatttcggtttaaggaactccagttttctgacaaattaaacgtcatctttgatggagctatgccaactgaggaaatgataacaaggcttaagaggcagaatgatgcttcagctacattgcgtggaaaagagcgtgagaagaaacgcaggaatgttggtcgggattgtggattaaagagtgccattatgagcatgtccagttcatcatataccaaggtcaaagccacgtggactcctacactgcacaagatctttgttgatctatgtatgcaagagacattaaaggggaataagcctgggacacattttacaaaggaaggttggaagaacattatggaatcattttatgcaaaaactggtgtgaattatggtagactacaacttaagaatcactgggattctaccaaggaacaatggagaacctggtgtaagcttattggcaccagttacatgaaatgggatccatctgaccagaagtttgaggctagtgaagaagattggaccaactatttacaggaaaatccagaagctgcacaatttcgctataaggaactaaaattcactgaccaattggaaaccatctttaatggaactactgttactggagagactgaacctgctgtgcaacaaaggaaaagtgacgatagtgttgttactttccctttacacataaaagagcctgatacagacaacttcgacgagaaaactgaatgtcattgtgatgttgttgcgtcaagaaatggtgtgagtattcagaagaatgctagtgcagtttcatcaactgaaggtaaacgcaattatagtatcggtgaatgcattgaatgccttgatagaatggaagaaatagagcaaggaagtgatctctacatgtttgctttagatgtattccttaagcaggaatatagggaaatttttctgcagttgaaaacgcctaatctgaggatctcgtggttgcagcggcttcagtcttgtgtaacttccaaatattttttatggccactttgtacgttgtgtttggtaaatctcacattggttgcataa

SEQ ID NO: 132 - DNA, 528 bp, Glycine Max
atgtcgagcccagattctcgatcattcagttggcactacacggaactcgatgacagagacctcgagatccgaggtaggactctgttttttgtcatcgtactcttctccattattctcctcgtcactgttctcttcatctacacgcgctgggtttgccgctaccagggacgcctccccaccaccgcgttcaccgccgcagccgcccacgcgccgccgctcgcgcagcctcagggaatggacccagcttccatcaagaaattgcccataatcctccaccacgcgccgtcggaccgcgaggaaagcgcgtgggacgaaacggagtgctgcatctgcctcggcgagttcagagacggcgagaaagtgaaggttttgccggcgtgtgaccactatttccactgtgattgtgttgacaagtggctcactcatcactctagttgccctctttgcagagcttctctcaaggttgaatcttccttccctaagattttgattcaggaaccaccccttagaattgacttccagttctag

SEQ ID NO: 133 - DNA, 1017 bp, Glycine Max
atgtcggatgctttgatcaatggattggccggagctggaggagggatcattgctcagctcatcacatacccacttcaaacggtaaacactcgccaacaaaccgagcgtgatccgaagaaagacacgaggagtcaaggggccctcgaacgaatgtgccaggttgtaaaagaagaggggtgggaacggttgtatggaggcttgatgccatcggtagtgggtacagctgcgtctcagggagtttactattatttctatcaaatattcaggaacaaagctgaagcagctgcactacaacaaaagaaaatgggcgttggtgatggatcagttgggatgctctcctctcttgttgttgctgctttatctgggtgtgttaacgtgctcttgacaaatcccatatgggtagttgttacgcgtatgcagacacatagaaaagagtcgaacagaactccagctgatcagggtttgtttgttgccactgagcagccaattctttctgcagttgagcctcttccttatggaactagtcatgtgattcaagaaatctacggtgaagctggaatttggggtttctggaaaggtgtattaccaacattaatcatggtaagcaatccttccatacagttcatgctgtatgaagccatgttggcaaagttaagaaaaagacgtgcttggagtaagaagggtagcaacggggtaactgctttagagatatttcttattggagctttagctaagcttggagctactgttgtaacttatccgatcctagttgtgaaggcaaggctccaagctagacaggataaaactggagacaggagacaccattacaaaggtacatgggatgctattattaaaatgatccgctatgaggggtttaatgggttttacaaaggcatgggcacaaaaatcgtacaaagtgtgctggctgctgctgttttgttcatgatgaaggaagaattagttaggggggttcgtttcttgcttgccaaggatgctgtaaagccaaagaatctgtga

SEQ ID NO: 134 - DNA, 1311 bp, Glycine Max
atgtctccggccgccggagtcagcgtccccctcctgggggattccaaaggaacgccgccgccggcttccgtccccggcgcggtgttcaacgtggccaccagcatagtcggcgccggaatcatgtcgattccggcgatcatgaaggttctcggcgtagttcccgctttcgcgatgattctcgtggtggccgtgctggcggaactgtccgtggacttcctgatgcggttcacgcactccggcgaaacgacgacgtacgctggcgtcatgagggaggcgttcggatcgggtggagcattagccgcgcaagtttgcgtcatcatcaccaacgttgggggtttaattctctaccttatcatcatcggagatgtgctatctggaaagcaaaatggaggggaagtgcatttgggcattttgcaacagtggtttggaattcactggtggaattcccgggaatttgctttgcttttcaccttggtctttgttatgcttccattggtattgtacaaacgtgtagagtccttgaagtacagctctgcagtgtcaactcttcttgcagtggcatttgttggcatatgttgtgggttggctatcacagctctggtgcaaggaaaaacacaaactcctagattgtttcctcggctagactaccaaacctcattctttgatctgttcactgcagttcctgttgttgtcacagccttcacatttcactttaatgtgcaccccattgggtttgagcttgccaaggcatcccaaatgacaacagcagttcgattagcattattgctttgtgctgtgatctaccttgcaataggcttatttgggtacatgttatttggggattcaacccagtcagacattctcatcaattttgaccagaatgctggttcagcagttggttccttgctcaatagtttggtccgtgtaagctatgccctccacatcatgctggtgtttcctctcttgaacttctctttgagaaccaacatagatgaagttctcttccctaagaagcctatgctagccacagacaacaaaagatttatgatcctcactctggtgctgcttgtattctcctaccttgcagctatagcaatcccagatatttggtacttctttcagttcctgggatcctcatccgcagtgtgccttgccttcattttccccggctctattgttttaagggatgttaaaggtatatcaacgagaagagacaaaattattgcactgataatgattatactagctgtggttacaagtgtgcttgccatttccaccaacatatataatgcttttagtagcaagtcataa

SEQ ID NO: 135 - DNA, 915 bp, Glycine Max
atgtctgcatatgctcatcaaatggagcagcagtactctgcacctagtctctcggatgattctgagacaggaggccattatgaattagaatcaggattcttcatgaaatcgtttactgcaacaatcttcgttgcttcacttgtcactcttggagttctactaattactttggtgatttccttggtgattatgctgcaatcctgtcaaagtaaaagtgccggaggagttatcgagcttctgaatataaatgaatactacagttattgcagggtgtattctctgcatgctgagctcaataacttagaaggatataatcttcctagaatctgcagagacctggctgtacactatatcaaagtaggccaatatgctagagacttggatttgactatgtctttgattgacgattatttcaagagtgttagacctgcagaggatggtttggatgtggttttgatggacatagatgacatttttcctcggaactctgactctttcaatttgtttcacaggttttacaatgacagcactagcaactgtattaaagaggcaaaaaatgtaaagctcatgtttgtttctagactatacatgtaccttcaaactggtggatggtctataattttgttatcgagagagcctagaacacaccgaaacgtcaccattaatcatcttgactctgcgggacttagaagttggtctgccttgatgatgagagcagaagattcagatcctaccaaagggtatgagtatttctctaggcaaaggaatgtgataaggaaaaagggcttcagaataaaaagtatcataagtagccatatggatgcagtgactgttccagagaccgaagtgcgaaattatttgcttccaggccatctatgtgacaagtttgagaagcaggtagagcatagatcctga

SEQ ID NO: 136 - DNA, 543 bp, Glycine Max
atgtcttcttcatcttcttcgttcacgagtctccacatcacggccttagacgcgatagtgaacgtcaactccctcttcaccctcgccgtcttcatcggcctaacctggaaccccaacgacccttccaacagcctcaactccgatccggcgtgtgcccccaccgccgccatcgccgagaacctcatcgccttccacgtctactctttcagctccttcctcttctccagcctcgtcgccctcgccctcaagcaggccatccgcctctcccgcaccacctccttccactaccccgccgtcgtcgaccacctcgtcgcggacgtcaaccgcaccgccctccgcctcggcatgctcgtctccggcgtcggatccgtcgccggctgcgccttcctcatgctcgcgctcgtcaacgtggcgcagatcaagctcggaaccctcgcctgcggaagctcacacacctacgccgccgtcgttccgcttctcatcttcgtccccctcgcgctcctcatctacgtctccctcgttctctacgccttcacacgctag

SEQ ID NO: 137 - DNA, 597 bp, Glycine Max
atgtcttttatcggtacccagcaaaagtgcaaggcttgtgagaaaacggtttatcccgttgatcagctttctgctgatggtactgcttatcacaaagcttgcttcagatgctctcactgcaaaggaacattaaagctgagtaactattcctcaatggaaggtgttctttactgtaagcctcactatgagcagctcttcaaggagagtggctccttcagcaagaacttccagtcagctgcaaagctagctgataagacaactcctgagctgacaaggtctcctagtaaagctgcgagcatgttttctggcacacaagaaaagtgtgccacatgtggcaaaactgcttatccattagagaaggtaacagtggaagggcaggcctatcacaaatcatgtttcaagtgttcacatggtggatgtcccataacgccatcgaattatgcagcccttgagggcattttgtattgcaagcaccacttctcccagctttttaaggagaaagggagctataatcatcttactaagtctgcatcagtcaaacgggcagccgcagccacagcagcagcaacaacagctgcctctgttccagaatcttga

SEQ ID NO: 138 - DNA, 690 bp, Glycine Max
atgtggctaccatggcgtctacgaaccacagcttcgcgtccaaaccgatcccgatccttccccatcccctgctcttccttcaaagacatccaatccatcctccaatcccaaccccaacctccctctctcttccgccgccttatcgtctcgccctccctcatccgctcctttagcagcccccgcgccgccacctcctccatcgaaccgcctccggactccgaccgttccgccgtcgtcgtctactacaccagcctccgcgtcgtccgccgcacctacgacgactgccgcgccgtccgatccatcctccgcggcttcgccatcgccatcgacgagcgcgacgtcagcgtggacgagcgcttccgcgaggagctgcagcggatcctcgtccaccggagcgtgatgctgccgagcgtcttcgtcggcggcttgtacatcggcggcgccgacgaggtgaggaagctctacgagagcggcgaattgcacgagctgatcggacggttgccgaagtcgcagaggaacatgtgcgatttgtgcggagggctgagattcgtggtgtgcgacgagtgcgatggaagccacaaagtgttcggagagaagagtggtggattcaggagctgttcgtcttgcaattccaacggtttgattaggtgtcctgcatgtttcgtggtgcagccgcaacacaccaaataa

SEQ ID NO: 139 - DNA, 1086 bp, Glycine Max
atgttaaaaaaccaaccacaaccagattggcctgagcccattgtccgggttcagtccttatccgaaaactgcatagattcaatccctgaaaggtacatcaagccttctactgatagaccatccataagaagttctaattttgatgatgccaatattccaatcatcgaccttggtggtctgtttggtgctgaccaacgtgtctcagactcaattcttaggcaaatctcagaggcttgcaaagagtggggcttcttccaagtcactaaccatggtgttagccctgatttgatggacaaggctagggaaacttggcgtcaattctttcacatgcccatggaggtgaagcagcaatatgccaactcgccaaaaacctatgaagggtacggaagcagacttggaattgagaaaggtgctattcttgattggagtgattactattttcttcactatcttcccttgccactcaaggactataacaaatggcctgcctcgcctccctcttgcaggaaagtgtttgatgagtatgggagagagttagtgaagctatgtgggaggttgatgaaggctttgtcaataaaccttggattagatgaaaaaattcttcaaaatggttttgggggagaagacataggggcatgtctaagagtgaatttttaccctaaatgtccacggccagagttgacgttgggtttgtcatcacactcagaccctggaggaatgactatgttgcttccagatgatcaagttcctggtcttcaagttcgaaaatgtgataattggattaccgtgaagcctgcacgccatgcttttatcgtcaatatcggagaccaaattcaggttctaagcaatgcaatttacaagagtgtggagcacagagtgatagtaaattcagataaagagagagtttctctggcatttttctacaaccccaaaagtgatatacccattgagccaataaaagagctggtaacaccggaaaagccctcactctacccagcaatgaccttcgatgaatacagactcttcattagaatgagaggacctcgaggcaaatctcaagttgaatctttaaagtctcccagatga

SEQ ID NO: 140 - DNA, 1440 bp, Glycine Max
atgttacctcaaaagcaagctgaagaagccatgatgtcaagcctcacccaaacgatggagcgtgaggagggagaggaagtgaaaggggagacctcacagtttagctttaaaaatgctctctggcatggtggttctgcctatgatgcttggttcagctgtgcctcaaatcaggttgctcaggttctgttgactctgccttactcattctctcagctgggaatgctttcaggcatcatattccaagtgttctatggcttgcttgggagttatactgcttatttaattagcattctgtacattgagtacagaagccggaaagagaaagagaatgtcagcttcaaaaaccatgtcatccaggggtttgaagtgttggaaggcttgctgggtccatactggaaagctattggattggccttcaactgcacttttctcctctttggatctgtcatccagctcatagcttgtgcaaggaatatatactacattaatgatcacttggacaagaggacttggacctacatatttggagcttgctgtgccaccacagtgttcattccatcattccacaactacaggatatggtccttccttggtcttggcatgaccacctacactgcatggtatttgaccattgcagcccttgttcatggccaggttgaaaatgtgacgcattcggccccaaataagatggttttgtatttcacaggcgccaccaacatactctacactttcggcgggcacgccgtcacagtggaaatcatgcatgcaatgtggaagcctcagaagttcaaatatatatatctttatgcaacagtttatgtgttcaccctcactctaccatctgctattgccgtttactgggcctttggtgaccaacttttggatcattccaatgccttctcgctcctccctcgctctggctggcgtgacaccggtgtcatcctaatgctcattcaccagttcatcacatttgggtttgcttgtacgccattgtatttcgtgtgggagaaagtgataggaatgcatgacacaaagagcatatttttgagggcaatagcgaggttacctgtggtgataccaatatggtttttggccattattttccctttctttgggcccattaattcagctgtgggggcccttttggtcagcttcaccgtttacattatccctgcttctgctcatatgctcacatacagatctgcctcagcaagaaagaatgccgcggagaaattgcccttctttatccctaactggacggtgatgtacgtggtgaatgcatttgtggtggtgtgggttctggtggtgggctttgggtttggagggtgggccagcatgacaaatttcattaagcaggttgacacattcgggctatttgccaagtgctaccaatgcccgcccaaagttctgccctcctccaaccacaccttgcatcactga

SEQ ID NO: 141 - DNA, 1219 bp, Glycine Max
cagacactaccaacaatccaatggggacagaatatcagggttgttcttgatgttggttgtgaagttgctagctttggcggctatcttctggacaaaaatgttattgctatgtcatttgcaccaaaggatgagcacgaagctcagatacaatttgctttggaacgaggaattcctgcaactctttctgtcattggaacccaaaagttgacatttgctgacaacggatttgatttgatccattgtgcaagatgcagggtgcattgggatgcagatggacaacctttttctataattgacttactatgtttaggattcttagacctggtggtttctttgcatggtctgccacaccagtttatcgggatgatcaaagagattgggaagtatggaatggaggaaaggagaaatgagaagggacgaaagagaagtgaaagatgtgaagagaaatttttctttgaaagaactatagtttatgatttcttgaagaatgttacaaaacatgcaaatttttccaatgatggatccatggtgaccgtaacaaaagcaatgtgctggactgttgtggctaagactcttgattcatctggaattgggcttgttatataccagaagcctacctcatcttcctgttatcaagaacgcaaagggaacactcctcctttatgtgaaaataacgatagaaaaagtatctcatcatggtatgccaaattcagtagctgccttatacctcttccagctgatggtgagggtaatatgcagagctggtcaatgccttggccccaaaggcttaccaatgttcttgaaggacagcaaacactggtccgaattagtttcggacatttatggagatggtctttctataaactgattagctttattatgtcactctgctttgacatttatgatccagagttacccattgacatgccaaatactcttacaactatatttgacagagggctaataggaatgtaccatgattggtgtgagtccttaaatacatatccttggacttatgatcttgttcatgctagctttatcttcaaacatcttatgcaaagatgtgacattgttgatgtggttgtggagatagatcgcataatgagaccagatgggtatctcctggttcaggactctatggaaataattcacaagcttggtccggtcttgcgttcacttcattggtctgtaacattgtctcaaaatcagtttcttgttg

SEQ ID NO: 142 - DNA, 900 bp, Glycine Max
cgcatcaaagaagcacaagcacggatagccaaagagcgtgaagggattctgaatgccagtaatggggacagagcagctaaacttttcaatggcaaagagataaagaaagccacaaacgacttctcctgtgatcggcttctcggtgttggaggctatggtgaagtctacaaggggattcttcaagatggcactgttgtggctgtcaagtgtgccaagcttggcaaccccaaaggcactgaccaagtcctcaatgaggttggcatattatgccaagttaaccaccgcaaccttgttggtctacttggttgctgcaaaatgggacccttcttgatcacttgcaaggtcaaatgcctaagggccgtgactggcttacatggactcatcgccttcaagttgcacgacaccgctgagggtctcgcttaccttcacttcatggctgtgcctcctatctaccatagagatgtgaagtccagcaacattctgctagatatcaagctgaatgccaaggtttcagattttggtttgtctaggttggctcggacaaatatgagtcatatctctacttgtgctcaggggacccttgggtaccttgatcttgagtattataggaactaccaattgattgataagagtgatgtttacagttttggagtggtgctacttgaggttttgacagctcagaaggcactagattttaatagggctgttgatgatgtgaacttggcggtttacgtgcatcggatggtgaccaaggaaaagttgttggatgtcattgatccaacgatgaaggcagtgacatttttggcattgggttgcttggaggaaaaaagacagaatcgaccttcaatgaaagaggtagccgaggagattgagtatatcattaatattgcctcggcaaag

SEQ ID NO: 143 - DNA, 468 bp, Glycine Max
cgtatcacattctcagttacagaagatgtgattcttgttcgatcgtggtttaatgtgtcaaaggatttaattataggagctaaccaaacatcaaacgaacaattttgtgaaagaagctggactcaattaaaatctcgatggaacaggatctattctccagttcaaaagtttaacgggtgctacaaacaagcagataaacataggagaaatgaaagttcagagaaggatattttggatgatgctcatatgatttactcacaagacacaagtaaaaaatttgagattaagcatgtttggttgttgttaaaagatcaaccaaaattcgatacagaatttatgtcaaagtgtttaaaaataacaaaggtttctacttctagaaattactcatcgtcttctaacccaaagacacccgttgaagtcgaaaaatatgatacgccttcgccaatgtcttacccaattggacaaaaa

SEQ ID NO: 144 - DNA, 1071 bp, Glycine Max
gaaaattcaaaaggacaaaatggtcatttgctaagacttgatgaaataataagaaaaagaataggaggagaaattgagaaggtgagtggttgtttgcttgcggcgttcttgtatctttttcacgtccaattcgaaattcacgttgaaactagcaataggaattgcgcaaaatgtgttgataactacaagttgtgtaatttgtcatgcattgcttgcggcttatatgctctacctttgtttatcaaagtgatccaaggatgggatcctcttcaaaatccatctcatgggttggagttggtatcagagtggaaggcattgcttcaagaagaattagattctgttgatatgtgggatgtgttaacaccttatactcaattggtttcagaggttgtgttgattgctatcagaaaatcttgtatcaatacttggcaggtacaggatcctgagccaatgttgtggtttctggaatcttggaaaaagttacttcctgcttctgtccttgctaccatattagacaatatagtcatgccaaaactatcaagtgctgtagatacttgggaaccacaccgtgagaccattcctattcacacttgggtgcatccatggctaacctctattggggcactagttggagggttactgttcttggtgagtggtacccgactgacccaagtgatgattctgtttatgctatattgtctccttggaagactatttgattctgcaagttgggaacaacttatgcttcgttttattgtaccgaagttgcagcttgtcttgcaagagttccaagtgaattcggaaagtaagaatgttgataagttttgttgggtaatgaactgggcttctgttattcctattcatctgatggttggtatgatggacaaattcttcaagcttaaaccaggtagaatgcacaatggtcatcaaatatatgggtttggtaatgtcggcacaacaatagactttctaaatcaaaaggtatatgcccaacatgaagacacatggtctttggaatctcttcaaggcttgctggagttgcataataaatcacttagcaaaagatgctaa

SEQ ID NO: 145 - DNA, 201 bp, Glycine Max
gacagttgccaattgaagataacaaggttcttgaccttaacctttgcattgctcatcatcatgctggaaaaatcaacgactaaagaaaccgtatgcattttagaatgtaaaaaattggtggtgtctatatcattactaacttcaattaaggaaaagagtgtacaggtacaacaaattttgaacttttcatttatttattaa

SEQ ID NO: 146 - DNA, 1938 bp, Glycine Max
gcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtagattgcgtaatctttctgttctgattttgagtagaaaccaatttagtggacatattccttcaagtattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtggatacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggggaaaagcttctggtttttgattacatgtctaaaggaagtcttgcttctttcctacatggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 147 - DNA, 2181 bp, Glycine Max
ggagtgctgtttggcccctcaatgttggggaacaaaaacattctggggcaaaccttatttcctgtgaagggtgctgtagtgcttgaaacagttgcatcgtttggccttatgttcttcttcttcatatggtgtgttaaaatggatgttgccacattgatgaagactgaaaagctggccatcactgttggtatttctgtgttcgcatttacattggtaatccctactggactagcaattctgttgaggaaatatgctacaatggacagcagccttgcacaggcactgccctttatggctctctcacaaaccttaactgtattcattagcatagcagtgctcttgaaagatctcaaagtccttaacactgatatgggacgtttaaccatgtcagcagcaatgtttgctgatatagctggctttaccttgacagtgatcatttttgctgtactgcagaatcagagtggtagctttctgacactagcaggcctccttctgtccgtagttgcactctttcttgctgttatatttgtgatgaggccagcaatactttggacggtaaagtactcaggtggcggttcggttaatgaaagctgcgttgtttgcatctttctcttagttctcttatctgcatttatcagtgagttaattggacagcattttattatgggaccaataattttaggcctggctgttccagaagggccacccataggaacagctttgttgagtaaattggagacaatctgtatgggatttctttatccaatctacctcgctgttaatggattgcaaactgatatcttcaaaattgacttgcaatctctgtggattgtgggtctcatactgatggtggctttcgttgtaaagatttgtgctgtcatgttgccaggatacttttacaatctacccatgaaacaatgttgtgtcattggcctccttctaaatggaaggggtatagccgagcttaccatgtacaatatgtggattggaagcaaggtatgtatctatttaatatcggaacaagagttcgctttgatggtggcctccattgtagtagtaaacgctatcctagcaccaatcgtaaaatacacatatgatccttcagaacaatatcagaccggaagaagatgcacaattcagcatactgggcgagatatggagctccgagtcatggtgtgcattcacaacaatgaaaacctcccaacaatcctgaacctcttagaagcatcctatgcaagcagagagagcaagattggggtcacagcattagtcctagtggagcttcaaggaagagccaggcctattcttgttgataaccaaaaccaactccatgatgagctgcgctcaatgtcttgcaacgcaagtcacattgagaatgcattgaggcaatatggacaacagaacgaaggatatgtatctgttcaatctttcacttcaatctccacctttgaaaccatgtatgatgatatttgtagaatttcattagagagtggatccaacattttgatcttgccattccacaagaggtgggaaattgatggcaccgttgagatttctcataggaccatccaaaccatgaacattaatgtcctccaaagggccccatgttcggtgggaattctagttgataggagcatcttgaatccttctccttcactcttgatggctagagcagcattctatgtcgtggtgttcttcattggcggtcaagatgacatggagacattagcctatgccactagaatggctaggcatgaatgtgtgtatgtaaccgtggtaaggttccttctatttggagaggagaattctaaagatagaaaacgtgacagcgatcttatagatgagtatagatactataatgccagaaatcgtaggtttgagattctggaagaattggtgaaagatgggatagagatgtcaacatgtataagaagattgatagattattttgatctagtgatggtgggaagggagcatccagagagtgttatttttcagggacatgatgaatggagtgagtgtcaagagctagggatcattggagacatgctagcatcaccagattttgtgaccaaggcatcgttgttggtggtgcaacaacagagaataagagggaggcttgttacacataatgtgaatgccactccagtgcctaatcaaagagatcagctcctacatgat

SEQ ID NO: 148 - DNA, 2217 bp, Glycine Max
ggtggcattattttgggccccacatttttggggcggaacaagacgtattggcaggttttatttccaccgagacagacggagtatttagtgatggcatccttaaccggcgccgtatatttcgtattcttagttgcattgaaaatggacgtactaatgaccataagagcagccaaaagcacgtggcgacttggagtaattcccttcctcgcttcatttgtggttatcttagcactcttatgtctctattatcacccccaacaaatttcctctgcatctttaacaatcgcgcgtgtctcagtaagctgcttaatgtcgttgagcaacttccccgtcgtgtctgatgcaatgcttgaactgaacctcacagccacagaacttggccagatcgctctctcttcctccatgatcaacgacatcatactatggcttttcatcgttatgcatagcttcacatctaatgttgatgtgaaaaaatcaatcgcattgttgggaaactggtgcttgctcgtcttcttcaacttctttgttcttcgaccaaccatgaaattgattgctatgagaaccccagttggaaaacctgtgaaggaactttatgttgtgttgatacttcttggggtgctagtgatggctggtgtgggagacttgatgggcgtaacgtttctcatgggacccttgatttttggtttggtcgtaccaagtggcccccccttagggacaacgctagcggagaagagtgaagttcttaccactgagttcttgctacccttcttctttgtgtacattggcatcaacacggatttgtctgcacttgaggattggcgcttatttttgacccttcagggtgttttcttcgcgggagacttggccaagttgctggcctgtgtgttggtttctctagcgtacaacattagacctaaacatggcacgctacttggcctcatgttgaacatcaagggtataactcaactcataagtttggctagattcaagaaacaaaagatgttggatgaggatacattcagtcaattggtgttctgtgtggtacttataaccgcgattgtaacacccttggttaacatattgtacaagcatcgccctcgagtacacgcagaaagcttattcgaaggggaactgagaacgatccaaagcactccaagaaacagagagtttcacattgtttgttgtgtacataatgaagcaaacgtgcgtggcatcactgccttattagaagagtgcaacccagtgcaagagagccccatatgcgtctacgcagtccaccttatcgagctcgtggggaaaagtgcacccattctccttcccataaaacatagacacggtcgcagaaaattcttgtctgtgaattaccccaacaccaaccacatcatgcaagccttcgaaaactactccaacaactcaagtgggccagtcaaggttcttccctacatcaacgtggcaccttacaagagcatgcacgacgccattttcaacctcgcccaagacaatatggtgcctttcattatcatcccttttcacgaaaacggcaacattgaccttgtcggacacgtggcagcctccatcaggaagatgaatactaggtttcaagcgcatgcgccatgcacgttggggatactcgtggaccggcactctcggctgggcgcgtccaacaacaacaacatgtatttcaacgtgggtgtattcttcataggtggggcccacgatagggaagctctggcattgggaattcgaatgtcggagcgtgcagatacgagggtgagcttgtttaggtttgttatcgtgaacaagaaaccgtgtggttgtaaaattattttgacaagagaagagcgtgaagaggaagaggaagataccatgttggacgaggggttaattgacgagttcaagagcatgaaatatggcattggtaacgtttgttggtacgagattacggtggacgatggggtggaggtgttggaagcagtgcatagtttggaaggaaactatgatcttgtgatggtgggaaggcgccacaatgatggatctttgaatggaaaagaaatgacaactttcatggagaacgctgatgcattgggaatattgggggatatgttgtcttcagtagaattttgtatggggatggttccggttttagtgacacagtgtggtggagtgaagataagttcagttaatgtctcacaaaaacgtttatctgttcataaataa

SEQ ID NO: 149 - DNA, 780 bp, Glycine Max
gtatccaagaaaagtcttggcggcatccaagcttggaaaatacgtcggttcaaggaaaatctgagtcaacgagtcagccgagtcgcaactcaacccaactcggttaccaagaatctcttcatcgccgcctcaatcgcctgcatcgcctgcaacaaagcttcatcgccgcctcttgaatcctcggtcctcccttcggatccacctccacctccaatatctccggcaccttgtgcctcagatctctgcacatcttcaaatcgtccggatccatcatcaggtggaggtcctccacctccgcgagaagcttccagatcctctccacggcgtagcagtcctctgctgctttcaggaaggttctggagagcaccgcgtccgcgattctctccagaaccttccgcgacgcgtgaatccacgactccgcgatctgcgcgtggatctcattcggcttgcacacgaggtcgtagagcaggctcggcttccccgctaggttcggctcgcccaaaccaagcgtgtaggagcacctcctcatttggcattccacggagagaaggatcctctgcgccacgtccctggatttgtaccaccggttggtgcagtgccacgtgtgtcggaattttgttcctcttcttcacaaagtatggcaatgatttcaatttgatgcatgatgagagactctatccggcgagtccattctctgtggttggagtaaggtctgggatcggagagaacaatggaaagaaagcggaacgtgatttcgagagcttgcaaaattggttttag

SEQ ID NO: 150 - DNA, 2295 bp, Glycine Max
gtgtggatgggtgataatccattcgattttgtggttcctgtcacattgttccaaatcattttagtcagtttactctctaaagcccttcattatgtcctcaggcctatcaatacacccaaattcatctgctgcgtcatcgctggcattctgttggggccaacattcttagggcgccatgaagaaatattgggagccctctttccggtaagacaatccctgtttctaaatacgttgtccaaaataggcactacatattgcgtgttcctcacttgtttgaaaatggacgtggtgacaacattaaaatcagcgaaacgttgttggcgattcggtgtgtttcccttcttggcttctttcttggtcactgtaaccttgttttctttgtattctcccaacggtaatgctaatcaaaaccaaattttcgctgttgtatccgaaaccttgatggaactcaaccttgtagccacagaacttggccaaattgctctatcttcagccatgatcagtgaaatattgcaatggactacgatggaactcctgttcaactcaaaattcagcatgcgatttctaatcgtgcttttgataggtgcaactggatttgctgttttattacttcttattatacgaccactagtgaacattgttttggagagaacaccacctgggaagccaattaaagaagcatacgttgtcttgttacttctggggcctttggttatggcagctattagtgacacattcggcatatatttcgtcatgggaccttttctctatggtttggttctgccaaatggaccccccctcgccacaacaatcatagagagaagtgaattgatcgtgtatgagttttttatgcctttcttcttcttgttgattggcacaaggacagacttgaccttaattcatgagcattgggaggtggttctagtagttctggctatcttgtttgtgggatgcttggtgaaggtacttgcatgtgcgctcatttctcccacctataatattaagcccaaacatggcgtcgtgcttgggctcatattgaatgtcaagggtatagtcgaactcatcttttacggtagaatgaataaactcagggttattgatacagaagtattcagtgtagcggtgatgtctgtggtggtcatgacatcaatttgcatacccttgatcaaatccttgtacaggcaccgtagggtgtgtaagacgcaaaccatacaagaagggtgtgtgaaaacaatccaaaacataaccgaaaatacaccgttcaacatcgtatcatgtgtgcacacagacgaacacgtgcacaacatgattgccctaatagaagcatgcaaccctaccacacaaagccccttgtacgtctacgtggtccatctcattgagctcgttggaaaaagcacacccattcttcttcccatgaacaaaaacaagcgaaaatctttgtccgtaaactaccccaacaccaaccacattttacgtgcctttgagaactactccaacaactcaagtggtcctgtaacggttctttcgtatgttaacgtggctccgtacagaagcatgcatgaggcagtttgtaacctagccgaagataactcagtgcatcttctcattataccctttcaccaaaatgatcaaaccctaggaagccacctggccagcaccattcgcaacctcaacacaaattttctcgctaatgcaaagggtactttggggatactagtggatagatactcggtgctaagtgggagtagctccaagttgtcttttgatgttggtatcttcttcattggtggaaaagatgatagagaagcattggcgttggggattcgaatgttggaacgccccaacacacgtgtcaccttgttccggtttgttttgcctaccaatgaagattcgaggtttaatggacttgtagaaaatgaagatgagaatttagagagcacgttggacgagagtctaatagatgagtttattgccaagaatgatattagtagtgatagtgttaacgttgtttaccatgaggctgtggtggaagattgcatacaagtgttgaaagcgattcggggaatggagaaggactatgacctagtgatggtgggaaaacgacatagcatggggaattttgtagaagaagaaatgtcaaatttcatggacaatgcagatcagttgggaattttgggggatatgttggcttccaatgagttttgtaatgggaaagttcccggtaaaacagttagaaaagaaaatgaatatgcctattcattgtatattaaattcaaaatttatatcgtactatga

SEQ ID NO: 151 - DNA, 1593 bp, Glycine Max
gttgaggaaggaagaaagtttgtagaagcttcaaagaatgggaacttgattcctctctgtcagagcatcttcgctgaccaactcactcctgtccttgcttaccggattttggttaaggaagacgattgggaggctccaagctttcttttagagtctgcagagcctagttatcatgcttcgagtgttgggcgctatagtgttttaggagcaaacccaactatggaagttgtggcaaaagaaaataaggttacaataattgaccacgaatctgggaatttaactgaggaaattgttgatgatcctatggtgattcccagaaaaatctcagagggttggaaaccctatctcattgatgaactaccagatgcattctgtggtggttgggcaggttatttctcatatgacactgttcgttatgtggaaaagaaaaagctaccattttcaaacgctccagaggatgacaggaaccttgctgacatacatctgggcctctatgagaatgtgattgtgtttgaccatgtagaaaagaaagcatatgtgattctttgggtgagggttgatcggtactcctcggctgagagtgcttataaggatggaatggaaagattagaaaaattagtggccaaattacaagatggccaacccccaaggctggctccaggttctgtggatttacatactcatcattttggtccatctttaaagaagtcaagcatgacaagtgaagcatacaaagaggcagtccttcaggcaaaagaacatattaaagcaggggatattttccagattgtattaagtcagagattcgaacgaagaacatttgctgatccttttgaaatttatagagcattgagagttgttaacccaagtccttatatggcctatttgcaggctaggggatgtattctggttgcttcaagtccagagattcttacacgtgtaaagaagaataagattatgaaccgtccattggctgggacagctagaagggggaaaacacctgaagaagatgcaaggtttgaagcaatattgctgagagatgaaaagcagtgtgcagagcatgtcatgttggttgatttgggacgcaatgatgttggaaaggttgcaaaaagtggttctgtcaaagttgaaaagcttatgaatgttgaacgatattcccatgtcatgcacataagttcaacggttactggagagttgcaagagcatttgactagctgggatgccctgcgagctgcattgcccgttggaactgtcagtggagcaccaaaggtgaaggcgatggagttgattgatgagctggaggtgacaaggagggggccttacagtggaggatttggatacatctctttctctggtgagatggacattgctcttgctctcaggacaatggtatttccgagcggaaccaggtatgatacaatgtactcatacaaagacgtcgaccaacgccgcgagtggattgcttaccttcaagccggagctggtatagttgctgacagtgtccctgatgatgagcaccaagagtgtcaaaacaaagctgctggtcttgctcgtgccattgatttggctgagtccgcttttgttgataaatga

SEQ ID NO: 152 - DNA, 1530 bp, Glycine Max
gttgaggaaggagcaaagtttgtagaggcttcaaagaatgggaacttgattcctctttgtcagtgcatattctctgaccagcttactcctatccttgcttaccggattttggttaaggaagacgatcgggaatctccaagctttctttttgagtctgcagagcctagttatcatgcttcgagtgtcgggcgctatagtgttgtaggagctcaacctacaatggaggttgtggcgaaagaaaataaggttacaataattgaccatgaatctgggaatttaactgagaaaattgttgatgatcctatgatgattcccagaaaagtctcagagggttggaaaccctatctcattaatgagcttccagatgcattctgtggtggttgggcaggttatttctcatatgacactgttcgttatgtggaaaagaaaaagctaccattttcaaatgctccagaggatgacaggaaccttgctgacatacatctgggcctctatgagaatgtgattgtgtttgatcatgtggaaaagaaagcatatgtgattctttgggtgagggttgatcggtactcctcggctgagagtgcttacaaggatggaatggaaagattagaaaaattagtggccaaattacaagatggccaacccccaaggctggctccaggttctgtggatttacatactcatcattttggtccatctttaaagaagtcaagcatgacaagtgaagcatacaaagaggcagtccttcaggcaaaagaacatattaaagcaggggatattttccagattgtattaacattgagagttgttaacccaagtccttatatggcctatttgcaggctaggggatgtattctggttgcttcaagtccagagattcttacgcgtataaagaagaacaagattgtgaaccgtcccttggctgggacagctaaaagggggaaaacacctgaagaagatgcaaggttagaagcaatactgctgagagatgaaaagcagtgtgcagagcatgtcatgttggttgatttgggacgcaatgatgttggaaaggttgcaaaaagtggttcagttaaagtggaaaagcttatgaatattgagcgatattcccatgtcatgcacataagctcaacggttactggagagttgcaagatcatttgactagctgggatgccctgcgagctgcattgcctgttggaactgtcagtggagcgccaaaggtgaaggcaatggagttgattgatgaattggaggttaaaaggcgaggaccttatagtggaggatttggatacatctctttccttggtgagatggacattgctcttgctcttaggactatggtgtttccaacaggaactaggtatgacacaatgtactcatacaaagacgtcgaccaacgccatgagtggattgcttaccttcaagccggagctggtatagttgctgacagtgtccctgatgatgagcaccaagagtgtcaaaacaaagctgctggtcttgctcgtgccattgatttggctgaggcagctttt

SEQ ID NO: 153 - DNA, 279 bp, Glycine Max
tcggacggcgaggaggcggaggacgtcggggatcccgaggcgtgggccacccttaacaaggggttccggcaggtgcagtcggtgctggatcggaaccggctactgattcagcaggtgaacgagaaccagcagtctcggatgcacgacaacatggtaaaaaacgtgtccctcattcaggaactcaacggcaacatctccaaggttgtctctctctactctgatctcaacaccaatttcaccaacgtttgccaacaacgctccaaaaactcctccaaataa

SEQ ID NO: 154 - DNA, 1380 bp, Glycine Max
tctgtggtctcaaaatgcaccgttgtccctcaccggaactcaactatgggagacctcaagctctctatctccgaccttaacatgctcttatctcactacatccaaaagggatgtctcttcaccactccttcacttccctcttccgctctcatccctcacctcaaaaacgctctttcccaaaccctctctctcttccctcccctcgccggccgtctcaaaaccgacgccgacggatacgtctacatcacatgcaacgacaccggcgtcgacttcatccacgtcaccgccgccgatatctccgtcgcagacctcctctccccgtcgtcgtcgtcgtcgtcgtccgatgtccctccaatcttcaaacaactcttccccttccaccacaaaatcagttacaccgctcattcctccccaatcatggccttccaggtcaccgacctcgccgacggcatcttcctcggctgcgccgtctgccacgccgtcaccgacggcgcctccttctggaacttcttcaacaccttcgccggaatctcaagaggagccaccacctctccctccaccctcccggattttcgccgcgaatccatcctcaactccaacgtcgtgctccgcctgccagaagaaatcaaggtgacctttaatgtagaggagccttttcgcgagagaatcttcagcttcagccgcgaatcaattcaggaactgaaagctactgtgaacaataatggcttgacatcgtttccgccgccggagaatggtgacgcggttgagttgatggcgaagatgagcaacgacacgcaaccgaaaacggtgacgacgacagagatttcgtcgtttcagtcactgtgcgcgttggtgtggcgctgcgtgaccaaggcgaggaatatcgaggggtctaaaacgacaacgttccgcatggcagttaacgttcgccaacgcttggaacccaagttgggggactgttacttcgggaacgcgattcagagcattgccacgtgtgcagaagctgctgatgtggcgtctaaggagcttcgctggtgcgcggagcagctgaacaaaagcgtgaaggcgttcgatagtgctacggtgcaccgcaacgtggaaaattgggagcgccagccaaagtgcttcgagctggggaaccacgacggcgccaccgtgcagatgggaagctcgccgaggtttccgatgtacgacaatgatttcggatgggggcggcccttggccgtgcgcagcggcggagcgaacaagtttgacggcaagatgtcggcgtttcccgggaggaatggcggcggcgccgtcgatttggagatggttttggcgccggacaccatggcgagacttgagtctgattctgagttcatgttttacgtgtctggttag

SEQ ID NO: 155 - DNA, 133 bp, Glycine Max
ttatgtgctaagcgcagcaagacatggtctggttggtgtggcagctccaacaactgtgacaagcaatgcaggactaaggaaggtgcaactcatggagcctgtcacggtaacattttgaaacgggcttgtgact

SEQ ID NO: 156 - DNA, 3501 bp, Glycine Max
ttcgaggcatatttgtctcggtcatggcgagctgtggagctcataaaatttgagtctggaactacgaccctatattttgtagataatcaccatatgaccattaagaaaggctccttttcagacgttcgagttaggtcaaggaaagctactttatcagattgctcctttttacgaactgggattgacatatgtgttctctcagcctctcagggtaatgacaattcagatgaatctagtgctaatcatttactctttatcaatttttctagcgtgtggcttgatgctaaaataaattccatacagagaaaaccacataatccagagtgctcatgtcagtattatgtaaacttctatgttaatcaaggttcacttggtacagagctgagaactcttaggaaggaggttaaagtagttggaataaatgaaattgccatcctccaaaagcttgaacgtaatacttgtcaacacaaatactatcgatgggaatcatctgaagactgctccaaagtgccacatactaaattgttaggaaaatttatatctgacctttcatggttggttgttgcatctgctataaggaaggtttcattctgtgcaagatctgtggaaaacaatattgtgtatcaaattttagggagtgatgctacaacctcttcattatacatggattctgaaataagtgttgtgaactttaaagtgaacgaagacggcatgcaaatgcctgttattcatctagttgatttatttgagactgacaccaatacaagcggcgataaacatgattcccactatgatgaagtgccatcatcttatggttttgagggcttacgacgatccaaacgtaggaacatacaacctgaacgttactctgattgtggtaatgtttctgagataaaggttggtaatgttcgaacctggccatacaagttaaacaaaaggaaagatgatgatggtggtggtgattcattagcccttgagcatcatcatctcaatgacaatgttactagaagaagtgatgcatattatagcacccctaagcttaagaggaagagattagttgatctggaagctgatgtagattttgatcctggaagggaaggcataaattccaataaaggagttagcgagaaaagacatggttcatcatggtattcaagaagcagaagccatgctgcagaacacagttataaagacagaagcttaaatgcaactgcctacaaggaaatgatagattcatacttgaaggatgtcaatagaacaccaactacagaagagccacctgtaatggaccagcggaaggaaataggcaactttgggcaaaagaaggaagcagaaatacctgaaagagaggacgaggaacaaatctctgagatcgatatgttgtggagagaaatggaaatggcactggcatcaagttatcttgaagaaacagagggttcaaatagtgccaattttgccaagactacggaagaatctaatcgcacttgtccgcatgattacagattgtctgaagaaattggaatttattgctacaaatgtggctttgtgaaaaccgagataaaatatattacgccacccttcattgaaatgcaacgctcagtgaggcaccaagaggaaaagcaatgcaatggaaaagatacaaaggaaaaggctagtaaagatgatgatttccatctgctctcaactcatgctcctacagatgaacataactctatggaacatgataacgtttggaagttaattccccaatttagagaaaagttgcatgaccaccaaaagaaggcttttgaatttctttggcaaaatattggagggtctatggagccaaaacttatggatgcagaatccaaaagaagagggggttgtgtgatatctcatgctcctggagctggtaaaacttttctcatcattgcatttctcgttagctatttaaagctattcccagggaagaagcctcttatccttgctccaaaaggcacactttacacttggtgcaaagaattcaacaagtgggaaatttctatgccagtgtatctgattcatgggcgtggtggaactcagaaagatactgagcaaaattcaattgttcttcctggttttccaaatccaaataaatatgtcaagcatgttttggactgcttgcaaaagataaaactgtggcaagagaaaccaagtgttttggtcatgagctatactgcatttttagcattaatgagagagggttcagagtttgcacacagaaaatatatggctaaagcattgagggaaggtcctgggatcttgatacttgatgaagggcacaatccaagaagcaccaagtcaaggttgaggaaagggttgatgaaactgaaaacagatctaagaatactactttccggtacattatttcagaacaatttttgtgaatacttcaacacactttgcttggcaagaccaaagtttatctccgaagtgcttgatacattagacccgattaccagaaggaaaagcaaaacagtagaaaaggcaggtcatttgctagaatcacgagctagaaaattgttcttagataaaattgctaagaaaattgactcgggtattggaaatgagaggatgcagggtctaaacatgttgagagaaaccacaaatggttttgtagatgtttatgagagtgaaaattttgatagtgctcctggtttacaaatctacacgttgctaatgaatacaactgacaagcagcgtgagattttgccaaaactacacacgagagtggacgagtgcaatggttaccctctagagctagagcttttggtaactcttggatcaatacatccatggttggttaaaacaacctcatgcgcaaataagtttttcactgcagaccaattgaagcagctagacaaatacaagtatgatatgaaagcaggatcaaaagttaaatttgttctgagccttgttttccgtgttatgcagagagagaaagtacttatcttctgccacaaccttgcacctgtgaagttattgatagagttatttgagatgttcttcaaatggaaaaaagatagagaaattctgctgcttagtggggaactagacctctttgaacgcgggaaagtgatagataagtttgaggagcatggaggagcatcaaaggtactccttgcttcaattacagcttgtgctgaaggcattagtttaacagcagcttctagagtgatttttttggactcagaatggaatccatcgaaaacaaaacaggctattgcacgggcttttcgtcctggtcaagaaaaaatggtttacgtttatcagctcttggtaacaggcacattggaggaagataagtacaaaagaaccacttggaaagagtgggtttctagcatgatttttagtgaggcttttgaggagaacctttcacattcgcgagcagtgaacattgaagatgatatactgagggaaatggttgaggaggacaagtctaaaacaattcatatgattctaaagaatgaaaaggcttcaaca

SEQ ID NO: 157 - DNA, 1017 bp, Glycine Max
aaaaaaaaaaaactagtgcttggtggcactaaaagcttgcccccaggtagctttggttggcccctagtgggtgaaacataccaatttttgttcaacaagattgaacatttccttcaagagagggttcaaaagcactcctcaaagatcttccacacatacatactaggagagccaacaatggttctttgtggccctggagcaaacaaatttgtctccaccaatgagacaaagcttaccttggggattctgaaaccagagggaatatctaggtacatagggaacaagattgaaccaaccatgcaccaacatttcacgacacactgggaaggaaaaaaagaagtgaaggtgtaccctttggccttgatgaaccaaaatgccagaaagtttgaggacttgtattttgggatccattctgttcctgtgaattttacaggctttatataccatagggcactcaaggctgcagctgcaataaggaaaaaaatccaatttctgatgccaagacttgaaataagcaacatcatcatggggttgatgaatttcagccacatgccaatagctattactcaagctttcatgatcaaacacattggacagaggcctgctatctaccagaaaatcttatccgagtatgctgatattaaaaaatccaaaggatccaatgcagcactagattgggacagcagacagaaattgaaatacacatgggttgttgcacaagagaccatgagactctacccaactgcaccaggtgcattgagagaggcaataacagatatcacctatgaaggttttactattccaaaggggtgggagaatcccaagtactttgatgaacccgaaagttttgatccctcaaggtttgaagggaatgttcctgttccatacacttggataccctttggagctggaccaagaacttggcctggaaaagactacgcacggttagtggtcctcaatttcattcacattctcataaccaagttccacttgggaaattatactttttctcagtaa

SEQ ID NO: 158 - DNA, 858 bp, Glycine Max
aactcgaattatctagatcatacggaaagaatgcacttcatttgtctgcccgcacatggctgtgaagcagtgaggttgattcttcgattcgcactgatgcagcaattgtcatgctcccagataattgatgacataaaaattgttatatttgatggcttaaatattgattgcggtcaaatggtgaatgagctattgctttttccagacgtacaccaacgtgaatgcattaacaagggagcacaaaacagctctagttattgctcaatcccttccaccatcagaagaaatcctagagataaaaggttccctacttcgtttcggtgcagtcaatgccaacaatctgaaccagccaagggacgagttcatcaagaacaccgtgacacaaatcagaagggacgttcgcacacagctagaacacgcagaacgaacaagaacgtgaacggaatcgccatggagctacgcaagctgaacagagccggtgtcaacaacgccacaaactcggtaacggtggtggcggttctctttgccacgcttgcgttggctgccattttcagcgttcccggtggagactatgataatggggtggcagtgatggtaggaacaataccccttttatatcttcttcgtcttcaacgccgttgcgctttaattttcacttcgctggctgttgtggtggttcaaatcacgcttgtaatcaacaagatgatgtggttggcgtctatatgcaccaccgttgcattcgcatcagcgtcttatatagttgttggtaggcatcacaagtgggctgcaatgtttgtcacttgttcttggtactatgtgctcaaagaggtaggagaaaagagaagaacttgttcatga

SEQ ID NO: 159 - DNA, 1152 bp, Glycine Max
aagcttttcaatgtggcagagtacggtgcaattgcagatggcaaggaagataacagtgtggcatttttgaaagcgtggagtgatgcatgcaagtggaatggatcagcaacggttttgatcccaaaaggaacctacatgctcaaaagtgttatatttaagggtccatgcaatgattcgattaccttccaaatcaaaggtgttctgaaggctccaatagatccatctttgctcactgatcaaaaatggataaatttcagatatatcgaccaattgaatgtgaatggaggcggcacattggatggtcaaggatctgccactcgccgaaaatgcaaaaacaatgcgaattgtgaaattctttttacaactatggattttgacttcatcaccaatggccatgtccaaaacttgcattccattgatagcaaaggtggccatttcatagtgttcggatgtgagaacatgaccttcacagatctaaccctaaaatcccccgagcacaaccgcaacacagatggaatcaaaatagcccaaacaaatgggataaacatcaccagtgtgaaaattggcaccggcgatgactgtgttgctatgatttctggcactaagaatgcttggatttcaaatgttgtttgtggccctggtcatggaattagcgtgggaagccttgggaagaatgatggagaaacggatgtggaagatatagttgtcaagaattgcacgtttgttggtactagcaatggtcttagaatcaaaacatgggctgctccattaaagaaaactttaaacgcttcaaattttgtctatgaagacattgtcatgaatagtgtgcaaaatcctattgtcattgatcaacaatattgtccactacatcaatgcgaccttaaggagatttcacacgtgcaaatcagcaacgtgacatacagaaatattcgaggaagcagcgaaactgatattgcagtcaattttaactgcagtaaagataagccgtgtcaaaaaataactctggacaacattaatttgtggcgttatggtgttcgtggcaagggaagacctctactaagaaataattgctttaaagtcgagggtgcttcttatggcaaacaaacccccccatcctgcatcgctcatcgtgcaacacctctttcaacctag

SEQ ID NO: 160 - DNA, 1449 bp, Glycine Max
aatagcaaacggaccagcctaaatttatacagacgaagatcaccaaaaagtaatgcaaaagatgttgagaatgagaagcctatccagttatccatccaagataaaagctcaagatgcaacttttctttcttaaaaccttttgtcctattgatgaccatttgcgacacttatgtaacactcctgtattctccaaaggtttacaacaataaccatttatcaagctctagctccaggtggatatggggtggtttagatcgtggttatatatcgaatgtagatattaactggggtgatatattgcaaattactgcgaaactgacagggaaaaaagagtttcaagaggttggccttctaaacttcaacaataatgaactagaccattgggaacagcttattcctaatgtcacacatgttgttctggagctggagtatgctgcaaaaaatgtgacatgggaatccctatacccggaatggattgatgaggaagaagaaaccgaagtcctggtttgtccttctcttccaagtcttcgatctcctggaataaggctcaatctcatagctgtgaagcttcctcatgcaaatggggggaattggtctagagatctaggcttacaacttctttcaaaggaaattatcccttgtatgtgccttttgttaccaacttctttccaatacctaatttgtttacctgtagagaacttgtgggacatgaagggaatgtttttgggagaaaaactccaccttccaccaggatcttgtgaacttgcatttcctttgaggggcaaagagctgagttacgtgggaaatgttcgtagagaagcatatgcaacaattctccattccgctcacgtttatgtttgtggagctattgctgctgcacaaagcatccacatgtccggttcaactcgagacctagttatacttgttgatgagacaataagtgagtaccacagaagacaattcaaaggatcagaaaaaggtgcttacaatgaatggaactacagcaagttccgtttgtggcagcttacagattatgacaagataatattcattgatgcagatttgctcatcctaagaaatatagatttcctatttggaatgccagaaatcactgcaactggaaatagtgaagtctcacatcaagtagaagtagaaaagttaagtttttggttaaagtgtagtgtcaagtttccttatgtggttaaaagtgatgctgctcatgaaaggtggcggaaggtgcatgatgcaatgcctgagcttttgcaacagttttgcatgttgaagcaagctgaagttgctaattacacaaaagggcattggcaaattaaagttaaagatatgaggttgaagaaatgcatagacaatagaccaattggactgatgatgagtctcatactccaacatctcctgtcattgccacatcatctctttctgatttgtgacatgtga

SEQ ID NO: 161 - DNA, 596 bp, Glycine Max
aattcggttgggaaggggttaatgaaagttgaagaagagagtgaagaatacgaatccattaagaatgttttcttgaagggtatggggtttgtgggacatgccacagatgccatggcaatttacaagaacatgctttcctttagtgtggcaaggcaagctcgttgggtttcgtttaaaattttctctaaggcggtggcaattaaatctggaggggatgctaatattggatatgcttggtatggtagttcgttggatgatctcttagagattgtatctggtggattccatggatgcaaaaaacatgatgataatgatgatgatgagtgtcatggtattgggattcccttatttgctgccaatttttcccttgatagtgctatgtgtacggtggcagatgagcatggttttaggcatgtgctactatgcaaggtgatattagggaaggtggaagctgttcatgctggctcaaagcagagccaacctagttctaagcaatatgacactggggtggatgatatatcagcacctagaagacatactatatggactgcttatctgaatacacacattcatccaaattatattatatgtttcaa

SEQ ID NO: 162 - DNA, 801 bp, Glycine Max
aattttgcaaagataaatgatttaatgacaaaatcgttccaaagttacgctgaactgaagaaacaggctgagaaggacgaccttgaagactctcatgacattgaagcagggaaactcgacaaacccacggaagaccataaccacctctctcagttcttccaagaagttgaagcaatcaaggttgaaatagaagagatcgcgaacctcttattggaccttttgcaactgcacgaagaagaccgcatggtgtctgacatggttgccttgttttgcaaggcaaggatcatcaagtcaaggctcgaggttattgaccaatccaacataaccaatcgcactttatcagaatcctacatagaaaaaggagggaaaaagatcacggattccattctcctaataacatttgccaataaaaaaattgatatgaccagaatgtctgtcacaaatggtttgagggcaaaacttagggtcatgttgatgcatggatttcagtccttgagagacaagtttctcatggagaaaatgatttcgaggagtctcaaagttgagtttatggttgctgcagcagggaaaacggatattgataatgctgatttgggtgttaggcatgaggaagtgatcatggatatccagaggagtttgaatatgcttgaccagatttttgttgacatagctattttggttgagacccaaggagaaaacttggatagcattgaggatcgtgtggccagtgttgttaacaatgctaaccaaatgaagaggaagaacaccaacacagaatggctctgttgggttcttgtgtga

SEQ ID NO: 163 - DNA, 470 bp, Glycine Max
acagcaattgaatggacactttcaaagctcctaaagaatccaagagtgatgaagaaagtccaaatggagttggaaagtgtggtaggtatgaagaggaaggtggaggaatcagacttgggcaagttggagtatttggagatggttgtaaaggaaagcatgaggctccatccaggggcacacttgctaataccacaccagtccgcggaagattgcatggttggagattttttcatacctaaaaagtcaaggctcatagtgaatgcatgggcagtaatgagagacccaagtgcatggaaaggggatagttcaggattgcaattgggtttcactgtgattcgtctaacagtggcacgacttatgcattgttttgattggaaactaccaaatgacatgttgccagatcacttggacatgacagatgagttcggcctcacagtgccaagggccaatcatctacatgccattcccac

SEQ ID NO: 164 - DNA, 659 bp, Glycine Max
accatcgatactgatttcttgaccaagaagaagaagcaagtttcggtgcaacttccgagtttgacatcacctgtctccactgtgagatttgagtttggcaatttcgttgcacgacaagccctgcttcacgaagagtattgggtaagtttcgtttcttcttttcttctatccgaggctgagagtgctttgatattggttcgtcatggggagtctttgtggaatgagaagaacttgttctcgggatgttgcagtgtacctttgaccaacagaggtgtagaggaagctattgaagctggtcagaggattagctatatacccattgatatgatctttacgtccgcactcattcgtgcacagatgaccgctctgcttgcaatgactcggcactcccagaagaaggttcctattatcatccatgatgagagtgaacaggcaacaacttggactcaagtttacagtgaaaaaaccaccaagcaatctattccagttattacagcttggcagttgaatgaaagaatgtatggggagttacagggtcttaataagcaggagactgcagaaagatacggaaaggagaaggtgcatgaatggtgtcggagttttgacattcctcttcccaagggtgagagcctggaagtgtgttttcagagagctgttcc

SEQ ID NO: 165 - DNA, 912 bp, Glycine Max
actccacaaaatctgctccaaggacccataacactccaaacactttccaaaaggccaaacaaagaattccgtgaagaaagatcaactaaacaatatgaatgtatcatatctaatggacaaatgaccataaaactccagagagaattactgaatgctgatatattggtgattgttgctgttacaaacaaggaatccgttgagtggattaataacaactgcaaaactattgaaaatgtaatatgccttgactcttcaccagatttgaaaaacaaattaggaggctatgatgttcccagtgaagtaagaggaagtatatttggaaatttttttggaaagtctcaatctgataaagctaaagaatcatatgaagtagtgcaaacagtatctgaagcatgggatcgacataattctgatgatataaggttctgtttgctgagtttcaaagggagctggcgtgttgtagcagggcagaacccggcatatgatcaatttccatgccaataccagtttttctataggggaaaagcaaaagggtcattttggtatgagcccgtattccaggtaaaaacattggaaggccaattggtctggagtaggaggaaatatagggtcagaagagataacggagttgtttcaaatgagttttggacaattgtggatgtatctgataatcttagttggggtttgttctattatcacggtgctgctagagttgcagggcaatcttatactggggcagtacttacaaatgtgaaattaaagagtgggaaatccaaagtacatgcctatctgattattaccagaattattaatagtctcaatccggttacgttcagcacgtctccaatcagtaggagaaaaaactggaaattgtggtcatcttatcctcttgagctgccaaagaaaaagctg

SEQ ID NO: 166 - DNA, 2941 bp, Glycine Max
actttaagcatcaccacagacagagaagccttgatctcatttaagtctcaactgagtaatgagactcttagccctttatcttcttggaaccataattcatctccttgcaattggactggtgttctatgtgacaggcttggccaaagagtaactggcttggatctttcaggctttggactctcaggtcacttaagcccttatgttggtaacctttcctctcttcagtctctccaattgcagaataaccaattcagaggagtgattcctgaccaaattggcaacctattaagtcttaaagttctaaatatgagctctaacatgttagaaggaaagcttccttcaaacatcacccacttgaatgagcttcaggttcttgatttatcctcaaacaagattgtcagcaagattcctgaagacatcagcagcttgcaaaagcttcaggctttgaaactaggaaggaacagcctctatggtgcaataccagcttctctaggaaacatttcttctctaaaaaatatcagttttggcaccaactttctcactggctggattcccagtgaattgggtaggctccatgatttgattgagcttgatctcattctcaacaatctcaatgggactgttccacctgctatattcaacttatcttcccttgtcaactttgccttagcttcaaactctttctggggtgagattcctcaggatgttggtcacaaacttccaaaactcatagtgttcaatatatgcttcaattatttcacaggtggaattccagggtctttgcacaacctcaccaacattcaggtcattcgtatggcttccaaccatttggaaggaacagtgccaccgggtttgggaaatctcccatttcttaaaatgtataatattggttataacaggatagttagttcaggagtaagaggtttagacttcattacttctttgacaaacagcactcacctgaactttctagcaattgatggaaatatgctggaaggtgtgattccagaaaccattggcaatctctccaaggatctctcaacactatacatgggacagaatcgtttcaatggaagcataccctcctccattggtcgtctcagtggcttgaagttgttaaacttaagctacaattcaatctcaggagaaatcccacaagagttaggccagttagaggaactacaagagctatctctggctgggaatgagatatcaggaggtattccaagcatacttggtaatctcctgaagttaaacctggttgatttgtcaagaaataaacttgtggggagaatacctaccagttttgggaatttgcaaaacctgctttacatggacttatccagcaaccaactcaatgggagcatacctatggaaatcctcaatctcccaactttgagcaatgttctgaacttgtcgatgaactttttgagtggaccaatacctgaagttgggagattgagtggtgtggcctccattgacttttccaacaaccaattgtatgatggcatccccagctcattcagcaattgtctcagcttggaaaaattatctttggccaggaatcagctttcaggtcccattccaaaggctcttggagatgtgagaggcttggaggctttggacctgtcttccaaccaactctctggagccattcctattgaacttcaaaatttacaggcgcttaagctcttaaacctctcgtacaatgatttagaaggagctattcctagtggtggagttttccaaaacttttctgccgtcaatttagaaggcaataaaaatctctgcttgaacttcccatgcgtgactcatggccaaggaagaagaaatgtaagactttacatcatcatagccatcgtggtagcattaatactgtgtctcacaataggcttactaatatatatgaagagcaaaaaagtgaaggtagcagcagcagcatctgaacagctgaaacctcatgcaccaatgatctcttatgatgagctccgtttggcaactgaggagttcagccaggaaaacttattaggagttggaagctttggttcagtttataaaggccatctaagtcatggagctactgttgcagtgaaagttcttgacactctaagaactggctctttaaagagtttctttgcagaatgtgaggccatgaagaactcaaggcatcgaaatctggttaagctgatcacatcatgctctagtattgactttaaaaacaatgattttctggctctggtgtacgagtacctgtgcaatggtagcttggatgattggatcaaggggaggagaaagcatgaaaagggaaatgggttaaaccttatggagagactgaacattgctctagatgttgcttgtgcattggactacctccacaatgatagtgaaattccagtagtgcactgtgatttgaagcctagcaacattctattggatgaagatatgacagcaaaggttggagactttggactggctaggttgctgattcaaagatcaactagtcaagtttccataagctccactcgtgtcctaaggggttcaattggttacatacctccagagtatggatggggagagaaaccatctgctgctggtgatgtatacagttatggtatagtgttactagaaatgttctgtggtaaaagtccaacagatgagtgtttcacaggaggcctaagcataagaagatgggtgcaatcatcattgaaaaacaagacagtgcaagtgattgaccctcacttgctttccctcattttttatgatgacccttctgagggatcaaatgtacaactcagttgtgtggacgcaattgttggagttggcatatcttgcactgcagacaacccagatgaacgcattggcattagagaagctgttcgtcaactaaaagctgctagggactctctttcgaatcagtctgatgagagtcctacacttacta

SEQ ID NO: 167 - DNA, 207 bp, Glycine Max
atactcgcgactctcaggcgaagtcaacggactctcagtcaagagaaaatagtgatcctccggatcacacctcaaatagttgaatatgcactgctgccagaagcgctccatggcgtcccaattctcaacctggccatgctgaattgggtagttgagattataagtgctgctagatcgagacttggaaagagttcctcgattgattaa

SEQ ID NO: 168 - DNA, 1909 bp, Glycine Max
atcaaccgtttctcaacccttttcacgtggaactccaacttcagacaccttgtcaatcagggccatgcccaaaacgcccttattctcttccgccagatgaagcaaagtggcatcacacccaacaactcaacctttcccttcgtcttaaaagcatgtgccaaactttcccatctcaggaactctcaaatcatccatgcccacgtcctcaaatcatgctttcagtccaacattttcgtgcaaaccgcaacggttgatatgtatgtcaagtgtggtcggttggaggatgcacacaacgtgtttgttgaaatgcccgtcagggacattgcttcttggaatgcaatgctgttgggatttgctcagtctggcttccttgataggctgtcttgtcttctacgtcacatgaggctttctggaattcgtcccgacgcagtcactgtcttgctactcattgattcgattttgcgtgtgaaaagtctgacatctttgggtgcagtttattcctttgggattcggattggtgtacatatggatgtttctgtggctaacactttgattgctgcatattccaagtgtggtaacttgtgctcggcagagactctgtttgatgaaattaactctggtctgaggtctgttgtgtcctggaattcaatgattgctgcatatgcgaattttgagaagcatgtcaaggctgttaattgttacaaagggatgctagatggtggcttttccccagacattagcacaattctcaatttgctttcatcgtgcatgcaacctaaggcactatttcatggtttgctagtacattctcatggagtcaagttgggttgtgattctgatgtatgtgtggtgaatactctcatttgtatgtattcaaagtgcggggatgttcattctgcaagatttttgtttaatggcatgtctgacaagacttgtgtttcatggactgtaatgattagtgcatatgctgagaaaggatatatgagtgaggcaatgaccttgtttaatgcaatggaagctgctggtgagaaaccagatttggttactgtgcttgctttgatttcaggttgtggccagacaggggcgcttgaacttggaaaatggattgacaattactctattaacaacgggttgaaagataatgttgtagtttgtaacgcactaattgacatgtatgccaagtgtggaggttttaatgatgctaaggagcttttctacaccatggctaacagaactgtcgtctcctggacaaccatgattactgcttgtgcattgaatggagacgttaaagatgccttggagttattttttatgatgttagaaatgggaatgaaaccaaaccacataacatttcttgctgttctccaagcttgtgcacatggaggtttagtagaaagaggattggagtgcttcaacatgatgactcaaaagtatggcataaaccctggtatagatcattattcttgtatggttgatcttcttggtcgtaaaggacatctcagagaagctttagaaattattaaaagtatgccttttgaacctgattctggaatatggagtgcattgctctctgcttgcaaacttcatggtaagatggagatgggcaagtatgtgtctgaacagctatttgaattggagccccaagtggcagttccatacgtggagatggctaacatatatgcatcagctgaaatgtgggaaggagttgcagctattagaagaaatatgaaatatcttcaagtcaggaaatctcccgggcaaagtattattcaagtaaatggaaaacctactatatttacagttgaggatagggatcaccctgaaaccttgtacatatatgatatgctagatggtctgacttcccgttctaaaaaaggactactagcttattcagaggagatttttgaat

SEQ ID NO: 169 - DNA, 679 bp, Glycine Max
atcctaagatgcttcctcatctccctcttcctctccctacccttcctcttcctcttcctccacctcctctctccgccgccacacgtcaccaccaccaccaacgacctaagaatccgacccggttactcctcctacgactcctacatccaacgccagctcaacaagaccctcaacccgcgcctccgaaaaatatggacaacccgcgactggaaccgcaaaatcccggttttcgcgcgcttcttcgaggaccttaaggataaaaaacttctcaataacgcgtccaaggcactctgcataggcgcgcgcgtgggccaagaggtggaggcgctgaggcgaatcggcgttagtgactccgttggaatggacctcgttccataccctccgcttgtcgttaagggtgactttcacaaccagccgtttgatgacggcacgttcgatttcgaattctcgaacgtgttcgatcacgcgctgtacccggaacgattcgtgggcgagatcgaacgcacgttgaagcccaacggcgtgtgcgtgctgcacgtggcgctgtcgagacgcgcggataagtactccgctaacgacctcttcagcgtggagcccctcgtagcgatgtttaagaactccgctctggttcacgttcgtagcgtcgatggttttggattggacaccgaggttgcgtttc

SEQ ID NO: 170 - DNA, 1539 bp, Glycine Max
atgaaaacccaaagtgcttctctcctctgtctttttctctctcttgctatccttttggctagtggcactgctgcaagtgcaactccaagaagcgcagtgccaagccaccatgtttcaacattcaacagaagcctttttccttccacttttctctttggaattggttcttctgcttaccaggcagaaggagcagcaagtgtagatgggagaggaccaagcatatgggacacctacactagacagcatactgaaaagatttgggatcatagcaccggtgacatgggagctgatttttatcatcgatacaagggtgacataaaaatagcgaaagaaattgggctggactctttcagattctctatctcatggtcaagaatattcccaaagggcaagggagcagttaacccccttggggttaaattctacaacaatgtcatcgatgagatcctagcaaatggtttaaaaccttttgtcactctttttcattgggactttccacaagctcttgaagatgagtatggaggattccgtagtcctaaagtagtggcggattttcgtggctacgcaaacttctgcttcaagacctttggagacagagtcaaatattgggtcactttgaatgaacccttatcatttagtctcaatggctacaatggtggcacctttgcaccaggtagatgttctaaatacgttgccaattgtagtgctggcgattcatccactgaaccctatatcaatagtatgtctattttagcttgtgatacttatacccctacatcctatcgacatggctccgtgctggtcttccgacaaattgggatcactaatccaacacactactttttgccaaaatctcaaagtgctgcagattacaaggcagcaagtagagctctggacttcttctttggttggtattctgatccggttttctatggtgactatccggagagtatgaaatcttcagtaggttctaggctcccaaaattcacaaaagctgaatctgaaggtctaaaaaattccatagattttcttggtgtgaattactacaccacttattatgcggaacatgctgaacctgtcagtgccaaccgaaccttctacacagacatactagccagtctcagtacggaaaggaatggtctacatgttggaacaccgactgatttgaattggctctttatctttccaaagggaattcatcttcttatggcacacataaaggataaatacaagaatcttcctatttacatcactgaaaatggcatggctgaatcaaggaatgactcaataccagtcaatgaagcccgcaaggatagtataaggattagataccatgatggccatcttaaattccttcttcaagcgatcaaggaaggtgttaatttgaagggctattatgcatggtcattttcggacagttttgaatgggatgctggttacacagttcgattcgggctcatatatgtggattacaagaacaacttgaaaagataccccaagttctctgctttttggttgcaaaagttccttctcaagtga

SEQ ID NO: 171 - DNA, 1374 bp, Glycine Max
atgaaaacccaaagtgcttctctcctctgtctttttctctctcttgctatccttttggctagtggcactgctgcaagtgcaactccaagaagcgcagtgccaagccaccatgtttcaacattcaacagaagcctttttccttccacttttctctttggaattggttcttctgcttaccaggcagaaggagcagcaagtgtagatgggagaggaccaagcatatgggacacctacactagacagcatactgaaaagatttgggatcatagcaccggtgacatgggagctgatttttatcatcgatacaagggtgacataaaaatagcgaaagaaattgggctggactctttcagattctctatctcatggtcaagaatattcccaaagggcaagggagcagttaacccccttggggttaaattctacaacaatgtcatcgatgagatcctagcaaatggtttaaaaccttttgtcactctttttcattgggactttccacaagctcttgaagatgagtatggaggattccgtagtcctaaagtagtggcggattttcgtggctacgcaaacttctgcttcaagacctttggagacagagtcaaatattgggtcactttgaatgaacccttatcatttagtctcaatggctacaatggtggcacctttgcaccaggtagatgttctaaatacgttgccaattgtagtgctggcgattcatccactgaaccctatatcaatagtatgtctattttagcttgtgatacttatacccctacatcctatcgacatggctccgtgctggtcttccgacaaattgggatcactaatccaacacactactttttgccaaaatctcaaagtgctgcagattacaaggcagcaagtagagctctggacttcttctttggttggtattctgatccggttttctatggtgactatccggagagtatgaaatcttcagtaggttctaggctcccaaaattcacaaaagctgaatctgaaggtctaaaaaattccatagattttcttggtgtgaattactacaccacttattatgcggaacatgctgaacctgtcagtgccaaccgaaccttctacacagacatactagccagtctcagtacggaaaggaatggtctacatgttggaacaccgactgatttgaattggctctttatctttccaaagggaattcatcttcttatggcacacataaaggataaatacaagaatcttcctatttacatcactgaaaatggcatggctgaatcaaggaatgactcaataccagtcaatgaagcccgcaaggatagtataaggattagataccatgatggccatcttaaattccttcttcaagcgatcaagtga

SEQ ID NO: 172 - DNA, 103 bp, Glycine Max
atgaaaaggaggaggaggatggaggctacaaactttccaaacttattcactattctgccaaatttgggaatcctctccttaaacgtaacttgtcatgctatca

SEQ ID NO: 173 - DNA, 244 bp, Glycine Max
atgaaaagggcactcccagccaatgcaaaaatctcaaaggaagcaaaagaaacagttcaagagtgtgtgtctgagttcataagcttcatcactggtgaggcctcagacaagtgccagagggaaaagaggaagacaatcaatggtgatgatcttctttgggccatgacaacactaggatttgagaactatgttggacccttgaagctctacctcaacaactacagggaaactgagggagaaaaga

SEQ ID NO: 174 - DNA, 867 bp, Glycine Max
atgaaaatcaagcaaattctcttgttctcactcctactacttgccccctttttctcaatcaccactttagctcaatcaccagctgcagcccccaaagccccagcaaaacctgcaccttcaaaacctgctcctgccacaccggctccagcgcccgcaaaaccattagtcccttcattaccccagtcaccctcttcaggtgttgattcttctggcagccaagacattgtgaagatcctaaggaaggccaagtcattcaacactctaatccggttgctgaaaaccacccaaatcatcaaccaagtgaatgcacagcttgtgacctcaaaaaacggaggcttaaccatccttgcaccagatgatggtgcattttcagaactcaaagcaggttactttaactccctaggagataggcaacaaaaagcactgatacagtatcatgttcttcccgtttatgtgtccagctccaactttgatgctctgagcaaccctgtgctgacattggccagtgacagccccacagggtatcagataaacgtgacagcatatggtaacagtgtgaacatatcaactggggtggtgaatgccacactcacaggcattgtgtacactgataagacacttgccatatatcatgtggacaaggtgctcattcctttggacttctctaagccaaagcctatagctccagcaccagctgtggccaaggctcctaaagctgataaggagaactcttcagcagaagatgaggaccaggctcaggcagccaaggacagctctggtgcaacaagttttgttagcattcatggaacaacgttggtgtcctttggagttgctattcttgcagcagcagctacaatgtcgttttga

SEQ ID NO: 175 - DNA, 1380 bp, Glycine Max
atgaaagcggagacattgacgttagttctggtgaatctggcaggtattatggagagagcagacgagtctctgcttccaggagtgtacaaagagattggtgctgctctgaacgcagatcccactgcgctaggttcactcactttcttcagatcaattgttcaatctttatgttacccactcgctgcatacctcgccactcgtcacaatcgtgcgcatgtcatagctctcggtgcttttctttgggccgctgccacattctttgttgccatctcctccaccttcttacaggtagcaatttcgagaggtttaaatgggattggactagcccttgttactccagcaattcagtcccttgttgcagattccacagttgatagcaatcgtggtatggcttttgggtggctgcaactaacaggaaattttggaagcatcattggtgggctctttgccgtgcttattgccccaacctcatttaagggtatacctgggtggagaatagcttttcatctggttgcattgattagtgttatagtgggtatattggtttgcctcttcgctaatgatccacgcttttcaaaggccagagagagagcaacaacatatgaagctccaaacaagtccttttgttctgatatgaaagacctaatgaaagaagcgaagtcagtaattggaaatccatcatttcagataattgtggctcagggagtgtttggaacatttccagggtcaagcttgtcatttgccactctttggttagaactaataggcttcccccgcgtgacaactgcattcctttggacactatacgtggttgctacttcatttgggggtctatttggaggaaggatgggggatattttatcccaacggtttccaaactctgggagaatattgttgtcacaaataagctccagttcagcaattcctcttgctgcaattttgttgttgggattgccttatgatccatccacggccttcaagcacggtctgcttttatttatcatggggttaataagatcctggaatgctccagccactaacaatccaatatttgcagaaatagtccctgagaagtcccgaacaactatatatgctttggatcgatcttttgagaccatattgtcatcctttgcaccacctattgttggagctttggctcagcatgtttatggttacaaaccaatcacaaaaggatcctcagatgagatagaaaaagatagagaaaacgctgcatcactcgccaaggcactttacactgcaattagtattccttcggtactctgcgtttccatctactcgtttctttattgcacgtacccgagggacagggagcgagcgagaatggaagcattagtggaatcagaaatgcaacagctacag

SEQ ID NO: 176 - DNA, 1200 bp, Glycine Max
atgaaagctatggagttggtgggagagaaatggatagaaattgtgacgtgtttggtaatttcaacaacattaatgcggagtgtaagtggaagtgaaagcgagtgcattttcccagcgatattcaacttgggagactcgaattcagacactggcggtctctcagcagcgttcggacaagctcctccccccaacggaatcacttatttccactcccctaacggacgcttctccgatggtcgtctcataatcgattttatagccgagagctccgggttggcatatctgagggcttacttggactcggtggcctccaacttcactcatggagccaatttcgcaacggccggatctactgtcagacctcagaacacaaccatatctcagagcggatacagtcccatttccctagacgttcagttcgtgcagttctctgatttcaaaaccagatccaaactcgttcgccaacaaggaggggtttttaaggaattgttgccaaaggaggagtatttttctcaggctttatatacctttgatattggccaaaatgatctcactgctggctacaaactcaacttcaccacagaacaagtcaaggcatatataccagatgtattgggccagttctccaatgtcataaagggtgtgtatggggaaggtggaaggtcgttttggatacacaacacaggaccattggggtgcctgccatacatgctggatcgctatcccatgaaaccaactcaaatggatgagtttgggtgtgccaaaccattcaacgaggttgcccaatattttaaccgtaaattaaaagaagttgttgagcaactgcggaaagaattgccaggagctgcaatcacctatgttgatgtgtatacggtcaagtacaccctcatcagccatgcccaaaaatatggttttgagcagggggtgatagcatgctgtggacacggtgggaaatacaacttcaataatacagagagatgtggagcaaccaagagggtgaatggaacagagattgtgatagccaattcatgcaaagatccaagtgtgaggattatttgggacggaatccattacaccgaagctgctaataaatggatcttccaacaaatagtcaatggttccttttcagatccacctcactctttaaaaagggcttgttatggtaaatccattaggagacataaattccagttattgtaa

SEQ ID NO: 177 - DNA, 336 bp, Glycine Max
atgaaaggaacttctgcaccaaaaaataaacaaaagaaaggagggttgaagtcacttcaagtccttgctgcaattcttttatctgagatgggccaattaggtgcaaaaaaccttttagctttagtttctatagtgtgtagttggcttccccaagagaactttataaagcttgaaactttgaaaggactaggttgtaatcagacagaacagtcatattttaagtctataactaaaatgtatgacaaaaaaattatgcaaatatacactagcataaggacatgctttggaaatgatgtgaagacatacaccagacaatatgctcatgaattgcaatga

SEQ ID NO: 178 - DNA, 1020 bp, Glycine Max
atgaaaggaagcaagaagccttatctagttgtgatcctcatagaagccatctatgctgccatgtttctgctctcaaaagctgcatttgaccatggcatgaacaatttcatctttgtcttctatagacagacaacagccaccatattccttatcccttttgctttcttctttgaatggaaaactgcacctcctttgaccttggtgaccttctgcaagatctttttcctttctttcctggggatcagtgcgagcttggacatatatggtattggacttatttacacttctgctactttagctgctgctaccacaaactgccttccagtcatcaccttcttcttggcgctcatactcaggatagaaaatttgaaagtaacgagtacctcgggggttgctaagttggttggtgtagtggcatgcttgacgggatcagcaattcttgctttctataaaggtcctcatttagaagttttaagccattatcacgttttagggtaccataaaaaccaacaacatctgggtcgtgttgcatctgggacatggattaagggttgcttcctcttgctactctccaacaccttttggggaatgtggcttgtgctacagacttatgtcataaaaggatacccttcaaagctgctcctcacaactcttcagtgtttcttaagctcgattcagtctttgggcattgccttggccgtagaaagagatattgagcaatggaagttgggatggaatgtcagactccttgccgtaggaatcatggtgaccggtgtaacatattacttacaaacatgggttatagagaagaaaggaccggtgtttctagccatggcaacaccacttgctttgatcatgaccatcttctcctccgcagttctcttgggcgagatcataactttgggaagccttttaggtggcatcgctttggtcattggactgtactgcgtgctgtggggaaagagcagagagcaaatgccaaaagcctcgttagacttggaggaggcatcatcgggttag

SEQ ID NO: 179 - DNA, 1404 bp, Glycine Max
atgaaatcggagacactgaacctggtgctggtgaatctggcgagtattatgcagagagcggatgagtctctgcttccaggagtgtacaaagaggttggtgaggatctgaaggctgaccccactgcgttgggttcgttgactctcttcagatcacttgttcagtctctctgttaccctctcgcggcttacctcgccacccgtcacaatcgtgcgcatgtcatagctctcggtgcttttctttgggctgctgctacattcctcgttgccatctcctccaccttcttacaggtggcaatttcaagaggtttaaatgggataggacttgccattgttattccagcaattcagtcccttgttgctgactcaaccgttgatagcaaccgtggtatggcttttgggtggctgcaactaacaggaaacttaggaagcatcattggtggtctcttctctgtacttatagcctcaaccacagtcgcaggtatacctggttggagaattgcctttcatctagttgcattgatcagtgttatagtgggtatattggtgcgcctcttcgctaacgatccacactattcaaagagcgatgacacagcaacaaatcaagctcaaaataagtccttttattctgaaatgaaagatctaatgaaagaagcaaagtcagttattagaattccaacttttcagataattgtggctcagggagtgtttggatcatttccctggtcaggcttgtcatttgccactctttggttagaactaataggcttctctcatgtcacaacagcgaccctttggaccctattcatagttgctgcttcatttgggtctctgtttggagggtggatgggagattttttatccctacggttacccaacgctggtagaataatattgtcacaaataagcgctggttcagtcattcctttagcagcaattttgctgttgggattgcctgatgattcatccactgccttcatgcatggtcttgttttagtcatcatgggattcacctcagcctggaatgctccagcaactaacaatccaatatttgcagaaatagtccctgagaagtcccgaaccgctatatatgctttggattgttcttttgagtccatcttggcatcctttgctcctcctattgttggattattggctcagcatgtttatggttatagaccaatcccaagcggatcctcggattctgtggagattgaaacagatagggaaaatgctgcatctctcgccaaggcactttatactgcaattataatacctatgacaatctgcgtctccgtgtattcattgctttattgcacatacccaagggacagggaacgagcaagaatgatatcattagccgaatcagaaatgcagcagctagaagtggaagatggcacaaaagaa

SEQ ID NO: 180 - DNA, 1452 bp, Glycine Max
atgaacaaaagcaagaaaaagggaaagagattaccacctggtccaaaagggttgccaattttgggaaaccttcacaagttggggtcaaatcctcatcgtgatctgcatgaactagcccagaaatatggacctgtcatgtacttgcgcttaggatttgtgccagccataattgtttcttcaccccaagcagctgaactgttcctcaagacccatgatcttgtctttgctggtagaccacctcatgaagctgcaaagtatatggcttgggagcagaagaacttggcttttggtgaatatggttcttactggcgcaacgtgcgcaagatgtgcacattggagttgctaagccaaaccaaaattaactccttcagacccatgagggaagaggaacttgacctattgatcaagaatctaagaggggcatccaatgatggagctgttgttgatctcagtgccaaggttgcaacactcagtgcagacatgtcttgtagaatgattttagggaagaagtacatggaccaggacttggatcagaaggggttcaaggctgtgatgcaagaggtgttgcacttagcagcagctcctaacataggggattacattccttacattggtaaacttgaccttcaagggctaatcaggcgtatgaagacactgcgcagaatctttgatgaattctttgacaaaattattgatgagcatattcaatcagacaagggagaagtcaataaggggaaggattttgtggatgccatgttggacttcgttggtaccgaagaatctgaataccgcattgaacgccccaatatcaaagccatattgctggatatgttagttggttcaatagatacttcagctacagcaattgagtggacaatttcagagctactcaagaatccaagggtgatgaagaaactccaaagggaattggaaactgtggtgggtatgaagaggaaggtgggggaatcagacctggacaagttgaagtatttggagatggttgtaaaggaaggcttgaggctccatccagtggcaccgttactattaccacaccactcgagggaagattgcatggttggagaatatttcatacctaaaaattcaagggtgatagtaaatgcatggacaattatgagagacccaagtgcttgggatgaggcagagaagttctggccagagagatttgagggaagcaacatagatgtgagagggaaagacttccggttcttaccttttgggtctggcagaagggtctgtccaggattgcaattgggcctaaacacagttctcctaacagtggcccaactggtgcattgctttgattggaagctaccaaataacatgttgccatgtgaattagacatgacagaggagtttggcctctcaatgcctagagcaaatcatctacttgtcattccaacatattatcgccttcatgatcaaagttgttag

SEQ ID NO: 181 - DNA, 648 bp, Glycine Max
atgaacatcttcaggctcgccggtgacatgacccatcttttcagcattctcgtcctcctcctcaaaatctacgccaccaaatcatgttcagggatttctcgcaagactcaagagctgtacgcgattgtgttcgtggcacgctatttggatctgttcacggacttcatatccgtttacaacaccttcatgaaggtggtgttcattgcaagctccttagccattttttggtgcatgcgttttcatcccatggtcaggagaagctacgatagggacctagacacttttcgccactatttccttgttggggcaagctttgctttggcactcatcttgcatgaaaagttcactgttcaagagattttctgggcattttcaatatacttggaggcagttgcaatattacctcagttggttttgttgcaaagaagtggaaatgtggacaatttgactgtgcaatatgtattctttcttggtgcatatcgtgcattttacatcctgaactggatataccgctatatgactgagccacgttttactagatggatagcctgtgcctcaggtgttgttcagacagctttgtatgcagatttcttctactattatttcatcagctggaagaacaattcaaaactgaagttgcctgcctga

SEQ ID NO: 182 - DNA, 597 bp, Glycine Max
atgaacccgccggaatttccctccggcagctgcggaacatcatcgccgccaggaaagaaagagctccagctccaaggtacacgcccgccgcctctcagagtcagcaaagactcccacaagatccgcaaaccgccgcttccccccaccgcgcaccaaccggcggcgctgccggagcaccggaagccggtgatcatctacgccgtgtctccgaaagtcctccacgttcccgccggtgacttcatgaacgtcgtccagcgcctcaccggaccctcctccggcgacgtatcgccagcggcgagactcgcgtcgatcgagagaacgagcccgtcggagagggagaaagttcacagcgaagacaacgacgtgaagttgatgttagaaggagtggaagtgggtcaattccccggaatattgtcgccggcgacgttgcctccgatatcaccagggtttttctcggaaccgcaaacgacgtcattttggaatgacttgagcccgttttggtcaacgaacagcttcgtggcgagtccgtcggggttactttccggcgctttggtttctccgctgccgtcgccggacatctttaatctcttcgactaa

SEQ ID NO: 183 - DNA, 1113 bp, Glycine Max
atgaaccctaagtttattatggctaatggcaatttggtgcgggttctcatacatactgatgttactaagtatctctctttcaaagctgtggatgggagctttgtgtttaataaaggaaaggttcataaggtgcccgcaaatgacatggaggccttgaagtctccacttatggggctatttgaaaaacgccgagcacgcaagtttttcatttatgtgcaaaattacaatgagagtgatcccaagacccatgaagggatggacttgacaagagtgactactaaagagttgatagcaaaatacggtcttgatgataacactatagacttcattggtcatgctttggcgcttcatagtgatgatcgctacttggctgagccagcactggacactgtgaagagaatgaagttatatgcagagtctcttgcacgctttcaaggagggtcaccttacatatatcctttgtatggtttaggagagcttccccaggcatttgcacggcttagtgctgtttatggtgggacatatatgttgaataagcctgagtgcaaggtagaatttgatgaggaaggaaaggttgttggtgtcacatctgaaggggaaactgcaaagtgcaaaaaagttgtttgtgatccatcatatttgcccggcaaggtgaggaaggttggtagggttgcaagagcaatagccataatgagtcacccaatccccagcactgatgattcccattcggtgcaaattattttaccacagaaacagttgggtcggaagtcagacatgtacctattttgttgttcatatactcacaatgttgctccaaagggaaaatttattgcatttgtatcaaccgaggcagagacagatcagccagcaattgaactaaaacctggaattgaccttctaggacctgttgatgagatattttttgatatctatgacagatatgaaccggtcaatgaacccactttggacaactgctttgtatcaacaagttatgatgctactactcactttgagtcgaccgtggatgatgttctcaacatgtatacattgataactggaaaggttattgacctgagtgtggatcttagtgctgctagtgctgcagaagagtaa

SEQ ID NO: 184 - DNA, 2253 bp, Glycine Max
atgaaccttcaaagtgatgcacagaagctgttcgatactatgcctcataggaacctagttacttggtcctccatggtttctatgtacactcaacatggttacagtgtggaagcactgttgttgttctgccggttcatgcgaagttgcagtgagaaaccaaatgaatacattttagccagtgttgttagagcttgtacacaattgggtaatctcagtcaagctctgcagctgcatggttttgttgttaagggtgggtttgttcaggatgtatatgtgggtacgtctttgattgacttttatgccaagcgtgggtatgttgatgaagcaaggttgatttttgatggcctaaaagttaaaaccactgtcacatggactgcaattatagcagggtatgcaaaacttggaagaagtgaagtatccttgaagttgttcaaccaaatgagagagggtgatgtctatccagacagatatgtgatttctagtgttttgagtgcgtgctcgatgcttgagtttcttgaaggggggaagcaaattcatggatatgtgttaaggaggggctttgacatggatgtttcagtggtcaatggaattatagatttttatttgaaatgtcacaaagtgaagacaggtcggaagttattcaatcggctggtggataaagatgttgtttcgtggaccacaatgattgctggttgcatgcaaaattcattccacggggatgccatggatctgtttgttgaaatggttagaaagggttggaagcctgatgcatttggttgcactagtgttctcaattcatgtggttcactgcaggccctacaaaagggaagacaagtgcacgcttatgctatcaaggtcaatattgacaatgatgattttgtaaaaaatggtttgattgacatgtatgccaaatgtgattccttgactaatgcaagaaaagtctttgaccttgtggctgctataaatgtagtatcctataatgcaatgatagaaggatactcaagacaagacaagctggttgaagcattggatctttttcgtgaaatgcggctaagtttatcgccaccaactctattaacatttgtaagccttcttgggctatcttcatcattatttcttctggaactaagcagccaaatccactgcctgattattaaatttggggtttctttagacagttttgctggaagtgctctaatagatgtttattcaaaatgctcatgtgttggggatgcaagactagtttttgaggagatatatgacagagacattgtagtatggaatgcgatgttttctggttacagccaacaactggaaaatgaggagtctctcaaactttacaaagatcttcaaatgtcaaggctaaaacccaacgaattcacttttgctgctgtaatcgcagcagcaagtaacatagcaagtctgcgacatggtcagcagtttcacaaccaggtgataaagatgggtcttgatgatgacccctttgtcacaaattccctagtggatatgtacgccaagtgtggaagcatcgaagagtctcacaaggcattcagttccacaaaccaaagagacattgcttgttggaattccatgatttcaacatatgcccagcatggagacgcagccaaagctcttgaggtgtttgaacgcatgattatggagggagtgaagccaaattatgtcacctttgtaggtttactatcagcatgtagccatgctggacttctagaccttggatttcatcactttgaatcgatgtccaagtttggaattgaaccagggattgatcattatgcatgcatggtttccctcttgggccgtgctggtaaaatatatgaagctaaggaatttgttaagaagatgccaataaaaccagcagcagtagtgtggaggagcttgctcagtgcatgtagagtctcaggtcatgtagaattgggtacatatgctgctgagatggcaatttcgtgtgatccagcagatagtggatcatatatattactttcaaatatttttgcatcaaaaggtatgtgggcaagtgttagaatggtgagggagaaaatggacatgagcagggtagtgaaggaaccaggttggagctggattgaagtgaataatgaagttcacagatttattgccagagacacagcccatcgtgactctacacttatatctctagttttagacaatttgattctacagatcaaagggtttggttatgtgcctaacgctgccacattttttcttgatgattga

SEQ ID NO: 185 - DNA, 939 bp, Glycine Max
atgaagagacttggcagttctgattctctgggtgctctcatgacgatttgtccaccaacagacgaacacagtccgaggaacaaccacgcgtatgggagggagtttcagtccatgctggaaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgccattcctggatcggacacgaaggagttgagttacgagtgttttaacaagagtgatgaggtgggagggggttcttctgtgttccatgtggatttcaaagatggctcttctgatagtgactcaagcgcgatcttgaacgaggagaacaacaaccacagccccaacaataacgcggcgatttcgtcgtgtggggttctgcaaagtcacgggcttttgttgtcgccttcttcgtcgtcgatgaacaactgtttccagttccagaaacagtaccagacgacgacgacgcagtacgtaaagatggaggagcacaattttcttagcgccgacgaggcctgcaatttcttctcggatgaacaagcaccaactctgcagtggtactgttcagaggaatggagttaa

SEQ ID NO: 186 - DNA, 285 bp, Glycine Max
atgaagagcccaaaagagaaccacgtggagtgctggagcaacctcattgttctaaaatcatgttccaatgagattatgcatttcttcatcaacggtcaagctgatattggccccaactgttgctgtgccattagggtcataacccatgattgctggccggaaatgctaacttccttgggttacagttaccatgaagctctctctatacgtggctattgtgatgctgctgcttcaagcccagctttggcccctactactgatggacccgccaatccaatctattaa

SEQ ID NO: 187 - DNA, 846 bp, Glycine Max
atgaagcaaactctcttgttctcactcctactacttgcccccgttttctcaatcaccactttagctcaatcaccagctgcagcccctaaggccccagcaaaacctgcccccgctacaccggctccagtgccggcaaaaccattagtcccttcattaccccagtcaccctcttcaggtgctgattcttctggcagccaagacattgtgaagatcctaaggaaggccaagtcattcaacactctaatccggttgctgaaaaccacccaaatcatcaaccaagtgaatgcacagcttgtgacctcgaaaaacggaggcttaaccatccttgcaccagatgatggtgcattttcagagctcaaagcaggttactttaactcccttggagataggcaacaaaaagcactgatacagtatcatgttcttcccgtttatgtgtccagctccaactttgatgctctgagcaaccctgtgctgacattggccagtgacagccccacagggtatcagctaaacgtgacagcatatggtaacagtgtgaacatatcaactggggtggtgaatgccacactcacaggcattgtgtacactgataagacacttgccatatatcatgtggacagggtgctcattcctttggacttctctaagcctaagcctatagctccagcaccagctgtggccaaggctcctaaagctgataaggagaactcttcagcagaagatgaggatcagtctcaggcagccaaggacagctctggtgcaacaagttttgttagcattcatggaacaacgttggtgtcctttggagtcgctctgcttgcagcaacagctacaatgtcattttga

SEQ ID NO: 188 - DNA, 507 bp, Glycine Max
atgaagccaatgaggatctcttcgttcaccaatctcagatcaaatttgaccgttaagttcgccattaaatttgaatctgatggacacgttaggactattgatgtcactagccccgacaacgccaacattcagggaactagacacagtggtgatggtggccgaagctatggcgggggacgaggagggggtggaggtggatatagcgacgatgacggctacggtggtggtgatggctatggtggaggtggtggctacgatggtgacaggcttgttacaactgtggtgaatcgggacatctggctagggactacagccaaggaggaagtagagacaggtacaacagaggcaatgggtggtggtggcaagtatggaggcagcaatggtaggaggtacgatggtggtggaggaggcggtggtggaggaggaggtggtggcggcggaggaagctgctacagctgtggagagtctgggcattttgccagagattgcccatcaagtgctcgttga

SEQ ID NO: 189 - DNA, 312 bp, Glycine Max
atgaaggctcttcctaaaccattgcctgcatctatggtggctagttatctgtcaaacaagaaagaagatgaaaaagatgaagatgagaaggaagagaatgagcagtctgttgagcacttatcacctcaagatctattgaagagacatattaaacgtgccaagaagggtaggatcgttgaggagtggaatcgtaccatgattgatgattggcaagccgatttgctagctcatgagattctcatgttcctgcaagttgaagatccacacttttgtgactcatttcctctcccaaacaccacaacttttctctga

SEQ ID NO: 190 - DNA, 1053 bp, Glycine Max
atgaagtggggtgggaaaaaaccttctctttcttcttcttcttctaggccttcttctttcatatctcatgtatctcctttttcatggctttccaaaggcaggttttatggaggggatgatgatgaggctttctggagactctcatttggtgaagaggatggtaatgagcataggaaaagtgaagaagatattctgaaagtgaaaccagtaaagtacaatttggatgttgaacatgccattccatcctcaagcggactgaataatgctaagagaaaaggtagtagaaaagaaggcactcagaagatgaagcagaaggacactactggaatgagagaagaaacgaaaattctgaatgaagcaccaaagagtgtgaaggaactagaatccttaaggaggagatatgagaggaaagcacaaagagttttgcaagagcagctcttgaaactggaaaaggcagaagaggaagctgaaacaatttgcacaccaagaaagcatttttttgtagattcaaagggttctggccttgaaagtttcagagaagctcgtgtgtgtagtcctcaattgtgttctgagtggcataatttgaaacaaagtgaggggttgaaattgaaaccaaagagtagccaacaaaggcaatctcttcatgttagcagagaaaaccagaggaggaaaccaaagcacaacaacaaggttagagtgtattctccaaggatgggttccaaggtcgaagtccgcaaaataaaggccatggaagagaagaagaaagcaaaactgaagatgaagaaagaagaggaaattgtggaggaaacagaagaagggttagatagctttgctgtggtgaaatgttctttggatccacagaaggatttcagagattcaatgattgagatgatcacagagaaacagatcagcgagccagaagaaatggaagatctgttagcatgctatctgactttgaattccagtgagtaccatgatctcatcatccaaccagttcgtgtattcaatcagacaagcaatgttgttgttgtgattaacaacataaatgtttag

SEQ ID NO: 191 - DNA, 420 bp, Glycine Max
atgaagttagaagcagtaggaggagggtgcaagtaccacccaaataacaagcaactacccggtgtttgtccctcatgcttaagagacaaactcttgaagctctatgacagcagcaatccaacttatcctctcccctgtcctcctcgaccttacgtgtctcgtggccaccgccgccatagttctctcgtaatggattctgcttcttccaccatggttagcttcaattatgggttgaagaagagcaactccattgcctttgcttcgagaagccaagccataaatagggaagtcaatggaaacaacaagggtagtaagaaaaggggtatttggtccaagctgctcaaattgaccaaaaagaacaccaaggaggccttcatgcattccaggtccgtgagtgagggaaataattggcatttttaa

SEQ ID NO: 192 - DNA, 351 bp, Glycine Max
atgaagttctgtattttttgtcattcagtgttgggactgacaattccattaaggacagtttcggagcatgagaagggaaataagatgagatatactatcatatccaatcttaattcatggtttggtgagataataagatatgataaattaatcctattattgtatcatattctatttaccgggcaaaattttatcctatggtcaagacttgacatatgttttgttgttcataagctcagacggctcagtccatataagtgtcatcacattattgcatgcaaaccttactctgttacattacaacattcaatcaaaattccaagtaatgaatgggtaaagtttaatctttag

SEQ ID NO: 193 - DNA, 1458 bp, Glycine Max
atgaatagtgtgttcagcgagcagatactcgcggacaagctgtccaagctcaacagcacccagcagtgcattgaaactttatcacattggtgtatatttcaccgaagcaaagcagagctggtagtgggaacatggaataaacagtttcacaattcagagaaggttcagcgagtcccccttctgtatcttgcaaatgatatcctgcaaaacagcaggcgtaaaggaaatgaatttgtgaccgagttttggaaggttcttccctcagcacttaaggatgttcttgagaaaggtgatgatcaagaaaatcgtgcagtatttagactggttgatatatgggaggaaaggagagtgtttggatctcaggctaagagccttaaaaatgtaatacttggagaagaagcacctccacagttggaattcaacaaaaagcggtcccgttctgttagaattgtgaaaaaggattctcgttccatcaaaacgaaattgtccattggaggtacagcagaaaaaatagtctcagcctttcatacggtgcttaatgaacattccaatgaagatgcagagatgagtagatgcaagtcagctgttcatcgtgtgaggaagatggaaaaaaatgttgatattgcatgcgctgttgtaaaggaccctaagcgaaaaactttgtccaaggagctagtggaggaagaaaatattttgaaagaatgcattgaaaatctcaaattagttgaagcaagtagaacagcacttgttattcacttaaaagaagctttgcatgagcaggcaatcctggaatctgagctggagaatgttcgcactcagattcaggtagcgcaagcacaagtagaagaggctagctacatgcggaagcgacttgatgatgaagattcttcatataaagcctcaatttcaacgacttcacttactgatgtgaatacaaaatcagaagcagcaactaagaagtcagctgctgcaattgcagctgaggttgcagataagctaacagcttctacgtcatctcagttaatcatgacttctgttctctcaacatttgcagcggaagaggcaaaaagtgcttgtctaacttctgagtccatgtcaaaacctgagaagtcaatacctatatcagatccaaataatccagctgctgcatcacagggtcaatatcaaatgctttgtaattcatcctcccaacattatttgcaatcaacaggaggtgtcatttcttcttatggttatggtagcatcacaccattaccaccgggaccactcccaccccatatggtgggtccagtggtgcctttgacgcatcaggcaatgcaaataactcagcagcagccaacacctatagctcagcatcaaccaataaaaatgacacaacaagccccagcacctcctagtttccgaccacttcaaccgccaggaatggtgtactatggtaatcatcagcattctatatga

SEQ ID NO: 194 - DNA, 1458 bp, Glycine Max; identical to SEQ ID NO: 193

SEQ ID NO: 195 - DNA, 213 bp, Glycine Max
atgaatccagcggctaagccttcctcactcatctctctacctctcaccctaaaatcatcttcccttcctttccgttctgcgtcactagtgcgacaaagtcttcccttccttcaccagtgcgtcgaaggtcaatgcctcccttccatcaatgctgcaacaaagttttctcagtcgaaggtcatacttaaagttattatgttcctttcgtgttaa

SEQ ID NO: 196 - DNA, 831 bp, Glycine Max
atgaatgctagaagctggcacctcgtattattctccttatgtcttttctttggttcaggtctaggaacaaccaaaatattaataaatggcaaaaaacaggaaatcttctcatcatcggaattgggtactcaattagatgatgttcctatcgtcaatcccacaactcctgacacaggaaatccatatatgggaaaccctaacattcctcaaacacctgacacatcagggccaaacccaacaaccccaaccacaaatccaacaaccccaaccacaacgcccacaaccccaactacaacacccacaaccccgactactacatcctcaggtggtcaatggtgtgttgctaaccagggagcttcagacactgctctacaggttgctcttgactatgcttgtgggtttggaggtgcagactgctcagcaatacaaccaggagcaagctgttataatccgaacactgtccgcgatcatgcttcttatgcattcaatgactactaccagaagaatccagcacctaccagctgtgtatttggaggaacagcatctcttacaagcaatgatccaagtagtgggagttgcaaatacgcatcacccaagtcaacaagcactaatcagccaccaccaacaccaacatttgtcagcccaccaagtccaccaactccagtgatgaccccaactccaccagacatgctaaatcctggtggcggatcaactgtctttggttcagaaccaacaggaagccccaacacagccacatttgcatttaattccctgctgatgttgttcacatgtggtctgttggcttcccttcaactagcaaattacatctag

SEQ ID NO: 197 - DNA, 1071 bp, Glycine Max
atgaattcgacaccagcgaacctggaatcatcactttcagttcccagtgttcaagagttagcattccaacggccagagaaagtgccagcaaggtacataagagatcaagacggtgatggcatcattgccacctacccttctcatccatctcttcgtgtgcccttcatagacatggccaagttggtcaacgctgacacacatcaaaaagaagagcttcgtaagcttcatcttgcttgcaaagactggggtgtctttcagctggtaaatcatggactttcaaattcatcccttaagaatatggggaatcaagttaaaagattttttgaacttcctttacaagagaagaagagatgggcacagagaccaggaactcttgaaggctatggccaagcatttgtgacctccgaggaccaaaagctggattggaatgacatgatcttcctgaaatgcctcccaattcagaaccgaaaattggatttgtggccacaaaaccctcctgagtttagggaaacattagagagatattctgaagaaataagggaagtgacaatgtcagttgtgaagttccttactatgtctttggggattcaggataaagagatatcggaaagtttcagagaaggactgtatgatataaggatgaattgctacccaccctgtccagagcctgaaagagttcttggaattgcgccccatgctgacaattctgggatcactcttctgcttgactgtgctgattttccagggttgcagttcctcaaagataaaaaatgggtcaatgttgaacctatagaaggggcaattgttgtaaacattggccaaattattgaggtgatgagcaatgggatatacaaagcgccagagcatagagctgtagtaaataagttaaaggagaggttttcaatagtgacattctgctatccaagccctcatatggacattggacctgctgacaagcttacaggtgaaggaaaagtagctgtattcaagaaattgacacatgcagagtatttcaggaagtttttcaacagagaccttgatgaatcgtttattgatagtctgagagtatga

SEQ ID NO: 198 - DNA, 1590 bp, Glycine Max
atgaattggattggcgtcacggttggtggcctcgtgggcatagtgggtgcaatattggcactaaaagatgccaaagtggcgattccatttaccttgccctggtccttcgccacagacaatagtagcttcgagaaatcgctctttgttcccggcttgcaaaacctccaaaacaattgcttcctcaacgttgttttgcaggctctagccagctgtttttgctttcagagttttcttcacagtgtgattggagagtgcgggagtaaggacctggatgaaaacatgcctcttgcgcttgctttggctactttgctagaagagctgagttcatttagttcagaaagggttacactgagtcctcgaaagatgatgcttgccatgtccaactacattccaaattttaatctaactagccagcaggatgcagctgaagcatttctccatctgttatgcttactgagagaagaatttggaggttgttatgctccaaagatgagttctttagcagaaatttttgcttctaataatagaattcttactccaatacagagtgactgccaaagtgagcaggagagatggcagcaactcttccttggaccttttgatgggattcttggcagcagcttgacatgtcaaagttgttcatctcagatctcgattaactttgaacattttgattgtttgcctctttcacctgtgcttagtgatacttccacaataagagttggttgtaccctggtggattgcctgaagcagttcattgttgctgaacatgttgaaaattatcactgcagccaatgttggcataatgccgcaatcaagtatctttctataatggaaggaaatgaggtagaactagaaaagctaaggagatgctctgacccagaaatctgcgattgccgaaaaatgtataatcttgataaactaccctggtcaaacaggttttcacacactttgaagcagctaagtatggctaggtgtccaaggattttatgcatccagttgaaaagagtttatatgaatgtctttggagagctagtcaaactgcagggccatatttcttttccattgattttggatgtgttgtcattcatgacaactagactgggagtgaagaaacacgacatagatgtacaaagtgtgccattaaatttgaatacattgaaatttagtggccttcatggagcaaaaaaagagcagatcaagtcagatggtgttattgatgatggacttgtctcctctacaaatggacaggcacttcataatgacactgtatttccctgctctggctcttcagaaagcattcactcagatacacatatgcaatcgattgaccaggttgtacctcaagaaacatgttcgtatcaacttgtttctgttgtggaacactttggaaaagctggaagtgggcattacactgtttacagatctgtaagagtggagttttcagaagacgtctctgatgattacctcaatcaaactccaatgcgttggttttgtatttcagattctcaagtgcatgctgtttcagtggaagatgttctttccagtgaggccagcttgcttttctatgagagaattccaaggaactga

SEQ ID NO: 199 - DNA, 739 bp, Glycine Max
atgacaaaactcacgcatctaattgggataatcaaggacaaagcatcgcagagcaaggcggcgctactctccaaacgcaccacgctcttccttctacgcgccacgagccacgattcctccacgccccccacgcgcaagcacctagccacgctcctctcctctggcgacggctcacgcgctaccgcctcggccgctgtggaggtcctgatggaccgccttcaggggaccaacaacgccgccgtggccctgaagtgcctgatcgccgtccaccacatcatccaccacggcagcttcatcctccaggaccagctctccgtgtacccctccgcaggcggcagaaactacctcaacctctccaacttccgacacaacgccgaccccacatcatgggaactctcgtcctgggatcctgggattcttcctcggaacccgaccgacagagaagacagggtgtcgggtctggtcaacgcggacttgttgaccgagtttgactccttggtggctctggttgaagggatttgcaagaggcccgagcccaacaacgtctacgggaacaacgggttagtggaggagattgtgaagctggcgcgtgaggattggggtgtcgtggaagttgaggtgcgcgtgaggaggttggagcagtgccaagagatgatggatggagcaagagaacttggattgtgggattttgttggagaggttaaggataaagcagggattcaggtttatagacaagagg

SEQ ID NO: 200 - DNA, 1995 bp, Glycine Max
atgacaacagagttctcccaaacacttcaatcaaacatggctttaccagccaatgaaacctccatggcagaaaggtctcagtgggtgctcaatgctcctgctcccccatccacgtggcacaacctcatggcttctgtgaggaacacaatttcatcgtaccaaaaaatgtgttcttatataagaggccaacctggacccaaagttgtgctttccttcttgcggagcatttttcctattcttcattggggtcgtaattattcaccaaccaaattcagaaacgacttacttgcaggtcttaccattgcaagtctctgcattcctcagagcattgggtatgccactttagcaaagcttgatcctgaatatggactctatacgagtgtggtgccacctcttatctatgctttaatgggaacttcaagagaaatagcaattggacccgtggccgtggtatcgcttcttttgtcatcaatgattcagaaattaatagaccctgccattgatccaaatgggtatagaaagcttgttttcactaccactttctttgctggcatatttcaagctgcttttggactcttcaggttggggttccttgtggattttctgtctcatgctgctattgttggattcatggggggagcagctataataattggtctacaacagctgaagggactatttgggatcaatcattttacgaacaaaacagacataatctctgtcatgaaatccgtttgggaatcggttgatcatcccgtaagtgttacacttatccatttagttgcatgtcagcattggaatcctcgcaattttgtccttggatgttcattcttcattttcatcctgtttaccagatttctgggtaaaaggaataagaaacttttctggctgccagcaatatcccctcttgtgtcagttatgctatcaactcttattgtttttctgacaagagccgacaaaagtggagttaatattgtgagacatataaaaggaggattgaacccaagctctatcaatcagatagacttgaacagcccccatattggagcattggccaaaattggactagttgttgctgctgttgcactcactgaatcagttgctgttggccgatcttttgcatccatgaaaggataccatctagatggaaacaaggagatggtgtcattagggttcatgaacatcataggatgcttcacctcatgctatgttgcaactggttcgttctcccgcacggtggttaatttcacagcgggttgtgaaacattagcgtcgaacattgtgatggccattgtggtcttgatatcactacaatgtttgacaaagctattgtactttaccccaactgctattctcgcttcaataatcctttctgctctcccgggactcattgacatcaatgaagcttacaaaatatggaaagttgataagcttgattttcttgcttgtgttggagccttcttcggggtgctctttgcgtcagtggaacttggtctgctagtggctgtgggtatatcttttacaaagataatatggatctcaattggagcaggcacagaaactctgggaagacttcccggcacagatgtgttctgcgatgcacaacagtatcctatggctgttaagattcctggggttgcaataatacgcgtcaagtcttcattgctttgcttttctaatgcaaattcagtcagagaaaggatcctgaaatggatatcccgggaagaagccaagggaaacatagaagacaacaccggaagcataattcagctcgtaatccttgacacctctaatttggtgagcattgacacctcaggaattgcttctcttgaggaactgcacaagagtttggtctcaagtgggaagcatctagcaattgccaatcctcgttggcaagtgatttataagctaaaggcgaccaactttgtcacaagaattggaggaagggtcttcttgactattggagaagctattgactgcaagctggatttctga

SEQ ID NO: 201 - DNA, 825 bp, Glycine Max
atgaccggaaaactctcagaggcgatctgcggcatcgacaccctcaccaccctcgtcgtcgctgattggaaagacattgccggggagatccccacctgcgtcaccgcgcttccctccctccgcatcctcgacctcatagggaacaagctctccggcgagatcccggccgacgtggggaaactctcacgtctaaccgtcctgaacctggccgacaacgccctaagcggcaaaattccagcgtccatcacccagctgggctcactcaaacacctggacctcagcaataatcagctctgcggcgagattccggaagacttcgggaatctgggcatgctgagccgcatgttgctgagccggaaccagctaaccggtaaaataccagtttctgtctccaagatttaccggcttgcggacttagacttatccgcaaaccggttatccggttctgtcccgttcgaactcgggacaatgccggttctatccacactgaatttggatagtaactctttagagggcttaattccttcgagtttgttgagtaatgggggtatgggcattttgaaccttagtcgaaacgggtttgaaggctccatacccgatgtgttcgggtcacactcgtatttcatggctttggatttgtctttcaataatttaaagggtcgggtaccctcttcgttggcttcggctaagtttatcgggcatttggatcttagccataaccatttgtgtggatccattcctctcggagcacccttcgatcacctcgaagcgtcgtcgtttactagcaatgattgcttgtgtgggaaccccttgaagacttgctag

SEQ ID NO: 202 - DNA, 621 bp, Glycine Max
atgacctctgctcacgaccttactgataatgaagatgatggacagcagcagtcagaatcacaaattcagtccccttctgcaaatggaatttctgatccagatattagtacccagaatgtcaatgtacagtatgcaacacctggccagcttggaactgggcatgcaatggtaccacctgtgtatccatatccagatccttactatagaagcatctttgctccctatgatacacaaccttatcccccgcaagcctatagtggacagccaatggtccatcttcagttaatgggaattcagcaagctggtgttcctctgccaactgatgcagttgaggagcctgtgtttgtcaatgcaaaacaataccacggtatattaagacgtagacaatcccgtgcaaaagctgaatcagaaaataaagttataaggaataggaagccatacttgcatgaatctcgacacaagcatgcactgagaagaccaagaggatgtggtggtcggtttctgaattcaaagaaagacgagaatcagcatgatgatgtgacatcagctgacaaatcacaatccaatatcaatcttaattctaataaaaatgatcaaacctcatcagataggacatcctaa

SEQ ID NO: 203 - DNA, 621 bp, Glycine Max; identical to SEQ ID NO: 202

SEQ ID NO: 204 - DNA, 1101 bp, Glycine Max
atgacgcagaatgcaatagtgtccaagacaaaatccgggatcaagggggacatagccgtggcacagaagccactggcggcgcctccgccgccggggtacattcccattccgaggaggagggttttgaagaacctcgaaatcaatggaggacaaagaattaatgcatgggttgattccatgagagcctcttctccaaccaattccaaatccacctcttctctcgcagaagaacacagctcttggattcttcgccacccttcagcattagacatgtttgagcaaattatggatgcgtccaggggaaagcaaattgtcatgttcctcgactatgatggtactttgtcgcctattgttgatgacccagaccatgctttcatgtcggattcgatgaggagaacggtgaggaaacttgcaaggtgttttcctactgctatagttaccggcagatgcaaagacaaggtttacagttttgttcgcttggctgagctatattatgctggaagccatggcatggatattcaagggccaacaagagactgcaaatacagcaaagacaaaggagagccagttctttttcaacctgccagtgaatttcttcccatgattgatgaggtgcaccatcaattagttgagaaaatgaaatcaattcctggagccaaggtggagaacaataagttctgctgttctgttcattttcgctgcgttgatgaaaagaaatggagtgaactggcacaagaagtgagatcagtattaaaagagtacccgaagcttcgtcttaaccaaggaaggaaggtattggagattcgtccatctattaaatgggacaaaggaaaggcgctggaatttttgttagagtcactcggatttgccaactgtaacgatgtctttcctgtttacattggagatgataaaaccgatgaagatgcattcaagaaattaagagacagaggacaaggttctgggattcttgtctcgaaatttccaaaggacactagtgcatcatactctttacaagaaccaaacgaggtgatggatttccttcaacgtttggttgagtggaaacaagtatccctccgactcagaacacgttctcgggtgtaa

SEQ ID NO: 205 - DNA, 1101 bp, Glycine Max; identical to SEQ ID NO: 204

SEQ ID NO: 206 - DNA, 399 bp, Glycine Max
atgacgttgaaggtgttagatgccacagtgtcgagctttgatggagtgtttgagaagttccgatcagaggctccaaaaaataaggccaatctcatcctcttcttggctgacaaagatccttctacctctctcagctggtgccctgattgtgtgagagctgaacctgtgatctacaagaagctagaggcttcatctgatgagatttcacttttgagggcttatgttggagatagaccaacatggaggaacccccaacatccatggagggtgcaacctaggttcaagctcactggggtgccaaccttgatccgttgggagaatgacacagtcaaagctcgcttggaggatcatgaagctcacattgaaaacaaaattgaagctcttgttgctgacaagtag

SEQ ID NO: 207 - DNA, 3270 bp, Glycine Max
atgactatatggaactacgtcgtcacggctcacaagcccaccaacgtcacccactcctgcgtcggcaatttcaccagtcctcaagacctcaatctcatcatcgcgaaatgcacgcgcatcgagattcacctgctttctccccaaggcttgcagcctatgttggatgtgccgatatatggaagaattgcaacacttgaactcttccgccctcatggtgaagcgcaggattatctttttattgcaactgaaagatacaaattctgtgttcttcaatgggattccgagactggtgagcttgttacacgggcaatgggggatgtttctgaccggataggacgtcccacagataatggtcagattggcattattgatcctgattgtaggttgattggactccacttgtatgatggtttgtttaaagttattcccttcgacaataaaggacagctcaaggaagcatttaatataaggcttgaggagctccaagttttggatatcaaatttctttatggttgttcaaagccaactattgtggttctttaccaggataataaagatgctcgtcatgttaaaacatatgaggttgcactgaaggataaagattttgttgaaggtccatggtcccagaacaatctcgataatggggctgatttattgataccagttcccccacctctttgtggtgtgcttattattggggaagaaaccatagtgtactgcagtgctaatgctttcaaggctatcccaatcagaccttcaattacaaaagcctatggaagagttgatcctgacggttctcgatatttacttggtgaccatacagggttggttagcctacttgtaataatccatgagaaagaaaaggttacgggactcaaaattgagccccttggggagacttccattgcatctacaatatcataccttgataatgcattcgtctacgttggttcaagttatggagattcacagctaataaaactaaatctacagcctgatgcaaaaggttcttatgtggaagtattggaaaggtatgtcaatttggggcctattgttgacttctgtgtggtagacctcgaaaggcagggccaaggtcaggttgtaacttgctctggagcttacaaggatggttctcttcgtgtcgttcgtaatggaatagggattaatgaacaggcatcggtagaacttcaaggtatcaaaggaatgtggtcactgagatcctcaacagatgatccttttgatacttttctggttgtgagttttataagtgaaacaagaatcttagcaatgaatcttgaggatgagctggaagaaactgagattgagggattctgttctcaagtgcagactttattttgccatgatgcagttcataatcaacttgttcaagttacttcaagctctgtcagactggtcagctccacaactagagatcttcggaatgaatggcatgcaccatcaggctattcagtaaatgtagctacggcaaacgctacccaggttttgttggccacaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactga

SEQ ID NO: 208 - DNA, 288 bp, Glycine Max
atgactattcttccttcactccctcttccttttcttccgttgactgcaacctctccctcggtaccccttccacctgcgtctccgaagacgaagaaaaacgaagccgccacgaatgccattccgtctctaacttctgctgggacttactacaatccaaacacaacaaccctcaatcccattccaagtcctccggaaccaccaacaccaccgaccctctcctcgctcgccgctgcgccaattgtgataccacttctactcctctctggagaaatgcccccgtggccctaa

SEQ ID NO: 209 - DNA, 1479 bp, Glycine Max
atgactgaagaactagaagatggaaacctcatttctaagagtgaagctttcctcacctttgttgtgctttcttcatggaaagacactatcactgttctgaaatcatctgaaaacctatctccatgggctgaaaacctccaaattgtaagaagatgctgtgattccattgcatggaaagcttctaaagatgagctcacaagcgaggatgcagcacctaatcaagaaagctggtggttcaacgatgtggccgccttccgcattgatcattttatgcggatcatttctgcaataagggcaaagggaaccaaaccagagaccattggtaaatgtatcatgcaatatgccaagagatggctgccgggaatggaggtggagttagaagggctaagaggatatgggcatgaaaagtgtaacctacagttcagtatttttagtgggaagaagaaagaaagcagtggaaacagcaaggagcaaagaacaattattgaaagcctaataagcattattcctcctcagcaagatgcagtctcgtgtaagttcatgttgcagttgttaaagatggccatgatgtattctgtatcaccagctctcacaacagaccttgaaaagagagtgagtttggtgttggaagatgctgaggtgagtgatcttctaattccaagatatcaaaatggagatcaaggcaaaacggtcatttgcatgactaattcatctgaagaatgcaccatgctagacatagatgtagtgcaacgaattgtggaatacttcttgatgcatgaacaacagcagattcaacagcaacagaagactaggaaattcaatattagtaggctcttggataattacctagctgaaattgcaagagatccaaatctttcaattaccaagttccaagtttttgctgaattgctaccagaaaatactcgatcatatgatgatggcctatatagagccattgacacctacctcaagacccagccttcactgaccgagcatgaccgtaaaagactctgcaaaatcatgaactgtgaaaaactctcacttgatgcatgcctgcatgctgcacaaaatgagagattgcccctaagaactgttgtccaggttctattttcagagcaagtaaagatgagggcagcaatgcatgagaaagagccagcacaaattggaatccaatctgaacaagaagaaaaccagacatctgcaactatggacattaaggcactcaaagcagaacttgagaatgtaaagtcccaaatggtagaactgcagaatgactattgtgaattacaacaggagtatgaaaagttaagcaacaagccaaagaattcatcaggctggagtttaaattggcggaagattaagaactccttacatacaaaaccagcaggagttgaaattggagacagacaggatgcacccaagtcaccaaacaccattctacgtagactaaaccctagaagaaggctctccatgtcttaa

SEQ ID NO: 210 - DNA, 690 bp, Glycine Max
atgactggaagtggtatattttcgggtaattctgaagataccacatcagaagaaaattctgcaaattcaagaaacagaacaagcatacgcgtatatcagcaagcaatgaatggaatcagtcagatatcattcagcactgaaggaaacatttctccaaaaaaaccaacctccctacctgagatagcaaagcagcgtgaacttagtggaacatatcgaagcgaatcagtcatgaagatcaacaagcaaacatcaagtgccaagaccaaggagctcagcggaagtgatatatttgcccctcctcctgaaattgtgcctcgctcactggctgctgcacacactttggaatcaaaagaaagtgaagacacaagaaaacctgttccacaaaaagtgagcacatctgcacaagtttctaatcgtgctggtggccaaagtaatttctcattcagtgaagaaccagttaagaagatattaagaaaaaaaatacatgaccagaagtttgcagagatgacaggcaataatattttcaagggagacgctcctgcaggatcaccggaaaaaccttcgagcagagctaaacttagagaaatggctggaaatgacatatttgcggacggaaaggcagaaaacagagataatataagaggtgcacgcagacccccaggtggaggaagcagcattgccctcgtttaa

SEQ ID NO: 211 - DNA, 711 bp, Glycine Max
atgacttctgtactacactactcactcctgctgctcctgcttggagtggtgattctcaccactccagtgctagctaatttgaagccacgcttcttctatgagcctcctccaattgagaaaccccccacctatgaacctccaccattttataagcccccatactacccaccaccagtgcaccaccctccaccagagtaccaaccaccccatgaaaaaacaccacctgagtatctacctcctcctcatgagaaaccaccaccagaataccaaccacctcatgagaagccaccaccagaataccaaccacctcatgagaaaccaccaccagaataccaaccacctcatgagaagccaccaccagagcaccaaccacctcatgagaagccaccagagcaccagccacctcatgagaagccaccaccagagtatcaaccacctcatgagaaaccaccaccagaataccaacctcctcaagaaaagccaccacatgaaaaaccaccgccagaataccaacctcctcatgaaaagccaccaccagaacaccaacctccccatgaaaagccaccaccaccacccccagtagtgtatccacctcctcatgagaaaccacccatttatgagccaccgccattggagaagccaccgactaaacctatcataatagaccaattattaattaaatatgatattatgttgccgttgaggggttaa

SEQ ID NO: 212 - DNA, 768 bp, Glycine Max
atgagaaaatgcactgtgcaggcgttgggactcgctattgccttcttccttttactcatcctcctaaccccatccattcctcagcctcagcgataccatgacttcgctgacaagcgcgaattctttggcattcccaatgcacttaacgtgatatcaaatttcctattcatggttattggtctcattggccttgtgctttgccaccgtatgaactattttaacatcagtttgcaaggtgaactatggggttggacatgcttctatgttgctgtgacttcagttgcttttgggtcttcatactatcattttggcccaaatgatgcaggacttgtgtgggacaggttgccgatgtctgttgctttcgcgtctctgttggcaatccttgtcattgaaaggattgatgcaaagaagggaacaatttcaattgtctctctaattatggcgggcataatgagcaatgtgttctttggtgacatccgtttatatgttctggcccaaggtgcatcatgcattgccatacctctcatggctactttattgcctccaatgtacacgcattcagcatattggctctgggcttcaggattttatgttctagctatgctgcaagaggccgccgatagagtgatttatttactgacgtttcacattgtcagtggtcacacacttaagcatttgtctgctgcaatggttcctatcatcctaacagtcatgcttgcaaagagaagtgtttactcggagaagcttttgcatgcaaagtctgcttaa

SEQ ID NO: 213 - DNA, 528 bp, Glycine Max
atgagaaacaaaatgtgccttttcctcttcctgttttttatggaatgctatctggccacggcaaggggaattgtggtgcaacaaaagtcagaagctgcaatcccagtgacaacattgtcaccacctgaaggcaacactacattcattgatggcacaacttggtgtgtggctcttgctggtgtttcccaagctgacttgcagaatgctcttgattgggcttgtggacttggaatggcagattgcacagccatccaacatggtggaccatgttttgaaccagatacactagtttcccatgcatcctttgctttcaacagctactatcagattaatggcaattctgatattgcatgcaattttggaggaactgctgctttgacaaagcataaccccagttatggaaaatgtgtctattctacatctggatctttagttgcttctgccccaccttcactgaggaagcataaccaaaacctggtttggtcgaaacttgctgccttgttactgctttcatacttttggatgtga

SEQ ID NO: 214 - DNA, 1224 bp, Glycine Max
atgagaaagtgcccagaacttcccaacaagtgtacttttcttacagaaaagagagaggctattgaacttcatcctggacaaatgctcacttccgcaaaaatcaagttacaactttttccaattaatgaaggaactcggataggacttgaaaaggatgggcataatccttatttagaactcacacttagaggtcgaaagaaaatatgttcaatactaaaacaccttggaaagaagtggggaagttcaagtatagccaaaggggagcttatgctttttccatataatataatggaaaatctatctggctgcagaaggtggacaattaatgatagtgacacaacagcctctgctgtttatactgctgttggaagccctgcactcttccggttgaagtatggctggttctacatgcttgaacccgggtcttttggtataccttccacaccaactcccgataagcctgatgtagctggaagcggcaatgctaatttagaggagactttatgtggtgagcgggacaaggttaggataagcaaagaatacaaagcaactgaagtgggcaatgcagcaagtgaaactgtgtctcagaaagtagaaaacgcaactgttgatcctatggataatgagccaagaataagtagtagccttcaacagccatcatctccatggattgatagtctaagcaatataagcattgggggcctcctgtctgaagcgtcattatttggcgggcttgatccaaaatcatttgctggcatacagccatgtgatataacttctgattcattggatgcttttattgctgctgctcaaattaataatcgcccagttccaagactgcctgctgatgacttgcgcacatctattttagatgctgaagaaacatgccatgcatttcctcttcgaaagttatcttccccaacagatgtgcaggcagcttgtggcaaggattattctgcagtgcgcagtcaggatgtttcttcaaacttattaaagttttcaaatgcagacaaggtcaatgatcaagatggagcttcacaaaatcctccatccgggaagactcagacagacttgttactttcttcacgcccatatgatgatgatagaagtcttgggttaacaggcatcaattggaatgattctatgggaccttttgatcttggcatgccggctcagaagcttaatggtggagacagtcttagtattggtggatttgttaaataa

SEQ ID NO: 215 - DNA, 309 bp, Glycine Max
atgagaactaaaattgtttctctcctctgtcttctatctcttgctacccttttggctagtggcactgaaagtgcatctccaatcagcctgaagccaagccacaaggcttcatcattcaacagaagcctttttccttccacttttctctttggaataggttcttccgcataccaggtagaaggagcagcaaatgaagatggaagaggaccaagcatatgggacaacttcactaaagagcatcctggttaccctctttctttgactttatttagaatcttttcggataaacttatgcaaaaactcttctaa

SEQ ID NO: 216 - DNA, 225 bp, Glycine Max
atgagaatgcaaattagtcccaaacgacactgtgttgctgttggagcattctttcagtcttcttcttctcctcatatattcaaaggtggagccgttgaagacacttgtggggagggagctagcaatagcaatggcaactcgaaggatgcagcgttcaaaggtggagcggttgaagatgctgttgcagcattctttgagtctctttttcttctcatccagttttaa

SEQ ID NO: 217 - DNA, 333 bp, Glycine Max
atgagatccgacgccttccaaacagctaacatttatcgccttcttctcaaggcagtcaagaaacatattgggaaggaagagaacaagagacattttatagaatttgtaacctcagagttccgtaacaaccgaaatttgtctgactgtgtggctatccaacagaaaataaagcttgctcgtgattatacttttcttcttaacagtgtacaccatcacaaggatttacttttttcatacaatattgccgtggataggtcagatgaagtaaaaaggactcttggaaaatctgcttctagtgttggtcttcagcttcccgaggtttatcagccataa

SEQ ID NO: 218 - DNA, 996 bp, Glycine Max
atgagcaaccaattattctacgcaaaccttgtgctcgccttttacctctcatgtcactatgctcttgctcagactgaaaatttccctttgccactcaaagctgtgaatcttggaaattggttcgttattgaagggtggatgaaaccttctctctttgatggaataaccaacaaagatcttttggatggaactcaagtgcaattcatgtctacaaagttacaaaagtatctctgtgcagaacatggaggaggaagtgttgttgttgccaaccgcaccaaagctttgggttgggaaactttcaggttgtggagggtcaatgaatccaccttcaattttagagtttctagtaagcagtttataagattgacaaatcaaaatggaggaagcaatttagtggctgattcagattcacctagcgacatggaaacattcgagattctgaggagtgatgatgaccctaacatggttcgcattagagcaccaaatggccagtttttacaggccatatctgagaatgtggtgcttgcaaattatgaaggatctagttgggatgatagtgacccttcagtcttcaaaatgaatgttttgagtggaagcattataagaggtgaataccaaattacaaatggatatggcccagataaagcttccaaaatcatgagggatcactggaacacgtatatcactgaagatgatttcaagttcatgtcagaaaatggcttaaatgctgtgagaattcccgtgggatggtggacaaccctagacccaacaccaccaaagccatttgttgggggatccttggaagtgttggataatgccttcacatgggcagaaaagtatggaatcaaggtaattgtggacctgcatgctgctccaggctcacaaaatggaagacctcacagtgcctcaagagatggatatctagaatgggatgattcatacatatctgacactgtggcagccatagactttctagctgaaaggttcaatttgtag

SEQ ID NO: 219 - DNA, 837 bp, Glycine Max
atgagcaaccaattattctacgcaaaccttgtgctcgccttttacctctcatgtcactatgctcttgctcagactgaaaatttccctttgccactcaaagctgtgaatcttggaaattggttcgttattgaagggtggatgaaaccttctctctttgatggaataaccaacaaagatcttttggatggaactcaagtgcaattcatgtctacaaagttacaaaagtatctctgtgcagaacatggaggaggaagtgttgttgttgccaaccgcaccaaagctttgggttgggaaactttcaggttgtggagggtcaatgaatccaccttcaattttagagtttctagtaagcagtttataagattgacaaatcaaaatggaggaagcaatttagtggctgattcagattcacctagcgacatggaaacattcgagattctgaggagtgatgatgaccctaacatggttcgcattagagcaccaaatggccagtttttacaggccatatctgagaatgtggtgcttgcaaattatgaaggatctagttgggatgatagtgacccttcagtcttcaaaatgaatgttttgagtggaagcattataagaggtgaataccaaattacaaatggatatggcccagataaagcttccaaaatcatgagggatcactggaacacgtatatcactgaagatgatttcaagttcatgtcagaaaatggcttaaatgctgtgagaattcccgtgggatggtggacaaccctagacccaacaccaccaaagccatttgttgggggatccttggaagtgttggataatgccttcacatgggcagagtaa

SEQ ID NO: 220 - DNA, 396 bp, Glycine Max
atgagcaggagtttgggaattccggtgaagctgctccacgaggcttcggggcacgtggtgacggtggagctcaagagcggagaactctacagaggaagcatgatcgagtgcgaggacaactggaactgtcaactcgagagcatcacctacactgccaaggatggcaaaacatcgcaacttgagcatgtgtttattcgaggcagcaaagtcaggtttatggtcatccctgacatgctgaagaatgctcctatgtttaagcgtttggatgcaagaatcaagggtaagggtgcatcacttggtgttggtaggggcagagcagttgcaatgcgagcaaaggctcaagctgctgggcgtggagctgcgcctggaaggggtgtaccaccagtgcggaggtga

SEQ ID NO: 221 - DNA, 915 bp, Glycine Max
atgagcattaacgaggatgaatggcaatggtatctcaataggtggtacaacaggcagtgcaccaatgggcaaaagagaaagtacgacatcaccaaaaaaagctatcttggtcagtgccatgatgatgggccagtgcccaccaccagtcctaatgagatcggcaagcctgataaagtggcattgactgcaatgcttgcagggtatgccatgcatgggcaagggaaagaagcaatagagttctttcaaaggactgtattggaaggtatgaagcctgatcatgttacttttgctctgttaagtgcttgtagccactcagggcttgtcaaggaaggaaaggtttatcgtaacatcaatcttgggaaggaagctgcagagaatttgattgcattaaatccttcagaccctagaaactatatcatgctttccaacatatattctgctgcaggtctgtggagtgatgcatcaaaagtgagagctttaatgaagactaaagtttatactagaaatgctagatgcagttttattgcgcatggaaaaaaaatctgttgttttgtggtggatgattattctcaccctgactcagacaaaatacacaagaagctggaagagattatgagaaaaattcaagaggttggttttgtgtctgaaactgaatccattctccatgatgttgatgaagaggtcaaaacagatatgattaacaagcatagtgagaagatagcacttgcatttggacttttggttagtaatgctgatatgccattagttataataaaaaatctccaaataagccaggattgcctcaacactgcaaaatttgtctcgctgatagagaagtgtacaatcactatccgagattcaaagcgatttcaccatttttcagatgcatcatgctcttgtggtgattattggtag

SEQ ID NO: 222 - DNA, 582 bp, Glycine Max
atgagcgacgacgaaaggaagaagcaaatagcggagctgagcaaaagcctcaaagaaggagagaggctcgtgggcccaacgagacggcccgacggaaccctccgcaagcccattcgaatccgcgccggctacacccctcaagacgaagtcgccatttaccaacccaaaggagcactcgagatgggctccgctgggcctcccgggtacgaaccagacgctgattccaagcccaagaccaagtccgttaagaggaacgagagaaagaaggaaaagcgcattcaggctgcgcttgaaaaggaaaagaatgtgagtgaagttgaagatagtggaaagcaggaatctctggaggcattgacctcacaggtaaatcggctcgctgtgcaagattcgccccaagctcaagatattgataaaagaattcgtgctctcaaaaagaagattcgacttacagaagcattggagcagaaaagtgcagagcaagatctgaagccagagcagttggaaaagctagcaaaattagaagattggcgtagggagttaaagttattggaggatgagaagggtgaaacaaccgtatcatga

SEQ ID NO: 223 - DNA, 591 bp, Glycine Max
atgagcgacgacgaaaggaagaagcaaatagcggagctgagcaaaagcctcaaagaaggagagaggctcgtgggcccaacgagacggcccgacggaaccctccgcaagcccattcgaatccgcgccggctacacccctcaagacgaagtcgccatttaccaacccaaaggagcactcttgaaaaaggagatgggctccgctgggcctcccgggtacgaaccagacgctgattccaagcccaagaccaagtccgttaagaggaacgagagaaagaaggaaaagcgcattcaggctgcgcttgaaaaggaaaagaatgtgagtgaagttgaagatagtggaaagcaggaatctctggaggcattgacctcacaggtaaatcggctcgctgtgcaagattcgccccaagctcaagatattgataaaagaattcgtgctctcaaaaagaagattcgacttacagaagcattggagcagaaaagtgcagagcaagatctgaagccagagcagttggaaaagctagcaaaattagaagattggcgtagggagttaaagttattggaggatgagaagggtgaaacaaccgtatcatga

SEQ ID NO: 224 - DNA, 2514 bp, Glycine Max
atgagcggcaaaggcggtggaagccagaaggcagggattcctccggcgagtcggaagatggttcagagcctgagggagatagtgagcaacatccccgaacacgagatctacgccactcttaaagactgtaacatggaccctaacgaagccgttagtcgcctcctctcccaagatccttttcacgaggtgaaaagcaaacgtgagaagaaaaaagagggtaaggacacaacggataccaggtctcgtggaataagcaatgcatctagtcgtggtggcggcggtgctagggttggctctgaccgttatgttgggcgtggagattctggtctcctgcagggaaaacctgtattcaaaaaggaaaacggaacacctgcttatggaggttatactgctcctgcatctagctcattggacaataatgtgaacaggcaactaccatcctacagtgattctgtccgtgtctgtgatggactatcttcatcacaacatggtggattgcaatctccatgggcggcgaacccaggtcaagtatcaatggctgacattgtcaggatgggtaggccacaggccaaggcatccatgcctaactcttctctccacagtggtagccatcagaatgattttgcactcccatcagcttcacaaaacaatttgcattcagtgcaagttcatgcttccaagttgtcagagacaaataatgaccatggctttgctattgactccaatgttgaacagactgatgaatggccatcgattgagcatcaaccagctgtttctgtatccttggttgtagatggtcatccaacgtctgagtaccatacaaactcgtctaactctggtgaagctaatcagcagctgaagacccatgtaaatgaatttgtagctgaagatgatcctgttgagaatcccgacattgttggatctgctaaaagtatatctgaagagaatcccgaaagtacatctgtttttgatggtagcttgtacaaggacataaattcttaccaacctcatcggcatccttttgaaaataatgaagctgaagatggtgtttcatcagtagccacaaacttagagcagctaaatttacactcaaatgatcaggggacagaaccagaggaggaaaattcttctgtagtaattccaaatcatttacaactccattccgccgaatgcttaaatctgagctttggaagttttggatctgcaaatgatgcttccctttctggatctggtccgtatgcatctaggcccttgaaaagtaacttggaggatacatctggagctaacgatgtttcaacaattgggtcctcagatgttagaaatcctgactattatgccgatgagcatcttactactacctcggatgggaatttagctcacataactggtgtggatgctgggacttatgagcattcctccatttcacaatcagaggctttaaaatctgaaccccctgaaactgctcaagaaaatcaatattcatttccttcttcttcacacgagtttacctacgaaaatgcccaacaaccagatgttacataccctcattcgcagacaagctcacagatacagaacctgtctcccttctctagtgtaatgcaggcttatacgaattctttgcccagtgcactgttggcttcaacagttcaaacagcaagggaggatatcccatactcacccttccctgcaacacaatcaatgccttcaaaatatagcaacattgcttcttcaattggtggtccctctataaccatgtcagaggctctaagggcaaataacatttcaacacctcaacctaatccacaagctctgcctggtgccaatgttgccactggacctgcacttcctcaacaccttgctgtgcatccctattcacagcctactcttcctctgggacattttgctaatatgattggctatcaattcttgcctcagagctatacctacatgccatcagcatttcagcaggcttttcctggaaatagcacataccaccaatctctggcagccatgcttccacaatataaaaatagcatttctgtcagtagcttacctcagtctgctgctgttgcatctggatatggttttggaagttccacgagcattcccggaggaaattacccattgaatccacctgctgcgcctactagtacaaccattggatatgatgatgttataaactctcagtacaaggacaacaatcatatgatttcactacagcagaatgagaattctcccatgtgggttcatggacctagctctcgaacaatgtctgccgttcctgccaacacgtattacagcttccagggacagaatcaacaaccaggtgggtttcggcaaaaccagcagccctcacaacaacattttggatcccttggataccctaacttctaccattctcagactgggatttctctggaacatcagcagcagaatccaagggaagcatcccttgctggctctcaaacccaaccacctaagcagtccccacaaatatggcaaaacagctactaa

SEQ ID NO: 225 - DNA, 2511 bp, Glycine Max
atgagcggcaaaggcggtggaagccagaaggcagggattcctccggcgagtcggaagatggttcagagcctgagggagatagtgagcaacatccccgaacacgagatctacgccactcttaaagactgtaacatggaccctaacgaagccgttagtcgcctcctctcccaagatccttttcacgaggtgaaaagcaaacgtgagaagaaaaaagagggtaaggacacaacggataccaggtctcgtggaataagcaatgcatctagtcgtggtggcggcggtgctagggttggctctgaccgttatgttgggcgtggagattctggtctcctgcagggaaaacctgtattcaaaaaggaaaacggaacacctgcttatggaggttatactgctcctgcatctagctcattggacaataatgtgaacaggcaactaccatcctacagtgattctgtccgtgtctgtgatggactatcttcatcacaacatggtggattgcaatctccatgggcggcgaacccaggtcaagtatcaatggctgacattgtcaggatgggtaggccacaggccaaggcatccatgcctaactcttctctccacagtggtagccatcagaatgattttgcactcccatcagcttcacaaaacaatttgcattcagtgcaagttcatgcttccaagttgtcagagacaaataatgaccatggctttgctattgactccaatgttgaacagactgatgaatggccatcgattgagcatcaaccagctgtttctgtatccttggttgtagatggtcatccaacgtctgagtaccatacaaactcgtctaactctggtgaagctaatcagcagctgaagacccatgtaaatgaatttgtagctgaagatgatcctgttgagaatcccgacattgttggatctgctaaaagtatatctgaagagaatcccgaaagtacatctgtttttgatggtagcttgtacaaggacataaattcttaccaacctcatcggcatccttttgaaaataatgaagctgaagatggtgtttcatcagtagccacaaacttagagcagctaaatttacactcaaatgatcaggggacagaaccagaggaggaaaattcttctgtagtaattccaaatcatttacaactccattccgccgaatgcttaaatctgagctttggaagttttggatctgcaaatgatgcttccctttctggatctggtccgtatgcatctaggcccttgaaaagtaacttggaggatacatctggagctaacgatgtttcaacaattgggtcctcagatgttagaaatcctgactattatgccgatgagcatcttactactacctcggatgggaatttagctcacataactggtgtggatgctgggacttatgagcattcctccatttcacaatcagaggctttaaaatctgaaccccctgaaactgctcaagaaaatcaatattcatttccttcttcttcacacgagtttacctacgaaaatgcccaacaaccagatgttacataccctcattcgcagacaagctcacagatacagaacctgtctcccttctctagtgtaatggcttatacgaattctttgcccagtgcactgttggcttcaacagttcaaacagcaagggaggatatcccatactcacccttccctgcaacacaatcaatgccttcaaaatatagcaacattgcttcttcaattggtggtccctctataaccatgtcagaggctctaagggcaaataacatttcaacacctcaacctaatccacaagctctgcctggtgccaatgttgccactggacctgcacttcctcaacaccttgctgtgcatccctattcacagcctactcttcctctgggacattttgctaatatgattggctatcaattcttgcctcagagctatacctacatgccatcagcatttcagcaggcttttcctggaaatagcacataccaccaatctctggcagccatgcttccacaatataaaaatagcatttctgtcagtagcttacctcagtctgctgctgttgcatctggatatggttttggaagttccacgagcattcccggaggaaattacccattgaatccacctgctgcgcctactagtacaaccattggatatgatgatgttataaactctcagtacaaggacaacaatcatatgatttcactacagcagaatgagaattctcccatgtgggttcatggacctagctctcgaacaatgtctgccgttcctgccaacacgtattacagcttccagggacagaatcaacaaccaggtgggtttcggcaaaaccagcagccctcacaacaacattttggatcccttggataccctaacttctaccattctcagactgggatttctctggaacatcagcagcagaatccaagggaagcatcccttgctggctctcaaacccaaccacctaagcagtccccacaaatatggcaaaacagctactaa

SEQ ID NO: 226 - DNA, 900 bp, Glycine Max
atgagcgtggaagatcttcctgggaaagaggtaaacgtgctgaagggtcacgagggtggcgtgttagccgcgaggttcaacggcgatggcaattatgttctgagttgcggcaaagaccgtaccatacgcctttggaatcctcaccgtggcatccatatcaagacctataaatcccacgctcgcgaagtccgcgatgtccacgtcacacaggacaactccaagctatgttcctgtggtggagatcgacaaatattttattgggacgttgcaactggacgtgtaattaggaaatttcgtggccatgatggtgaggtaaatggtgtcaaattcaatgagtattcatctgttgtagtctctgctggctatgatcaatcattgcgtgcttgggactgcagatcccacagcacagagccaattcagattattgacacatttgcggatagtgtgatgtctgtttgtttaacaaaaactgaaattattggaggaagtgttgatggaactgttcgaacatttgacattcgtattggcagagaaacatctgataatttagggcaacctgtcaactgtgtatcaatgtcaaatgatggtaactgcattctagccggttgcttagactctacattgcgtcttttggacaggtcgacaggtgaactgttacaagaatataaaggacacactaataagtcttacaaattggattgctgccttaccaatacggatgctcatgtaactggtgtctctgaggatggcttcatttatttctgggatcttgtagatgcatctgttgtttcaagattcaaggctcatacctcagtggtaacaagtgttagttatcatccaaaggaaaactgcatggtaacttcttctgtggatggcaccattagagtatggaagacataa

SEQ ID NO: 227 - DNA, 3081 bp, Glycine Max
atgaggaagaaagtggacgagcgaatcagaactttaattgaaaatggcgtcagaacaaggcataggtccatgttcatcatcgttggcgacaagtctcgagaccagattgtaaatcttcattacatgcttagcaaggcacagattaagtccaggccaactgtgttatggtgttacaaggacaagcttgaactaagcagtcacaagaaaaagcgtagcaagcagattaaaaaattggtgcagaggggtctctacgatccagagaaaggtgattcgtttgacttgtttctggcaggtgggggattcacttactgtttatacaaggaatcagaaaaagttcttggcaatacctttggcatgtgtgtgcttcaggattttgaggcattgacacctaatctcctagcaagaacaatagagacagtggagggaggagggctgattgttttgctgcttcggtctctatcctcgctgaccagtctgtgcaccatggtgatggatgtccatgatagatttcgaactgaatcccacaatgaggctgctgggcgctttaatgaacggttcttattatcacttgcttcttgcaaggcatgtgtggtaatggatgatgaactgaatatattaccaatttcatctcacataaggtctattaccccagttcctgttaaagaggactctgacgaactctcagaagcagaacaggacctgaagaaccttaaagaacaactaaatgaagatttccctgtagggccattgattaagaagtgttgcacattggaccagggaaaagctgttgtgacatttctggatgtaattttggacaagacacttcgtagtactgttgctttattggctgctcgtggtcgtgggaaatcagctgctcttggtttatcagttgctggagccatagctgttgggtattcaaatatctttgtgactgcacccagccctgagaatttgaaaaccttgtttgactttatatgcaagggttttgatgctcttaactacaaggaacatattgattatgatgtggtgaaaagtgcgaatcccgagttcaagaaaggtactgtaaggatcaatatttacaagcaccacagacagacaattcagtatatactgccacatgagcatgaaaagctttcacaagttgaactgttggttgttgatgaagcagctgctattccactgccagtggtgaagtctttgctgggtccatatctggtcttcctgtcttctactgttaatggttatgaaggtactggacgctctttatcactaaaacttgtgcagcagttggaagagcaaagccatgtgtctactaagagcacaaaggacactggtcgcctgtttaagaaaatagaattgagtgaatccatcagatatgcttctggggatcccattgaaagctggcttaactctctactttgcttagatgcttcaaacaccatccctaatattagcaggttacctccacctagcgagtgcgatttatactatgttaatcgggatacgctcttctcctatcacagagatagtgaattatttttgcagcgaatgatggccttatatgttgcatctcattacaagaattctccaaatgatttgcaactgatggcggatgctccagcacaccacttatttgtactacttggacctgttgatgaatcaaagaatcaacttcctgatattttgtgtgtcatccaggtttcccttgaggggcagatttctcgtaagtcagcaatccaaagtttgaccgatggtcatcaaccttttggagatcaaattccatggaaattctgcgagcaattccgagatacagttttcccctcgctttcaggtgctcgtattgtacgcatagcgacacacccaagtgccatgaggcttggatatggttcacaagcagttgaacttttaatacgctactatgaaggacaacttattcctatttccgagattgatgttgaagataaagtgcaggctccacgagttagagtcacagaagctgcaaagcaagtttcactacttgaagaaaatataaaacctcgaacagatcttcctcatttgctagtacatctgcgtgaaaggcagccagaaaagctccattacattggtgtctcctttgggctaactttggacctttttcgcttttggaggaaacataaatttgctcctttctacattggccagattccaaatgctgtgactggtgagcatacatgcatgatcctgaaacccctaaacaatgatgaaattgaagctgatggatcaaatcaactgggcttttttagtccattttaccaagattttagacaaagatttgctaaacttcttgcttccacttttcgtgtcatggaatacaagcttgctttgagcataatagatcccaaaatcaatttcaagaaccaagaccctacggaggccacatctgataaatgtctgcagtcagtcaaagattatttatcaccacatgatatgaagcgattagaggcgtatgttgacaacctggctgactttcatctgattttagatttggttccaacccttacacatctgtacttccaagaaaagctcccagttacgttgtcgtatgctcaagcttctgtgttactctgcattggtctgcagaatcagaacatttcatacattgagggacaaacgaatttggaaaggcaaacgatattgtctctatttataaaggttatgaagaagttctacaaatatctagatggccttgcatccaaggagattgaatcaaccttgccaagactgaaagaaattgtcatggaacctcatagtgtctctttggacgaagatctcaataatgcagctaaacaagttgaggatgacatgaaatcaaaagcagaagcaacctttactcccgaattgctccagcagtttgccattgaaggagaatctggctttgagactgttttacaaaataatggtggaaaaatacccataggtggtcttattagcgtgaaatccagcaaagtgaagcatgaaaaggagaagggaagtcataagagtgacaaaaagcggagtaaagataaccacaaccataaatcaagcaaaaggaaaagatcttga

SEQ ID NO: 228 - DNA, 729 bp, Glycine Max
atgaggagaggagctaagagaaagacgaagcaggaccaagaagccaaacacgtcgcagccgaagataacaagaccgaagctcagcctcgagctaaacgggccaaaacctccaagcctcaatccgaacctgagtacttcgaagataagcgcaacttggaagatttgtggaaggaaacattccccgttggaactgagtgggaccaattggatactgtctatcaatacaagtgggatttctcgaatctagaaaatgcgtttgaagaggatggcgtgttgtatgggaaaaaggtttatctctttggttgcactgagcctcagctggtcatgtttaaaggggaaagcaaagttgtcttgatacctgctgtagtagctgttgtatcacctttcccaccatctgataaaattgggataaactcagttcaaagagaggctgaagagatagttccgatgaagcaaatgaaaatggactgggttccatatattcccttggagggcagagatagccaagttgatagactaaaatcccaaatatttatcttgagttgtacccaaagaaggtctgctttaaaacatctgaagttggatagattaaagaaatatgagtactgcttgccttatttctatcagccgtttaaggaagatgaacttgaacagagcactgaagttcaaattatatatccagctgagccaaagccggtaattacattgatagaaattttttcctggtga

SEQ ID NO: 229 - DNA, 1023 bp, Glycine Max
atgaggagaggagctaagagaaagacgaagcaggaccaagaagccaaacacgtcgcagccgaagataacaagaccgaagctcagcctcgagctaaacgggccaaaacctccaagcctcaatccgaacctgagtacttcgaagataagcgcaacttggaagatttgtggaaggaaacattccccgttggaactgagtgggaccaattggatactgtctatcaatacaagtgggatttctcgaatctagaaaatgcgtttgaagaggatggcgtgttgtatgggaaaaaggtttatctctttggttgcactgagcctcagctggtcatgtttaaaggggaaagcaaagttgtcttgatacctgctgtagtagctgttgtatcacctttcccaccatctgataaaattgggataaactcagttcaaagagaggctgaagagatagttccgatgaagcaaatgaaaatggactgggttccatatattcccttggagggcagagatagccaagttgatagactaaaatcccaaatatttatcttgagttgtacccaaagaaggtctgctttaaaacatctgaagttggatagattaaagaaatatgagtactgcttgccttatttctatcagccgtttaaggaagatgaacttgaacagagcactgaagttcaaattatatatccagctgagccaaagccggtcttttgtgaatttgattgggaattagatgaacttgaggagtttactgataagctcacagaggaggaggagttatccgaagatcaaaaggatgccttcaaggaatttgtcaagggaaaggttcgtgaagctaagaaagctaatagagaggcaagggaagctcggaaaaaagccattgaagaaatgagtgaggaaaccaaagctgcgtttgagagtatgagattttataagttctaccctgttcaatctccagatgcacctgatgtatcaaatgttaagtctccattcattaacaggtattacggaaaggctcatgaggttctgtga

SEQ ID NO: 230 - DNA, 186 bp, Glycine Max
atgaggtgtatccgcacgccaagtcagacactgcagcttgcacaaaggaaccacctattgaagaagaaaaagcctcaagggaaagataagtgtaaaagtcgtgtgtgctggctgggtaagcatagcgtgtccaagagtgtcattttcgtaaatgaactcacaaatcaatacaaaagtcttgattaa

SEQ ID NO: 231 - DNA, 957 bp, Glycine Max
atgagtagttcttcatgcacaaactcctctgtcaatggcttctacaacttcctcactcaaggactcaatgagcttcaccaatccttcctctcccatgacttcatgtcaatccaattcatttcagaggtcttctcatccctccaatccttccattcccagttaaccattttggtccaaaggctttgcttgtcagttggaggaaaatggctgaatgaatacatggatgaaagctcaaggctttgggatatctgccatgtactcaaatctgccatttctggaatagagaactattcttcaactggctccaatatagcttcctcagttgatggctaccataatttgactccagagctttcacatcaggttattagggccataaatatttgtcaaagggagagtctaggattggtagaggaaaacaaaagcttgatggaaacaagaacgcaggcattgtctcaatgtctaaaccaaaacatgtgtatggaatcaaagttaaacgagttcaacggcttccgaggtgttctttgtgcaatgaggagtgttagctcattgcttctaatgattttgctgtgtggggttgcatattgttggtcttcctcatgctttgaccaacaagggtatgaaggacacatggtttttggatcaggttttgttgtttctatggcaagattgcagcagaaagttgcacaggagattgaccagaataatggccagcaagggattctgcttcttgaattccaacaagcaaagatttccatggaggaattgaaagtggagttagagagaatggtgggttatgatgcacaacatgagatccaagcaaaagttgacaacttgaaacgttgctttggattgttgagatgtggggttgagactataacagggcaacttgatgatttctttgatgaaattgtggaaggaaggaagaagttgttgaatatgtgtagtcataagtag

SEQ ID NO: 232 - DNA, 483 bp, Glycine Max
atgagtgaacttctttttgatgacattttcaaggtcgagaaggtagaccctgatggtaaaaagtatgacaaggtttctcggattgtggcacggagtgagaagtgtgacatgaacatgcttctagatgtaaataccgagatttatccaatgggggaaaaagaaagattcttgatggctttgtctccttcacttgttttgaatactaaggatggttcagtgtcaattcaagacaagtttgaatacatcatgcacgggaggttatataacattacgaaacctcagcttgaaaagaaagaaaagaaagagaaacgttcagaatctcagcctgaagagaatgaggaatgttcaaaacctcagcttgaagtggaggtatatgcatcgtttggtgggcttcagttgatgctgaaaggacatgcttcccactgtgttaagtttgcagtcgatcagaagttgtttttacttataaggaaggttgaaagttga

SEQ ID NO: 233 - DNA, 1353 bp, Glycine Max
atgagtgttatgtatagtcctgttctcaattactcagatgtggagcatcagctaaggaaaaaccaagacatggattcaagtattggacatccacaacaacactgtcaccaacccaattctggactattgaggtattgttctgctccaagctcattgctggcaagcctcattgacaacaccattcatggctgtgtcaacgaggaatcgttcacaagtgagaatcatcatcatcagcagcagcagcagcagcagcattatcttccatctacaagttcagaaatggagaccatgttatccaaattgctaccatccaacaatggatggagcaattcagaagctttgcaagaatttggaggcaagcctgtgaagcaggaaataggggaatctattccacaagagccaccacaacagaatggttattcttatggtggctctcagttgatttaccaatctcagcaaattcaaggcttgccaaatggtggatcttccagtgcttctggcagtgcttttgatggctcttttggtgtggtgcactccatggcttcagaggactccattcaatctaaaatgggtatcaggaattgctccaatctctttaggcaaaagagttcccctgctgcatttttctccattgaaaatgatcttgcagcattgagagaagtaggaagctttaaagccgatgatgtttcaaatggactagttactgcatcaactggtgggttgcatagttctcatactttctcatctaggccatcttcatgcttgaaacggttgccacaaatagccgaaaatggaaatgaaagcctagaagaaaattgtgaccaaagtagaaacctagtaaatgacaatggtagctcaaaatgttacatacctagcttcaccaatgaattatgggaaagttctgcattcaatgccccaaaaacagagaatgaagatgaaatcatgttttccacttcaaatattttggaatctcaggaagcagatttcagctttcaaaatctgggtttgactcaccatttgagtctacctagctcttctactaagatgtcatccatagaaaagtttcttcagattcaaggttctgttccttgtaaaattcgagccaaaagaggctttgccactcacccaagaagtattgcagagagggtaagaagaacaagaattagtgaaagaatcaagaaactgcaagacctttttccaaaatcagaaaagcaaacaagcacagcagatatgttagatttggcagttgagtatattaaggacctgcagcaaaaagttaagatactctcagattgtaaggcaaagtgcaaatgtacaagtaatgagaagcattacactagaacttgtgcttga

SEQ ID NO: 234 - DNA, 1758 bp, Glycine Max
atgagttctattgaaggtgctacacagcttctggaagaggctctccttcaggatgatgaagagagtaaacagtacacaagagatggctcagttgactacagaggcaggcccgctattaagaaggatactggcaattggagggcttgtccttttatcctaggcaatgagtgttgtgaacgtttggccttctttggaattgcaacaaatcttgttacctatcttaccaccaagctgcatgaaggaaacgtttctgccgcaagaaacgttagcatctggcttggcacttcttatctcacacctctcattggagctgttctaggagatggttactggggtcgatactggacaattgctgttttctctgtggtttatttcattgggatgtgtaccctgacactttctgcatctttaccagcattgaagcctgctgaatgcttgggttctgtatgcccttcagctactcctgcacaatatgctgtgttctactttggtctatacgtgattgcacttgggatcggtggtataaagtcatgtgtgccatcttttggggcaggtcaatttgatgatactgatccaaaggaaagggttaagaaggggtcgtttttcaattggtattacttttctatcaatctaggtgccattgtatcgagcagcatagttgtgtggattcaagacaatgcaggatggggtcttggatttggcattcctactttgttcatggtattatctgtgataagcttctttataggcacacctctctacaggtttcaaaaaccagggggaagtcctgttacaagaatgtgccaggttttgtgcgcgtctgtccggaagtggaatttggttgtccctgaggatagtagtcttttgtatgagatgtcagacaagagatctgcaattaaagggagtcgcaaactgctgcatagtgatgatctaaggtgtcttgatagagcagctacagtgtccgattatgagagtaaaagtggtgactattctaatccatggagactttgccccgtaacacaggtggaagaattgaagatcttgatccgcatgtttccaatgtgggctactggggctgttttttctgctgtttatacccaaatgtcaacattgtttgtggagcaaggaacagtgatgaacacaaacattggttcctttgaaatacccccagcttccctcgcaacttttgatgtcctaagtgtggttttgtgggctcctgtctatgacaggataattgttcccattacaaggaaattcaccggcaatgaaaggggaatttcagtgttgcaaagagtaagcattggctacttcatttcagtcctgtccatgttagcagctgttgttgtggagattatgcgtctgcggcttgcaagagaccttgatcttgttgatgaacctgttgctgtaccactcagtatactttggcaaatccctcagtacttcttattgggggcagcagaagtattcgcattcgtgggactgcttgagttcttctatgatcaatctccagatactatgaagactttaggtacagcactgtcacctttgtattttgcgttgggaaattacttgagctctttcattcttactatggtgacttacttcaccacacaaggtggaaagcttggctggattcctgataatttgaacaagggtcatctcgattattttttcttgcttttagctggacttagcttcttaaatatgttggtatacattgttgctgccaaaaggtacaagcagacgaagacttcttaa

SEQ ID NO: 235 - DNA, 153 bp, Glycine Max
atgataaatgttgtcggcatccatggagaaataaagaaggaagaagaagccatacaagagcacaaaggtcactgtcacaacccctttatcagagaatgtactcgaaaaatgaataatgaaaagttgcagaaaaagtacaaagaaattccttaa

SEQ ID NO: 236 - DNA, 219 bp, Glycine Max
atgatacacaacaataatttgggtcccaccataatattctctatattgtataatttagtgtatcctcttctttctttggtggaaaatatttgcatatttttcaactacattattcttcactactttctttccatattgtgttcattaatatatggtacagctacagctgctaacaaagtagaaaaccacggatctatgtcccttacttgttcaacataa

SEQ ID NO: 237 - DNA, 255 bp, Glycine Max
atgatcatatttgaaaccacagatctgcaagtgctctgttatggttccgttagggatgtatttggtggagaacgcgaggctgaccgaatcgaacctatcgctgtgtttttgcttgtgatggtaaggcttgcgatggttctgcttgatgaggttgcgacggttgttttcctcgtcggaggagtccttgttggccacgatgatgaccgagttgcggtgagtggggaatataaatcatcgactcattttggagggtag

SEQ ID NO: 238 - DNA, 891 bp, Glycine Max
atgatgaagaacgatagagaaaagggtaacgaggttgaccagagttacatacagcagcaccactcgttgtcaatgccaatgatgttttcgggttttaacagagagaaggagatgtcagccatgatcactgctttgacacgtgtggtttgtggagattattctcttgttcatcacaatattgataatactaatagtgcaattgttggtggtggtggtggtgatgatgtttcaaatatggcttctggttctatgccaccttcgtctacttctttatctcatggtggcaactctgttctcaagagaagaagggaagatgataatacaagtgatttcttacgtggaggttcattccctgctattttaacaactgcggaaggttcaagcacgataagaagaagaagagcgaatacggtatacgattacgaatacagaagagagaaggtgaaagtggaggaggaagaagaagcgaggaggaaatacagaggagtgagacagaggccgtgggggaaatgggctgcggaaataagagaccctttgaaagccagaagggtgtggttaggaacatttgaaaccgctgaggacgcagccagagcgtacgatcaagcttccttgcgtttcagaggcaacaaagccaaactcaacttccctgaaaacgttaggctcagacacactgagactcttcagggttcacgtgcttcaagcaatttttatgacaactcttattcgcatgttcatgatttacccgtgagcctctacgatcagactaccatggcttcttcatcaactatatctatgacttctccccaggcaccaccttcgatttatcctacgcatctactaccggcatggtcttctggttatgcttataatagctcctcttcttctgcctga

SEQ ID NO: 239 - DNA, 1908 bp, Glycine Max
atgatgaagtgtttctcggtgtccttagcctctttatgggttctccttgctctcttttctctgagtgtgtcatctcaaaatatatctgagagtgggctacagcaagctagcctcccaccaagaggttggaattcctatgattccttttgctggacaatttctgaagacgaatttttacaaagtgctgaaatggtttctcaacgtctcaaggctcacggatatcagtttgtcgtggtggattacctctggtataggaagaaagtcaagggtgcttaccctgattctcttggatttgacgtgatcgatgaatggggaaggatgatccctgacccaggaaggtggccttcttccataggtgggaagggattcagtgaagtagctaataaagtacatagtttaggtttgaagtttgggattcacgttatgagagggataagcacgcaagctgtcaatgcaaacacccctatcctagatataacaaagggaggtgcttatcaagaatctggtcgagtgtggcatgcaaaagacatagcaatgccagaaagggcttgtgcatggatgcctcacggtttcatgagtgtaaatacgaagttgggagctgggagagcttttttgaaatccctttatgagcagtatgctgcatggggtgttgatctcgtgaaacatgactgtgtgtttggagatgacttggatttaaatgaaataagctatgtgtcggaggttctcagtgtgcttaatcgccctattgtgtattctctgtctcctggaaccagtgtgacaccagccatggccaaggatgtcagtggactagtcaacatgtatcgaataacaggagatgactgggataaatgggaggacgtcaaggctcattttgatgtaacaagggatttttctacagctaatatgataggagggaaaggtttgaagggaaattcctggcctgatttggacatgctaccatttggatggctaactgatccaggatcaaatgaaggtccacacagatttagtaaactcactctagaagaaaaaaggacacagatgactttgtggtctttggcaaagtctccccttatgtatgggggggatgtgcggaggatcgatccaaccacatacgaacttatcacaaatcctaccctgctagagattaattactttagctcaaacaatatggagtttccttacatcacaagctcaattaacttgaagcaccctggagggaaagaaagaagacttaagaaaggaatacattcattgggtttgactagctgcagtgaatcaaaggcgaggggttggtctattgaaagtcttaaccaagatcttgaaagaatctgttggaaaaagggtttagaaaacaagcatcaggcccctttctgcgtacacaaaagagaacttcaattcagattagacggggtgagtatgtatcaagaggactatcgagggaaacatcaattagttgcaactgacagaatgaaattttgcttggacgcttctccaagacgaaaggttacttctaaagagttcaagagaggtacattttctccatgcagatgggattcaaatcagatctgggaactgaactccaatgggaccatggtaaatagttactccggtctttgtgcaactgtagagtatattgaagctaatgttaattctggtgggattcgctcttggatcgcaacaggaagaacaggggaaatctatcttgctttcttcaatctaagcgaacagaagacggagatatatgcaaagacatcatatctggctaaggttcttcctgacaaaagcatcacttcatgcaagggcgaggaagtgtggagtggaacagatgtaataacaacgcaagggacgatatcaatgaacgtggaaattcatggatgtgcactatttgttctaaattgcaactag

SEQ ID NO: 240 - DNA, 903 bp, Glycine Max
atgatgatcatgcaagaaacacaatctcttattattcccaccacaattctaatactagcactattctacaccacttcagcccaactctcacccattcaaccccccacaacatcaccctcaccaccactatcccaaccctccccgccatctccggcacttccctcgccgccggcgaccgcgccggcgccaggattcaacactgtccctcttgtcccaggccccaccattgacatagtccaaatcctaagaaaagccaaaaggttctccgtcctcattcgcctcttaaaaaccacacaactcatcaaccaacttaactcacagctcgtaacttcaagctcaggagggttaaccctctttgcacccgaagacagtgccttctccaaactcaaagcagggttcctcaactctctcactgatagacagaaggtggagctcttacagttccacactctctcttcctgcatttcaatctcaaactttgataccctcacgaacccggttcaaacgcaggccggtgatgaccctcagaggctgcaactaaacgtcaccacttacagcggtagccaggtcagcatggccacgggcgccgtcaacgcctccgtcaccggaaccgtttactccgacaacaagttggccatataccaggtggacaaggtgcttctccctcttgacctagtgctgccaagcaaggcgccggctccggcaccggcgttagcgaaaaaggggttgccgaaggctgataaagggaattccacggcggcggacgatggagctaccggcggtgatgatgacagcgacgggaaggccttgcaggcgggtgtttctgctggttgttcgatgaagtgggtgaataatgttgttgttattggggtagtgggtttggttggtggagttttgatgtaa

SEQ ID NO: 241 - DNA, 1668 bp, Glycine Max
atgatggcttcttcctctctcttctacctttctctctccctcatcctaaccctcacctccgccgcgcgccacaaaccccacccctcaccggccaagccaccagccaagcccgccgtgaccaccgccacctcgccggcaattcaacaagcctgcgccgcgacgcgcttcccgcagcaatgcgaagcctctctctcccaatcccagaacctccctccgaacccgaacccgacccctctccagctcctccagtccgccatcgcgctctcctccgacaacctcgccaccgcacagacgatggtcaagtcactccacgacgcctccgccgacagccgcaaccgcaccgtcgccgccgccacctgcatcgagatattagccaactcccattaccgcatttccctcgccagcgacgcgctcccacgaggcaggaccaaggacgcgcgtgcttggctcggcgccgccctcgcctaccagtacgactgctggaacagcctcaaatatgccaacgacaccgaaatggtcggcaaaaccatgttgttcatcgataacctcgaaactctctccagcaacgcactcagcatggcgttttccttcgacgccttcggaaacgacaccgcttcgtggaagcccccagtaacggagcgcgacgggttctgggaggctgtgggctcgggtggccccgcgtccgcgggaggggtaccgccgaatttgacgcccgacgttacggtgtgtaacaatggaggagacgggtgttataagacggtgcaggaggccgtaaacgccgcgccagcgaacggaacaaagaggtttgtgatatacataaaagaaggggtttacgaggagaccgttaggattccattagaaaagaggaatgtggtgttcttgggcgacggcattggcaaaaccgtcatcaccggtaacggcaacgtgggacaacaagggatgacaacttacaactctgccactgtcgcggttcttggcgatggattcatggcaaaggaactgacggtcgaaaacacagcaggtcctgatgctcaccaagcagtggcattcagattagacagtgatctttctgtgattgagaattgcgaattcttgggcaatcaagacactctctatgctcactcactgcgccagttttacaagtcatgccgcattgagggcagcgtggacttcatctttggaaacgctgcagcagttttccaagactgccaaatcctagttcgtcccaggcaagtgaagccagagaagggtgagaacaatgccatcacagcacacggcagaacagaccctgcagaacccacaggctttgttttccaaaactgtttgattaatggcactgaggaatatatagcattgtacctcagcaagcctcaagtgcacaagaactatttgggtaggccttggaaggagtattctagaacggttttcattaattcgatcttggaggctcttgtcacaccacagggttggatgccatggagcggtgactttgctctcaagacactttactatggggagtttgagaacaagggtactggctctgatttgtctcagagggtgccatggagtagcaagatccctgctgaacacgtattgacgtattcggtgcagaatttcattcaaggaaatgattggattccatcatctgttggtagcccatcctcgtaa

SEQ ID NO: 242 - DNA, 681 bp, Glycine Max
atgatgggaagtaagaatgatgtgaaactattgagttttttgttgagtccagttggtcacagagttgaatgggctctgaagctaaagggtgttgaattcgagtatgtagaagaagatatcttcaacaaaagcaatctccttctggaactgaacccggttcacaaaaaggttccggttcttgttcatcaccagaaaccaatcgctgagtcactcatcatcgttgaatacatcgaccaaacatggaagcagcatccactgttgcctcaacatccttatcaacgagctcttgctcggttttggggtaccgttgctgataagcttgtgaagacatcatatgttgcaatgtgtagcagtggcgatgaacaagaaaagagtgtgaaggaagccaaagaagtaatggataaaatagaagaagagattattaaggggaagaaattctttggaggggacaatattgggtaccttgaccttgcatttggatggatcccttactggcttcccatttgggaggaagttgggtcaatgcaaatagttgacccattgaaacattgtgccatctctgcatggaacaccaattttctcagccaccctatcatcaaggattgcttgcccccaagagacaagatgctcgtttattcccaccgtcgcaaaaatgagttttcttctactcttcgtcgttga

SEQ ID NO: 243 - DNA, 117 bp, Glycine Max
atgatttataatcttccaagggatacgtcatacctatcagcccacaagaagaaacaatggtctacgcagacagtgatttctgagtcattgctatttcattcaaccactaggctctaa

SEQ ID NO: 244 - DNA, 1482 bp, Glycine Max
atgatttggatagcactttttttagtttcactggcttttctgcggttatggagaagcaataagaatgcaaagaaattaccacctggtccaaaagggttgccaattttgggaagccttcacaagttgggaccaaatcctcatcgtgacctgcacaaactagcccaaaaatatggacctgtcatgcacttacgtttaggttttgtgccgaccatagttgtttcttcacccaaatctgctgaattgttcctcaagacccatgaccttgtctttgctagtagaccacgtttcgtggcggatcaatacatctcttgggggcagaggaacttaggctttgctgaatatggttcttattggcgcaacatgcgcaagatgtgcacattggaattgctaagccaatccaaaattaactccttcagacgcatgagggaagaggagcttgaccttttgatcaagcttgtaagagaggcagccaatgatggagctgctgttgatctcagtgtcaaggttgcaacactcattgcagacatgtcttgtagaatgattttaggaaagaagtacatggaccaggacatgtgtgggagagggttcaaggctgtgattcaagaagcaatgcgtttattagcaactcctaacgtaggagattacattccttacattggtgcaattgaccttcaaggcctaacgaagcgcttcaaggtactttacgaaatcttcgatgacttcttcgagaaagttattgatgagcacatggaatcagagaagggagaagacaagaccaaggattttgtggatgtcatgttgggctttttaggtactgaagaatctgaataccgcattgaacggtccaatatcaaagctatattgctggatatgttggctggttcaatggatacttcagctacagcaattgagtggacactttcagagctactaaaaaatccaagggtgatgaagaaactccaaatggaattggaaactgtggtgggtatgaagaggaaggtgggggaatcggacctggacaagttgaagtatttggagatggttgtaaaggaaagcatgaggctccatccagtggtaccattgctaataccacaccaatccacggaagattgcatagtcggagattttttcatacccaaaaaatcaagggtcataataaatgcatgggcaattatgagagacccaagtgcatgggttgaggcagagaagttctggccagagagatttgaaggaagcaacatagatgtgagagggcgtgacttcgagctgataccatttgggtctggcagaagggcctgtccaggattgcaattgggcctaataacggttcgtcaaacagtggcccaacttgtgcattgctttgattggaagctgcccaataacatgtttccagatgatttggacatgacagaggcgttcggcctcacaatgcccagggccaatcatctgcatgccattcctacgtatcggctttccaattaa

SEQ ID NO: 245 - DNA, 1497 bp, Glycine Max
atgatttggatagcagcttttttagtttctcttgcttttctgtggttatggataagcaacaagaatgcaaagaaattaccacctggtcccatagggttgccaattttgggaagccttcacaagttgggtgcaaatcctcatcgtggcctgcaccaactagcccaaaaatatggacctatcatgcacttacgcttaggttttgtgcccaccatagttatttcttccccccaagctgctgaactgttcctcaagacccatgaccttgtctttgctagtagaccaccccatgaagctataaagtacattgcttgggagcagaggaacttgggatttgctgaatatggttcttactggcgcaacatgcgcaagatgtgcacattggaattgcttagccaaaccaaaattaactccttcagaatcgtgagagaagaagaacttgacctatccatcaagcttctaagagaggcatccaatgatggagctgctgctgttgatatcagtgccaaggttgcaagaatcagtgcagacgtggcttgtagaatggtcttgggaaagaagtacatggaccaggacttggatgagaaggggtttaaggctgtggtgcaagaggtaatgcacttactagcaactcctaacataggtgattacattccttacattggtaaacttgaccttcaagggctaatcaagcgtatgaaggcggttcgcaaaatctttgatgaattctttgacaaaattattgatgagcatattcaatcagacaagggacaagacaataaggtgaaggattttgtggatgtcatgttgggctttgttggtagcgaggaatatgaataccgtattgaacggcccaatatcaaagctatattgctggatatgctgttgggttcaatggatacttcggctacagtaattgagtggacactttcagagctcctaaagaatccacgggtgatgaagaaagtccaaatggagttggaaactgtggtgggtatgcagaggaaggtgaaggaatcagacttggacaagttggagtatttggatatggttataaaggaaaacatgaggctccatccagtggcaccgttactaataccacaccaatcgagggaagattgcatggttggagattttttcataccaagaaaatcaagagtggtaataaatgcatgggcaattatgagagactcaagtgtatggagtgaggcagagaagttctggccagagagatttgaaggaagcaacatagatgtgagagggcatgacttccagtttataccattcgggtctggcagaagggcctgtccaggaatgcaaatgggtctaacaatggttcgactaacagtggcacaacttgtgcattgttttcattggaaactgccgagtgacatgttgccagatcacttggacatgacagaagagttcggcctcactatgccaagggccaatcatctacttgccgttccaacttatcggcttcacactgcaagtgattag

SEQ ID NO: 246 - DNA, 180 bp, Glycine Max
atgcaacacaccatattgggaaggttgcaggatagcaatgcggtgttgtcgcatttcaacgacttctctcagcactgctttgctgagatttccggcgacatcgctagaaacacgcgtgttttgaggtctgtcaagtccgaccttgattatatctttcagaagctcagaagtatgaaataa

SEQ ID NO: 247 - DNA, 704 bp, Glycine Max
atgcaacattattgtgttgttgggcgttcccaagtaccttgcctttttatttttggagactctttatctgattgtggaaacaacaacaatctacctacagatgccaaagttaatcacttgccttatgggattgattttccacatgactccactcactattcgaaaattcgtacttcagttgatataataattttctgggttatagatgcgaaagatgtacctctgagcttttgggattcgaagattttatcccaccctttgcaaatatcaatggttcagacatactcaaaaggggtgaattatgcatccggttcagcggggattcgcaaagagaccgggtcacatttgatatttgcctttgtgattggtgtgatgtgtcatttcattacccatcaagtcgaacttattctcctgaacactatactaagaatattcaaggaatttaaaggtattattttacttcaaattctagaagaaatttccgatttggatgaacttggggcaaggaagtttgctttgataggcgtggggcttataggctgcatagtccacaacaagtctctattcatgggaaagctgggtcaatatgggttgacgagcacattgaagcatcactcttttttaatgaaaagcttaaatcagttgttgatcgtttcaataaagaattacctgatgtcatatttttcttcattaacagtgctgtg

SEQ ID NO: 248 - DNA, 1176 bp, Glycine Max
atgcaatatctgtatgatgatagtgggaggcgttaccttgatgcatttgcggggatagttactgtttcttgcggacattgccaccctgaaatcttgaatgccatcacggagcagagcaaacttctgcagcatgctacaaccatatatctacatcatacaataggtgattttgctgagtcattggcagcaaaaatgcctggaaaccttaaggttgtttattttgtaaattctggttcagaagcaaatgaattagcaatgatgatggcccgtttatatactggtagtcttggtatgatttctttgagaaatgcatatcatggggggagttctagtacacttggtttgactgctctgaacacgtggaaatacccaattccagagggccatgttcatcacgttatgaatccagatccatatcgtggagcctttggtgcagatgctgctagttatgcaaatgatgtccaagaccatattgactatggaacttctggaaaagttgctggatttatagctgaaacaatgcagggagttggaggagctgttgaactggcaccagggtatttgaaacttgtttatgacattatacataaggctggtggtgtctgcattgccgatgaagttcaaactgggtttggtcgaacaggaagccattattggggatttgagacacagggtgtcattcctgatatagttaccatggcaaagggtattggcaatggtctgccattaggagctgtagttacaactccagaaattgcaagtgtgttggcccaaaagattcaatttaatacctttggtgggaaccccgtttgctctgctggtggacttgcagtgcttagggttcttgataaggagaagcgtcaagctcactgtgccgatgttggatctcatttgcttgaacgattgagatttctcatggaaagacatgacatcataggaaatgtaaggggaaggggcctaatggtaggcatagagttggtcactgaccgagacaacaagacacccgcaaaggctgaaactgctgtcgtgtttgaaaaactcagagagcttggtgtgctagttgggaaaggaggacttcatggcaatgttttcaggatcaagccaccaatgtgtttctccaaagatgatgcagattttcttgtggatgccttggattattctctatcaaagttgtga

SEQ ID NO: 249 - DNA, 2202 bp, Glycine Max
atgcaatcgaggcctagccgccatattttttcagcatcagatgacactacaatgaccaaaaatattcgtgccactcatgctcccgttgatggacacattggcgttagacctcttcttcatgttgttcaagacatttttcaccgcgctgcctctctcatccctggcattgttcagggaaaacaagtgcagatggatgccatgaaggacagtgcataccaatctgatttagctaacgtgatagatatttcgtaccacacaatcaacaaaatttcctgcgagatatgttgcaagtgttcaagcggtggagatgtacatgccacaaccatgggaatactgggcatgctctcaagctattcatgggatgccaaggtggtgatagcattggcagcatttgcagccaactttggggagttttggctggtggctcagctttatgccaccaaccgtcttgctaagtctgttgcaaagttgaagcacatccatgaaacactggaacaagtggatgatttgggaccaaagtttcaaacagtcaacaaccttctcaaggcaatgttggatgtaaccaataacattgtccaattccatgagcttccctctcaatacattgaccctgaggcaccagagatgttgactgcctccaatcttattcctggtgctgtctattggaccattcggagtattgtgtcctgtgcatcgcatattttaggcataactggcttgggtcaaggatatatgacatcaacaacagagacttgggagctttccagtttggcccataagcttgataacataaatagtcaccttcgaaagcaactcaccgtttgtcgtcagcatttaggtaagccaatcaaattactggattacttcatatacgcaaatggggaatcatcgtctggcttttcttttcttactataaaatatctgtatcctattttgcttggtaacatcatgttatatatgatgcagatgataacagacagagagaagcatttgcaacacttcggctcctttttgagacaccccatcaagataattcgaaggttctcaaagctatgttttgcagcaaggatgatccgttgccactgtttgatggttagcattgaggtgctgaggaggaaaattgtgctgctctatataacagacgtacataatgtccccgatcaagagcttgtgatttttgaacaaatgtaccaagagtcacgtcaagattcaaccagattagagagtcaatacgaactcgtttggattccagttgtggacaaagcaatcccgtggaatgacgtgaaaccgaagtttgagaagctgcaatcaatgatgtcttgttactctctttatgacccttctctattggagcccgcaaccatcaggtacattaaagaggtatggcttttcaaaacgaagcctattcttgtagtgttggatccccaagggaaggttgtgaatctgaatgcaatacccatgatgtggatttggggaagcttggcttatcctttctctagctcaagggaggaagcactgtggaatgcagaaacatggggacttgtactattggcagattcaattgatccatcgcttttggaatggatatcggaaggcaaatatatatgcttgtacggaggtgacgatattgagtggatccgtaaattcacaaacactgcatattccctcgcaagaactctgcaactaccactagagatgatttatgtggggaaaagcaatccaggaaagaaagttcaagaaatcaacaatgccgtacaaacagaaaaattgagcaacgtacttcctgaccttgccataagttggttcttctgggttaggctagagagcatgtggcactctaaatcacagcagagcaaaacagtagagaacgaccacataatgcatgaagtaatgagaatcctaacctatgatagcggtgacccgggatgggccgtgattagtcaaggcacgggaaagatggcacagggcaaaggagacacatttctaaagtgcctgaatgaacatgaacaatggaaagacgcagcaaaagataaaggacttttgccagcaatggatgattatataaaagaactccaaacccctcaccactgcaatcgcttgatactccccggaaccagtggcgggataccagacaaagtgtcatgtgctgaatgtggccaaacaatggaaaaattctacatgtatcgctgctgcaatgagtaa

SEQ ID NO: 250 - DNA, 3294 bp, Glycine Max
atgcacaccggtggaagactcgttgctggttcccacaacaggaacgagtttgtgctcatcaatgccgatgagaatggaaggattaagtctgtccgagagctgagtggacagatatgtcagatttgtggggatgagatagagattactgtggatggggagccatttgttgcctgcaatgagtgtgctttcccggtttgccggccttgctatgagtatgaaaggcgcgaggggaaccaggcttgtcctcagtgcaagaccagatacaaacgtatcaaaggtagtcccagggttgaaggcgatgaagaggaagatgatactgatgacttggacaatgagtttgattatggggatattgatgctttgggcccacaaccaatgtcggaatccttgtattctggacgccctaacactgggcgaggtgctaataatggatctggcttggcgacaaacttggaacatggctcgtctgctctcaattctgacataccgctcctgacttatggggaggaggatcctgagatatcttctgatagacacgcgctaattgttccgccttatgtgaatcatgggagcagagtccatccaatgccttataccgatccgtctattccattgcaacccagacccatggtccccaagaaagacattgctgtgtatgggtatggaagtgtggcttggaaagaccgcatggaagattggaaaaaaagacagagtgacaaacttcaggtggtgaagcatgaagggagcaatgatggaaattttggtgatgattttgaggaccccgatttacctatgatggatgaaggcaggcagccactttctcggaagctacctatcccttcaagcaagataaatccttacagaatgattataatactccgccttgttgtgcttgggctctttttccattatagaattctccacccagttaatgatgcatatggcttgtggttgacatcagtcatctgtgaaatatggtttgctgtatcatggataatggatcagtttccaaaatggtacccaatacagcgagaaacataccttgatcgtctgtcactcaggtatgaaaaagaagggaagccatctgagttgtccagtgtagacgtctttgtcagtactgttgatcccatgaaggaacctccactgattacagcaaacactgttctatctatccttgctgttgattatccagttgataaagttgcatgctatgtctcagatgatggtgctgctatgcttacttttgaagcactgtctgagacatctgaatttgctaggagatgggttccattttgtaagaaatacaatattgagccccgggcaccagaatggtactttggtcagaagatggactatctgaaaaataaagtacacccagcatttgtcagggaaaggagagcaatgaagagggattatgaagaatttaaggtgaggattaacagtttggtggcaacagcacaaaaggttcctgaggatggatggaccatgcaagatgggactccttggcctggaaataatgtgagggatcatcctggcatgattcaggtcttccttgggcaggatggtgttcgtgatgttgaaggaaatgagctaccccgcttggtctacgtttctagagaaaagaggccagggtttgatcaccacaaaaaggctggtgcaatgaatgctctggtacgggcttcagcaattatcactaatgcaccctatcttctgaatgttgattgtgatcactacattaacaatagcaaggcacttagagaagctatgtgttttatgatggatcctcaactagggaaaaaggtttgctatgtgcaatttcctcagcgatttgatggaattgatagacatgatagatattcaaacagaaatgttgtatttttcgatattaacatgaaaggattggatgggatacaaggtccaatatatgtcggaactggatgtgttttcagaaggtacgcactttatggatatgatgcacctgccaagaagaaaccaccgagcaaaacttgtaactgttggccaaagtggtgctgcctatgttgtggctctagaaagaaaaagaatgccaatagtaagaaggagaaaaagaggaaggtgaagcacagtgaagcatcaaagcagatacatgcacttgaaaatattgaggcggggaatgaaggaaccaacaatgagaagacatccaatctgactcaaacaaagttggagaagaggtttggacagtctccagtatttgtagcctccacacttttggatgatggtggagttccacatggcgtgagtcctgcatcacttttaaaagaagccatccaggtcatcagttgtggttatgaagacaaaacagaatggggaaaagaagttgggtggatatatggttctgtgacagaggatatcttgactggatttaaaatgcattgccatggttggcggtctgtgtattgcattcctaagcggcctgcatttaaggggtctgcgcctatcaacctttcagatcgtctgcaccaagttcttcggtgggctcttgggtctgttgagatttttttcagcagacattgtccaatctggtatggctatggtggtggattgaaattgttggaacgattttcctacattaactcggtcgtatatccctggacttccctcccattgcttgtctactgtactctaccagccatatgccttctgactggaaaatttatcgtacccgagattagcaactatgccagtcttgtgttcatggccctcttcatatccattgcagcaactggcatccttgagatgcaatggggcggtgttagcatagacgactggtggaggaacgaacagttttgggtgatcggaggtgtttcttcccatctatttgccctatttcagggtttactgaaggtcttggctggtgtgaacacaaacttcactgtgacctcaaaagcagcagatgatggagaattctcagaactctacatattcaagtggacatcactcttgatccctccaatgactttacttatcatgaatattgtcggggtggttgtcgggatctcagatgccatcaacaatggttatgactcatggggacctctctttggtagattgttctttgcattgtgggtgatcctccatctctaccccttcttgaaggggttgcttggaaaacaagatagaatgccaaccattatattggtttggtcaatccttctggcctccatcttgactctcatgtgggtcagaattaacccgtttgtgtcaagagacggccccgtgttagaaatttgtggattgaattgcgacgagtcgtga

SEQ ID NO: 251 - DNA, 528 bp, Glycine Max
atgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaataa

SEQ ID NO: 252 - DNA, 534 bp, Glycine Max
atgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatgtcagtacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaataa

SEQ ID NO: 253 - DNA, 2013 bp, Glycine Max
atgcagatagaggcactgcccccggctctccaacgcccgtttcagcctccactttctcttggattccctttcaaaccttcttttttaactccagccacacacgccccttcgcacttcaatacatattcacgttttcagcattcagttaagtttcgtcgctcttttgcaacggttacagcgaccaccgagaaggttgttattgacgacagcgacaccaccaacgacgaaccgggcttcgttaacattggctacatatcgagtgttcatggaattcagggcgagattcgcgtcaagccagccaccgattttcctcaactgcgcttttccactcctggaagaagatggttgaagagcaaggttttgggtagagaaagtgttcaagaagttgagctggaggaaggtagagagcaccctgcacttaagagttggatactcaaattcagaggaattgacacagtggaccaggctaagaagcttattggtgctaccttgctcgtggtggatgaagacaggccggaattagaggagggtgaattttacacacatgatctgatagggatgaaagtttttatgaaggaaaatggaaaacttgtgggaactgtcatgaatgttttcaatagtggagccaatgacctactacaaattgtacttgattcatcttttgatatgcttgacaaaagtggcaagtcaaggtcagcagaaatagatgcatctgatcagcttgttttggtaccttttgttgaagccattgttccagatgttgatatgaaaagaagacaaatgcatattactccgcccaagggactcctggaattaaatttacgatttgatgataggtccaaaaaagaaaggcgccaacttgaatggaaagaaaagaaaaagtttcaaaagcgtctcatagcagcaaaaaagaaactcattgaaatggagcaaaaacacatatttcatggatttcaatatggtgagaaagatcaatggagctcgcttagtgatcagattgttggtgtaaattccaaattgctccaggaggctttacaaagtcttgagcggccagcaaagaggcaattaatatgtggcccgatgtcatttcatgggtggttgaaatggaaagttgctgagttggtcggtgccatagaagcaaagcttataaattctatccaaatatcagaggaatattttttaaatggaggtaaaaataagttgtttagagatatgcaagagaagggacttgagctcatgtctaaggggaaaatggctattgtctttctcttgaatgacaaagagcatcaggggagcatttctgactctaacaaggttgaaaatgaagcaattgacacttcggtacttcacatgtttcaaaaggtcaaagatcatgtttctgtgcctttaattttggtttcctcagcccaacaaattcagtcttttaggaatctgtttacaagcaacaattacttcgcatttgactctgaaaaggtatggtttttggaggaagagaagctgccagtaattagcagtttgcccaagggacagaacaaatataagattttaatgaaatcaccttgggaaatactccaatctccagttggatctgggggacttattagcttgttttcaaaccatagtattgcagataatcttattgacatgggtgttgagtacattgaggtttgctgcacaagtgaaaaaatggccggtggaaactctctacttcttgggttgattaattcacgggaagccaagattgggatacaaatttcgcctaaaatcactgattcggaagaaaactttgacttgatattctcgatggactttgtaaagaagttaacgaagcaaagcaacaaactccaatttgatgcaatcccaaaggcacattcctttgttgagaaagttgacaaagaatgggttactctcacctcgtccacccccaattcatatgagctctcttgtagcatatatagttccttaaacgcatgttcgttggataaggtttgtatagtggaggttagagaataa

SEQ ID NO: 254 - DNA, 522 bp, Glycine Max
atgcagcatgcaagaatcaaagaagaaaatgtccttcagattgcattttctctccatattttcctgcaaatgatcctcaatgatttgcttgtgttcacagaatctatggtggcaggaatgttgaaagaatgcttcaagtttagaatatgtcatgcaaacaaattccaccatacttacgtgaacaacctgcaaatactttattttgaagcacattgtaggattcaaggccctatttatggatgtgctgggattatctttaaattatatgaacaaatcaacagtgccgaaattgcacttgcgtatatcgatatccaaactcaaactgcttgtcacaagcttcaagctgaatcaaactttgatgtcttgccagcacaaagtagcatcacagcaaagtttcaatggaaaaccattttcaaaacctcagttgctttaggagtttttttttttctttctttttttgaaaaacatagaataatgctggaggagttcaatgcttcgaagtgcttactaaatacaaagtaa

SEQ ID NO: 255 - DNA, 192 bp, Glycine Max
atgcaggagatcagcagtcaggttcaaaccaccatccaggctgcattgtctcagtatcttcctcaaaaaaccgaagcagagacctcatcaaaaaataaaagaaagatcgcagagattgaagcacaactccatgaggcagagaatgtgataacagatattagatcagaattaattagatatcgcatgggttag

SEQ ID NO: 256 - DNA, 4068 bp, Glycine Max
atgcatagaggccttgcttcaatcattactggcatccgggaaatgggttctcgtttgagcaaagcacgtggttctctcaaaaatgaatcagaaggaacatcctcgggaaaaaatgaagtttcatacgaggagctgtctagattgatgaggataagggatttgatgagcctattgttgacttatccaatgaaaatggacgagggaggtaaattaaaatcctgcattagtgcatttcctgaatggaaagctcagttattgtccactgatcatgatactattgtgatggacaaaccatggcgtgtactaactgagaaggcactgggatgtatgaagggatttatgcccacggaaataataagtaaaatagaaagtggtgagagatccatcttcaaccataatgatgccgatgcaataccaaaagccattctccacctaactgttgatctcgcagttaaccaactaattcaaactttgttttctggagattactatgcacgctatatcagtctgtcatccagaaacttggctgaaaaaagatctgtagtgaacaaaatagaagcagcctttgaagagaagcacaatatgtttggaatcgacaaagattttcttagtgccctgtggatcaattcctcaacatataagactgatgcagagattcgagttcaagaagagatcaataacaagatggcagcaggtttttcggagacaaaagggggtgaggaaaaaatgaataggcatttggtgattgtagtggatgcagacagcaacaagaagctggaccttcacaaagtgcgttttcctactggagttgtggtggtgttgataacaactgagctgaaggatgatgacttcagaatcacaagcatgatggatttgaatataaggacccaggatcatttgttgccttgggaactcttttgcagctatgtgggcagtagcaaggtatgctcatcactggtcattcagagaattgcagtgcaaattgttaaggaatgtcatggccatcttcttgccgttgtccttgtggcaaactacctgaagaatgtggaagatgttaaacagtggcaagttgcacttgacaaattaagcagcagcctgaatccttcctatgattatagagatagtgacggaattggcattagtagggtcatggtcaatgcatttgtagatattatttgggaagacattgatgatacacaaaagctttgccttgaactaagtttgtctgttcacaacattaaaattgggaagcgacttgctatcttagtgtctgattgggccgatattttatcaggacatacacaagaaatgaaactgaattcaaatgaatttggtgaatacataaggcatatcagagtgcttctagaccgttttgtctttttgaaaattgaaaggggagatgtctatttgcctgtagaaacctatgatataataaaatcattacacaccttgaatccttccatcataaggcatgatgcattagggtttctggagccaccctgcattgaacgatggcacaaccttattcggatagaattgatggacgacaaaatatgtgagctaccagaatcaccagaatgccctaaactcagagtgctcctgttgcagggtaatgttgatttgatggatatccctgactcatttttcgagcacatgcctttgctacaacagttggacttatcctacactagtataagggatttgccctcttctgtctccaaattaacacaacttaagaaattttatcttagaggttgtgatctcttcatggaactaccaccacaaattggactactaaaaaatcttgaagagcttgatcttgatgggactttgataacccatctacctaaagagatccgagaattgatcaacttgcgaagcttaaccctttgctttgatggataccatcatgtacttggtcatggcaataaaggcaagcaaatttccaactcaacaattattcctacgggactgatatcaaatcttactcagttgaattatttaaacatcaaagttgaccctgaagatgagcgatggaatgataatgttaatattgtttttgtggaaattattggattaaagaggttggagacagtgagtatatatatcccaaaggctaaccttttgaaattgatacctgtccacaaatccctcaatttcagattggttgttggtaatcatatgcgacgtttcatatcgcgtgtgacacctgaactggaggaaaaattcaaacgttgtgactatagtataaagtttgttaatggtgtaaatgttccaaacgtagtgaagatgacgcttggaaacttcaaggccttatacctagaccgacatatgaccatcaagagtctctctgattttgagttgaggaatttatctgggttgcaaatatgtgtattggcggaatgtaatcaaatggaaacaattgtggatagaagttatttacatgatgggcctgctcttccaaatttggagtttttgagcgtattctatatgaaaaacttaaaaagcctttgtgaaaggcctaacccctcttttctccgcttgaagtctatagcattgcacacttgccccatgttaactacagtttttaccgaagattctcttaaggacctttccttattggaggagattattattgaagactgtccaaaagtaaccacccttatacgccatgactcatcagaaataaaaacacggttcacaatgcccaagttgagaaagatatctcttctctatcttcctgaattggtcaacatttttaatggcctgcatgttgaacatgatgtagaaaaaatggtattttattattgtcctaaactccaaagtctttcacaatgggagttgtcaaaggcatctgtgaagatcatcataggagaaagcgtgtggtgggaagcattgaaatggaatgcagcagagtggggagatgctggtcgacccaatgtttttgaacgaattttttcaccaatcagtgaggaggctgacatcatgactcaactggctgcacatcaagagactcaattaagtacagatcacgatgagtttctgggaaccaaacaaaggcatgatgatagtaagttaccatcaaatcctgaagaagtagaagacctacggcgtgactcagctgcaaatcctttgattgcattcacttatgatgagttaaagattatcacagaaaattttaggcaagatcgtgtgttggggggagtaggatttggaagggtttacaaaggattcatttctgaggagttaataaggaaagggcttccaacacttgatgtagctgttaaggttcatgatggtgacaacagtcatcaagggcacagagaatggctgtcgcaagtcgaattttgggggcagctttcacatccaaatctagtcaaagtaattgggtactgttgcgaagacaaccatagggtactaatatatgagtacatgtcccggggaggtctggacaactatttgttcaaatatgcacctgccataccaccattgtcctggtccatgagaatgaagattgcatttggcgctgcaaagggacttgcatttcttcatgaagcagagaaaactgtcatctatcgatgtttcaagacatcaaatattttattggaccaggagtacaattcaaaactttccgactttggccttgctaagtttggaccagttggagacaaatcccatgtttctactcgagtaatgggaacatatggttatgccgcacctgaatacttagcgacaggtcatctgtatatcaaaagtgatgtttacagttttggtgttgttcttcttgaacttctcactggaagaagatccttagacacgacatttgatggagagcagaaacttgcagaatgggctcattctttgctgaaggaaaagaagaaacttctaaaaatcatagatccaaggttggatggtgattatccaattaaagcagttcacaaggctgcaatgcttgcatatcattgcttgaaccgcgacccgaaagcaaggcctctaatgcgagaaattgtacattcattggagcctttgcaggcacacacagaggcacctattggaaaaaaacgttga

SEQ ID NO: 257 - DNA, 795 bp, Glycine Max
atgcatctcaatatgcgtcgtaacatcctcgtcactctcacacatcacacaacaatggcttctcttcattcttctttcctccttacatcaaattttctttccctcacaaccccatcaagttcttccactcacgttctctttcccatgagactctccacgacccacttgcgaccccttcttctcaccacacgacacggtttcgggagaccaccctttgccgcggtggcggaacaggcggccaccgcgaccgaggcgtccgcgaggaggctctacgttggcaacattccccgcaccgtcaccaacgaagagcttgccaagattgttcaagaacatggtgctgttgagaaagctgaggttatgtatgataaatactctggaaggagccgccgctttgcatttgttacgatgaaaactgttgaggatgcaactgctgtgattgagaaacttaacggcactgaaattggaggacgtgaggtcaaagtaaacgtaacggaaaaacctttatcaacaccagatttgcctttactccaagctgaggaatctgaatttattgacagtccccacaaggtgtatgtgggaaatctggccaaaacagtaacaactgatactcttaaaaactttttttctgagaagggaaaagttcttagtgccaaggtttcacgggtccctggtacctcaaaatccagtggatatgggtttgttactttttcgtcagaagaggatgtagaagctgcaatctcatctttcaacaattctttgttagaaggccaaacaatccgtgtaaacaaggcatag

SEQ ID NO: 258 - DNA, 825 bp, Glycine Max
atgcatgtctctaatggaagacaatggttgcctacaccggaggcagccgatggtttgcagtctgagcttccgtttgagtttcaagttctggagattgctttggaggctgtgtgcacttatctggactcgaatgtggcggaccttgagcgaggtgcttaccctgtgttggatgaattggctaggaatgttagcaccaagaatcttgagcatgtgcggagtttaaagagtaatcttacgcggttgctggcacgagtgcagaaggtgcgagatgaaattgaacatctgttagatgacaatgaagatatggcacaactatatttgacaaggaagtggttgcagaatcaacaatttgaggaggctcatttgggtgccacaacctcaaataactttcctaatacctcacgttctgttcgtcaacttggttctatcagaagtgaaagtcttgtgaccagccattatgaggatgataacaatgtggaggacttggagatgttgcttgatgcatatttcatgcagttggatggaactcgtaacaaaatattatcagttagggagtatattgacgacactgaagactatgtcaacatccaacttgataaccaccgaaatgaacttattcagctgcagttgacgttgactattgcatcatttgctattgctattgaaactttgattgctggtgcatttggtatgaacattccttgtaacttatataacattgatggagtattttggcccttcgtttggaccacgtctgcggcttgcgtattacttttcttgcttattttagcatatgcaagatggaagaagttgctgggatcataa

SEQ ID NO: 259 - DNA, 4260 bp, Glycine Max
atgcattttgaggattccatgcttgttgcttcatgtgcttttcttttggagctttgtggtttatcagccaacaagatgcgcattgatattgctgtgctaaaacggatatctttgttctacaaatcgagtgaaaataatgaaaatctctggcaattatcacctaagggatctgtgtttcatgcaatatcccatgaaggtgatgtaacagaatctcttgctcgagctttagctgatgaatatttgcacaaggattctcctgcaactgctactgagactgtaagtaaacaagcttcacgagctcttatacttgtgttgcaccatttggaaaaggctagccttccacagttggttgatggaaaaacttatgggtcatggctattaagtggaaatggtgatggaaatgagttaagatctcaacgaaaggctgctagccagcactggactttggtaacaaatttttgtagattgcaccagcttccgttaagtaccaagtaccttgctgcattagctagagacaatgactgggcatcaaaggagtttagtgatccgcgtctccgacttcatatgttaacagttttgagaggaatgcagtcaaagaaaaaggcaagcactgcattgttcttggatacactggagaaaggcagtgaaacaacctttcctgatgaaaacatgtgtgttccagttgaactcttccaaatattagctgagtgtgaaaagcaaaaatgtcctggagaggctctcttgaggaaagcaaaagagttgtcctggtcaatattggcaatggttgcttcatgtttccttgatgtctctccattgtcatgcctgacagtttggttggaaattactgcagcaagagaaacttcatccattaaggtgaatgatattgcctcccagattgcagacaatgttggagcagctgtaaatgctactaatgccctacctgtaggtgacagagtacttacatttcattacaataggcagagtcctaaacgtcgacggctaataactcttgtttcactagactcctctgcttctgcaatatctgacatctgtagctcttctataagtgaagaaatatttgattccaaaggtaaaactatggagaatgatagaaaaatagaacattttggatgcattaatgttccaagtgattcccatgaagggcctgcttctctctcaaagatggttgcagtgctttgtgaacaacaattgttcttgcccttgctaagggcatttgagatgttccttccatcatgccccttgctaccattcatccgtgctcttcaagcattttcgcaaatgcgcctctcagaagcttctgcacatttgggctccttttctgcacgaattaaggaagaacctttctacttacaggcaaatgtaggaagagaggcgcagattggggcatcatggattagttctactgcttcaacagctgctgatgctgtgctttcaacctgtgcatctccttatgaaaaaagatgcttactgcaacttcttgctgctactgactttggtgatggtggacatactgctgcacactatcgaagggtttattggaaaattaatctggcagagcctttacttcgtaaagataatgagttgcatttaggtgatgaaatttcagatgatgcttccctcttgtctgcactagagaataataggcactgggagcaagcaaggaactgggccaagcagttggagcccaatggtgcaccctggaaatctgctatgcatcatgttactgaatctcaggctgaatctatggtagctgaatggaaggagtttctttgggatgtgccagaagagagggttgctttatggagccactgccacacactattcatcagatattccttcccttctcttcaagctgggttattttttcttaaacatgctgaagctgttgagaaagatcttcctgcaagggagcttcatgaacttttattgctttctctgcaatggctgagtgggatgataagtctttccaaccttgtctgtccattgcaacttctacgtgaaattgaaaccaaagtatggctcctagccgttgagtctgagactcaggtgaagagtgaaggagatttcaattttaccttttctaccagggagagtggtatcaagaacgaccccagtattattgaccgaactgctagtataatagcaaagatggacaaccatataaatacaatgaggagtagaattgtagaaaaatacgagtccagggaaaataaccaaatcccccacaagaatcaagtgatggatgctggtctttcaactacttttggtgggaatacaaagacaaaaagaagggccaaaggatacatggcaccaagacgcccacctcttgaatcagcagataaaagtgctgatactgatgatggctctagtaccaatagtttaaaaaatgagtttcagttgcaagaggaaaacgtaaaagtggaaatgtctttttctaggtgggaagaaagggtcggagcagcagagctagaaagggctgtactttctttattggaatttggacaaattgctgccgccaagcaactacaatataaattctctcctggacaaataccatctgagtttagacttgttgatgcagccttgaagcttgctgctatttcaacacctcctagcaatgtatcagtgccaatgcttgatgaggaagtgcgttcagttatgcactcatatggtataatgaatgataagcactatgttgacccgctgcaggttttggagagtttggtgaccatttttattgaaggcaatgggcgtgggctatgtaagagaataatagcagttataaaagctgcaaacaccttgggcctctcattttctgaggcgttcaacaagcaaccaactgaactactacagctgctttcgcttaaagcacaagattcctttgaggaggccaactttctggttcggactcatccaatgccagcggcaagtattgctcaaatacttgcagaatcttttctaaagggtgtgttggctgcacatcgtggaggatatatggattcacagaaggaggaagggcctgctccattgctgtggagattttcagacttcttgaagtgggcagagctttgtccctctgaaccagaaattggacatgctttaatgcgtttggtgattactggacaagaaataccacatgcatgtgaggttgagcttcttattctgtcacaccacttctacaaatcatcttcttgccttgatggagttgatgttcttgtggcccttgctacaactagggttgatgcttatgtcttggagggtgattttccatgtttggctcgcctgataactggagttggaaatttttatgctctcaatttcatttttggcattcttatagaaaacggtcaattggatcttcttcttcagaagtattctgctgctgcagacacaaacactggcactgctgaggctgtcagaggatttcgaatggctgttcttacatccttgaagcatttcaaccctaatgaccttgatgcatttgccatggtctacaatcattttgatatgaaacatgagacggcagcccttttagagtcacgtgcagagcagtcatgtgagcagtggtttcgctgctacaacaaggaccagaatgaagacctgttggattccatgcgctacttcattgaagctgctgaagttcactcttcgatcgatgctggcaacaaaacacgtaaggattgtgctcaggcttcccttctgtctcttcaaatacgaatgccagacttccaatggctttatagatcagaaaccaatgctagacgagcgttagttgagcagtctcgatttcaagaagctctgattgtagctgaagcttataacctgaaccagccaagtgagtgggctttagtactctggaaccagatgcttaaacctgaagtaatggaggagtttgtggctgaatttgtggcagttttacctcttcagccttcaatgctgtttgatttagctagattctatagagctgaagttgctgccagaggggaccaatcccatttttctgtctggctcacagggggaggattgccagctgaatgggctaaatatttagggagatcattcaggtgcttactgaagcgaacaagggatttgaagttgcggacgcagttggctacagtggcaactggatttggggatgtcattgatgcatgtacagaagaaatggataaggtccctgacaatgcagcgccactagttctgaggaagggtcatgggggagcttacctccctttaatgtga

SEQ ID NO: 260 - DNA, 1986 bp, Glycine Max
atgccacaaaatgttggtttaataaaaaacaaagtttccaactttaccaaactaataaatattatggagtccatttttgtgattcttctgatctttatggtggcatcaaatccatgctctgcggcgccttctccttctccctctgcctctcccaccatttccactaccaacagttccacatgcccagtgtccatgaattatgtgcaaacagtcccttggaacagctcttcctgccaaaacttccaacccttggcatcacaataccaaacaaaaacaagtccttgttgccaaactctgctatccctctttggaatagcactttcacaaaacctcaaaaaaagctctcttttccaactccctaacctccctacctccagctcttgtcttcaacacttccaatccaacctcacatctctctcacttcccaacaaccttgtctcctcctgctttgatccatctcaatttgtcatctctccaaacatctgtgctggtattcaaaatattgaagattggcacactaggcttggtcctacaccagagctcaacactgcctgtggaccagacctcactgaccctaaccaatgcagaacgtgtgtggctgagggggacaaggttcagcagaggcttctttctattgatggtaatgattcacattccctagattgcttttacttcgcaacactttacctggctggagttgtcaatgagcttggccctgaaagcaaaggtgttatgtcttgcattttgattctgttgcttaattcacaagttgattcaagggatggccattatgctcttgtgttggggttaattttagcttcacttgcattcctggtaatcatattaggattaggattttattgttggtacacaaagaaaagaaaagtggaaaatttgctagcctatgctgatctacaggaacaaagcttcagcctaaggctgaggccaaatgcagtgttaacttggtttgaatttgaggaccttatgagggccaccgacaatttttcacctcagaacttcattggaagaggtgggtttgggttggtttacaagggcattctacctgatggctcaatggttgctgtgaaaaggcttgaagaatcagattctcaaggtgatgctttgttctgcagtgaggtggagattgttagcaacttgaagcaccgaaatctggtaccgctaaaagggtgttgtgtggttgatgaggggaatgagaatcacaattttgagtacagaagaaggtatctagttcatgaatatatgccaaatggtagccttgaagaccatctctttccaaccaaactagacaatcaaaatacaaaaaagtcccttacttggtctcaaaggaaaagcataatcttggatgtggcaaatgctttggtttatttgcactttggagttcaacctgcagtttttcacagagatatcaaagccaccaatatactacttgatgcagatatgagagcaagggttggagattttgggctagccagacagagcagtgaaagtaggtcacagctaaatactagagtagcaggaactcgcggatacgtggcacctgaatatgcactttatggtcagctaactgagaagagtgatgtctatagctttggtgtggttattcttgagataatgtgtggaagaaaagcccttgaattgtctccatcaggaacaccaattttcttgatcacagattgtgtttggtcattgatgaaatctggaaacataggagaggctttggatgcttctatgttaggagatgaaaattgtgctagaaacataatggagaggtttttgctggttggaattctttgttctcatgtaacggttgcttcaaggccaacaattttgaatgctttgaagatgttagaaggggatattgaggtcccaccaattccagataggccactgagtcatgggaactatgtgttgtacagtggtgattgctctgggatgagctcaggatgtggatttgtgagctcatga

SEQ ID NO: 261 - DNA, 2646 bp, Glycine Max
atgccagggaacaattttaactgcgtccctttaacaccaaggtctagattggaaaggcttctgagggaaagagagctaaggaaatccttcaagcttgaagaggtcacggaaacgaatgcggatgcaagaggttttacaggcaaacaacgcttgttggtggtagctaacaggttgcctgtgtctgctgttagggagggtgtggagtcatatcgccttgatatcagtgtaggagggctagtcagtgtaaaggaatttgataccagatggattgggtgggctggtgtgaatgtgcctgatgatgttgggcagagagcattgacaaaagctttagctgaaatgcgatgcataccagtatttcttgatgaggagatagttaatcaatactataatggctactgcaacaacatcttatggcctctatttcattaccttgggcttccacaagaagatagacttgctacaactcgtactttccaatcccaatttgatgcatataagaaggcaaaccaaatgtttgctgatgtagtaaataagcattatgaggaaggagatgttgtttggtgccatgattaccacctaatgttccttccaaaatgtttaaaacaatacaatgacaaaatgaaagttggttggtttctccatacaccctttccttcctcagaaatacataggactctaccgtccagatcagagctgttgagatctgtacttgcagctgacctggtgggattccatacctatgattatgccaggcattttgttagcgcttgtactcgtattcttgggcttgagggaacacctgaaggagtagaagatcatgggaaactgacccgtgtggctgcgtttcctattgggattgactctgatagattcactcaagcccttgaactccctgaagtccaggaacacatgaaagaactaaaagaaagatttgcaggccgaaaggtaatgttgggtgtcgatcgtcttgatatgataaaaggaattccccaaaaaatcttggcatttgaaaagttccttgaggagaattcacactggcgtgataaagttgtcttgctacaaattgctgtacctactaggaaagatgttccggaatatcaaaagcttacaagccaagtgcatgagattgtaggacgcatcaatggaagatttggtacacttacagctgttccaatacaccatctggatcggtcacttgactttcatgaattatgtgcactctatgctgtaactgatgtagcacttgttacatctttaagggatggaatgaatcttgtcagctatgaatttgttgcgtgccaagcatccaagaaaggggttctcattttaagtgagtttgcaggagcagcacagtctcttggtgctggtgctatcttggtaaacccatggaacatcacagagatagctgcttctattggttatgcgttggaaatgtcagctgatgaaagagaaaaacgacatcagtttaatttcaaacatgtgaagactcacacgtcacaggaatgggctgcaacttttgtgagtgaacttaatgataccattgttgaagctcagcttaggacaagacaagttcctccattacttcccaacaaagtggcagttgattgttactcaaaatccaataaccgattaatcatactgggtttcaatgccactttgaatgaaccagtggatgcccttggaagggctggtcaaattagagaattggaacataaattacactcaaatacgaaggaacctttaaagaagttatccgatgatccaaaaacaacaatagtagttctgagtgggagcggccgagctgtcctggacaaaaacttcagtgaatttaacatgtggttggcagcagaaaatgggatctttttgcgacatacttcaagtgagtggatgacaaccatgcctgaaaatttaaacatggattgggttgatagcgtgaagcatgtttttgagtattttactgaaagaactccaaggtctcattttgagcttcgggagatgtcaatagtatggaattacaagtatgcagatgttgagtttggaaggattcaagcaagagatctgcttcaacatctgtgggcagggccaatatcaaatgcatctcttgatgttgtccaaggtggtcgatctgttgaggtccgcacaattggcgtgtcaaagggagcagctattgatcgtatccttggagagatagttcataaaaaaggcatgaagacaccaattgactatgtcctatgcgttggccactttctagccaaggatgaagatgtgtatcaattttttgagccagagctaccatctgaatcacctccagtaccaagagctatgctatccaaatccaattcttacaggccatcatctctgtcaaaattaccagccaccaccaaaaccagttcgaaggcagctcaatacaagaaacaacgttcgttgtcaaacatagaaaagagagaacttgatcaatggagaccaatgtgtggtgataaaatagcactgcatgagggttcctcagtgcttgatttaaaaggtgataattacttctcttgtgttgttggacggaaaagatcaagtgcacgttaccttcttaaaacctcagatgatgttgtcaacctcttacgtgacttggcagaacattcttcttcaccaacttaa

SEQ ID NO: 262 - DNA, 1833 bp, Glycine Max
atgccagtagaaatggacttcatatttgtgctattgctattgggttgcttatgttcttttgtgttgcctgatacacaaggagatgcactatttgcattgaagatatcattaaatgcttcagctcaccagcttactgactggaatcaaaatcaagtgaatccttgtacttggtcacgtgtttactgtgactcaaacaacaatgtcatgcaagtatcactagcatatatgggattcacaggatacttgaacccaaggataggagttctaaaatatcttacagctctttctttgcaagggaatggcatcactggcaacataccaaaagagttaggaaacctgacaagcttgagcaggttagatttggaaggcaacaaattaactggagaaataccctcttcccttggtaatcttaaaaagcttcaattcttaacattaagtcaaaacaatctcagtgggactattcctgaatcacttgccagtcttccaatcttaatcaatgttctgctagattcaaataatctgagtggccaaatcccagagcagttattcaaggttcctaaatacaatttcactggaaataatttgagttgtggtgcgagttatcatcaaccttgcgaaactgataatgcagatcaaggttcatcacataaaccaaaaactggtctcattgttggaattgtgatagggttagttgttatccttttccttggtggtctgatgttctttgggtgcaagggtagacacaagggctacagacgtgaagtttttgtagacgtcgcaggtgaagttgatcggcgaattgcatttggccaactaagaagatttgcatggagagaactacagatagctacagacaacttcagtgagaaaaatgttttaggacagggaggctttggaaaggtttataaaggtgttcttgctgataacacaaaagttgctgtcaaaaggttaactgattatgaaagtcctgggggagatgcagctttccagcgtgaggttgagatgataagtgtagctgtgcataggaacctgttacggctgattgggttttgtactaccccaaccgagcgcctcttagtttatccctttatgcagaacttaagtgtagcctatcgtcttcgagaaatcaaacctggtgaacctgttctggactggcctacaagaaaacaggtggctctgggaacagcccgtggcttagaatatctccatgagcattgcaatcctaagattattcatcgggatgttaaggcagctaatgtattactagatgaagattttgaagctgttgttggtgattttggcttggcaaagttagtcgatgttcgaaaaactaacgtgacaactcaagttcgtgggacaatgggccacatagctccagagtatttgtccactggaaagtcttcggaaaggactgatgtttttggttatgggattatgcttttggagcttgttacaggtcaaagagcaattgacttttcacgtttagaagaggaagatgatgtgctgttacttgaccatgttaagaaattagaaagggagaaaagactagatgcaattgttgaccacaacctaaataaaaattacaacatacaagaggtagaaatgatgataaaagttgcattactctgtacgcaagcaacaccagaggaccgtccaccaatgtccgaggttgtaagaatgctagaaggagaagggttagctgaaaggtgggaggaatggcagcatgtggaggtaaatcggaggcaagaatatgagagattacaaagaagatttgattggggagaagattcggtctataatcaagatgccattgagttgtctggcgggagatga

SEQ ID NO: 263 - DNA, 144 bp, Glycine Max
atgcccattataattgaacatacagaatctgcatcagaaacatcagggtgggatcaagatgaaatcaacaagtacaggaaagaatatggagacatgaaacttttcaagtggaaatttggaaagaagtacacctcattaatctaa

SEQ ID NO: 264 - DNA, 498 bp, Glycine Max
atgccccctgaatccacatccataattttgaaagaaataatgacggctctcacacaaccaaatattggtctacttggactgtatggatcgagtaatgcgaacaaggaaaacgtagtggagaaagtcaccaggagagttgagagggacgggctgtttaatgtggttgtgaagacatgcgtgatgaaaaagccagatttaaaaagaattcaaggagaacttgggaatgcattgggtctacaactccatgagaaaactctaaaggaaagagctacccgtttgtgtgagagggttaaaatggaggacaagatccttatcattcttcatgatcttcacggtcaaatcaacttggccaagattggaataccctttgggaatgaccacaagggttgtaaaatcttgttagtaactgagaataaagaggtgttgtcccacaaaatgaaaacccaaatagaattttctgtggacgaggagccgtcaagttctggtttaatttattaa

SEQ ID NO: 265 - DNA, 498 bp, Glycine Max; identical to SEQ ID NO: 264

SEQ ID NO: 266 - DNA, 2058 bp, Glycine Max
atgccccgtaaagtaaattacggactcgattacgacgacgattactatgatgatgattatgatgactatgcttatgatgatgttgatgcagaagactatggaggacctgatacaaagcaagagaccattaagcctggcctttggcaatgctccatttgcacttatgacaacgatgagagtatgactttttgtgatatttgtggtgttgtacgccgtcccttggttaatactggaacttccaacagtaacaaaacagatcctttcaagttcaatgttccatcccccgacgatgtggtttatactggcctacgttcttccaaaacgggtttgaaagacaacttatcatccttaatgcaaaagagcagacaggatagttcaactgagagcaagctttccaaaaaagtagcaattgatctgcaaacaagtggtaaaacttcaaacagcttgccggaatctttgtcaaaagacaaagataacaatattaataaaataaattcttcgaaaaatggtacaattgatattcaatcaagcaaagaaaagtcaggtagtttgtctacacggtcaaaagtcaaggaaagtgataacatcagttcctcttctatcaaagatggaaaacctgaaagtatttccagcagtttcagcaacatggttgtcgatgtaagatttggaaattctgataacactaatgctaaaggaactcactcacgtgtttcttataagccagaaaaatggatgctccctgaacaagctgaagatacattgactcagctgaatcttgcaattgttggccatgttgattctggaaaatcaactctatctggtaggttactgcacctattgggacggatctcccagaaagaaatgcacaaatatgaaaaggaggccaagttacagggcaagggatcctttgcttatgcttgggcacttgatgaaagttctgaagaaagagaacggggaataactatgacagtggctgttgcttattttgacacgatgagatatcatgttgttgtgctcgattcccctggccataaagattttgtcccaaacatgatttctggggcaacacaagctgatgctgcaattcttgttatagatgcctcacttggttcatttgaagctggtatggatggcagcaaagggcaaacaagggagcatgcacaacttatcagaagctttggtgttgaccgggttatagttgctgtaaataagatggatgctgttgcgtactcccaagatcgatttgattttataaggcagcagctgggagtttttctccacttttgtggtttcaaagattcttctctatcttggattcccatgagtgccatggaaaatcaaaatttggtggcatccccttctgatgctcgtttaaaaaactggtatggtggaccttatctattagatgcaattgactctctccaacctcctactagagaattctcaaaacctctactaatgccaatatgtgatgtcatcaaatcaactacacttggacaggtttctgcctctggtaaactagaagcaggagctcttcggagtggatcaaaggtcttggttatgccttcagctgttgtgggaacagtacgctcattggagcgtgactctaatgcttgtactgttgcaagagctggagataatgtagctgtaacgttgcaaggtgtggatggaaatcatgtgatggcaggagatgtactatgccatcctgactttcctgttgcagttgctaagcatttggagttgaaagtgctagtgttggatggtgcaagtcccatattggtgggcacacagttagagtttcacatacaccatgcaaaggaacctggcagagtttcaagaatattatcagtacttgatcccaagacgggtaaggtgaccaaaaagtcacctcgctgtctctctgcaaagcaaagtgcagtaattgaggtgattttgaatgagacagtctgtgtggtagagttctctagttgtaaagctcttggaagggtatccctaagatcaatgggaagaacgattgctgttggagttgtgacaagaataattgaagaacaaggttaa

SEQ ID NO: 267 - DNA, 306 bp, Glycine Max
atgcccgggcatttacttggcggacctgtgcctctttctccggcggccggcgtggaaccgccggtgatagtgaagaaattgctgacgacgaactcgacactcgtgttcttgatcatgtctgtgatggtatccatcaggaggaagtttcttgtgttgaggttgagctggtttgcagcaaggagcagttccatcaactcctcggtggagcggaacgacgacgtcgccgccatgagcatcaatgaagaactgcaccatctccatctctttcgcaataaaaggttccatctcgaagatgacattatctga

SEQ ID NO: 268 - DNA, 490 bp, Glycine Max
atgccctttaaccaagatttatttgactttttatttgcaccaactcaagcattgaattctcaaggcgaggaggttcatatgccaattgttgatgatgctagctataattctttggatttgggacacaacaacttggaaaacaatgatgatgaaactttaaccgaagaggatatctctaatttgatagatttattacttgaagatgatacttatatctttgatttcattgagttagatgatgacaaccacaacacaggaaacaatggagtttcaagagtggaatttgcaaatcaagttagtattcaaaatcttgaaaggatcagaattcatgaaaatccagagcaatcttcagacttgatgtgttccatttgtcttgaggaatttttgattgggacgataacaattcgcttgccccacccttgctatcacatctttcatgaacattgtataacaaggtggcttaacatgaataatacgtgtcctttgtgtc

SEQ ID NO: 269 - DNA, 828 bp, Glycine Max
atgcctattcctaggtttatgctcttttcatcccagcatcgctccactgctgcggccctcgctcttcttcgaaggtgcgttccctctacgacaactcaatctgttaggtattcaaaatcaacaagtcacggtaaaacaaaacattatcttcatcctgtattccaaccagaatccagctccgcctcccaggtttctcgctcatggggtgcctatgttgttccagctgctgttcttggatttgctgggcttgcagctttttttcactataatgatgagagaagagcggttcccaaaggtcatcagggtggtggcctcagaaatgttgccaatggacccataattgggggtccatttacactaattaatacagagaaacaagcaattacagaacgtaattttcttgggaattgggtcctcctctactttggttatacctcatcccccgatcttgggccagagcaagtccaaattatggccaacgcaattgatatattagaatcaaaacagaatctcaagattctaccagtatttgtttccattgatcctcaacgtgatactccctcacaacttcgtgcttaccttaaagagtttgattcaagaatcataggattaactggacctgttgcagctattaggcagatggctcaagaatatcgtgtttactttaaaaaggtagaagaggatggcaatgattatcttgttgactgttcccacaacatgtatttgctgaatcctaaattggaggttacgagatgctttggagtcgagtatagtgcagaggagttgtcagaagcgatagtgaaagagctgaacagaaacccctcttga

SEQ ID NO: 270 - DNA, 618 bp, Glycine Max
atgcctccgcgctctccgtcgatcaacaaactctgcgtcgagaggctctccaaaaccaaaggtaaaccaaccctcctgtcgtttctgatagttcaaaacgcagaatcaggtttaggtggtgacccttatcattggcctggtcaagcaatggggctttcattctcagtccctgaaggagtcaaagtcccttccagtttggtaaatatatttaaggagcttcaccaagaccttggctgctctattccaactcatggaaatcttcaaaaatgggctttgcagggtgttctcttactcaatgctgttctcacagtcaggaagcatcatgcgaattctcatgccaaaaaaggctgggaacaatttactgatggtattatcaaagacaatctcacagaagatggaagagttgtgtttctgttgtggggaaacaatgctcgggagaaatctaggaaccatcgggtttttcgggaccaaatgtggagtgaagagtttctagctcgtctaaagaagctggaagaagcatggaaagctgctaaaaatgttggtgacaaatttccggccaataccgtctacaacaaaagcaaagagccaatgaaatggattccggcaggggaatattga

SEQ ID NO: 271 - DNA, 978 bp, Glycine Max
atgccttcaggtgctaggaagagaaaagctgccaaaaaaaataaggcaaagaaaaacagcatcaacccatcaaccaacaagcccaaaggaaatggtgatttgaagtcgcgggatgagaaaggaagtgatggtggtgagggtaattctcctgcatttcgtgaacatggtgaccatcgtaatccattcaatgatgggagtgaagatctggaagagagagggccatcagctgctcaaccacatgctcctgatgtcgtcgggtccctggaagaagttgttagtgatgtcaagattgaccaggtgttgggaggaaaggaagatggtgttgttttggtagagagaggtttgaagtctgaggagtgttttgagagcaaaactgcaagttttgagaatgggaatggtggcaacactccaaagggtcaatccctcgctgagaagaactcaaaggatggaaattgtaactcagttgaagaggcagttgcaagtcataagttggttaagtccattgattcttccccttccaaaatgacttcaattactgaaatgccaccagttgaggagactgttaattcacctgctgactcttctgttaatttagttacagccatggcttctgtgtctgaggtggaaaagagtgatactggaatgttactagagaagtcagtagtccatccagtagaagtgaccaatctcgcaatgaagataaatgacgataacgtatattccttaaccaatgataatgtgacaatgtcaagtgtggaggagcctaagccaaaggaatgtgatagtaaaatgttaacttcaccgtctgctagtcctttcactaaatttaccaatggtaaagaacatattaaggattgtaagactgcaaaatgttctgaaaatcagcctcatgtagcattggctccaaatttggtgcaaaagacctcctggttgagttgctgtggattgtttgaagttctgtcaagttcaaatagataa

SEQ ID NO: 272 - DNA, 933 bp, Glycine Max
atgccttcaggtgctaggaagagaaaagctgccaaaaaaaataaggcaaagaaaaacagcatcaacccatcaaccaacaagcccaaaggaaatggtgatttgaagtcgcgggatgagaaaggaagtgatggtggtgagggtaattctcctgcatttcgtgaacatggtgaccatcgtaatccattcaatgatgggagtgaagatctggaagagagagggccatcagctgctcaaccacatgctcctgatgtcgtcgggtccctggaagaagttgttagtgatgtcaagattgaccaggtgttgggaggaaaggaagatggtgttgttttggtagagagaggtttgaagtctgaggagtgttttgagagcaaaactgcaagttttgagaatgggaatggtggcaacactccaaagggtcaatccctcgctgagaagaactcaaaggatggaaattgtaactcagttgaagaggcagttgcaagtcataagttggttaagtccattgattcttccccttccaaaatgacttcaattactgaaatgccaccagttgaggagactgttaattcacctgctgactcttctgttaatttagttacagccatggcttctgtgtctgaggtggaaaagagtgatactggaatgttactagagaagtcagtagtccatccagtagaagtgaccaatctcgcaatgaagataaatgacgataacgtatattccttaaccaatgataatgtgacaatgtcaagtgtggaggagcctaagccaaaggaatgtgatagtaaaatgttaacttcaccgtctgctagtcctttcactaaatttaccaatggtaaagaacatattaaggattgtaagactgcaaaatgttctgaaaatcaggttttacattttctctcatatacattacaagttttacaagatttgtaa

SEQ ID NO: 273 - DNA, 1488 bp, Glycine Max
atgcctttttcaactcttactttaagagtgatcagaaatgagattccttttgacttcataagaagaagagtatctatcatcttagaaacagaagacaaacactcacaattctttggcaggttcctggtaacaaaaggagcactgttagaagtattgagagtttgttctttcattgagaatttcgataaagatgaaatttcgcccttctcttcagatgattatcagcggattttaaatctctcagaagatttgagcaatgaggggttaagggttatagcagtagctataaggaagctgaaaatgaaccttattagtatttgtgaatatttatggagagagatagaaacagagtttctacgcaagccgcaaaaatgcgaaacaagtaatggaagcaaaagagaagaggaggatattgaaagagacatgatgttccttggcctcataacatttttcgacccaccaaaggactcagcaaagcaagcactgcggcgtttgtctgagaagggagtgaaggcaaaggttttaactggtgactccctctccttgacaacaagggtatgcagggaagttggcataagcaccactcatgtaataacaggtcccgaactagagcaacttgaccaagacactttccatgaaacagttcaaagagccacagtactagcccgtctcaccccaattcagaaacaacgagtggtgcaatccttgcaaacaattgaaaaccacgttgttgggttcttaggagatggagtgaacgattcactagccttagatgctgccaatgtaagcatttcagtggactcaggtgtagccattgccaaagacatggctgatattatcttacttgagaaagacctcaacgtgcttgttgcaggagtggagcatggtagaatctcttttggcaacacaatgaagtatgtaaagatgtcagtgatagctaacttgggaagtgtcatttcactcctcattgcaacacttttattcaagtatgagctcttaacttctagacagcttcttactcagaatttcatctacagtgtgggacagattgccattgcttgggacaaaatggatgaagagtatgttaagacacctcacaagtcctcagagagaggcttgtccatgttcatattgtggaatgcaccagtgtgcaccctttgtgatgtggcaacacttttgcttcttcggttttattacaaggcttacaccgatgtgactcgaaagtttttccattctgcttggttcgttgaaggtcttctattgcagaccctcatcatccatttgataaggacagagaaaaatcctttcatacaggatgttgcatcttggcctatcttgggattctccgttatacctatctcatatttcggatttttggtgcttctttttctgggtgaaacttattgcctgcatttgtatgagttgcatattttcccaggccttgtattaattaacaaaaccggtttaagattattcagacagaattaa

SEQ ID NO: 274 - DNA, 345 bp, Glycine Max
atgcgacagtgtcgagctttgatggggtttttgacaagttccgatcagaggctccaacaaacaaagccaatctcctcctctgacccagctgattgtgtgagagctgaacctgtgatctacaagaagctggaggcttcacctgatgacattgcacttttgagagcttatgttggagatagaccaacatggaggaatccccagcatccatggaggatggatcccaggttcaagctcactggggtgccaaccttgatccgttgggagaacaacaccgtcaaaggtcacttggaggatcatgaagctcacattgaaagcaaaattgaagctcttgttgctgacaagtga

SEQ ID NO: 275 - DNA, 1251 bp, Glycine Max
atgctaaattttggaaggtccagaagtcagtcaagggcagccagagctacaacaatgggaggcatggattatgcagattcaaaaaagaagggcaattttgttgggaaagtatttcttgctgctgcattaacaacactgtgcataatcatgatcaagcgatctccatctttgaattcccctagcccgttttctgttcgtgaacctggggtcactcatgttttagtaacagggggtgcaggatatattggttcacatgctgctctacgacttctgaaggagaactatcgtgtcaccatagtagacaatctgtcacgtggaaatttgggggccgtcaaggttcttcaagacttatttccagaacctggaaggcttcaatttatttatgctgacttgggagatccacaatctgttaataaaatatttttggagaacaaatttgatgccgtgatgcactttgctgctgttgcatatgtgggagaaagcactgctgatcctcttaagtattatcacaatattacatcaaacaccgtgttggtattggagtctatggctaaacatgatgtgaagacattgatatattccagtacatgtgcaacatatggggaacctgagaagatgcccattacagaagaaacaaagcaggtcccaataaatccatacgggaaagccaagaagatggcagaagagatcattcttgatttatctaaaaactcagacatggcagtaatgattctgagatacttcaacgtgattggatcagatcctgagggaagattgggtgaggctcctaggcctgaactgcgagagcaaggtcgaatatcaggtgcctgctttgatgctgctcgtggtattgtacctggtttgaaggtaagaggaacagactataagacggctgatggaacttgtgtacgagattatattgatgtaactgacctggttgatgctcatgtaaaagctctggaaaaggcacaacctagtaatgttgggatctacaatgttggcactggaaagggtagttcagtgaaggagtttgtggaagcttgtaaaaaggccacaggggtggacattaaagtggactaccttccgcgtcgtccaggcgattatgctgaggtgtacagtgacccatcaaagatcaaacgtgaattgaattgggttgctaagcacactgatcttcaacagagtttgaaggttgcatggagatggcagaaatctcatcgtgatggttacggggtttcaaatgcattattttga

SEQ ID NO: 276 - DNA, 714 bp, Glycine Max
atgctaatggagaccagccatgcaaggaacaggaggaaccatagcagaaccatagcaggaggagccgttgcaaggaggagctcgacgatgctgttggagaccagccgctgcagaaccagcaggttacagaagaacctaagcgaatcgcactaccggtcactcattgatgagcttattcgtgcaggcggcgatttttcaagccgacacgggagtttaatgccccctgaatccacatccataattttgaaagaaataatgacggctctcacacaaccaaatattggtctacttggactgtatggatcgagtaatgcgaacaaggaaaacgtagtggagaaagtcaccaggagagttgagagggacgggctgtttaatgtggttgtgaagacatgcgtgatgaaaaagccagatttaaaaagaattcaaggagaacttgggaatgcattgggtctacaactccatgagaaaactctaaaggaaagagctacccgtttgtgtgagagggttaaaatggaggacaagatccttatcattcttcatgatcttcacggtcaaatcaacttggccaagattggaataccctttgggaatgaccacaagggttgtaaaatcttgttagtaactgagaataaagaggtgttgtcccacaaaatgaaaacccaaatagaattttctgtggacgaggagccgtcaagttctggtttaatttattaa

SEQ ID NO: 277 - DNA, 864 bp, Glycine Max
atgctactcacgtgttaccaccatcccttccctcattcactttcttcaacctcaacccactcgctcttcaccacaaacagaaactgcaacctctctctctctttctccatcgtaacctcgcgccctctccacctcacaacgcacaccgctcaccgcttcaattccctcacagttcgagccgactcatttcgcctccgatccgaacatgccgccgccgattccaatttcgactcgctcctttcgctgctcgagttctcgtgtctgctctcttccgccatatcctccgctgccgccgctgtgctcgcgggttccaagaacgagctcatcgccgggatcggtgccagagctgctccgttcggcggcgcgttgcttgtggtcggggttctggtcggcgcgtggattcggaggcggcagtggaggcgcgtgagtgtggaggctgggaagggcgggttggaggtgaacttgctggagaggattgagaagttggaggaggatttgaggagttccgcgacggttgttagggttttgtcgagacagctcgagaaattgggggttaggtttagggttacgaggaagggcttgaaggatcccatagctgagactgcggctttggcccagaagaattctgaggctgctagagcattagcagtgcaatcagacattttggagaaggaacttggtgaaattcaacaggttttactagcaatgcaggaacaacagcgaaaacagcttgatctgattcttgcagttgggaaagctagtaagctatgggaaagcaagcaagaaaccaatgaacgacatgatacgttagaattgtctaattcagctgaggatggggtaaaacaggaggtgcaccaaatatga

SEQ ID NO: 278 - DNA, 747 bp, Glycine Max
atgctactcacgtgttaccaccatcccttccctcattcactttcttcaacctcaacccactcgctcttcaccacaaacagaaactgcaacctctctctctctttctccatcgtaacctcgcgccctctccacctcacaacgcacaccgctcaccgcttcaattccctcacagttcgagccgactcatttcgcctccgatccgaacatgccgccgccgattccaatttcgactcgctcctttcgctgctcgagttctcgtgtctgctctcttccgccatatcctccgctgccgccgctgtgctcgcgggttccaagaacgagctcatcgccgggatcggtgccagagctgctccgttcggcggcgcgttgcttgtggtcggggttctggtcggcgcgtggattcggaggcggcagtggaggcgcgtgagtgtggaggctgggaagggcgggttggaggtgaacttgctggagaggattgagaagttggaggaggatttgaggagttccgcgacggttgttagggttttgtcgagacagctcgagaaattgggggttaggtttagggttacgaggaagggcttgaaggatcccatagctgagactgcggctttggcccagaagaattctgaggctgctagagcattagcagtgcaatcagacattttggagaaggaacttggtgaaattcaacaggttttactagcaatgcaggtgagaagagattacacgagagtcaagacaaactaa

SEQ ID NO: 279 - DNA, 249 bp, Glycine Max
atgctcaaccatagcacaataatggcaccccactattcactattctgtttaacatcttctactctagactgcaaaaggcaacaagaaaatctacttgtattccaagcacttgcctacgatagcaataatgtcaacaccttagcaagagttaaacatgtaaaacatcattttgatacctgcttattccagtcagtattgccaatgcttcataattcctcaatggctcaatttaacctaaaaatcctgtag

SEQ ID NO: 280 - DNA, 1677 bp, Glycine Max
atgctcactagcctagtcccaaccttttggcgccaacgccactccttcttcgtgctcgcgacccttttctcctccactcgggatgtgtaccacgcgaacctcgacatcgtcgccctctcacgcgccgggaaagtcgacgccgcacgcaaactgttcgacgaaatggcaacaaaagacgtcgtcacgtggaactccatgctctccgcctactggcaaaacggccttctccaacgctccaaagcactcttccactccatgccgcttcgcaacgtcgtttcctggaactccatcatcgccgcctgcgtccaaaacgacaacctccaggacgcgttccgctacctcgccgcagcgccagagaagaacgccgcgtcgtacaacgccatcatctcagggctcgcgaggtgcggccgcatgaaggacgcgcagaggctcttcgaagcgatgccgtgtccgaacgtcgtggtggagggagggattgggcgcgcgagggcgctgttcgaagctatgcctcgaaggaactcggtgtcatgggttgtgatgataaatggtttggtggagaatgggttgtgcgaggaagcgtgggaagtgtttgtgagaatgccgcagaagaatgatgttgcgaggaccgctatgattactgggttttgtaaagaagggaggatggaagatgcgagggatttgtttcaagagattcggtgcagagatctcgtttcttggaatataattatgacgggttatgcacaaaatgggagaggggaagaggcactgaatttgttttcacaaatgatcaggactggtatgcaaccagatgacttgacttttgtttcagttttcattgcctgtgcaagtcttgcatcactcgaagaaggaagcaaggcgcatgctcttttaattaagcatggctttgattcagatttgtcagtatgtaatgccctgattactgtgcacagcaaatgtggtggaattgttgattctgagttagtttttggacaaatttcccatccggaccttgtttcatggaacactatcattgctgcatttgcacagcatggtctgtatgacaaagcacgctcctactttgaccagatggtgacagtcagtgttcaacctgatggcataacttttctgagtttactatctgcgtgttgtcgtgctgggaaggttaatgagagcatgaatctatttagtttgatggttgataattatggtattccaccaaggtctgagcactatgcttgcttagttgacgtgatgagtcgagcaggtcagttgcagagagcttgcaaaataatcaatgagatgccattcaaggcagattccagcatctggggtgctgtgcttgcagcctgtagtgttcatttaaacgtggaattaggggaactggcagctagaagaattttgaatttggatccttttaattctggtgcctatgttatgctgtctaatatatatgctgctgctggcaaatggaaggatgtccatagaatcagggttctgatgaaagagcaaggagttaagaaacaaacagcttatagttggttgcagattggaaacaaaacccattatttcgttggaggggatccatcacatcctaatattaatgatattcatgttgctttaaggagaataacattacatatgaaggtaaaaggtaactatgaagaaattttcttttaa

SEQ ID NO: 281 - DNA, 1257 bp, Glycine Max
atgctccataaatatgggttgctacaacataaaaaagatacatgcatagcagagggctttaacaagatgggattactttctcttccaccaattgaaccagttaaactacaaactgaggtggattttgctcagaaactttgtgagatagctcatttcttggagatcatccgaaatctgcaatgtagacataggtcaatatttcaaagggccagtcaaggattggctgacagaggagaagagtcatctttaataagtacagacatgttgcaggaagaatcccaactttcaattcttccatcagatttagagtcattggatgtgttgaaccaacatgagctttcttttcctcgaccaggcagcaacaataatgaaaatcttgcgctggtgcctgttgattctgagtctcatttggtctcagatgaatttggctacatatctcatttaaccccattaggaggaatcttaggaaagaaagttttgcctgtggaaaatccaagagagatgatggcacgttggaaggtagataatctggaccttaagactgtggttagagatgctttgctctctggccgtcttcctttggcagttctacatcttcatcaaatgaatgattttgttgctgataaagagcctcatgatacttttactgaagttcgtgacattggcagagctgttgcttatgaattatttttgaagggtgaaactgaacttgctgttgctacacttcaaagacttggagagaacgttgaatcttatcttaaacaacttctgtttggcactgtaaggagatccttgcgaatccagattgctgaggaaatgaaaagatatggttatctaggaccatatgagtggaaaatattggatgatatgtcactgattgagtgcagtttaactactgggaagaaaaatttccatgagctgagacttgtaatcttatttatccctgtgcatgtatatgagaagagtctctatcctagcagtagcttctggaaatcatataatcaccgactgaaagaaatcagcattgcaccggactctgttttaccagtggaaaataaattaaggctcttgcataaccattcatttgatagtcatgtcattgaatgtggtgagattgatggaattgtctttgacgcatggattgatattagtgaaagttcctctgctctggaagttgatgaagatgatgctcatgttggatattgggctgctgctgctgtctggtttgatgcctgggaccaaagaactgttgatcgt

SEQ ID NO: 282 - DNA, 1893 bp, Glycine Max
atgctccatgcttacgcacagaaccacagactccgcgaagctatcgacctctttcgtagaattcccttcaaggacgtcgtttcctggaactccatcatcaaggggtgtcttcattgcggcgatatcgtcaccgcccgaaagctgttcgacgaaatgccccgccgaaccgtcgtgtcgtggaccaccctcgtcgacgggttactgcgcttgggaattgttcaagaggctgaaaccttgttctgggcaatggaacctatggacagggacgtggctgcgtggaatgcaatgattcatgggtattgtagcaatggtagagttgatgatgctttgcaattgttctgccaaatgccttcgagggatgtgatttcttggagttccatgattgctgggcttgatcacaatgggaagagtgaacaagcattggttctttttcgtgacatggtggcttctggcgtgtgtttatcttctggtgtcttggtttgcgggttgtctgctgctgctaagataccggcttggcgtgtggggattcaaattcattgctctgtgttcaagctgggtgactggcattttgatgaatttgtttctgcttcgcttgtcactttttatgctggttgcaagcagatggaagctgcgtgcagagtttttggtgaggtggtttataagagtgtggtgatatggactgctctattgacagggtatggtttgaatgataagcatagagaggcattggaggtgtttggagaaatgatgagaattgatgtggttccgaatgaatcttccttcaccagtgctttgaattcttgttgtggattggaggatattgagagggggaaagtgatccatgctgcagcggttaagatgggtttagaaagtggcggatatgtgggaggttctcttgttgtcatgtatagtaaatgtggttatgtcagtgatgcagtgtatgtatttaaggggattaatgagaaaaatgttgtctcgtggaactcagtcattgttggttgtgcacagcatggatgtggcatgtgggctctagcactctttaaccaaatgttgcgggaaggggttgatcctgatggaattacagtgactggtttgctttctgcttgtagtcattctgggatgttacagaaagcaaggtgcttcttccgatactttggccagaaaagatcagttactcttacaattgagcactatacaagcatggtggatgtacttggacgatgtggagagctcgaggaagcagaagcagtggtgatgagcatgccaatgaaagcaaattcaatggtatggttggctttattgagtgcatgcagaaagcactctaatttagatttagccaaaagagctgcaaatcagatatttgaaatagagcccgattgtagtgctgcatatgtattgctgtcaaacttgtatgcatcttcgagcagatgggctgaagtagctttgatacggagaaaaatgaaacataatggagttgtgaagaaaccaggatccagttggctaaccttaaaaggacaaaagcacaaatttctctctgcagataggtctcatcctcttgctgagaaaatttatcaaaagctagagtggctaggagtgaagttaaaagaattaggttatgttccagatcaacaattcgctttgcatgatgttgaaactgagcaaaaagaagaaatgttgtcttaccatagtgaaaggcttgcaattgcatttgggttgcttagcactgttgaaggcagtgcaataacagtaatgaaaaatctacgtgtatgtggtgattgtcataatgcaataaagcttatggcaaagattgttgaccgtgagattgtagtacgtgattctagccgctttcatgactttaagaatggtatatgttcgtgtggggattattggtag

SEQ ID NO: 283 - DNA, 828 bp, Glycine Max
atgctggaaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgccattcctggatcggacacgaaggagttgagttacgagtgttttaacaagagtgatgaggtgggagggggttcttctgtgttccatgtggatttcaaagatggctcttctgatagtgactcaagcgcgatcttgaacgaggagaacaacaaccacagccccaacaataacgcggcgatttcgtcgtgtggggttctgcaaagtcacgggcttttgttgtcgccttcttcgtcgtcgatgaacaactgtttccagttccagaaacagtaccagacgacgacgacgcagtacgtaaagatggaggagcacaattttcttagcgccgacgaggcctgcaatttcttctcggatgaacaagcaccaactctgcagtggtactgttcagaggaatggagttaa

SEQ ID NO: 284 - DNA, 1116 bp, Glycine Max
atgcttattttcaacgccaacaacagaagcgtgcttgcttcgttgcttggttggttcaattgtatcagtatatactcagaagccatgatattagttgatggcattccattttctacccattcatctcaccctcagggaaaggatattctacttgatttgttggaaaatcccattctggtatcagcctcaaactctttgaaggctaactcagagaggaagttctcagtatctgatgagtctagtccagagagatcaaaatgggtttatatattccagagagaatatgctaccgttgaccccgcccttgttgattttgttggcaccgatgaagcaacaacgtgtgttggccttgttattcggaaccaaaagaatggaatgacgtcagttgcccatatggattcaccaaaaattgtagaaatgggcctctcccaaatgttatcatcactcgtcgacaacagtttggagactgagtttgatgtgcatcttattggggggtttgaagatgtctcactgcaacatgcaaatggtagcacagtatcagaaagccctgcagatttggatggttattcctttcctctgtgtttaaagattgttcacactttatggtcaagagaggagaagtttcacatccgaactatctgtgttcttggacataataccagaagggattctgatggaaacacatacccctttttcaatggatttgtggcggagactacaacaggaatcatcatcccagctatctttgatagaacttctagatgtccagatgaaattgtcagaagaatacgagtatccgtgtcttatgaagatgccaactggaacggaaagttactagaaacatatgattctggcattgactgtttcaaaatcgctccttgtcgctggactcttcgccaaaatcatattgcttcatcacttctgaactattctgattccgaaattctttcaatatgttctacatcacctactgctgaagcctcagattttgtggagaatttaaaaaggcagtggaattatttgatcgagcatccacactggacagaaacctttcccaagaaacagcctcgcacttttgcaaggagttcttctgatggaaggtggataaggtgttga

SEQ ID NO: 285 - DNA, 1509 bp, Glycine Max
atgcttccaccttatttggttaagcttcctcacctcagacatgttgattttgctttgaactacctaagtggtacgatcccaaaggagtggggttcaacaaaactaactaatatctctctatttgttaatcgtatatcaggggaaattcctaaggagttgggaagtattaccactctaacatacttgaaccttgaagcaaaccaattttctggtgttactttgaatttctatttattttccaagattcaattctatcactgtcagagtaaatttgaaagattaaacactctgattttatcatccaataaattgtctgggaagttacgggtgacatttgctaagtttcagaatttgacagatttcaggataagtgataacagtttcaacggagaaatacctagcttcatacagaattggaaattacttcaaagattagaaatgcatgcaagtggactggagggacctaccccatcaaatatatctcttttaagtaatttaaatcagttgaggattggtgacataaatggtccaagtcaggactttcctatgttaagaaacatgacaggaatggcaatattggttctgaggaattgtcatattactggagagcttcctatttacttctggagtatgaaggatttgaatatgttggacgccagtttcaataagttggttggggaaataccagtcgctgcgcatgtggggcatctgagatttctcttcctaactggcaacatgctaagtggtaatgtacctgagccagtcttgatggatggaagcagtgttgacctttcttacaacaattttatgtggcaagaaccagatcaacctgcttgtagagatgacctaaatctaaacttaaacttgtttcggagcttctcagggaccaaattacaggggattcttccatgttcaaagatctccaattgtccagcatattcacattgttttcatgttaattgtggtggaaagaatgtaaaggtgatggaaaatgatgaaaatattcactatgtaggagatggaggtgtgttaggtagcggtgctgctaatatttcattgatcatgaaaatcactggggatttcttggatgatggtgatcaattaaattcacgttaccttaggtctttgccatcttcagatttacctgagctatataaaacagctcatgttactccaatttcgcttacttattttcactattgcttggaaaatgggaaatatactgtaaaactccacttcgcagaaatacaattttcaaatgataacacatttggaagtcttggaaagcgcttatttgatatttatgttcaggaaatattaatttggaaggattttaatattgaatgtgaaacacatgctgctcaaaaaccatatatactgtccttacatgatgtcaatgtaacagaatattctggagattcaattctactgggctggcaaggggactacaaggattcctgttggtggagtttatggtcccctcatatcagctttctctattgtttctga

SEQ ID NO: 286 - DNA, 1653 bp, Glycine Max
atgcttcccagcaccgacttccaccgactctgcctccacctctttcgcagaatcgttcccgaagccctcctctcggtgtatgttagacctgctggtagttatgtgatgggttggagctgtggtgggttgcactgtaccctggagaggcagaggcagagggcattgtcattcttgtgggtcattttaatattcctgcaggcttgcgtgctgccaaggccacgctttccaattcgcaagatgaatgttaatgttgtccctgaatgtaaggctgtggttcttccgatggtgaaacacccatttgttgttggtttcttggttgctgagcttccattggtggaggaaaagtgccagaaatctaaaagtgatgggccagaaaatctcatgactgttgaggaaccttattcatttcctccctttttggatttagacaagaagtcaagggaaattcagaatcttcaggtcaaggatgaggcagttggtatgcataatttcacttctgagcaaagatcaaatactgtcaacatttcagtctctagctatggcatatgtcatggatcagttgccttgaaatttgcatttcataacgtttgctacttgagtctcatggttatgctacatttacggaaagcaatgttaattcagcaatcagcatggcaaaataatgtcaggatggctaatctggttgagcaaatccgtggtccactttcaaagacaaagaggactcagatttcatatgacattgttgaagacctcttggtgcaaggtgatcgtctgagggatgttctccatcaactacaggataccgtttatttgacaaagggctttggcctcacttgcattcaattgtgggatttcctatttctctatactttatgtattctcttatcaatttgcgaatcacctcttctatccaaagaagaatctgtggtcatgaatttttataactatattctttcccttgtcaaaataccaagtttggtcatgaaatcatggttttactcacatacttgctctccaggggatgtctctgcaaataaaatgaaaaaatctagtgagtcactttctctaagtgctgctgtccaggatatagagatgccactgccacctttggcccttgctccattgcaacatggaatcagatcatgcaatgtttctcaagtattggaagacttggtggattcagtgagaccacttgcccagggtaaaaaacgtgtagtagaactaagtgaactctcatcatcacctttgctagctgctgtagaagaacctgcattgcaccaggctttcagcaatcttattgaaggtgctttactaatcacacatgttggaggaaaggttgaaattgtatctaaggcagcaccagctggtggtacccttgtacttattgatgatgatggacctggtatgcactatatgactcggatgcactcactcacacctcatggacgagaactgttgtctgataatatgattgaagacagtatgacttggaattatggctttgtcgtccgcattgttttgccttggattaaagatgctcctcttggagctgggggaactcgtgtggaactctggcttccttcatcaattgtacaagaccacgtatctgaagcttcagcatttgtaccatgtgaatcccttaatccaatataa

SEQ ID NO: 287 - DNA, 1266 bp, Glycine Max
atgcttcgctccaatggctttaggctccttcgatcgctgcccgaaaaactcctccgccacgccaacgaacccatatatgatggagtgtgccaaaggggttataggacattgagttctggtctttgtaatccatccagagttattgggaatttttctccaaatgttggaaatggtgttaatttgaagaacttgttgctttttggagccgcggatacatattgggggacatctagatccgttcatgggtcagcatcattggcaagggactattacgaagtgcttggtgtgagtaagaatgctagttcttctgaaataaagaaagcatactatgggcttgcaaagaagctccatccagacacaaacaaagatgatcctaaggctgaaaagaagtttcaagaagtttcaatggcatatgaggttttgaaggatgaggaaaaacgtcaacagtatgatcaggttggccatgatgtgtatgtaaaccaagaaagcaccagtggttttggaggcaacagtggctttaatccatttgagcagatgttccgtgatcatgattttgtcaagaacttttttcatcagaatattggtggagaggatgtcaagactttcattgaactatcttttatggaagctgtccggggatgcaacaaaactattacatttgaaacagaagtgctttgtaacacctgtggtgggagtggtgtgcctcctggtacaagacctgaaacctgtaggcgctgtaaagggtcaggagtgacatttgtacaaactggcatatttaggatggagagtacttgtggtacatgtaagggaactggcaaaattgtatcgaatttctgcaagtcatgcaaaggtacaaaggttatcaaaggaacgaaatctgtcaaattggatattatggctgggattgacaacaatgaaactataaaggtttatagaagtggtggtgcagatcctgatggagataatcctggtgatctttatgttaccatcaaggtcagggaagatcctgtcttccgtagagaaggatctaatattcatgtagatgctgtcttaagtatcactcaggtaatgttccttaatgaaaaagttttgagcctatgcctggttgtttatttcaggtatctattaacttatgtgtgcattttgttagtattagtttataattctggggatgcaaattggtggcatggcctagatagagaaaatgttgggaccatgtggggcatgtgttttttgtatatttgctgtcaatttgaaatcatgtga

SEQ ID NO: 288 - DNA, 249 bp, Glycine Max
atgcttctatttgcttcattttgctcatgtttagaagccagaaaacttgttctagacaagaagctgaacccatcttcaagaagggacagtttgttcctgagtgcactccctaagggcaccgtgccaccttcttcaccaagcaaaaaagggcactccatggaggttgatgagaagctcatagcacgacacctcataaccatcgatccagttcttctaagatctgttcctagccctggtgttggtcactaa

SEQ ID NO: 289 - DNA, 2070 bp, Glycine Max
atggaaaaccaccaaaaccacaaggtagaaccagaacctgacatagagaagaaccataaccaccgccaccaacagcaacaacaccgtaacgaagcgtggggcacctgggaggagctgttgctagcgtgcgccgtgaaccgccatggcttcacggactgggacgccgtcgccatggaggtccagtcgcgcaccacgcgcctcctcgccaccgcgcgccactgcgagcagaaatttcatgatctcagccgccgattcgccgtccaatgcaacgacgacgttcctccgccgcgccagaacggcgccgccgccgctatctctgatcacgtcccctggctcgacgaattgcgcaaactccgcgttgccgagctccgccgcgacgtccaacgcagtgacgtttccattctgtcgttgcagttggaggtgaagaggttggaggaggagaaagcgcaggaaaaagacttaaaggacgacgagaaaccagatctggcggaaagaaccgcgaacaacacagacaagacgttgccaaccacgggcgacgaatcagaccgggagaaccagtcggttaacgagtccaactcgaccggttcgcggttcgagaaaaccggagatggcgacgcgaagaccggaaccggaccggatccggtgccaacgtgcgagtcggtgcctccgagtgaggggaggaaagtggaggaagacgatgactcatccgagttacatgactcggtggctcactcgggcgaaggagggacgcgcgagagcagcgaggtgcagagctccgcgagcttaatgcgtaagaggaagacgcggcggaggaaggaggtttccggagccactgacgcctcgtgtccggcggagaacgacgaggcggcgacggtgaaatcagaaccgttggttggggttttggagttgatcaaggggcacgaacacagctcattgttcgagcgccgtcttgatagccagcaggatacggatagatacaaagacctagtgaaacagcccatggacttggaaaccatacaattgagactccaaaagggtcactattcctcatgcaccagtgcattcttccgcgacctcctcctcctcttcaccaacgccaccgtgttcttctcccatgactccctggaatcgcaggcggggcggcagctgcaccgccttgccaccgcggagatgaagaaccacggccaagcacaatcggatcctatcccccggaagaacgattcactccctccaaatgcaccattagctaaaccagattctctcctttccaagaacaaagcctctggtcctatattggtttgccgcaaacgcagttcaatgtcatccaaaccttcctctgccacctttggccaaaagggtgaccaacccgtcttcaatgacaagaaggaaaggccatcttctgatgcaaagccacccatgaagccctcttcttctgatacagacgaagaggagcttcccaaagctaaggaaaagcctgttactggagcaagaagcttgaggcggagcaacaagaacctcaatagtaatagtagtaataataataataagaaaccgtcctctatctccactcctaaggcagggtcctcggggaacaagccttcggagactgttaaaccggaaaagagcaaagcagaggggggggcagacaagaagaggagtgcagctgcagatttcctgaaacggattaagcgcaacacttcagcggaagcatcgaagggtggtagtggcggtggaagcgggggtggaggaggaggaggaggaggaagtagcagcagcagcaaaggtggtggaggtggtaatggtgccaaagagcagaagaaaatggtgaacaatggaaagggagacaaagggaaagaaagggcatcaaggcataataacgttggaggaggttcaggctctgcggataaaaggaataataagaatattgagaacagctctcagtcaaagaggagtgttggtagacctccaaagaaagcagcagagacaaatgcaggtagtgcaaagcgtgggagagaaaatagtgctagtgctggaaaggataagcgccccaagaaacgttccaagaaatga

SEQ ID NO: 290 - DNA, 1329 bp, Glycine Max
atggaaaccatgaagcccaaatcagcactgagcaataggagcaagaaactggcaaagacattccagaaggtgatgagcctccgaagtgcaacgaaactcgcttcaaacaatggcatttgcatgctcaattcccacctcaaaaatagagcaattatggaggctctaattgcaagactcttcgctggagtcaccaccatcaaagcagcatatgcagaactccaaatggctcagcacccttacaacaacgagtccattcaagccgcggatcaagccgtggtggatgaactcagagccatatcggagttgaagcgcaggttcttgaaaagggaccttgatctttcgccgcaagtcaccattatgctcgcggagatccaggaacaacaaagtctcatgaaaacctacgaaatcaccatcaagaggctcgaagccgaggttgatttcaaggacaataacatctcatcgctcaaaaaacacctcgacgagtgtgtttccttcaacaaatcgcttgagaagaaactcaactcgagtggctccttgtcattgtttgataacctcacactttcgtcgttgagtccatcccattttgttcatttccttcaccactctttaagatcagttagaagcttctccaagattatgatcgcggaaatggaatctgctcattgggatctcgaagcagcggttaagttcattcatccaaacgcagttttcaacaaaccaactcaccaaaccttcgcatttgaatcgtttgtttgcataacgatgtttgaaggcttcaactacccaaacttcaacgtccaagaagacaaaaacttacacaaccaaggagcagaaaacctctactttgacaaattcaaaaggctcaaatctttgaatccgaaacagtacttaacccacaacccaaactcttccttctccaagttcctgaaatccaagtaccttcaagtggtgcacgccaaaatggagtgctccttcttcggcaacttgaaccagaggaaggtggtgaactctggagggtacccagattctactttcttcatttcctttgcagagatggcaaagcgcgtttgggccctgcattgtttggcgttgtcgtttcaggacgatgatgtcactgtttttcaaatcaagaagaactcgaggttctctgaggtgtacatggagagtgtcacggaagaatctgtttcgccttctgccggggaatcctctgattccagctccggcgagcttagggtgggtttcacggtggtgccgggtttcaaaatcggtaagacagtgatacagagtcaggtttacctctctctagtgggttcttcggccagttcctaa

SEQ ID NO: 291 - DNA, 420 bp, Glycine Max
atggaaacgccaactgtaacgatacctaaaattggaccaaaaccgtcaaagaaattgaagcttcccacaccaaaggagctgatatcacactatgagtctcagggtatggactcgcaagatgcgtccttgaaggtcatcgaggatcttcagaaggcgctgtttggagtaatatcctctggcaaaggtaaacatgacaagctattgactgagtcttctaggaagattgatgcaattagcaatcgactcactgttcttgacatgaagcttgattccaaacctggttatgttgagacttttgcaattgggcttgcctcgggagctgccctgaaagggattggtgcaattgtgcctcatattattgcccctcttttccagatatggaactctgttttcactgccactaaatcttccccccaatga

SEQ ID NO: 292 - DNA, 1428 bp, Glycine Max
atggaaagcattgccgcgcagctgaagcgcggcatctcccggcagttctcgtcggggtcgctgcggaggaacctctcgcgccagttcactcgccaagcctctcttgatccccggcgtaacaaccagcgcttcagcatcggccgccagtcctctctcgatcctattcgccgtagccccggccccgtccagcccgagctcaccgtgcccgagaacctggactccaccatgcagctcctcttcatggcctgccgcggcgacgccaagggagtcgatgatttgctcaacgaaggcatcgacgtcaacagcatcgacctcgacggccgcaccgccctccacgtcgccgcctgcgaaggccacgtcgaagtcgccaggctcctcctcacccgcaaggccaacctcgacgctcgcgatcgctggggcagcaccgcggccgccgatgccaaatattatggaaatacagaaatttattacatgttgaaggctcggggagcgaaagtgccgaaaaccaggaagactccaatgactgttgcaaatcctcgtgaagttccggaatatgaactcaacccgttagagctacaggttcggaagagtgatggtatttcaaagggaacataccaagtagctaaatggaatggcaccaaggttgcagtgaagatacttgataaggacagttattcagatcctgataccataaatgctttcaaacatgaactcacattattagaaagggtgcggcatccgaatgtggtccagtttgttggagctgtcacccagaatatacccatgatgattgtgagagagtaccattctaagggtgacctggcaagctatcttcaaaagaaagggcgcttgtctccatcaaaagttctacggttttgtcatgatattgctaggggcatgaactatcttcacgaatgcaaaccagatccggttattcactgtgatttaaagccaaaaaatattttgctggatagtggagggcaattgaagatagctggatttggcactgtgagattttcactaatttcacctgatgaagcacagctggtacagcctgagcctaacattgatctttcaagcttgtatgtggcaccggagatttacaaagatgaagtttttgatagaagtgtggatgcatattcttttggtctcattttatacgagatgatagagggtacacagcccttccatccgaagtcctcagaggaggcagttagactgatgtgcttagaagggaaaagaccagcattcaagatcaaaacaaaacattatcctccggagttgaaagagttgattgaggaatgttgggatccaacacctgttgtgaggccaacattttctcaggtcattgtacggttggacaaaattgttgcaaattgctcaaaacaaggatggtggaaagatacttttaaactcccttggaaataa

SEQ ID NO: 293 - DNA, 2229 bp, Glycine Max
atggaaatggaagaaggtgggagcaggggtgcgcggagaaggggatgcacgtttcagaagaacgatttcttcccggaggaatcgttcaagagctggggtagctacggaatagcgttgagggagacgccgtggaagtttaagaatcgggtcatgacccgatccaaggacgagacggaggtggtggagatgaaggggcggagcagcaacgagatgaagaagacgctcaactcgtgggacctcatatggttcggcatcggcgccgtcatcggctccggcatatttgtcattaccggcctcgaggcacgtgacgctgccggtcctgctgtcgtcttgtcctacgttgtttccggcatctccgccttgctatccgtcttttgctacacagaattcgccgtcgaaattcccgtcgcaggtgggtcatttgcgtacttaagggtggaattgggagacttcgtggcgttcatagccgccggaaacatcctcctggagtacgtaatcggcggtgccgccatatcgcggtcatggacctcctatttcgccaccctctgcaaccaccacccagacgagttccgcataataatccccaacgtgaatcccgactacggccacctggaccccatagccgtggtggtcctcatagccatcgccaccctcgcaatggtcagcaccaaagcctcctccctctttaacaacatcgccaccatcgtccactgcctcgtcatcgtcttcatcatcgtcgccggactcatcaacgccaacccccaaaacctcactcccttcacacccttcggcgttcgcggcgttttcaaggcctcagcggttctcttcttcgccttcatcggcttcgacgcggtggcgacgatggctgaggaaaccaagaaccccgcaagagacattcccattggacttgtcggctccatgacgataacaacgttggtgtactgcttgttgtctttaacactatgtcttgtgcagtcctacaaggatattgacgtggatgcaccgttttccgttgcgtttcatgctgtggggtgggattgggctaagtacattgtcgcattgggtgcgttgaagggaatgaccactgttttgcttgtgactatagttggtgaatctcgttacttaacacacatttcacgtactcacatgatgccaccttggtttggcctcgtggacgacaagaccgggacgccagtgaatgctacaatagcaatgctaacagtaacatcagtgattgctttcttcacaaactttcgtgttctctctagcctcttgtccatttccactctccttattttcatgctggtggccgtggcgcttcttgtgaggcgatattactcaagtggggtaaccacaaaggcgaatcaagtgaagcttattgtgtgccttgtgctaatatttgggtcttcgtgtggcgtttcggcttattgggcaaacagtgatgggattattgggtatgtgatttgtgtgccgttctggcttttggggactggagggctttggcttggtgttccaatggccaagacacccaaactatggggggtgcctttggttccgtggctacctgctttgtctattttcattaacattttccttcttggatctatcgacgtggcctcatatattaggtttggggtgtggacagcgtttctcttggtttactatgcttttgttggcttgcatgcttcttatgacgccgcaaaggagttaaagagtgcaagtagtaatactactactaatcagcttgaccaagacttgaacatgctggaacagggagtgcaaagccaaaatatcatcgcaggctcgcagcttctctcgcagcttctaggctccttcctctcccggcgccgtcgtccacgctccgtcgtccgtcgtccggcgtcccaaaggattattgaactgttacgtttggtagttgaaaatcctattgcagatgcggtgctctgttgcttatgggatttccataatcctaactgccttgcgtggcaatgtgaacaacacttgtcgataggaagagagaagcttgcatgctcaggaacacaaaagcaatgttgtcaaatagcggctatcacggcgctatcacgctatagcgtagcgggttttggagaaaacgcaattgcaacggcgtcgcgttgcggattccgcgagaatcgcgatccccggagtcttacgcgtcgcgaaaccacgttgggtcgtggctgttgcgtcgtcggtttccgacaaggatga

SEQ ID NO: 294 - DNA, 1038 bp, Glycine Max
atggaacggtatgagataattaaagatattgggtcaggaaactttggtgtggcaaagctggtcaaggaaaaatggagtggtgaattatatgctatcaagttcattgagagaggcttcaagattgatgaacacgtgcaaagagagattataaatcataggtccttgaagcatcccaatatcattagatttaaagagttgttgcttactccaactcatcttgcaatagtcatggaatatgcttccgggggagaactgtttgaaagaatatgcagtgctgggagattcagtgaggacgaggcgagatatttctttcagcaactgatttctggagtcagctattgccattcaatggaaatttgccacagagatcttaagctggaaaacacacttctagatggaagctcagcaccacgacttaaaatctgtgactttggttactcaaagtcatctgttttgcactcccagccaaaatcaacggtaggaacccctgcctatattgcaccagaggttttgtcaagaagagaatatgatgggaaggtcgcggatgtttggtcttgtggggtgaccttatatgtgatgttggttggagcatatccttttgaagacccagaagacccaagaaacttcagaaaaacacttcagcgaattcttagtgtccactattcaattccagactatgtacgaatcagtaaagagtgtaggcaccttttgtctagaatatttgtggccaacccggaaaagagaattaccataccagagattaaaatgcacccttggttcctaaagaatttgccactagaatttatggacgagggcgaaggggtgttgcagaatgatgatcatgtgaatgaagagtcatctgaaatcactcaaagcattgaagaaatactggccatagttcaagaggctaggaaaccgggtgagggcccaaaagttggtgagcaatttgttgggggcagcatggacctcgatgatattgatgcggatgctgacatcgatgacattgagacaagcggtgattttgtctgtgcattgtga

SEQ ID NO: 295 - DNA, 1131 bp, Glycine Max
atggaagagactagtttagctgatctgttgctaacaggagctgaagctgttgaagcacaaaactggccccttgcttcagatataattgagaaacttaacaatgcctcatctttagaaaatggtgatggtttattgaacaggttggctcttttctttactcagagtctctattataaaagcacaaatgcccctgaattgctacagtgtggtgctgtttctacgcacacaaatgctttctgtgtgtttcaggttctccaagaactctctccctatgtaaaatttgctcatttcactgcaaaccaagcaatcttagaggccacagaaggtgctgaagatcttcacatcattgattttgatatcatggaggggattcagtggccacccttgatggttgaccttgcaatgaagaaaagtgttaattcccttagagtaacagccatcacagtgaaccaaagaggtgcagattctgttcaacaaacaggaagaaggctcaaagagtttgcagcttctatcaactttccattcatgtttgaccagttaatgatggaaagggaagaagattttcaaggaattgaacttggtcaaacactcatagtcaactgcatgatacaccagtggatgcctaataggagcttctcattggtcaaaacattcttggatggtgtgaccaaattgtccccaaggcttgttgttttagtggaagaagaactatttaattttcctaggctcaagtccatgtcctttgtggagttcttctgtgaggctttgcatcactacactgcactttgtgattcacttgctagtaatctatggggtagccacaagatggagttgagcctgatagaaaaagaggttattgggctcagaatattggacagtgtgaggcagtttccttgtgagagaaaggagagaatggtgtgggaggaagggttttattccttgaaagggtttaaacgtgtacctatgagtacatgtaacatttcacaagccaaattcttggtaagcctctttggtggagggtattgggtccaatacgagaagggtaggttggccttgtgttggaagtcaaggcctttgactgtggcttcaatctgggaaccaatggcttatctggatgacaaggtcaaatag

SEQ ID NO: 296 - DNA, 663 bp, Glycine Max
atggaagaggaagagcacgaggtgtacggaggagagatccctgacgagggagagatggaaggagacattgacatgtccgccgccgacgatgaagccgccgtcgacgatgacgccgccgtcaaggagctcgacgagatgaagcgccgattgaaggaaatggaagaggaagccgcagcgcttcgcgagatgcaagccaaggtcgagaaggagattggcagcgttcaagatcctgctaatgcagctgcttctcaggcaaacaaggaggaggcagatgctcggtctgtttttgttggcaatgttgattatgcatgcacaccagaagaagtgcagcaacactttcagtcctgtggtactgtaaacagggtcactatcctgacagacaagtttggccagcctaaaggttttgcttatgtggaatttgttgaagctgaggctgttcaagaggctctcctgttgaatgaatctgaattgcatggccgtcaattgaaggttttgcctaagaggaccaatgttcctggaatgaaacaatatcgtcctaggtgctttaatccttacatggcgtatggcttcaggaggccatatactccttacttgtattccccttatgggtatgggaaggttcctaggtttagaaggccaaatcgttacatgccgtactactag

SEQ ID NO: 297 - DNA, 1293 bp, Glycine Max
atggaagagggatatcatcatgcatccacatctacacagaccagtccagatgaaaatgggatgaaaaatattcaaccagagcaactggaaatacaagaaatggggagaagagagagtgcattaggcaaagatatagagcaacaacctaccctcctagaggagtatcacttgaggaataaatcagaaagaagccctgcaacttatatatctagtcatgactttactgagaatagccattttcctgaaggaaaagaggcacttaatggtgctatggaggagttaaaagatggttacatttctgagaatgggaaactggttcttgatttcttgcaagccatccatgctgcagagaaaaggcaggctgacttagatgcacatgcttttaacgaagagaagaaagtgttaaaggaaaaatatgaaaagaagttgaaagatgcagctgccagagaacttatgctcgctgaggaggctgcaatgttggacagggagctaaaaagagagagagcaaaagcatcccttgctatcaagtcacttcaagaaaagatggaagagaaactgaagacagaactagaacaaaaggagattgaaactgatttgaagtttaaacaaactcaggaattagcaaaggcagagttaaatgcagccatagcaaatgagaaggcagctcaaattgaaaaaatggctgaagcaaatgttaatataaatgccttatgcatggcattttatgctcgatctgaagaagctcgtcaaagtcatgctacacaaaattttgctttgagagcacttgcattggaagatgcactatctaaaggacttccaattgagacagaaatagcatctttgcagtcttatcttggaagcacagataaagattcagttttggatttggtgctagcatcccttcctgaagaaacacgaagcaacggcacagacacacaactgcagttaaagcagaagtttgatgccttaaaaggtagtgtaagacacttcagcttcttcccaccgggagggggaggtatgttggcacattctttggcacatgtagcatcctggttgaaggttagggaagacaatcaatctggtgatgggatcgaatctgtgatcaataaagttgaagtttatttggcagaaggaaaacttgctgaagcagcagcttgtctagaagaaagtgtgagaggcacacaagctgcagaaattgttgcaggttgggtgaggcaagcaagaaacagggctatttctgagcaagcagtgctgcttcttcaatcctatgccaattcccttagctttacatga

SEQ ID NO: 298 - DNA, 192 bp, Glycine Max
atggaaggaaaaatggtaacaaggacgaagcaccgaggtgtttgggtgatcatgaatttccactctcctccttcgacgttgatatgtgtttacaccacaccggcacaaagaaccacgaggttttgcacaattcctcaccagagaacgttcatctttcctttgatcctgtttggtgatgtccacgcacaataa

SEQ ID NO: 299 - DNA, 522 bp, Glycine Max
atggaagtaaccttcgccatcgctgtcttcgtgccactcattttcgccggagcttcctcggccagggagctccggccgtcggaccacggcctcaccttccagacactctcgccggcagggccgcattcctcgccggagatgcgatccttcttcaacagcgccaactcctctccgtccatgtcctcctcctcggacgtcgcacttccccgtgccatggactccggcgaagcctccccgccggcgtggtggcaaaccgacggaggccactccgtcgaaggcgtgggaaaggcgctgacgatggcgagcttggggtgcggcgtggccggcgcggttctgcttgtggcttcgggtttgatctatttgttaaagtaccgaaacagaaacagaaacagaaagcagaagttaaacgcagcgttttgcggtgagaatgagaatcgcggtgaaaatattgatgaggaaaacaacaagttgcaattggtgattatccatacattaaatggttcaaaaagttattatttttaa

SEQ ID NO: 300 - DNA, 1308 bp, Glycine Max
atggacaagggggtgccacctagcctcttcgtcaatgacggttctttcatggagaggttcaagcaacttcagcaagagcaggagaaagggaagaatgtcaaattggaggattctaaaccaattaaggttaattcagggtctttgtctcccaatcactccattaccaaaacgcccgtggacttgaaggttaatgacacaagaaaaacatctcagggtggttccagtggcaagctagctttcagtttaaaacaaaagtcaaagctggtgccaccccctgttaagttaagtgctgatgaggatgaagaaactgaagctgggtatgtttcaaatgatgcaccactaaaacggcaaaagttaggccaggaggaaggcattgaccaatcatcaagacaacttgatgttgcacctcattccccaagtgatcctacagtgaagaaagttgctgacaaactggcaagttttgtggctaaaaatggaaggcaatttgaggatgtaacacgccaaaaaaatcctggggatacacctttcaaatttttgtttgatgagagatgtgctgaatacaagtattatgaatatcggcttgctcaagaagaagatgctcttgggcaatcaagggaatcacaggtgcctcgtaacgggggtacaagcacttcatcttccaaacaggctagtggtcatcagagatcatctcagcagcatacataccaaattcctgcatctgctttatatgaaagtcctgacaatccaagagcttctggattttcaattcaaacatcaccagtaggaagcagtgaagagcccagtggttcatcaaatgctgattctttggcgctaatggagttctacatgaaaaaagctgcacgggaggagaagtataaacaacctaagcattcaaaagatgagatgccccctcctgcttctcttctaggcaaaaaaggccatcacatgggtgatttcattcctccagaagaactcgagaagttcttggctacctgtaatgatgctgcagcgcagaaagctgctagggaggctgcagagagggctaagattcaggctgataatgtaggccaccggctcctgtcaaaaatgggttggaaagaaggtgagggtttgggtggatccaggaagggtattgcggatcctatcatggctggtaatgttaagaagaataacttgggggttggtgctcaggaacctggggaggtgagtgcagaggatgacatatacgagcagtacaaaaagcggatgatgcttggctaccgttaccgacccaatcccctgaacaatccccgcaaggcttattactga

SEQ ID NO: 301 - DNA, 783 bp, Glycine Max
atggacatcactgccttcaaatccctcaacattccatttccaacctttccatcaaaattttctccttttcgtccattcagtttctttcacttcaaaccttttcgcactccttcctcacctcgcttcatctcccattgctctctcaatgggtcagcagagataacaagcaaggaaggtactttgcctcgtggcgttggagaggcagtgaatgaagcgtcaagttccaagattcttcaggttgtgctcgtgtcccctcagattccaggaaacactgggtgcattgctagaacttgcgcagcatcagctgttggattacacttagttgggccattaggatttcaggtggatgatactaaactaaagcgtgctgggttggattactggccatatgtggttgttaaaattcatgattcttgggaagattttcataattattttaggcaacaggagggtgaaaaacggttgctagcatttacaaagagaggaacaaaaattcattctgagttttcctacagaaaaggtgattatctaatattcggctctgaaactagtggcctgcctcctgaagccttgctagactgcaaaacagaaccatttggtggtggaactatcaagattccaatggttgagacttatgtcagatgtttgaatctatctgtaagtgttggcatagctttgtatgaagcttctagacaactaaactatgagtcacttcaggtaccttcagaaagctgtattgatactactgaggaatcatttattgctgaagacatttttgcttga

SEQ ID NO: 302 - DNA, 564 bp, Glycine Max
atggacatttcacagagaaagagaactttgctaaagatcattgttcttggtgatagtggggtgggaaaaacttctttgatgaaccaatatgtttatagaaaattcagccagcagtataaagctacaattggggctgattttgttacgaaggaaatacaagttgatgataaactcgtaacattgcagatttgggatacagcagggcaagaaaggttccatagtcttggggctgcattttatagaggggcagattgctgtgttctggtatatgatgtaaacatacacaaaacatttgatacactaaacaattggcatgatgagtttcttaagcagggagatatgaacgaccctgaagcatttccctttgtattacttgggaacaaggttgacgtagacggtggaaacagtagaagggtcactgagaaaaaagctagagactggtgtgcttcccggggaaacataccatactttgagacctctgcgaaagagggctacaacgttgaagaggctttttcatgtgttgccaaaattgcactagaaaatgaacatgatcaagacatgtga

SEQ ID NO: 303 - DNA, 1464 bp, Glycine Max
atggacccatcttcttctcgtccagctgtagttatcgacaatggctccgggtatacgaagatggggtttgctggtaatgttgagccgtgttttattgctccgacagttgttgctgttaatgagtcgtttctgaatcaatcgaggggctcttctaaaggcagttgggtggcccagcacaatgctggggttatggcagatcttgatttcttcatcggggatgaggcactttccaagtctcggtctagcagcacttacaatctcagctacccgattcggcatggccaggttgagaattgggatgccatggagcgcttctggcagcagtgcattttcaattatttgaggtgtgatccggaggatcactatttcctcttgaccgagagcccattgaccgcgcccgagagtcgcgagtatactggggagatcatgtttgagacttttaatgtgcctggactttacattgctgtcaattccgtgcttgctcttgcagctggatacacgacgtccaagtgtgagatgacaggagttgtagtggatgttggagatggagctactcacgttgtgcctgttgcagacggctatgttattgggagtagcatcaaatcgattcctattgccggaaaagatattactctttttgttcagcagcttatgcgggaaagaggagaaaatgtaccaccggaagactcttttgaagtggctcggaaagtgaaggaaatgtattgctacacctgctctgacattgtgaaggaatttaataagcatgacaaagaaccaggcaagtacatcaagcattggagaggtattaaaccaaagacgggggcaccatattcatgtgatattggctatgagcgatttcttggccctgagattttctttaatcctgagatatatagtagtgactttactacccctttgccagttgtaatagacaaatgcattcagtctgcgccaattgacacaaggagatcactatacaagaatatcgtgttgtctggaggttcaacaatgttcaaggattttcacaggaggttgcaacgtgatcttaagaaaatagtggacgcccgtgccctttcatctgaagcacgcataaatggggagataaaatcacagccagtggaggtaaatgtactcagccatccaatccaaagatttgcagtttggtttggaggatcagtacttgcatcaacacctgaattttttacgaagaaaaaaatctcttttgatcttgagcacattgatctgagacaatttgttgaatggtatgtatggatttataggtttgagatattatttattgtccatgagaaagcaatggtggatggattacatgccaatgtcatgattgtagttggttgtccatgctctttgtctgacattgataacctgaattttgtatgctttgcctggttaaatgactttatgattgcacacatggtattgttgctgagtttagaaatatga

SEQ ID NO: 304 - DNA, 1269 bp, Glycine Max
atggaccccatcgtcctctccgacgaagaagacccctcaacgccgttcccgctccgtcccaagaaacgccgaaccgaaccggacccaaacccaaacccaaaccgcaccgtcttcgtcatcgacgatgacccaacccctcacaaatccgccacaccttctatcgttcccgagactccaatgtatttgtttgtttccgtgctaatatgcagctttgggttttctagtggaattgaatctgtcatgctttatgattgttccccttcagggattagtcaaatgatatgtttggaatcggataacgagtcggaaaattgtggaataagcacacggaacgaaaatgaagcaagagattctagatggatttcgaattcaggggggtctggaaggtctcctggtatatgcttggaatcagataacgagttagaaaattgtggaatggacaaaccggttgagaatgaaccaagagatgcaagatggacttcaaatttgatggggtctggaagttctcctcgtatttgtttggaatcagataacgagttagaaaattgtggaatgggtgagcgggatgagaatgcaccaagagattcaagatggacttcaaactcaatggggtttggaagttctactgagaggcatatttcagggggaaatgctactcaaactgaaatgcctggggatgacctttcaaatccaacctcttcacaagggaagtttgcaatgaaatctattgtggcagaaattgatgcaaaggcggttgaatcaggttcaattggagggcatctgcttactaggtttgctgaaaaagggcttacataccatattacatcaaatctagtcgcagggtcaattttgtggtctatgaaagttccagaacatatttcacagctttctactgaaagaattgagattccatatgtcttgctcatttatgaggctggcaaattttgtaaccttgtcatgaatgattctctttttgatcaactctctagcattcaaagtctttatccagcatatacagtttgttacctcaccaataggttattggcttatattaataaaaaggaacaggaaaaatataagaaccccgagaacagtagttgttggagacgtccacctgtagaggaggttctggcaaaactaacaactaatttcaacaaagtacactccaggcagtgtttagacgaggctgagctggctgaacatgttgtcagtttgacatgtagcctagcatcttgtcagtttagaaagaaaaaaaaaaaaaaaatttaa

SEQ ID NO: 305 - DNA, 1269 bp, Glycine Max; identical to SEQ ID NO: 304

SEQ ID NO: 306 - DNA, 309 bp, Glycine Max
atggaccgtcgtaaagagaaaaatgctccatggttatcggtgccgcaatttggggactgggatcagaagggccaagtgccggactactcacttgatttctcaaagatccgggaaactaggaagcagaacaagacaaatatttccagggcaagccttggcaatgaagaagaattcatggattcaacaacctccagcagcgtcaacactgcccacagcagtgagcaccctcaaccccactaccatcaaacccactctccaactgcaaggaagagcttcctcagctacttcaattgttgtgtgaaagcctaa

SEQ ID NO: 307 - DNA, 291 bp, Glycine Max
atggaccgtcgtaaagagaaaaatgctccatggttatcggtgccgcaatttggggactgggatcagaagggccaagtgccggactactcacttgatttctcaaagatccgggaaactaggaagcagaacaagacaaatatttccagggcaagccttggcaatgaagaagaattcatggattcaacaacctccagcagcgtcaacactgcccacagcagtgagcaccctcaaccccactaccatcaaacccactctccaactgtaagattcttgtctacacaagctgcttag

SEQ ID NO: 308 - DNA, 6456 bp, Glycine Max
atggaccgtgcgcttctcctcgcttgcgtgatttgcgggatcctcttcttggtgttgggcttggcatcgttcttcattctttgggctgtgaattggaggccctggcgaatttatagttggatctttgctcggaaatggccaaatatcttgcaaggtcctcaacttcatttgctctgtggtttcctgaatctttctgcatgggtagttgttatttctccaattctggtacttatcatttggggctcttggttgattgtaatattgggtcgagacctgattggtttggctgtaataatggctggcactgcccttctattggcattttattcaattatgctctggtggagaactcagtggcaaagctcaagggctgttgcaatcctgcttcttttggctgttgctcttctttgtgcatatgaactctgtgcagtatatgttacaactggatcacgagcatctgaccgctattctccttctggtttcttttttggagtctctgcaattgctttagcaatcaacatgctatttatttgcagaatggtgtttaatgggaatggcttggatgtggatgaatacgtgcgaagggcatacaaatttgcttattctgattgtattgaagtaggtccagtagcatgtttaccagaacccccagaccctaatgagttgtatcctcgacaatctagaagggcttcccatcttgtactgctctatcttggctcactatgtgttctgttagtatactccatcttgtatggtctaacagcaaaggaggagaattggcttggagcaattacatcagttgctgttattattcttgactggaatttgggagcttgcctgtatggttttcaacttcttgatagtcgtgttgcagcactgtttattgctggaacatctcgtgtttttcttatctgttttggagtgcactactggtatttagggcactgtatcagctatgctgttatggcatctgtactgctaggagcggctgtttctcgccattggtcagccacaaacccattggctgcgaggagagatgccttacaaagcactgtagttcgtctgagagaaggattccgtagaaaggagcacaacagttcatctagcttttctgaaggttgtggctcaagtatgaaacgaagtagtagtgttgaagccggtaatcttggtaatgtcattgaagctggcagggctatggctgcaggtgatgggagcaattggaataatgtcctgtctcaaactactagtttgccggatggaatcaatagtgataaaagcatagatagtggaaggtcaagtttagcattacatagcagctcctgtcgctcagttgttcatgagccagaagttggaacatcatctgatgatagaaatttggatcacaataattctttggtggtttgttctagtagtggtcttgatagtcaagggaatgactctagtgcatcaaactctgcaaatcaacaaacactggatttgaatttggctcttgcgttccaggaaagtttgaatgaccctaggattgcaactatgctgaaaagtaggacaagacaaggtgatcgagaattgagtagtttattacaggacaaaggattggatccaaattttgctatgatgttaaaagagaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacatgggcttgaaaagtggcttcagttgtgcagacttgtattgcatcacattacgggtactccagagcgagcatgggttctgtttagttttattttcatacttgaaaccatcattgttgccatattccgtccaaaaacgatcaaaattattaatgcaacacaccagcagtttgagtttggtttggcggtgctcctgttatctcctgtgatatgttcaattatggctttccttcgatcacttacagcagaagaaatgtcaatgacatcaaaaccaaggaagtatggatttattgcttggctactcagcacttgtgttggattgttgctctcctttttaagcaaatcatctgttctccttggtatatccttgactgtgccactattggtggcatgcctttctgttgccattcccatatggatttgtaatggttaccaattttgggttcctcgtgtgaattgtactgggagtgctggaaatgatcgaattcctcgaacaaaggagggtattgttcttcttatcagtatgtcagtatttgttggatctgtactggctttgggtgcaatagtttctgcgaagcctttagacgatttacgatacaagggatggaatggtgatccaaaaattttgggttccccttacacatcatctgtttttcttggctgggcaatggcatctgcaattggtttagttgttacgagcgtgcttccaataatttcatggtttgcaacatatcggttctccctttcctctgctatctttattggactttttgcagttattcttgtggcattttgcggggtgtcctatttagaagttatcaaaactagggacgaccaagttccaacaaacggtgatttcttagctgctttacttcctttagtctgcattccagcagtgctgtcgctttgctgtggattgcttaagtggaaggatgatgattggaaactttctcgtggtgtatatatttttgttataattggtcttttgcttctgcttggtgctatttcagctttgatagttgttgtcaagccttggactataggagtagcatttcttttggttcttctccttatggtattagcaattggtgccattcaccactgggcatcaaacaatttttatttgagccggacacagatggtctttgtttgcttccttgcttttctgttggctttggcagcatttcttgttggatggtttgaaggtaaaccatttgttggagcatcggttggttatttttcatttctttttcttcttgccggacgggcattgacagttctgctttcaaatcccattgttgtatattctcctcgagttttgccagtgtatgtgtatgatgctcatgcagattgtggaaagaatgtcagtgtggcctttctcatgctatatgggattgccctggcaaccgaaggctggggggttgttgcaagtttaaagatctatccaccctttgctggtgcagctgtatcagcaattaccctagttgtttcatttgggtttgctgtatctcgtccttgcctaactcttaagatgatggaagatgctgtgcatttcctgggtaaggaaactgttattcaagcaattgctagatcagcaacaaagaccagaaatgcattatctggaacctactcagcaccacagaggtcagctagttctgctgcacttttgattggagaccctaccattatgcgtgatagggcaggaaattttgtgcttccgagagctgatgtgatgaaattaagagaccgcttgagaaatgaagaattagttgcaggttcattctttagtagattaagatatcataggacatttcgccatgagccaaccagcgatgtagatcatagaagagtaatgtgtgctcatgctcgaattctggcactagaagaggccattgatactgagtgggtgtacatgtgggacaagtttggtggttatttgcttttgttgcttggtttgacatcaaaggcagaacgagcacaggatgaggttcgtttgagactctttcttgatagcattggattttctgatttaagtgctaagaaaataaagaagtggatgccagaagatcgcaggcaatttgaaatcattcaggagagttacataagagaaaaggagatggaagaggaagtcttcatgcagaggcgtgaagaggagggcagagggaaagaaaggaggaaggccctacttgaaaaagaggaacgtaaatggaaggagatagaagcttctctgctctcctccattcctaatgctagcagcagagaggctgctgccatggcagcagctgtacgtgcagttggaggtgattctgttctagatgattcctttgctcgagagagggtttcaagcattgcacgtaggattcgtgcttcacagttatctcggcgtgcacttcagacaggagtggcaggtgccatatgtgttcttgatgatgagccaacagccagtggcaggcattgtggtcccattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagacggaaggtggcatattgtaacaatgtcaattgatgctgatttaggtgaagcaacatgttatttggatggtggatttgatggctatcagaatggattaccattgtgtgtgggtagcagcatttgggagcaggggacagaagtgtgggttggtgttagaccaccaacagatattgatgcatttggtcggtcagatagtgaaggggttgaatctaagatgcatattatggatgcttttctttggggaaggtgcttaactgatgatgaggtttcttctctctatacctcaatggcttcggcagacttcggtgcacttgatttccctgaagataattggcagtgggctgattcaccttcgagggttgatggttgggacagtgatcctgctgatgtagatttatacgacagagatgatgtagattgggatggacagtattctagtgggaggaaaagaaggtcagaacgtgatggcatggtggtggatattgattccttttcaaggaagtatagaaaacctagaatagaaactcaagaagagattaatcaacggatgttatctgtagaattagccatcaaagaagctctctacgccagaggagagacacgctttactgatcaggaatttcctcccaatgatcactcattgtttgtggatcctgcaaacccccctgcaaagttacaggttgtttctgagtggttgaggccaggtgagattggcagacagaaccatcttgactgtcgtccgtgcttattttcaggagctccaaacccttcagatgtttgtcagggccgtttaggtgattgttggttcttgagtgctgttgctgttctagcagaggtttcacgtatatcagaggtaatcatcactccagattacaacgaggagggaatttatacagttcgcttttgtgttcagggcgagtggatccctgttgttgttgatgattggattccttgtgaattaccgggcaaacctgcatttgctactagtaagaaggcctatgaactctgggtctctatattggagaaggcatatgccaagttgcatggctcttatgaagcactagaaggtgggcttgttcaggatgctctggtggatcttacggggggtgctggggaggaaattgacatgaggagtggtgaagcccaaattgaccttgcaagtggtagattgtggtctcaactgttacgcttcaagcaagaaggttttctcctaggtgcaggaagtccttcaggttctgatgtgcacatctcttctagtggcattgtgcaaggacatgcatactcaatactgcaggtaagagatgtggatggtcataaacttgttcagatccgaaatccatgggccaatgaagtggagtggaatggtccatggtctgactcatcgcctgagtggacagataggataaagcacaagctgaagcatgttccgcagtccaaagatggcatattctggatgtcctggcaagattttcagattcattttcgatcaatatatatttgccgtatctacccatcagagatgcgtcattctgttcatggtcaatggcgtggttacagtgccggggggtgtcaggattatgatacatggaatcaaaatccacagttcagactgactgcaactgggcaagatgcatcatttcctattcatgtattcattaccttgactcagggtgtgggattttcaagaacaacagctggttttagaaattatcaatccagccatgattcacagatgttctacattggaatgaggatactcaaaactcgtggcagacgtgctgctttcaatatctacctacatgaatcagttggtgggacagactatgttaattctcgagaaatatcctgtgaaatggttttggaacctgagccaaagggatatactatagttcctactactatacaccccggtgaagaagcaccatttgtactttctgttttcaccaaggcatcggtaactctggaagctttgtag

SEQ ID NO: 309 - DNA, 6456 bp, Glycine Max; identical to SEQ ID NO: 308

SEQ ID NO: 310 - DNA, 3951 bp, Glycine Max
atggacgcggatctgaagtcggcgaaggcggcgtaccggaacgccaaggcggagggaaaccaccgagaggaggcgcggtgggccaacgtcatcggcgacatactcaaaaaccgaggagagtacgtccaagccctcaaatggctccgaatcgattacgaaatttcgctcaaacacttaccggaaaagcatttgctcccaacttgtcaatcccttggcgaaatgtatctccgcctcgaacacttctccgatgccctaatttatcagaaaaagcatttagatcttgcgagggacgctggcgacgtcgttgagcaacagcgggcgagcacgcaactcggtcgcacttaccacgagctcttctcgcgatcggagcacgaccacaactcaattcgcaacgcgaagaagtacttcaagtccgcgatggatctcgcggtgaagctccaggagaatcctccaaacagcaagtcctcttttctcaaggagtacatcgacgcgcacaacaacataggcatgctggagatggatctcgacaacttgcatgaggcgcggaagattttaactagaggattggagatttgtaatgacgaggaggtcgctgaattcgatgatggccgcagtagactccaccacaaccttgggaatgtgtatatggaacttagggattgggataaagctaggaaacacattagaacggatattgtgatttgtaacagaattggacatgttcaaggggaagccaaggggtatattaatcttggtgaagtgaattacaggactcagaagtatgaagatgcaagtgcttattacgagaaggcgcttggtttggcaaagagcttggaggatgaggatgctttggtaaggcaaatcgagcagaatattgaaactgtgagagaagctgttaaggtaatggctgatataaagaaagaggagcagagccttaagaagctcaaaagagatatagccactgccagagggacaccaaatgagcgcaaattcttgctgcagcagaatgcagttcttgagcgtttggttgagaaagcaaggatgatctctgcgtgggagaagcattgtgaatttgcaaaggagaagaagaaaatagcaagtgaactctgtgataggcagagactggctgattcatatctggatgttgcagaatcataccataaactcagaaaattcaacaaagcaatcaagtggtacaaaaagagttgggaaatgtacaaaaatattggtaacttagaggggcaagcaatggtgaaaattaatattggtaatgtttatgattctactgaaagttggagaaaagcattggatgcatttcaagagagctacagtatcgctgttgaagcagacctccctgatgtgcaactcgctgccttggaaaatatgcattatagcaacatgataagatttgatgatgaggatgagacaaggaggttgaatcttctaattgataagctgaagaaattagaagaaaaagaggcagaagctaaaagtatgccagaggatttttgctctgaaactgatactgaagcagatgagtgtctgtcaaacagtgggtctgatgatttttgctttccaaagacaatttctcgatcaaaaactctgactactggagaagaattgaaagaggacgcacctcttatgtcactctatcagtccttaaaaggctcatccaaaaagaaagcaggccacaaagaaagtcttgccaactctaccaagcaagatgagcattcacccagtagtctgaaaaatcaaaccagtgatcatcagacagttgttggtcgtaaacgtgtccgtgtaattctttctgatgatgatgatgatgaagtcgagtgttcaagcagaaaggatcataattgcccgtatgttttctttgttatttgctttgctctgtcccaaagattcccttatagttattatatattgattgatgcttgcctgattgcagttaagagtaaagccagtccttgtaaatttcaggttatctcagaaaatggatccaagactgcaattaatgttgaagaaagtagtagttctttcaaatgttggagtccacatagagccacaaaatctggcagacattccaggtcttttagcaatgatatagttgctgaacctgattttcctggtggttctaaatgtgacactgatcaatatgttacatgccggattgggaatgacctaatacgtgtagaagcatccttgtgtaccactggtgaccagttgaacattgactctttgaaggctgtagttgcttgcttatattatctacaatttccaactgaaaagagatcagagggtttgttgcccattattgagcatataaaatgtgctggaagagatctagaatccctggaaactgttgaacatcttaaggaagttttgggaaatgacatggttgaagcttccgttgatggatggattcacaagggcctgataaaaatgtatgtagaccactgcaaggagttgtcagaggtaccgaacatcaaggtattgaagaagctttacaatttagaggtttcagatgacgaaattgttgtgtctgactgcgaccttcaagacttgtctattacaccattgataaatgcactgcattctcaaaagtcatttgcaatgcttgacctctctcacaatttgttaggaaatggaacaatcgagaaactgcaaaaggtgttcacagcatcaggacaatcttatggtggcttaactctggatttgcattgcaatcgatttggcccaacatcattgtttcagatttgtgaatgttcactgctatttgatcgactagaagtgcttaacatttctggaaaccgtcttactgatgcatgtggatcttatctttcaacaatattaaaaaactgtacagctctttgtagcttgaatatagagaactgttgtgtcacatccagaactattcaaaaagttgcggatgcattggactctacatctgttcttgcccatctatgtataggatacaacagccctgtatctggaaatgctatagttaatcttgtgtccaagctttctactctgaaaaggttttctgagttgaatatgagtggtctaaaactaggcaaaccagttgtcgataccctttgcaagcttgcagggaccttaaatttgtcaggactaatacttggaggcacgggtgttggaactgaaggggcaattaaattagcagaatcattgctccaagggactgaagagcttgtgaaacttgacctatcatattgtggtctaacatttaactttgttttaaacaccagtgttaattttttttgttccatcctagagctgaacctggaaggaaatcctatcatgcctgagggcagcaatactttattttctcttcttgtaaacccacagtgctgtctcaaagttttggtccttaaaaagtgtcaacttgggcttgcaggaattcttcacataatcgaggctctggcagagaacagctgccttgaggaacttaatgttgctaataattctattccgaaggaagtttctgctctacaatatgatttatcggtaaaaagctgctcacaaaaccaggagcagaaacttgatactatgaaagttgatgataatcaagaggtccttggctctctaaacagtgccgaccatctactggaagttgctgatagtgaagatgttccagtagaaacagctgcttctggatttgacgacagctgtgccagttcatgtcaaagaaattcatctcccgagtgccatttcacgcaacagttttcaattgctattggtaaggcaaagaacttgcaattactagaccttagcaataacggtttttctgcacaagctgcggaagcattctatggttcgtgggcgactttacggcccctttcaagtcaaaaccacattactgagcagataattcacttctcaacgagggaaaataagtgctgtagagtgaaaccttgctgcaagaaagtttga

SEQ ID NO: 311 - DNA, 1047 bp, Glycine Max
atggacgctctgaggaaacaagccagcaagctcagagagcaagttgccaaacagcaacaggctgtaataaagcagttcagtagtagtggttatgagagttcagatgttgtggtcatcgatgaggtcgaaatgcagagacatcaccagctggaaaagttgtatagggccacacgttcagggaaggacttccagaaggaaattgttaaagcagcagaaacatttacagctataggttataagcatattgaaacaggaacaaaactttctgaggattgctgtaaatatggagcagagaacaacagtgacaacatattagctaaggctgcatcagtatatggtgatgcccgcaagcatgtggaaaaggagcacgaagaattaaatcggcttttatctacgcaggtattggatcctttgagacaaatgatcaatggtgttcctttggaggatgctcgccatcttgctcaacgatatagtcggatgagacaagaagcagaggcacagagagaggagattgttagaagacaagcacgggttcgggaagctccaactgctgaacaggttgccaaactgcatgctgcagaagcaaagatgcaggagctgaaagcaaacatggcagttctaggtaaagaagctgcagctgcattggctgctgttgaagcacaacagcagagacttacttttcaaaggcttgttgccatggttgaaggggaaaagacttttcatttaagagttgcagctattcttggtgaaattgaagctgagatggtctcagatagacagaagaaagaatctgctcctccagtaggtatttctgagaatggctcagagaaaacaatgtacttcttggctgaagcaacacatcccttcagtgctgaatcagaaaaggagctgagtttttcgaagggtgattttgttgttgtgcgaaaggtgagcccatcaggatggtcagaaggagaatgcaacggtaaagcaggatggtttccttccgcatatgtggagaaacgacaaagaatcccctctagcaatatggctggtgaagtttactag

SEQ ID NO: 312 - DNA, 1161 bp, Glycine Max
atggacgttgttcgttcacaaagaggtagtagtagagacacgagcccagaccgtgcgaaaatatgcaggatgaaccaaaaagtgaagccctttagaaaagttcaagtcgtttactatctctcccgaaacggtcttttggagcacccccatttcatggagctcacccttttgcccaatcaacctctccgtttgaaagatgtcttcgaccgactcatggctctccgtgggactggcatgcctttgcaatattcatggtctagtaaaaggaactataagagtggttatgtgtggtacgacttgggtctgaaggatataatacatcccgcagaaggaggcgagtatgttctcaaaggttctgaactcgtcgaaggatgctctgagagatttaatgtgagaaacaagcagcagggaattcatcaacaggcagaggcaaattacaattacagttacgattcgaggagtaaggcgttgggtgtgtgcaacaagcagcagcagcagagagagagtgaagagttggaggaatacgaggagcaagaaaaggagtatgaggagggagagaaaacaagctacacgagctccacaacaaccccacactctggttgctccagaggggtatcaacggaagaagtggtttatgaggaagaagaaagcaagaagaagaagaagggtggtggtggtgcaggcggaaataataagaagcatttaagtggagagaaagagaaagtgaagagaagggtggtggatggtgatgggtcggggtcgagtcgttattcaggtctgctgcagttgatagcgtgtggaggtggggcaggggagtacatgaaggggaagcaggggccgcgtctcagcgacgtggggaccaaagaaagagacaagaaggctttgttttgggaggaggctgagactgagatgtcggagaatcccaggttgttggggaatttgcagacagaggagaaggagtactttagtggtagcttggtcgactcaatcaaagcccaccgggagggtgagcctgtgctcaacaagtccaattcctataacgaactaaggagaagtaggctggggatggtgacggaagaagacaagaagaaggtggtgaagggaggaatgaaagacaaatgtatccctcttatcaaatcccccaagactagtaggaaatga

SEQ ID NO: 313 - DNA, 1314 bp, Glycine Max
atggactacgaaccctactatagtagcggaactgatgatgatcttccaccaacacatccaaatagaatccccagaggggaacgtcttgcaggaaatggaagattgccagcaggttcaattccatacccaaggatgcatggtgaaattgatatggaaactcaaattcaccaacttgagaaggaagcatacagttcaattctacgggcatttaaagctcaagctgatgccatttcttgggagaaggaaagtttgattacagaacttagaaaagaactaagattatcaaatgaggaacacagagaacttctaggtcatgttaatgcagatgatgtcatacaaaatataagggagtggagacaggcaggaggcaatcagcctgttgtgctgagtgttgggcaagctattcatgattcaattccaagtcccactatctctgcatctcgtaagaagctgaagataactccatctgcaccatcacaatcttttggtgggccttctgcattttgtccccaacccgtggctgcaccccttcagccatcttcagtggcaaaacgaggatccatttctggatctaagggcaagaagcacaaacctggccaagtattacctggtgtatcttcaataaagcaatacccttcatcaggactaggtggaaggaatcaagtacctaatagagttacttctggtactgtcatgggtgaggttgccaagggagcatcgttggattcattagttggtagaagagtgagaacaagatggcctgatgacaacaacttttatgaagccattatctccgactacaatcgaactaaaggtctacatgctttgctctatgacttggggactgcaaatgaatcatgggaatgggttaatctgtcagagatgtctcctgaagatattcagtgggtaggtggggatcctggagtcaatcatcgtgggggttttgctggatctggtaatgggatgagtatatctgtaagacatgatagtgttccaggagctggaagaggtaggggaactgcaaaggggcaatccagaaaagatttctttccatcacagaatggaataggaatgaagactccagatgatatacaaatacttcacacagacacactagtgaaggaggtggagagggtattcaatgcaaatcatcctgatgcgcttgaaattgagcaagtcaagaaaatattgaaggatcatgagcaagctcttattgatgcaattgcaaggcttgcagatctttcggatgacgaaagtgatacagatgaggagggtagccaccatttctcacatgctcaagcaatggctcactaa

SEQ ID NO: 314 - DNA, 1653 bp, Glycine Max
atggacttcgacgagtacgaatacctggagaagacagtggaggaagacatagattcctccaagaagaagaaggacgtcaccgacaagagcgagaggagttaccgaaagccccgcgacgtcgacgacgatctcgacgccgatgacagaaagagcaagaggtctagggtcgacgacgagaacggcggttccaagagagatcgcgacagagacagagagagagaccgtgaccgcgaacgttcctctggtcgtcacaggagcgagagggagagagacggagagaggaaagacagggataaggatagagagaggagggataaggataaggataaggataggagagaccgtgatagggacagggatagggatagggatagggaaaaggagcgcgagagaagagagaaggatagggagcgagagagggaaagagcggagagggagagatccacaaggagcaggagtcgctccgagagggacagagatagggagcgagattttgatatgcgcgatggccggagatttagggataaaaaagaggctgcagaacctgaggcagacccagaaagggatcagagaactgtttttgcctaccagatgccgctaaaagcaacagagagagatgtgtatgagttcttttcaaaagctggcaaggtgagagatgtccgtctgatcatggataggaactcaagacgatctaaaggagttgggtatattgaattttatgatgcgatgtcagtgccaatggctattgctctctctggccaacttcttcttggacaacctgtaatggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagcttcgggagatttttgagccatttggtccggttgagattgtgcaactgcctcttgacttggaaacaggacactgcaagggttttgggtttgttcaatttactcatctagaacatgccaaggctgctcagagtttaaatggaaaattagagattgctggcagaactatcaaggtttcatgtgtcacagatcatgttgcaagccaagatacaaccgcaaaatctgcagacttggatgacgatgaaggtggattgactttaaatgctcactcaagagcattgcttatgcagaggctggctggtgctgaccctgcaagcctaggtttgcctgttgtgaatggctcagttcctgctcagcagactattagcttgcctattggcgcaccagttctaccaacgcaagttatgcctaatccagcagtagaacctgtaggaaaccccagcgactgtttacttttaaagaatatgttcgacccgagcactgagacggaacctgattttgatatagacattaaagaggatgtagaggaagagtgttctaaatatggccgggtgaagcatatttttgttgacaaaaaaagttcaggttttgtgtatttgcggtttgatacagtggaagcggcaagtggtgctcaacgtgcaatgcacatgagatggtttgcacgcaggttaatttcagctgtcttcatgcaaccagagttgtatgaagccaagtttaaaggggaagtttga

SEQ ID NO: 315 - DNA, 1623 bp, Glycine Max
atggacttcgacgagtacgaatacctggagaagacagtggaggaagacatagattcctccaagaagaagaaggacgtcaccgacaagagcgagaggagttaccgaaagccccgcgacgtcgacgacgatctcgacgccgatgacagaaagagcaagaggtctagggtcgacgacgagaacggcggttccaagagagatcgcgacagagacagagagagagaccgtgaccgcgaacgttcctctggtcgtcacaggagcgagagggagagagacggagagaggaaagacagggataaggatagagagaggagggataaggataaggataaggataggagagaccgtgatagggacagggatagggatagggatagggaaaaggagcgcgagagaagagagaaggatagggagcgagagagggaaagagcggagagggagagatccacaaggagcaggagtcgctccgagagggacagagatagggagcgagattttgatatgcgcgatggccggagatttagggataaaaaagaggctgcagaacctgaggcagacccagaaagggatcagagaactgtttttgcctaccagatgccgctaaaagcaacagagagagatgtgtatgagttcttttcaaaagctggcaaggtgagagatgtccgtctgatcatggataggaactcaagacgatctaaaggagttgggtatattgaattttatgatgcgatgtcagtgccaatggctattgctctctctggccaacttcttcttggacaacctgtaatggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagcttcgggagatttttgagccatttggtccggttgagattgtgcaactgcctcttgacttggaaacaggacactgcaagggttttgggtttgttcaatttactcatctagaacatgccaaggctgctcagagtttaaatggaaaattagagattgctggcagaactatcaaggtttcatgtgtcacagatcatgttgcaagccaagatacaaccgcaaaatctgcagacttggatgacgatgaaggtggattgactttaaatgctcactcaagagcattgcttatgcagaggctggctggtgctgaccctgcaagcctaggtttgcctgttgtgaatggctcagttcctgctcagcagactattagcttgcctattggcgcaccagttctaccaacgcaagttatgcctaatccagcagtagaacctgtaggaaaccccagcgactgtttacttttaaagaatatgttcgacccgagcactgagacggaacctgattttgatatagacattaaagaggatgtagaggaagagtgttctaaatatggccgggtgaagcatatttttgttgacaaaaaaagttcaggttttgtgtatttgcggtttgatacagtggaagcggcaagtggtgctcaacgtgcaatgcacatgagatggtttgcacgcaggttaatttcagctgtcttcatggtaatcttttga

SEQ ID NO: 316 - DNA, 1500 bp, Glycine Max
atggacttcgacgagtacgaatacctggagaagacagtggaggaagacatagattcctccaagaagaagaaggacgtcaccgacaagagcgagaggagttaccgaaagccccgcgacgtcgacgacgatctcgacgccgatgacagaaagagcaagaggtctagggtcgacgacgagaacggcggttccaagagagatcgcgacagagacagagagagagaccgtgaccgcgaacgttcctctggtcgtcacaggagcgagagggagagagacggagagaggaaagacagggataaggatagagagaggagggataaggataaggataaggataggagagaccgtgatagggacagggatagggatagggatagggaaaaggagcgcgagagaagagagaaggatagggagcgagagagggaaagagcggagagggagagatccacaaggagcaggagtcgctccgagagggacagagatagggagcgagattttgatatgcgcgatggccggagatttagggataaaaaagaggctgcagaacctgaggcagacccagaaagggatcagagaactgtttttgcctaccagatgccgctaaaagcaacagagagagatgtgtatgagttcttttcaaaagctggcaaggtgagagatgtccgtctgatcatggataggaactcaagacgatctaaaggagttgggtatattgaattttatgatgcgatgtcagtgccaatggctattgctctctctggccaacttcttcttggacaacctgtaatggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagcttcgggagatttttgagccatttggtccggttgagattgtgcaactgcctcttgacttggaaacaggacactgcaagggttttgggtttgttcaatttactcatctagaacatgccaaggctgctcagagtttaaatggaaaattagagattgctggcagaactatcaaggtttcatgtgtcacagatcatgttgcaagccaagatacaaccgcaaaatctgcagacttggatgacgatgaaggtggattgactttaaatgctcactcaagagcattgcttatgcagaggctggctggtgctgaccctgcaagcctaggtttgcctgttgtgaatggctcagttcctgctcagcagactattagcttgcctattggcgcaccagttctaccaacgcaagttatgcctaatccagcagtagaacctgtaggaaaccccagcgactgtttacttttaaagaatatgttcgacccgagcactgagacggaacctgattttgatatagacattaaagaggatgtagaggaagagtgttctaaatatggccgggtgaagcatatttttgttgacaagtaa

SEQ ID NO: 317 - DNA, 1590 bp, Glycine Max
atggacttcgacgagtacgaatacctggagaagacagtggaggaagacatagattcctccaagaagaagaaggacgtcaccgacaagagcgagaggagttaccgaaagccccgcgacgtcgacgacgatctcgacgccgatgacagaaagagcaagaggtctagggtcgacgacgagaacggcggttccaagagagatcgcgacagagacagagagagagaccgtgaccgcgaacgttcctctggtcgtcacaggagcgagagggagagagacggagagaggaaagacagggataaggatagagagaggagggataaggataaggataaggataggagagaccgtgatagggacagggatagggatagggatagggaaaaggagcgcgagagaagagagaaggatagggagcgagagagggaaagagcggagagggagagatccacaaggagcaggagtcgctccgagagggacagagatagggagcgagattttgatatgcgcgatggccggagatttagggataaaaaagaggctgcagaacctgaggcagacccagaaagggatcagagaactgtttttgcctaccagatgccgctaaaagcaacagagagagatgtgtatgagttcttttcaaaagctggcaaggtgagagatgtccgtctgatcatggataggaactcaagacgatctaaaggagttgggtatattgaattttatgatgcgatgtcagtgccaatggctattgctctctctggccaacttcttcttggacaacctgtaatggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagcttcgggagatttttgagccatttggtccggttgagattgtgcaactgcctcttgacttggaaacaggacactgcaagggttttgggtttgttcaatttactcatctagaacatgccaaggctgctcagagtttaaatggaaaattagagattgctggcagaactatcaaggtttcatgtgtcacagatcatgttgcaagccaagatacaaccgcaaaatctgcagacttggatgacgatgaaggtggattgactttaaatgctcactcaagagcattgcttatgcagaggctggctggtgctgaccctgcaagcctaggtttgcctgttgtgaatggctcagttcctgctcagcagactattagcttgcctattggcgcaccagttctaccaacgcaagttatgcctaatccagcagtagaacctgtaggaaaccccagcgactgtttacttttaaagaatatgttcgacccgagcactgagacggaacctgattttgatatagacattaaagaggatgtagaggaagagtgttctaaatatggccgggtgaagcatatttttgttgacaatggaagcggcaagtggtgctcaacgtgcaatgcacatgagatggtttgcacgcaggttaatttcagctgtcttcatgcaaccagagttgtatga

SEQ ID NO: 318 - DNA, 555 bp, Glycine Max
atggacttctactttggaaactctcctccttatcccaataattatgctcataattctcttaatatggctctatcttcccctgagattgcactatccgattatctcatgctcgatgactatgttgatcatcaagattctcgatcatcacaaagcaccgagtcatctgaaaaagcaaccttcaatgatgccactcacggattcagtactggtgcaacctctaagaataataacataaactgcaaaaatgggattaatgaaaacaaaggtggagtgggtccaaggatcgcgtttagaaccaaatcagagcttgagatcatggatgatggatacaagtggaggaagtacggcaagaagtccgtgaagagcagtcccaatctaaggaactactacaaatgttcaagtggaggatgcagtgtgaagaaaagggtggaaagggatagagatgactacagctacgtgataacaacatatgaaggtgtgcacaatcatgagagcccatttaccacatactacagccccatctccttcgtacattctgatactactttcaaatga

SEQ ID NO: 319 - DNA, 204 bp, Glycine Max
atggagaagaagaaggttgcatgtgtcgtcctcctcgtcgtgacctctattagcactgcaatggctcacgccggtcacgacaaggccgaagctcctgcaatcgtccccgccccagctctggcacccaaaggcggcgttgctgctcttggtccattccttggtgcctccctcctctcctttcttggatactatttgcagttctaa

SEQ ID NO: 320 - DNA, 2838 bp, Glycine Max
atggagaagctacttgcaataaagaaggataaagagagggagattcaaagaaacaaccacaaagacaccactaatgcttacaagctttggacaaacagggtatcagatgccgcagaagaagtgcagaagctgaaagttaaatacaaagaaaaaatgctaccctggtggcgtattcgtcgacgttcacgtctgagtgaaaatatggtgaagaagagcaactgtgttcgtgaacttgtgaaggatgaatgtttaagagattttcttgttgataaaccaccagagcctgtcttaaaggagttaaatgtcccacggataagtggatatccaacccttcaagatgccttggaaaagactctgggtttgctaagaaataataagattaaagtcattggagtgtgtggaactaaaggggtggggaaaacaacaataatgcggaacctaaacaacaatgaagaggttgctaaactgtttgaaattgtcatttttgtgaaagccacaactgatgatcatatgcttcaagagaaaattgctaatcggttgatgctggacataggaaccaacaaggagcatagtgatgatgttgcaagaagaatacacaaagagctagaaaagaagaagtatttattgattttggatgaggttgaggatgccatcaatttggagcagttgggaattccaactggcatcaatggcagtaaggttgtaattgccactcgattccctcgagtttataagttgaatagggtgcagaggctcgtcaaagtcgaggagctaactcctgacgaagcatggaagatgttcagagatactgttcatgcctttaatcctaagattgattcccttgacattcaacctatagcccaacttgtatgccaaaggtgctcttgtcttccacttctcatttacaacatagcgaattcttttaaattgaaagagtctgcttcaagttggtcggtgggacttgaagatcttaaaccttggccagaacttcaaaaccaaggtttacaagagttgtactcatgtctgaaattctgttatgatgaactcaaagataaaaagaagcagaaatgctttctatacacttcactgtatcctgtagatagcaaggtttacactgattatttagtggagtgttgggcagcacaaggtttacttggtgatataaatgacaaaaggtcatatcgaagtgcacgcaattgtggtattgacatattagaacatcttgctaatgtctctttactagagaaaggggaatcaatgatatatgtcaacatgaatcattgtatgaggcaacttgcattacacatatcctccaaagatcctgagtgtagcttttatctccaagatggtgaagaatctgaaaatctctcaaattcaaaagcttggcagcagtctaggtgggtctctatgagacaattgcttgatttaccaacacgccaagatcgcagcatggttttgacattgttgctgcgaaaaaatcccaaactaactacaataccccaaactttttttgagaacatgagcagtctacttctgttagacttgtatggtagcatgattacacaactgccatcgtctttatcaaaattgactggtctaaggggtttattcttgaaccgttgcgagctcttggaatcattatcatctgaaattggatcacttcaatttctagaggtccttgacatacgagatactaaagtaactttcatacctctacaaattggatgtttgactaatctaagatgcctgcgaatcccattcgttgcaagtgaagatgatgctcaaaatgttcatgtgatttcaaagcttcataggttggaagaattaaccattcaagtcatatcctatgaacaatggtgcaatgatgctgaaaatgttttacaacatgtggcttctttggaaaatgtaacagatctccgatgttgttttccctcctcaatcattcttagagaatttctttcaagaagtaaatcatggagttgtaagcaacaaaattcatttagattctttgtgggttgccaaaattcaaggcgacctcaaatacttgaatcttttgagtacaaaattactaattatttgaggtactgcaatggtggacaggaggatgactcggcaattattgaggtactaccaaaaactgatgcatttgaattagtttgccataaagatatcaaaaagttgtcaaattttgctggcatagtgtgtttggaacgcattcgtggtcttttgattaaaaaatgcaacaaagttttaacaattgtgtcagctgatacaagtagcaacaccatgaatggaatccaaatagaaacaagagtcatcttaccaaatttggagaaattgtatttggaaaatttgctcaatttgaaatgtgtttttagaggtcccttgcacagtggaaccttttccaaattgcatactttgtcattgaagaattgtccatcactgagagaaattttcagcaatggagcaattcaacatttttcagaacttcaaaacctgaaacttgaagattgttcaaaaattgaaatactgatcagcaaagacattgaaccagaaaaggatgtgcttccaaaactagaaatgcttctgctggttaacttgcctaactttaatactatatgctcaactcatacattggcttggtcctctttggagctgttaaggatacataactgtcctaagttgaaaactttaccactagacagtgacaatgcagtcaacttaaagtccattaaagggcagcaagagtggtgggatgagttggagtggacaaacaacgatgaggtgtatcagcggttgcaacccatctttgctgcctccaatgagtatttttcttag

SEQ ID NO: 321 - DNA, 789 bp, Glycine Max
atggagaagtacgaggtagtgaatgaggagatagggattgggagagacgcggtcgtaagacttatgcgttgcaaagaaactaaggatctcgttgccgtcaaatacatcccacgggaagacaggattattgatgagaaggtggcaagggaaatcataaaccttagatctcttcgtcatccgaatattgttcggttcaaggaggtggctttgactccaacgcatcttgcaatagttatggagtatgcagcgggtggagagctgtataaccgagtttgcaacggaagaatacgtgaagacgagtcatacctacttcattcgagaccccattcagtgattggaactccagcctatattgcaccagaggttctttccgggaaagattacgatggaaagttggcagatgtatggtcctgtggagtgatactttatacaatgttggtaggagcattgccatttgaggacataaaggataccgaaaatttccagaaaaccataaaacgagttatggctgttcaatacaagttccctgaaagagtttgcatatctcaagacagtaaaaatctgatatctcgcatttttgtggcaaatccagcaatgagaatcaccatgaaggaaatcaagtcacatccttggtttttaaagaacttgcctaaggaattgagagacggggctcaagatgtctactacaatgaagaaaatacaaaatatcctcttcaaagtatagaagagatcatgaacattgtcaacgaggccaaaactacaactgcaacttccagtccatatctatag

SEQ ID NO: 322 - DNA, 564 bp, Glycine Max
atggagactaaacagagttcggtgacggttacgctcagttacggcgcgttgacgtgcgccgcggaatttctcgcgactttgctagcttctgctgtcgtcaaagcctcgcttttggccccggatctctaccggctgctattgatcaacacgcctactgccaaaggagagagcaaaattcagagtgaagacaagcaacgtgatgcagagggagaagatggtaacgatgatgaaggcgacgatgacgacgatggagatggtggatttggggagggtgaagaggagttgtcatctgaagatggaggtggatatggcaacaattccaacaacaagagcaactcaaagaaggcacccgaaggtggcgcaggaggggcagaagagaatggggaagaggatgaagatgaagatggtgatgatcaagatgacgacgatgaggatgacgatgatgatgacgaagaggacgaggcaggtgaagaagaggatgaagatggtgctgaggatgaggagaatgaagaggacgaggaagatgaggaagcattgcagcccccaaagaaaagaaagaagtga

SEQ ID NO: 323 - DNA, 564 bp, Glycine Max; identical to SEQ ID NO: 322

SEQ ID NO: 324 - DNA, 564 bp, Glycine Max; identical to SEQ ID NO: 322

SEQ ID NO: 325 - DNA, 564 bp, Glycine Max; identical to SEQ ID NO: 322

SEQ ID NO: 326 - DNA, 564 bp, Glycine Max; identical to SEQ ID NO: 322

SEQ ID NO: 327 - DNA, 564 bp, Glycine Max; identical to SEQ ID NO: 322

SEQ ID NO: 328 - DNA, 1071 bp, Glycine Max
atggagagtgaaagcaagcaagttaagcagaagctgggggtcttggatatcctcaaggaagctgtaacattctatgtcagcaatatcaacttcattatcttcacctttctcaattcccttcctttcttttttgtcatgctttactttgaaattttgttccagcaaactatcgttgagaccccggaaattttttcacttctaccttttaacgaaagaaatcatgcctatgaacttgatgtaatttatgattacggcacaaacattcctagtagaagttttcgtaagaactatttgcctgataaaagttttagtaaggattatttgcctgttttgattctacttggattcatttacttggtgcctcttcatgttctagagctctgctcggcagttgtaactatggattcagcttcaaagctgtactcagaagagaataacatgagtgtcatggatatgtttaaaagatccattgacatatcaataatgaaaggcacatttatcacttctttgtatatgctcttttggtcaacttgccttttgattgcattcccatggatggcaggtaactgttatgtgctcttcagggatttaggatactacatattttttgcagtaatttgttttttagtttttgtaaagctgttgaaggtgtatttggaatggagtgctatttggaatatgagttttgtgatatcagttgtggatggtatatatggtattggggctttgcgagtttcgtattacctcagcagaggtaatcagaagagaggactacttgtgatgcttgttttctttgctttgggactttgtttaaggttgtcatgtgtctcccttggatgctataaaggagggtatgggatatttgtacaaattgggctcctcgctgtgttaaataccctgaaatggctgtcgtgcatgatttacttttctgattgcaaggagaggaaaatgcagaagaaagttgatgaggaatcagaatggaacttggagataatttgctgttatgtagtgataaatttgtttttatgtggagttagtgatgagaatttgaataatgtacaagatgtgtag

SEQ ID NO: 329 - DNA, 1413 bp, Glycine Max
atggaggaagaaagcacttcagcggaatccaatccttcttcgagcgaccgcatcaaactaaacgtgggcggaaagctcttcgagacgacgttctccacgctccgttctggcggcccggactcgctcctcttcgcgctctcgaaccgccgatccgccgacccgagccccgtcttcatcgaccgcgacccggagatcttctccgtcctcctctccctcctccgcacctcccaccttccctccgccgcgcgccgcttctccaagcacgagctcgccgacgaggccctcttctacggcatcgactcccacctccgggcggccgctgcccctccccccttctctggcatcgacgcggccctctccgcttccctccgccccgcctcggagggcctcccctcctctttcgtcgcctccccctccggcggcgtctggatcgcccacggcggccaaatctcctgctacgatcccatcctcacccacgccgccaccgtccgcacgcacctcgacgaaattgactccatctgcagagtctggcccgagatcgccgccgtcgggtccaaatccgacaccggcctccacttctacaacttctccggcagccgccacgttggatccgtccactggaccgatccgctcgatcctcgaatcttcaaagccagcgtcaacgccataacaagctcctcaaactccgttttcgcttcgttcgattgtccgcacagagagaattgcataatcgaagtcgataaggagaagcttctgatcgcgaatcagttcgctcggcaatcagggaaccaggcgaagaacatggttccccgaaagctgacgtggattccggcgaccggagttctcgtcggaagcgcggtcaccggcggcgcgttcggttactccggctacgtccggttgtgggacccgagatccggggacgtggtctgggagacaaacgagcctggtggttcgggacggagcagcaggtttggggattcgtttgctgacgtggaggcggacgtggaagggttgttgctgttcaagctgtgttctaagtccggggatttggctatggcggatatgcggtttttgaaggacgatccttgggtttatatgaaagagaagaaccctagtttggtgagttgtggtgaagtgaggaatagtgtggtgcattgttatagggggcaagtgtttgtggctagagaaggagcattggaggtttggtcaagggcggaacaaaaggaaaatagtgagggaaatgctgaagggttttttaggaggaattttgtggataagagggaggattcagagagaggggttataaagaagattgaaggtggtggggataggttgtttgttagtagggaagatgttgagggtattgaagtgtgggagagttctcattctgcaggagcaatttctgttttgtga

SEQ ID NO: 330 - DNA, 2331 bp, Glycine Max
atggaggacagtgaaaggtgtaggtttgaagaaaagtcattttcaaatggggatgtctacattggtaaaatcaagggcatgcttccccatggcaaaggaaagtacacatggtcagatggagcagtatatgaaggtgattgggtaaatgggaaaatgacggggaaaggactgattacatggccaacaggagcaaagtatgagggtgaattctctgggggatatcttcatggtcatggcacctttacacattctactggctgcatttatacaggtggctggaggatggatgctcatcatgggattggacgaaaggagtattccaattcagatgtatatgaaggtttatggaaagaaggaattcgtgaaggctgcggaaggtattcttgggagaatggaaatacatatattgggaattggaaaagtgggaaaatagatggcagaggggttatgaagtgggctaatggtgatatttttgacggttgttggttaaatggacttaaacatggatctggagtttatagatttgctgatggggggctttatattgggacatggagtaagggcctaaaggatggaaaaggaacattctatcctgctggtagtaaacaaccatctctaaagaagttgtgctctcttaacagcgatgatagtcgtttgttattgaatatggaaaaacatacagctccaaaacaaaaatttacacgtagtttttctgaaaagatttctgtcagtggtagatcaaaaagttctcgtcaaatatctcacaggacttcatcattagatgctaactgtatccttcaagatcctgctggaggttgcatatgtcgcgattcttcacccacattatcgcagacttttaatgaaagtcaatctgaggcaactagtgttaactctttggtttacgaaagggaatacatgcagggagttctaattatggagagaattaggaattattctgaaatgccacataaaaacaaacgtcaaaataagtatagtgtgaagcaagttaagaagggttcatggattgatatttttggaggcagccgaagctattatttgaagcttaatttgcagcttggcatcaggtacactgttggaaaaattacaccagtgcctgcacgtgaagttcggtcatctgattttggagatcgagctaggataaggatgtacttccccaaggagggttcacagttgactcctccacattgttctatagacttctattggaaggattattgccctatggtcttcaggaatttgagagagatgttcaaattagatgctgcagagtacatgatgtccatttgtggtgattctggtctaagggatatatcttcacctggaaaaagtggcagcatattctttctttctcaagatgatagattcgtgataaagacactgaaaaaatatgaactaaaggttatgctcaatatgcttcctaaatattaccatcatgtaggaagttatgagaatactcttattacaaaattctttggtctccatcgaataacactaagaggtgggaaaaaggtacgatttgtggtcatggggaatatgttttgcacagaacttcatatccaccgtcgttatgatctgaaggggtctactcaaggaagatatacaaaagaagataaaattaatagcaatacaacattgaaagatcttgatctaaaatatgaatttcatatggataaaaaattacgagaatccctattcaaacaaatttctctagactgcatgttcttggagtctcagcacataattgattacagccttctgttgggattacattttagagctccggagaatttaaaggccttagtggaacctcccagactaatgcagcttccacatagcttaccctctgaagatgatgcacacaaacaaggggagcagttgattattcctaaaggcttgttattagttgctcatgaacctagctttgtgaacactgcacctggaccccacattagaggaaatacattgagggcatactccataggtgacaagcaagttgatcttttacttcctggtactgcaaggctgagggtgcaattaggagtaaacatgccggctcaagcaacacgcaaacttcagggggataaggtggaggaatcagaagtagagctttttgaggtttatgatgtggtgctatacatgggcataattgatatattgcaagaatacactgtgaaaaagaaacttgagcatgcctgcaaatcactgcaatatgaccctatgactatatcagtggtggaaccaaagacatatgctgaacgtttcatcaatttcatggagaaaaaagttttcccggagccagagacttcttga

SEQ ID NO: 331 - DNA, 2331 bp, Glycine Max; identical to SEQ ID NO: 330

SEQ ID NO: 332 - DNA, 1011 bp, Glycine Max
atggaggaggaggaggaggcggagaaacagaagaagcacttagcaatgctggaacgcctttccaaacgcacccaaagccgttcgcaaaaccccgattcctcatcatcagaatcctccacttcctccatcctttcacgcttcacccacttaaaatcctcgattgagtcccaactcgcccaatcccaatccatttcctccgacccctccaacctcaaactccacttcaatcaaatctccgaatcaatctccgatttagaaaaattcgtcgccgaaaactcctactccctaccctcctacgacgtccgaacctccctcaaaaccgtctccgacttaaagcactccctcgacgacctcacttcccaacttctccccaaaaagaaattctcattcaaaaataaacccaccaccaagaaagaatacaaggattccgctattccactacccacacaaccccctcaactctccacgcgccttgcgccgcgtgactcgccggggttccgaaacaaaaccgctgagcttttaatttcggactttcgaggatccgaggttggggaattcaccgtttcggatctcgattcctgccaagtcaggataataggttccgtcagggcgcttttcgttcataggttgaagaattctagggtttacgtgggccccgtgacggggtcggttctcattgaggaagcggagggttgcgtcttcgtgttggcgtcgcatcagattcggattcacggtgccaaaagaagcgatttctaccttagggttaggagcaggccgataattgaggactgtaatggcgtcaggtttgcgccgtattgtttgaactatgaagggattgaggaggatcttcgtggcgccggtcttgacgccgagaccggaaattggagcaatgtggatgatttccggtggctgcgcgcggtgcagtctcccaattggtcggttttgccggagaatgagagggttgggactgttgagatatccaatttgaaaaatgaggataaggagatttga

SEQ ID NO: 333 - DNA, 1446 bp, Glycine Max
atggaggtgaccaaccttgtagtcttgccagcagtttcggcattctttgtcctttctctacatttcatcactaaagctgacagactcaggaaacatccaaacctcaatcttcctcctggaagattaggatgtcctattgttggagaaaccctcgagtttctgcgtacaatgaatgagggcaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagctcggtaaggaagttgttaaggttgtctctggttaataaggttggtgatgaggctaagatggtgagaaggttgctcatgagctttcttaatgcagaaacactcagaaactacttgccaaaaatggatagcattgctcagcgccatatagacacctattgggaaggaaaagagcaggtgcttgtctatcccatagtacagctatacacgtttgaattggcttgttgcttatttttaagcattgaagactctgaccatatatcaaagctttccttaaaatttgatgaatttctgaaagggatcattggcttgcccctcaacattcctggaacaaggtttcatcgtgcaatgaaagctgcagacgtaataaggaatgaaattgaaatgattttaaagaaaaggaaagtggatttggaggagaagagggcatcacctactcaagaccttctatcacacatgcttgttacatctgaccccaatggaaggtttatgaccgaaatggagattattgataacatacttcttctactctttgctggccacgatagttctagatcagtgttatcattggtcatgaagtatcttggacagttacctcaagtttatgaacatgtcttgaaagaacaacttgaaattagtcaagggaaagaggctgggcagttgttgcaatgggaagatgttcagaaaatgaaatactcttggaatgttgcatctgaagtcatgaggctgtccccacctgtgagtggtgcttacagagaagctataaaggatttcacctatggtgactataacatccctaaagggtggaagctgcattggaacaccggttcatcacacgaggatccagcactcttctcaaatcccgaaacttttgatgcttcaaggtttgaaggggcagggcctacaccattttcatatgttccatttggaggtggcccccgaatgtgtttggggcaagagtttgctagactagagatacttgtgttcatgcataatatcgtgaaacggttcaagtgggatttggtgattcctgatgagaagtttaagtatgatcccttgttagaaccagtaaaagggcttgcaattcgacttcatccttcccatttctag

SEQ ID NO: 334 - DNA, 1446 bp, Glycine Max
atggaggtgaccaaccttgtagtcttgccagcagttttggcattctttgtcctttgtctatatttcatcactaaagttgttagactcgggaaacatccaaaccttaatcttcctcctggaagattaggatggcctattgttggagaaacctttgactttatgcgtacaatgaatgagggaaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagttcggtaaggaagttgttaaggttgtctctggttaataaggttggtgacgaggcaaagatggtgagaagattgctcatgagctttcttaatgcagaaacactcagaaactacttgccaaaaatggatagcattgctcagcgccatatagacacctattgggaaggaaaggagcaggtgtttgtctatcccatagtacagctatacacgtttgaattggcttgttgcttatttttaagcattgaagactctgaccatatatcaaagctttccttaaaatttgatgaatttctgaaagggatgattggcttcccccttaacattcctggaacaaggtttcatcgggcaatgaaagctgcagatgcaataaggaaagaaattagaatgattctaaagaaaaggaaagtggatttggaggagaagagggcatcagctactcaggaccttctatcacacatgcttgtcacatctgaccccagtggaaggtttacgactgaaatggagattattgataacatacttcttctactttttgccggtcacgatacttctagatcagtgttatcattggtcatgaagtatcttggacaattgcctcatgtttttgaacatgtcttgaaagaacaacttgaaattagtcaagggaaagaggcagggcagttgttgcaattggaagatgttcagaaaatgaaatactcttggaatgttgcatctgaagtcatgaggctatccccacctgtgagtggtgcttacagagaagctaaagaggatttcacctatgctgattataacatccctaaagggtggaagctgcattggaacaccggttcatcacacaaggatccagcactcttctcgaatcccgaaacttttgatgcttcaaggtttgaaggagcagggcctacaccattttcatatgttccatttggtggtggcccccgaatgtgtttgggtcaagagtttgctagactagagatacttgtgttcatgcataatatcgtgaaacggttcaagtgggatttggtgattcctgatgagaagtttaagtatgaccccatgctagaaccagtagaaggacttgcaattcgactccatccttcccatttctag

SEQ ID NO: 335 - DNA, 1461 bp, Glycine Max
atggaggtgaccaaccttgtagtcttgccagcagttttggcattctttgtcctttgtctatatttcatcactaaagttgttagactcgggaaacatccaaaccttaatcttcctcctggaagattaggatggcctattgttggagaaacctttgactttatgcgtacaatgaatgagggaaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagttcggtaaggaagttgttaaggttgtctctggttaataaggttggtgacgaggcaaagatggtgagaagattgctcatgagctttcttaatgcagaaacactcagaaactacttgccaaaaatggatagcattgctcagcgccatatagacacctattgggaaggaaaggagcaggtgtttgtctatcccatagtacagctatacacgtttgaattggcttgttgcttatttttaagcattgaagactctgaccatatatcaaagctttccttaaaatttgatgaatttctgaaagggatgattggcttcccccttaacattcctggaacaaggtttcatcgggcaatgaaagctgcagatgcaataaggaaagaaattagaatgattctaaagaaaaggaaagtggatttggaggagaagagggcatcagctactcaggaccttctatcacacatgcttgtcacatctgaccccagtggaaggtttacgactgaaatggagattattgataacatacttcttctactttttgccggtcacgatacttctagatcagtgttatcattggtcatgaagtatcttggacaattgcctcatgtttttgaacatgtcttgaaagttatctttatgacagaacaacttgaaattagtcaagggaaagaggcagggcagttgttgcaattggaagatgttcagaaaatgaaatactcttggaatgttgcatctgaagtcatgaggctatccccacctgtgagtggtgcttacagagaagctaaagaggatttcacctatgctgattataacatccctaaagggtggaagctgcattggaacaccggttcatcacacaaggatccagcactcttctcgaatcccgaaacttttgatgcttcaaggtttgaaggagcagggcctacaccattttcatatgttccatttggtggtggcccccgaatgtgtttgggtcaagagtttgctagactagagatacttgtgttcatgcataatatcgtgaaacggttcaagtgggatttggtgattcctgatgagaagtttaagtatgaccccatgctagaaccagtagaaggacttgcaattcgactccatccttcccatttctag

SEQ ID NO: 336 - DNA, 369 bp, Glycine Max
atggagtcaaatgaagaattggtgatggaagttctatcaatggaagttctatcaatgtttgaatacaaccatggcaaagaccacaacaaggtcatcacaaatacaacattgacgcatctatattttatgaccaacaacaattcggacttggaatatgtattcgagatcacaatggcgaatttaatagttgctagatgtagagctttgttatctataattccaaactcaattgtgagttttgtgagaagacaatcaagccaagtagctcataatctagcaaaagcttctaggagagatgttcattatgattatacatctttgttaagattgtctcttcttacattacgaggaatcaatccctttcattag

SEQ ID NO: 337 - DNA, 1086 bp, Glycine Max
atggagttggacttgacaccaaagacagcagaagtgttgtttgagggagatggtggaggttactacacttggtggagttctaaagtgccactgctggccaagaccaatgttggtgctggtcggttagtgcttcagcctcagggctttgctattcctcattattcagatatatccaaagtaggttatgtgcttcaagggaacgatggcgtagctgggatggccctccgcaacagtactactagagaagaggtggttgtgaagcttaagaagggagatgttataccagtacctattggaagtgtctcgtggtggttcaacgatggggactcagatcttgtcattgtttttcttggagaaacttcaaaggctcttattcctggcgaaattagttatttctttctaaccgggcttcaaggagttataggaggcttctctaatgagctcacaagcaaaatatatggtttggacaaagatggggtggaaaagctcacaaaaagccaaagtggggttgtgatcatcaaattagacaaaagccaatctttgcctaagccccaaatggaaataaccaaaaagctagtctataatatagatgttgcacaccccgaaaatgttgtggaaaatgctggaatagtcaaaaccttaacggagcaagattttccttttattggggatgttgggttaagtgtgattagagtgaaacttgaaccgggtgctattaaggcaccatcatacccaatcaaccctacggttcagttgatttacattgctagaggaagtggcaagattgaaattgtggactttagtgggaagtgtgcattagagactcaagttgaggctggtcatttgcttgttgtgccacaattctttgtggttgcacaaattgctggggaagaaggaattgagagttactctatcgtgacaactacaaagcctttatttgaagagttgggtggaagggcatcaatttggagcgccttgtcaccatctgtgcaacaagcatctcttcacgtggattcagaatttcaaagcctcttcatatccaagatcaaggaaaccacaaatctcattcctcccactactaattag

SEQ ID NO: 338 - DNA, 933 bp, Glycine Max
atggagttggacttgacaccaaagacagcagaagtgttgtttgagggagatggtggaggttactacacttggtggagttctaaagtgccactgctggccaagaccaatgttggtgctggtcggttagtgcttcagcctcagggctttgctattcctcattattcagatatatccaaagtaggttatgtgcttcaagggaacgatggcgtagctgggatggccctccgcaacagtactactagagaagaggtggttgtgaagcttaagaagggagatgttataccagtacctattggaagtgtctcgtggtggttcaacgatggggactcagatcttgtcattgtttttcttggagaaacttcaaaggctcttattcctggcgaaattagttatttctttctaaccgggcttcaaggagttataggaggcttctctaatgagctcacaagcaaaatatatggtttggacaaagatggggtggaaaagctcacaaaaagccaaagtggggttgtgatcatcaaattagacaaaagccaatctttgcctaagccccaaatggaaataaccaaaaagctagtctataatatagatgttgcacaccccgaaaatgttgtggaaaatgctggaatagtcaaaaccttaacggagcaagattttccttttattggggatgttgggttaagtgtgattagagtgaaacttgaaccgggtgctattaaggcaccatcatacccaatcaaccctacggttcagttgatttacattgctagaggaagtggcaagattgaaattgtggactttagtgggaagtgtgcattagagactcaagttgaggctggtcatttgcttgttgtgccacaattctttgtggttgcacaaattgctggggaagaaggaattgagagttactctatcgtgacaactacaaagtaa

SEQ ID NO: 339 - DNA, 1884 bp, Glycine Max
atggataaagtttcatcagactgtccgtacccgggatgcttcttttgtgtcatgaaggaagggaatccaagcaagcgcagagcaagtgtactgaaattctttagagaactaccgtgtcaagatgaagatggtcaggttctccctatcagtggcctttggaacacggctatggcacatccaaatgaccctgaattcatcgagctaggaatatttgaatgcatgtctgctctcatatggaagggactgaagaaccggcgttggctttctcatgaccaaaatatatatattccttattatgctgctcatatcatcggttcctacacaatgaatatggaagaatttgcagaaagtgccgtgcatgctggggtcattcctcctttggttgagcttttacgaggtagattaacttgggttgagcagagggtggcagttagagcattgggacacttagctacatatgccagcacttttcctgccatagcaagtcatggtgaaattcttgagctctccatccaattggcaatgagttccctggaaatagtttattcacacttttaccaatatgttgatagaaggctcagttatcattgtgatcttcttacacgtggcatgggtggcgttgaaatggagtccaggaaggctgaggaatgggctagtcagttgcagtgttggtcccttcagctaattaattgttttgcttttaaacatgaatttcttcctaccatatgcaaacccgaatttctgataaaactacctggtatgtggggtggacttgttaatgaaaattcaccagccggtattggtttattaagaacaatttgtcatcaaaagcttggtaggggacctgttgccagttgccctggtattattgatgcattgtgtaatattgctcggtcttcggatgattggcagtatatggctattgattgccttctatggctgcttcaagatcccaatacatgtcacaaggtgattgataaagtggtgcctgtattagttgaccttgctgagattacaactctgggtgatcataaaaagcttggtgattcaatccttaatgtttttcaagagtgcatccagtctcaagggtcaggacgaagctcaattagtagtcacactaaagaacagattgaggatatattagattcaaagcagagattaaaatgggaaaagaatatgcccaaggaagatctgcatattaagcaggctgcagcgctggttgtcaagcttgaaggaaattccctgttctcatctggaaatattgctggagctgcatcaaaatactctgaagcattggcattgtgtcctatgagatccaggaaggagagagttgttctatatagtaatcgtgctcaatgccatcttttgctgcaacaacctttggctgccataagtgatgctacccgtgcactatgtctccatagacctgtcaatcgtcatgccaaaagcctctggagacgagcacaagcttatgacatgcttggattagcgaaagagagtttattggatgctattttatttataaatgagtgctctcagtcaaatgatcctgatctctcactgaggcaaaataaagttccagattatgctgagcgtttggttaagaagcagatgcgttctgcttggttatttcgagaggcagctattaagcatggtggggtccatagtcagggtgatggtggtgatatgtatggcccagagactgatgattcggaatgggagacagctagtgaaagtgatataggaaatgatggacgggatgacatgggtgatgacgacgatggtgattggaataatgatgatcagaggaaagattatgacaaaccttcaatgaaagatataaaacatggatacaatgtgcagcttgcggaagaagaaccttga

SEQ ID NO: 340 - DNA, 794 bp, Glycine Max
atggatactattgtctcagttgcttctccaattgttaaacgtgaatttggttacatagtctcctatgaagagaaccttcaaaggcttgaaaccatggctcaaaggctggaggatactaaagccagtgttcaacactctgctgctgaggcagaaaggaaaggagaaaagatggaagatattgtagagaattgggtgaagaatgccaatgacgctgttgctgaggcaaataaacttattgagattgatgggaatgcagaagcagatgttgtatggggctatttcccaatctcactggactccagaacattaatgctgattgagattaaggaagccttgaaggaccccgaaatctacaattgggaaaaagtggcaaaatgttgtgctggtttgcctcttttgatagttactgtggcaaagggtttgagaaaaaaacatgtcgttgcttggagggatgccctaattcaactagagagacttgatcacgaagatttgcgtgagaaagtcttccccactctggagttgagttttaatttcttaggagatgatcagaagtcactattgttattcattagttcatttggcctcagttatatccacattggagaattattttcatgttgttggaggttgggcttttatgagcgcatgaacactttggcaaaggaaagaaacatagattacaaattaataaatgaccttagggcctcttccttgttgcttgaagctgaggctgaacctgaatgggttagaatgcatgatgttgtgagttatgtggctaaatcaattgcttctag

SEQ ID NO: 341 - DNA, 156 bp, Glycine Max
atggatagcactagtgatgctaggacatattatcaaagtgaaacgcatgatgatcacgtatttaagccaaaagaagataaagataatgcaaacgaagtgttctcaatggattacactccagccagaaggaagccaccgatccacaatttgaattga

SEQ ID NO: 342 - DNA, 618 bp, Glycine Max
atggatcaaaaccagcatggtcaaccaacacaagaagcagttggcaagaaccaatatcaatctaatcctatgatggcacctaccaatcctcctagtgagactattggtccttatgtcacatcatccttccctagagagaaacaacatgctccccaagacatttaccaggaacaactcaacaacttttgggcaaaacagtgccaggaaattgaggagaccactgatttaaggactcacagcttgccttatgctaggattaagaagatcatgaaggctgatagggatgtgaggatggtgtcagctgaggctcccgtgttgtttgccaaggcctgtgaaatgtttattatggagctcacaatgaaggcttgggccaatgctgaggatcacagaaggaggatacttcagaagagtgacattgcatctgcaatctcaaagactgatgtgtttgattttcttgaggatattgtccccagggatgtaggcataccaagatcaagcattgctcaaaattttgatctaagtatgccaccacatcagaatgtcacatacccaccatattatgttccagcaatggtcacgggaagacccattcctgatcaaaatcatcatgggccgtaa

SEQ ID NO: 343 - DNA, 1287 bp, Glycine Max
atggatccctctacttctcgtccagctgtagtcatcgataatggctccgggtatactaagatggggtttgctggtaatgttgagccatgttttattgttcccacagtggttgcaattaacgagtcttttcttaatcaatcgaggaactcctctaaaggcaattgggttgcccagcataatgctggcgtaatggcagatcttgatttcttcattggggatgaggcactttccaagtctcgatctagcagcacttataatctcaactacccaattcagcatggccaggttgagaattgggacgccatggagcgcttctggcagcagtgcatattcaactatttgaggtgtgatccggaggatcactattttctcttgactgagagtccgttgacttcgcctgagagtcgcgagtatactggggaaatcatgtttgagacttttaacgtacctgggctttacattggtgtgaattctgtgcttgctcttgcagctggttacacaacatctaagtgcgagatgacaggagttgtagtcgatgttggagatggggctgctcatgttgtacccgttgcggacggctatgttattggtagtagcatcaaatcaattcctatttctggaaaggatattactctttttgtacagcagcttatgcgggaaagaggagagaatgtaccactagaggactcttttgaagtggcacggaaagtgaaggaaatgtattgctacacctgctctgacattgtgaaggaatttaataagcatgacaaagaaccagccaagtatatcaagcattggagaggcattaaaccaaggacaggggcaccatattcctgtgatattggctatgaacgatttctaggccctgagattttctttaatcccgagatatatggcagtgactttaccacccctttgccagttgtaatagacaagtgtattcagtctgcgccaattgacacaaggagatcattatacaagaatgtagtgttgtctggaggttcaaccatgttcaaggattttcacaggaggttgcaacgtgatctaaaaaaaatagtggatgctcgtgtacttttatctgaatcacgcttgaatggggagataaaatcgcagccagtggaggtaaatgtactcagcaatccaatccagagatttgcagtttggtttggaggatcagtgcttgcatcaacacctgaattttttacggcttgtcatacaaaggcagaatatgaggagtatggagcaagcatttgccggacaaatcctgttttcaagggaatgtattaa

SEQ ID NO: 344 - DNA, 825 bp, Glycine Max
atggatgagaattcagcaacaaatggaacccatgaggtgattttagatgtaaacaaggatgtctctagaacaactcaaccctcacgctcttgtgtcaatgtttctttcttacagaagttggtagctgaggtggtgggaacatatttcttgatatttgcagggtgtgcttcagtggtggtgaacaagaacaacaacaacgttgtaacacatcctgggatatcaattgtttggggactggttgtgatggtactggtttactctgttggtcacatctctggtgcccatttcaatcctgcagtcaccattgcttttgcctccaccagaaggtttcccttgaagcaggtaccggtttatgtagtagctcaggttgttggatccacacttgcaagtgcgactctcagactattatttagtggcaaggaaacccagttttcaggaacactcccatctgggtctaacctgcaagcttttgtgattgaattcttaatcacctttttccttatgtttgtcatatccggggttgccactgatgacagagcgatcggtgagttggccgggattgccgttgggtccactgtgctgttgaatgtgatgtttgcagggccaatcacaggagcatcaatgaacccagcaagaagcatagggccagccattttacacaatgaatacagaggaatatggatatatatagtgtctccaactcttggggccgtggctggaacatgggtatacaacaccattaggtacacggacaagccactgcgtgagatcaccaagagtacctctttccttaaaggagtagggcgtagtggtagctctaggtga

SEQ ID NO: 345 - DNA, 894 bp, Glycine Max
atggatgaggagtacgatgtgatcgtgttgggcacgggtctcaaggagtgcattctcagcggtcttctctccgtcgatggcctcaaggttctgcacatggacaggaatgactattacggaggagaatccacttcgctcaatcttattcagctttggaagagattcaggggagatgacaagcctcctccacatttgggagctagcagggactataacatcgatatgaaccctaagtttattatggctaatggcaatttggtgcgggttctcatacatactgatgttactaagtatctctctttcaaagctgtggatgggagctttgtgtttaataaaggaaaggttcataaggtgcccgcaaatgacatggaggccttgaagtctccacttatggggctatttgaaaaacgccgagcacgcaagtttttcatttatgtgcaaaattacaatgagagtgatcccaagacccatgaagggatggacttgacaagagtgactactaaagagttgatagcaaaatacggtcttgatgataacactatagacttcattggtcatgctttggcgcttcatagtgatgatcgctacttggctgagccagcactggacactgtgaagagaatgaagttatatgcagagtctcttgcacgctttcaaggagggtcaccttacatatatcctttgtatggtttaggagagcttccccaggcatttgcacggcttagtgctgtttatggtgggacatatatgttgaataagcctgagtgcaaggtagaatttgatgaggaaggaaaggttgttggtgtcacatctgaaggggaaactgcaaagtgcaaaaaagttgtttgtgatccatcatatttgcccggcaaggtattagaaaccaacctctag

SEQ ID NO: 346 - DNA, 1335 bp, Glycine Max
atggatgaggagtacgatgtgatcgtgttgggcacgggtctcaaggagtgcattctcagcggtcttctctccgtcgatggcctcaaggttctgcacatggacaggaatgactattacggaggagaatccacttcgctcaatcttattcagctttggaagagattcaggggagatgacaagcctcctccacatttgggagctagcagggactataacatcgatatgaaccctaagtttattatggctaatggcaatttggtgcgggttctcatacatactgatgttactaagtatctctctttcaaagctgtggatgggagctttgtgtttaataaaggaaaggttcataaggtgcccgcaaatgacatggaggccttgaagtctccacttatggggctatttgaaaaacgccgagcacgcaagtttttcatttatgtgcaaaattacaatgagagtgatcccaagacccatgaagggatggacttgacaagagtgactactaaagagttgatagcaaaatacggtcttgatgataacactatagacttcattggtcatgctttggcgcttcatagtgatgatcgctacttggctgagccagcactggacactgtgaagagaatgaagttatatgcagagtctcttgcacgctttcaaggagggtcaccttacatatatcctttgtatggtttaggagagcttccccaggcatttgcacggcttagtgctgtttatggtgggacatatatgttgaataagcctgagtgcaaggtagaatttgatgaggaaggaaaggttgttggtgtcacatctgaaggggaaactgcaaagtgcaaaaaagttgtttgtgatccatcatatttgcccggcaaggtgaggaaggttggtagggttgcaagagcaatagccataatgagtcacccaatccccagcactgatgattcccattcggtgcaaattattttaccacagaaacagttgggtcggaagtcagacatgtacctattttgttgttcatatactcacaatgttgctccaaagggaaaatttattgcatttgtatcaaccgaggcagagacagatcagccagcaattgaactaaaacctggaattgaccttctaggacctgttgatgagatattttttgatatctatgacagatatgaaccggtcaatgaacccactttggacaactgctttgtatcaacaagttatgatgctactactcactttgagtcgaccgtggatgatgttctcaacatgtatacattgataactggaaaggttattgacctgagtgtggatcttagtgctgctagtgctgcagaagagtaa

SEQ ID NO: 347 - DNA, 1230 bp, Glycine Max
atggatgaggagtacgatgtgatcgtgttgggcacgggtctcaaggagtgcattctcagcggtcttctctccgtcgatggcctcaaggttctgcacatggacaggaatgactattacggaggagaatccacttcgctcaatcttattcagctttggaagagattcaggggagatgacaagcctcctccacatttgggagctagcagggactataacatcgatatgaaccctaagtttattatggctaatggcaatttggtgcgggttctcatacatactgatgttactaagtatctctctttcaaagctgtggatgggagctttgtgtttaataaaggaaaggttcataaggtgcccgcaaatgacatggaggccttgaagtctccacttatggggctatttgaaaaacgccgagcacgcaagtttttcatttatgtgcaaaattacaatgagagtgatcccaagacccatgaagggatggacttgacaagagtgactactaaagagttgatagcaaaatacggtcttgatgataacactatagacttcattggtcatgctttggcgcttcatagtgatgatcgctacttggctgagccagcactggacactgtgaagagaatgaagttatatgcagagtctcttgcacgctttcaaggagggtcaccttacatatatcctttgtatggtttaggagagcttccccaggcatttgcacggcttagtgctgtttatggtgggacatatatgttgaataagcctgagtgcaaggtagaatttgatgaggaaggaaaggttgttggtgtcacatctgaaggggaaactgcaaagtgcaaaaaagttgtttgtgatccatcatatttgcccggcaaggtgaggaaggttggtagggttgcaagagcaatagccataatgagtcacccaatccccagcactgatgattcccattcggtgcaaattattttaccacagaaacagttgggtcggaagtcagacatgtacctattttgttgttcatatactcacaatgttgctccaaagggaaaatttattgcatttgtatcaaccgaggcagagacagatcagccagcaattgaactaaaacctggaattgaccttctaggacctgttgatgagatattttttgatatctatgacagatatgaaccggtcaatgaacccactttggacaactgctttgtatcaacagtgagtttactctggtattaa

SEQ ID NO: 348 - DNA, 1209 bp, Glycine Max
atggatgatgcacagggtagttcaaattctctgccccctttcctggcaaagacttatgagatggtggatgatccttccacggattcggttgtttcgtggagtgtcactagcaagagtttcattgtatggaatcccccagaatttgccagggatttgctgcctagattctttaagcacaacaacttctcaagtttcatcaggcagctgaacacatatggatttaaaaaagttgacccagaacaatgggaatttgccaatgatgactttgtcagagggcaacctcatcttatgaagaacatccatagacggaagcctgttcatagccattctttgcagaatctccaagcacaaggcccgctaggggaatcagaaaggcagagttttactgatgaaatagagaagcttaagcatgataaagagcaacttctcgtggaattacagaaataccagcatgagtggcaggcatatgagatacaaatacattgctcaaaagatcggttggaaaagttggaacagaatcaacaaaggatggtttcttctgtttctcatgtattgcagaaacctgtgatttctgtaaatatcttgcctctgacagaaaccctggatagaaaacgaaggttgccaagaagtggccacttttatgatgaagatggcgttgaagatgccattgaaacttgccaaatgttaccaagagaaaatgcagaccataccactgtcttgacattaaatgtggagcgactggatcagcttgaatcatccatggcgttttgggaggctattgtacatgatattggtgacaccttcgttcaaattcagtcaagtatggatttggatgaatctacaagttgtgctgatagtccatctttatcttgtgcgcaattagatgttgaagttcggcataagtcaccgggaattgacatgaactctgagccaactacagctgctgttcctgagcctgttgcatcaaaagaacaacctgcgggaaccactgttgcagcaactggtgttaatgatgtattctgggagcagttcttgacagaggatcctggtgcatcagaaacacgggaagtgcagtcagaaagaaaggattatgaaggcagaaagaatgaaggaaaacccagcgaccttaacaaattttggtggaacaaacggaatgcaaataatcttccagaacagatggggcatgttggtcaagcagagaaaacttag

SEQ ID NO: 349 - DNA, 1629 bp, Glycine Max
atggatgccactacaagcgaaaccccaactatccaattccataacatccctgatcagccaattactaccattgttgccacccaattgccaacacttcaaggccagcaagagcagcaacaccattgcttcggggactccagtccaggagagtttcccttgtctgctaatccctccatcgtccttcatgtccttacaacatgtaacttgtatcctcaagaccttgctaaacttgaggcaagtgctgcaacatgctccttcttcaagcagccggcaaactttgctccagattttgacttgtccttgtcagagcttgctgcattggacatgtgccagaagagagccatttttaagccaatgacaacagaacaacggcaacatttgaagcaaagatgtggtggctcttggaaattggttctgaggtttttgcttgctggagaagcatgttgcagaaggagggagaaatcgcaggtaatagcaggtcctggtcatagcattgccgtgacatcaaaaggagttgtttattcatttgggtccaatagttcaggacaacttgggcatggcaccactgaagatgtatggcaacctcggccaatcagagctttgcaaggcatccgaattatacaagctacagctatgactgggaggacaatgttgatcagtgattctgggcaggcttatgtctttggaaaagaatcttttggtgaagttgagacgattgtaaatcgaggatctaaaattgttacaactccacagttagttgaatctttgaaaaacatatttgttgtgcaagctgcaatgggaaactatttcacggccgtattgtcaagagaaggcagggtttatacattttcttggggttgtgttggcaaactctgtcaccagactgatcaaaatgatgtggaaccccgtcctttattaggagctctggaacacataccagtagtgcaaatagctgctggattctgctacctgctttgtttggcttgtcaaccaagtggaatgtcagtgtactcggttgggtgtggtttgggtgggaagcttggacatggtacaaaaacgaatgaggagtatcctcgtttgattgaacaattccagctgttaaaccttcagcccatggcgattgctgctggttcttggcatgcagctgtggttgggcaggatgggcgtgtttgcacatggggttggggcagttatggctgcttgggtcatggaaatgaagaatgtgaattagtacctaaggtggtggaagagctgagaaatgtcaaagcagttcatgttgctacaggagatttcactacttttgtagtgtctgatagtggtgatgtttattcatttggttatggagaatctggtagtcttggccatgtccctgaaaatcatgagcaggaagacatgcatgaaaatgtgttaactccaaagctagtcacttggatgaaacagatcaatgaacgggtggtacagattagcctgaccaatttcatatattggaatgctcatacctttgctctaactgaatcagggaagctgtatgcctttggggctggggacaaaggacaactaggtgtagagcttggtgcccaccagactgaaaaaggaaagccagagcgggttgatattgatctgggttaa

SEQ ID NO: 350 - DNA, 387 bp, Glycine Max
atggatgctaaatctcggatctcgcccacacgtctgacagataagaagtgtgtgccatgcaatctgaaggaattgcgaccaatgagtgaggatgcagcacacactctaatgccacaggttgctgagtggaatttggtaaacgaagatggtgtcatgaagctgaggcggtcatgggcagtaaagactttcaccaaaggattggaatttttcaggatagtagctgttcttgctgaaaatgaaggtcatcatcctgatcttcaccttgttggctggaataatgttacaatagagatttggactcatgctgttgaaaatgatttcatacttgctgctaagattgataagcttgatgtgcttgacctacttagacggaagccttcagactga

SEQ ID NO: 351 - DNA, 399 bp, Glycine Max
atggatgctaaatctcggatctcgcccacacgtctgacagataagaagtgtgtgccatgcaatctgaaggaattgcgaccaatgagtgaggatgcagcacacactctaatgccacaggttgctgagtggaatttggtaaacgaagatggtgtcatgaagctgaggcggtcatgggcagtaaagactttcaccaaaggattggaatttttcaggatagtagctgttcttgctgaaaatgaaggtcatcatcctgatcttcaccttgttggctggaataatgttacaatagagatttggactcatgctgttggtgggttgacagaaaatgatttcatacttgctgctaagattgataagcttgatgtgcttgacctacttagacggaagccttcagactga

SEQ ID NO: 352 - DNA, 984 bp, Glycine Max
atggatgctacatcctcacagtttgtttcctcaagaagaatgggtgtatatgatcctatccaccaaattagcatgtgggaagaaactttcaaaagtaatgatactaataatttaactgtatccacatccataattggggaggtggagatgaagttagataatcaggttcatgtgcaatcagaggatgcttctcatggaatatttggaacatctgtgaagtacgaccaagatgccaacaggcttactgataagacacaaagacgtcttgcacaaaatcgagaggccgctcgcaagagtcgtttgaggaaaaaggcatacgtgcagcagttagaatcatgtcgtttgaagctcgtgcagctagagcaagaggtagatcatgcaaaacaacagggattgtatattggcgacggattgggttctaataatttgggttttgctggctctgtaaattcaggaataacgcttttcaagatggagtatggaaactggctggaggagcaaaatagacaaattttagaactgagaactgctttaagttctcatataggtgacatacagctcgggacacttgtacagggcataatgaaccactacaccaaactctttagcatgaaatctgctgcagcaaaagcagatgttttctatgttatgtctggtatgtggaagacaacagctgaacgatttttcttgtggattggaggatttcgcccctctgaacttctaaaggttctggtccctctaagtgaacctttgacagagcaacaacggtttgatgcttatggccttgaaaaatcatgccagcaagcagaagatgctctttcacaaggtatggaaaaacttcagcaaatgctcgctgactctgtaggaccaggacaactagttgaaggaactcacattccccaaatggatactgcaatggagagactagaagcacttgtgagctttgtgaaccaggaaaaggagaggaaattctctcaaggttaa

SEQ ID NO: 353 - DNA, 1125 bp, Glycine Max
atggatgctacatcctcacagtttgtttcctcaagaagaatgggtgtatatgatcctatccaccaaattagcatgtgggaagaaactttcaaaagtaatgatactaataatttaactgtatccacatccataattggggaggtggagatgaagttagataatcaggttcatgtgcaatcagaggatgcttctcatggaatatttggaacatctgtgaagtacgaccaagatgccaacaggcttactgataagacacaaagacgtcttgcacaaaatcgagaggccgctcgcaagagtcgtttgaggaaaaaggcatacgtgcagcagttagaatcatgtcgtttgaagctcgtgcagctagagcaagaggtagatcatgcaaaacaacagggattgtatattggcgacggattgggttctaataatttgggttttgctggctctgtaaattcaggaataacgcttttcaagatggagtatggaaactggctggaggagcaaaatagacaaattttagaactgagaactgctttaagttctcatataggtgacatacagctcgggacacttgtacagggcataatgaaccactacaccaaactctttagcatgaaatctgctgcagcaaaagcagatgttttctatgttatgtctggtatgtggaagacaacagctgaacgatttttcttgtggattggaggatttcgcccctctgaacttctaaaggttctggtccctctaagtgaacctttgacagagcaacaacggtttgatgcttatggccttgaaaaatcatgccagcaagcagaagatgctctttcacaaggtatggaaaaacttcagcaaatgctcgctgactctgtaggaccaggacaactagttgaaggaactcacattccccaaatggatactgcaatggagagactagaagcacttgtgagctttgtgaaccaggctgatcatctacgacaagaaacattgaggcaaatgtatcgaatacttaccacacgtcagactggtcgatttctgcttgatttgggtgaatattttcaacgcctgcgggctttgagcaaactttgggctaatcgtcctcaagaacttactaagtcagtcatcaaacattag

SEQ ID NO: 354 - DNA, 888 bp, Glycine Max
atggatgttaaagctgcgccgaggttacaactttcagcggtggttcaacccgaaagtattggaagaagaccacccagcacatgtcgtttgggtgtgtctcgggaaccgcagagccttcgggtttttgtttcgtcaacgatgatgcgccgcagaacaaccgctttggaggtttcctgttcttacggcaacatttcagcttcaatattggaatctggaagtgttcgtgctcctcttgatgaagagctgattctaaagaatagatcgcaagagatccagccatatttaaatggacgctgtatttatcttgttggaatgatgggctctgggaaaacaacggtggggaagataatgtcacaagtgcttggttattcattttgtgatagtgatgcattggtggaggaggaggttggtggaaactctgtagctgatatattcaagcaacatggtgaaactttctttcgtaataaggagactgaggtgttgcataagctatccctgatgcatcaacttgttatttctactggtggaggtgctgttacaaggcccatcaattggaaatatatgcacaagggagttagtgtttggttggatgtaccagtggaagccctggcacagagaattgcagctgtaggaactaattctcgcccccttctacactatgaagcaggagatccttacacacgggcttttatgcgtttgtctgctctttttgaagagagaggtgaagcatacgccaacgccaatgccagggtctcattaaaaaatatagcaataaaactgggcaaaagagatgtgtccgaattgtctccaacagatattgcaattgaggcgctagaacaaattgacaactttttgaagggggaagggggccgctatgcagaatgctag

SEQ ID NO: 355 - DNA, 705 bp, Glycine Max
atggatgttaaagctgcgccgaggttacaactttcagcggtggttcaacccgaaagtattggaagaagaccacccagcacatgtcgtttgggtgtgtctcgggaaccgcagagccttcgggtttttgtttcgtcaacgatgatgcgccgcagaacaaccgctttggaggtttcctgttcttacggcaacatttcagcttcaatattggaatctggaagtgttcgtgctcctcttgatgaagagctgattctaaagaatagatcgcaagagatccagccatatttaaatggacgctgtatttatcttgttggaatgatgggctctgggaaaacaacggtggggaagataatgtcacaagtgcttggttattcattttgtgatagtgatgcattggtggaggaggaggttggtggaaactctgtagctgatatattcaagcaacatggtgaaactttctttcgtaataaggagactgaggtgttgcataagctatccctgatgcatcaacttgttatttctactggtggaggtgctgttacaaggcccatcaattggaaatatatgcacaagggagttagtgtttggttggatgtaccagtggaagccctggcacagagaattgcagctgtaggaactaattctcgcccccttctacactatgaagcaggagatccttacacacgggtaagtatttatgttctatag

SEQ ID NO: 356 - DNA, 867 bp, Glycine Max
atggattccgtccaaagcttcgtctcccaatcgatccaatcccacactctcctcactcaccaccaaatgaacatagtctccaacgagatcctaaccgccattcgccacgtcatcaccaacggcgtcgcccttgtcgccgcctcggaaaacgcgctccctctctcggagactccaacgttggactccccgaacaacaacgacgacgacaacgtggtggagctcgatgccatggagctgctggccaagcaccttcacttctgcgaggtgtgtgggaaaggcttcacgcgcgacgccaacctgagaatgcacatgcgcgcgcacggggacgagttcaagaccccggaagcgttggcgaataaagcccgtggagaaacgcgcttgaaggcgacgcggttttcgtgccccttggagggatgcaaccgtaacaagacgcacaagaaattcagggcgttgaagtcagtgttctgtctgaggaaccacttcaagaggagccactgtcccaagacgctgttgtgcgagcggtgtcggaagaagagcttcgcggtgctgtcggacttgaggagccacgtcaagcagtgtcggggagaggccacgtggaagtgctcgtgcgggaccacgttttcgaggaaggacaagctgctcggacacgtggcgctgttcgaggggcattcgccgatgcttggagaggagagagatacggtggtggcggcggccgcggaagggttacctgaagggttctttgatggattggatgaatttggatttggatccattcaaaacaactcttcacaggaggaacacttggccttggggcttcccacaaataatttagatgcatgggaattttctttttctaatttaatctaa

SEQ ID NO: 357 - DNA, 945 bp, Glycine Max
atggattcggaggatttccgatccattctggagagcgcgggcgtggacgtttgggccctcatggacgcggccatcgcggtggcctccgccgaccacgctcacgagttgaagcgccggagagatggaatcgttgagcgcctttacgcggccagttcaccgccgccgctgtgtcggaactgcgacgccggcgacgggggagaaatcaggacgcagagcagtccctccgcggaggaggaaaaggatccctacggaggcttgttcgacgacgagcaacggaagattctcgacattaaagagcaactcgaagaccctcaccagtccgaagattcgttggtggagttgttgcagaatctagcagacatggatattacatttcaagcgttagaagagactgacattgggaggcatgtgaatcggttgcggaagcattcgtctaatgatgttaagagattggtcaagttactcgtcaggaagtggaaggaaattgtagatgaatgggtgaagttgaaggccccgggagaaccgggtactgctgtcatggctgatgaggactcgcctcagcagagaatcctacaaaatgggcatcgtcagattcctgattttgcatactcaccaaatccacactatgggagttttgggtcagagcgcaacaatattgaagcagaacgaaaaccaaaagcaattcctcgcaaagaagctccttcaaaaccatcgccatcagtcactactcctgctcctcctactcaaaacagacagagagaaagcaattttgacccggatagatttgcttcagccagaaaacggcttcaagagaactacaaagatgctgcaaatgccaaaaagcaaagaacgattcaagtgatggatctccatgagttaccaaaacccaagaatgccttccttggaaaaaacaaaggcggcactggtcagggaaggcactggtga

SEQ ID NO: 358 - DNA, 972 bp, Glycine Max
atggattcggcaaacaccagcgggagcttgcaatcctcaagcggcgctgatgaagagtacgattcacgcgcagaatcatcaccactctctatgttcttaaccaaccaacctcaaccacaaccaccaccaagccaagttgctccctttattccaccaccacatcaacaactacaacaccaccaaaacacccacatgttcgaccctttatcaaactacttggatccgatcccacaaagttcagcatcactgttaaaccttgacgtgatgtggtcgaaacaagtgagatccgaaccaaaccaaacggatcttgttagcttgatacctcataaccaagcttttgtgtcaagtcaaacacgagggaacaatagtggtgcttttcctactttgcctccagagagtggttcccgaggactaatgctttcagtcagcagcaacatggttcgaaacccgaagaaacggtcaagagcttctaggcgtgcacctaccactgtgctaaccacagacaccaccaatttccgagccatggttcaggaatttactggcatcccagcacaacccttcacatcctcgtctttcccgagaaccagaacacaacaacaccactccttggaaattccgccgaatctcaaaaatggtgtgtttgaagaactgggactgagacacgaccatgttaacaccgacctcggatgtcttcatcagagcatggtttcgtcaacatcagttggagtgggagcattgtcaagtggaaacaacaacaacaataacttgagtaatgctactaattcttcaacggaatgggcccagagaacgggcaccattaccaacaatgattgcgatcacggaggaggaggagctctcagtggcactatcaactacagtgacactaatggcaaaaaggggccagacttcactgtaactgcaaccagaactcaaggaatggtggagtcctggattaattgttcttctgattaa

SEQ ID NO: 359 - DNA, 1263 bp, Glycine Max
atggattctctccctgatgccattctccaatgcatcttgtcccgaatcactaatgctcgtgacgtgtcatcttgcaattgtgtttccaagcgatggaaggactccaccccctacgtcagaaccctctactttcctcgcagctcatttgacaccccttcttcttcttctgagggtgctgacaacatcatcaaaagaatggtgtcaagagtggtgaagttagaggagctaattgtgtataaccccttttcctctaatggccttgcatcatggctctcactggccgggcaaactcttcttcagctcgagctccgaatggaaaacctcgccgacaatcagggcttccatgaaagcccttccaaattggactatattggtgctgctaagaatttggagtctctgaaactgtggggtgtgttgatggttcgttcccccaaatgggatgtgtttcctaacctcaggaacctcgaaattatcggtgcaaggttggaggaccctgtgttgagtgtggtgctttgctcatgcccggttctcaccagtttgttgctgcttggatgtgaaggggttagatcgctctctatcgagttgccatgtttggagcagtgtaagctggatttttatgggaggggggactgttctctcactttgacttcccccaacattgagtcccttgaggtacaaggctgtagctggattagggtccctgaaaccaagcatttgaggaaactttccatatccaacagtgcagggagagtgtatatggttgattttggaaaactttcagctctggagtatctgtgtatgagaggaatccagtggtgctgggatgccatatgcaaaatgctgaaattggcaagtgaggtgaaacacctctatatgaaggttgaattcactggggactatgatgcacttcaaccctttccagagattgattttgttgacttcttcaacagtcatcaaaagctacaaaagtttgacattcatggagccatgtttgcagctctttgccagaagaacagtctcaaacatgtggattcaggatttgtgattccgtttttggaggaagtggtgatcacagtgaggtcacctctaaatgctgaacagaaaatgagtactcttgaatcattgctcaaatacgggaaaagtcttaagagaatggttataaagattcttgagatgaagagctgccatagtagtgctgatgatttttttgacgagatttgccggttcagatatatgaatcatagcatagttcgaatagaataa

SEQ ID NO: 360 - DNA, 3447 bp, Glycine Max
atggattcttcttctcttccccaaacctctcttcctcccgcttccgactctgagaacgatgatggcttcttaagcggtgaagagtccgatttcgagcccgagcccaccaggcccgttctcgtcaactcttcttctcagccccctcatgagcccgtcttcgattctcctccccacagacccattgcgaaggtgtccggggacgatgatgatgatgatgatgacggttccattgttgaggacgcggacgacgacgtcgttttggaggaaggcggtgagaaagaggaatcgggtgaggcggtgaaggatggggaagttagcgatagtaacgaggtctttgtggaggcctctggcggtgatgatgttgctgttgagaatggagtcgaattcagtggcgctgataaagggtttgagggtgctgctgttgaattgaatgagaaagaggacaaagttaatgacggtgggaccgataattcggattctgaagttgtggtggacgagaagaagggtgagggtgttgatgttgaaaaggatgatgatggtggtggtggtgtgggtgtggatggtgctgttgataacgtcgaggttaatgtgttgggatctggggatgatgtggggattgaggaatctcagattaaagggctagacgagaccgcgatgaatctggagaatgattttgagcccattgagaagggtgaggaggaggttgttgatgggggtgttggtgttggtgagaatggagttgaaggggatgggttgaagagtgacattgatgttcctcctgaggaaggtggtggaggttcggagtttgttgagaaaaatgaagtaaagatggagggtgatgttggtcaacatggtgacagggagattgatgattcggtgttggatggggaaattgggagccatgtggaggagattggtggcaatggtgagagggagattaatggttcggtgtcggatgagaagggtgatggactggtgtttggaagcactgaggctgccaataagttcctggaggatttggaattacatcaatcgcgagaaggcaaggagctgtttgatactgctacattggcagctcttttgaaagcggcatcgggtgcggaccaagatggcggcagcatcacaataacctctcaagatgggtccaggcttttctctgttgagcgccctgctggcttgggatcaccgctccagtcaggtaaacctgccgtgaggcaaactcgtccgagtctttttactccttccatgagtagacctagtgccatttctgatagcaatttgagccaagaggagaaaaataaactggagaaattgcatgaaattagggtcaaatacttgagactagttcataggctgggttttactacagaagaatcaatagcagcacaggtgctgtatcggatgacacttgttgcaggcaggcaaagtggtcaaatgtttagcgtagagtctgcaaaggagactgcttcgcgtcttgaagctgagggaagagatgattttgatttttctgtaaatattctggttcttgggaaagcaggtgtgggcaagagtgctacaataaattcaattttcggcgagacaaagaccagcattaatgcttgtggtcctgctactacttctgtgaaagaaattgttggggtggttgatggagtgaagttaaggatttttgacacaccaggcctcaaatcttctgcattggaacaaaatttcaatatgaaagtcctgtctgcggtgaagaaattgactaaaaaatctccccctgatattgtcctctatgtggatcgcctggacctgcaaactagagatatgaatgacctgcctatgttaagatcaattactagtgtcctgggttcatcaatatggcgaaatgtcatagtcactctgacccatgctgcctctgctcctccagacgggccatcaggtgccccattgagttatgaagtatttgttgctcaaagatctcatacagttcaacaaaccattggacaagctgttggggacctacgtcttatgaatccgagcttaatgaatccagtttctcttgttgaaaaccatccttcttgtcgaaaaaatagagatggccagaaggtgcttcctaatggtcaaagttggagacctctcttgttgctcttatgcttctcaatgaagattctctctgatgctagtaactctacaaaaactcaagaatcatttgaccaccgcaggctgtttggttttcgtccccgctccccaccacttccatacttgttatcttcgttattgcagacacatacatacccaaaactccctgcagatcaaagtgggcctgacaatggtgattctgatgttgaaatggctgatttatctgattctgatctagatgaagatgaggatgagtatgaccagctcccaccatttaagcctatgaagaaatctcaggttgctaagcttactaaagaacagcagaaagcatattttgatgagtacgattatcgggtgaaacttctacagaaaaagcaatggagagaggagttgagaaggatgagagagatgaagaaaaaaggtaacacaaaagaaaatgactatggttacatggaagaagatgatcaagagaatggaagtccagcagcagtgccagttccattgcctgatatggccatgccaccatcctttgacagtgacaatccagcctatagataccgtttcttagagccaacttcacaactcctgacaaggccagtcttagacaaccatggatgggatcacgattgtggttatgatggtgtaaacattgaacagagtctagctatcatcaataaattcccagcagctgtcactgttcacgtaacaaaggataagaaagacttcaccatccagttggattcctcagttgctgcaaaacttggagagaatggatcagccatggcaggctttgacattcaaagcgttggaaagcagctatcttacagtgttagaggagagacaaaattgaaaaatttcaaaagaaataaaacttctgctggggtgtctgtgacatatttgggtgaaaatgtgtgtactgggctgaaagttgaggatcagattgctgtggggaaacgcttggtattagtgggtagcacaggggttgtgaagtctaaaactgattctgcttatggtgccaacgttgaagtgaggcttagagaggcagattttccaattggccaggaccagtcttcactgagcctttctcttgtgaagtggaggggagaccttgctttaggggccaatcttcagtcccaaatttctgttggacgaggttataaggtggctgttcgtgctggattgaacaacaagctcagtggacagatcactgtgagaacaagtagctcagaccagcttcagattgcccttgttgctatccttccgattgccaaggctatctacaaaaacttctggcctggggctagtgagaattattctatctactag

SEQ ID NO: 361 - DNA, 2112 bp, Glycine Max
atggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattgggatgaagcctggtccggattctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtttggagtgttcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacaggtttgcattcttctattaa

SEQ ID NO: 362 - DNA, 2502 bp, Glycine Max
atggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattgggatgaagcctggtccggattctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtttggagtgttcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtctga

SEQ ID NO: 363 - DNA, 849 bp, Glycine Max
atggattgttcagctgcaagaaaaacacaaaaggctgaccgtgaaaagttaaggagggatcgactcaatgaacaattcgtagaactgggtaacattttagaccctgataggcccaaaaatgacaaagcaaccattataggtgatacaattcaattgctaaaggacctaacttctcaagttagtaaactcaaagatgaatatgctacgctaaatgaagaatctcgtgagttgactcaggagaaaaatgatctcagggaagagaaggcatctcttaaatctgatattggcaacttgaataatcagtatcagcagcagctgaggaccatgtttccatggactgcaatggatcattcagttatgatggctccaccatcatatccatatccagtgccaatggcagtacctcctggtccaattcccatgcagccataccccttctttgctaatcaacatcctgcagtcatctccaacccctgttcaacttatgttccttatttagcccccaatacgattgttgaacaacaatccacccaatacgtatcccctccactacatccttgtggtcggtccaatgtgtcaggaaaacaagagtccaagagcaagtcatccagggagagcaaggctgaaaagaatgaggattctaatgatgtcactacagacctcgagttgaagactcctgggtcttctgctgatcaggatttatcatccagacaaagaaaatccagcaagttgtcaaggagggaaagcagttgcacagaaggaagttcattaggtaggtgttcttcttctcgcagtgttcaggacagctcatcgagcagtgtggcggcaagcagaaaggataatgaatga

SEQ ID NO: 364 - DNA, 852 bp, Glycine Max
atggattgttcagctgcaagaaaaacacaaaaggctgaccgtgaaaagttaaggagggatcgactcaatgaacaattcgtagaactgggtaacattttagaccctgataggcccaaaaatgacaaagcaaccattataggtgatacaattcaattgctaaaggacctaacttctcaagttagtaaactcaaagatgaatatgctacgctaaatgaagaatctcgtgagttgactcaggagaaaaatgatctcagggaagagaaggcatctcttaaatctgatattggcaacttgaataatcagtatcagcagcagctgaggaccatgtttccatggactgcaatggatcattcagttatgatggctccaccatcatatccatatccagtgccaatggcagtacctcctggtccaattcccatgcagccataccccttctttgctaatcaacatcctgcagtcatctccaacccctgttcaacttatgttccttatttagcccccaatacgattgttgaacaacaatccacccaatacgtatcccctccactacatccttgtggtcggtccaatgtgtcaggaaaacaagagtccaagagcaagtcatccagggagagcaaggctgaaaagaatgaggattctaatgatgtcactacagacctcgagttgaagactcctgggtcttctgctgatcaggttagtgttgttttccaaggatatcccatgatagaagatgcattggattcaagttgcgtgtgtctctggtttgcaggatttatcatccagacaaagaaaatccagcaagttgtcaaggagggaaagcagttgcacagaaggaagttcattaggtag

SEQ ID NO: 365 - DNA, 189 bp, Glycine Max
atggatttgatgtcatccatcttcaattgctttgttccatcttcatcaagtcaagtctctgactatgccaaaggatcatctcaattgaaatctccttcttcagagaaaccaaagagcaaaccaaaatcaaaaggagctccaatcgttgtttcctatttccctgtcaaccattatccgtcacgcttgtag

SEQ ID NO: 366 - DNA, 1071 bp, Glycine Max
atggcaaatgaactacccgtcaaagcttttggttgggctgcttcagacacttctggcacccttgccccttttcatttctccagaagggaaaatggcgtcgatgacgtcactctcaagattctcttctgcggggtttgccactctgatctccacactctcaaaaacgactggggtttcaccacctaccctgtcgttcctgggcatgaaattgttggtgttgtgacagaagttggaaacaatgtgaaaaacttcaaagtgggtgataaagttggagttggtgtgatagtggagtcttgcaaggaatgtgaaaattgccaacaggatctggagaattactgtccccgccctgtgtttacctataactctccttattatgatgggacacgaacccaaggtggttattctaacattgtggtcgtgcaccagcgttatgtgctccggtttcctgagaacttgccccttgatgctggtgctcctctgctgtgtgctgggataactgtgtatagcccaatgaaatattatgggatgacagagccaggcaaacatttgggagtggcagggcttggtgggttaggccatgttgcaatcaaacttgctaaggcttttgggctcaaagttactgtcattagtagttctccaaacaagcaagctgaggccattgaccgactcggggctgattttttccttgtttcatcagaccctgcaaaaatgaaggctgctttgggaaccatggactatatcatagacacaatttctgctgttcattccttgattccactgcttggtctgctgaagctgaatgggaagctagttactgtagggttgcctaacaaaccccttgagcttcctatctttcctttagttgcaggacgaaagcttataggggggagcaactttggagggctgaaagaaactcaggaaatgcttgatttctgcggaaagcacaacataactgcagatattgagctgattaagatggatcagatcaacacagccatggaaaggcttagcagagctgatgtgaaatatcgctttgtgattgatgtggcgagctctttctcaagtttttag

SEQ ID NO: 367 - DNA, 1131 bp, Glycine Max
atggcaaattcaaagggctcatcgagtttcagaaattttatgtatcctggaaagcatcctctacttcctcctaaaagtccgtttcctagtgtttcccaagcatatgctgattatgtcccaaatcccgctgttggtttaaaggctggtaacagaccgagagatggaaacacacaccaccaacgtacttcatctgagagcctagttatagaggagcagccttcatggcttgatgatctccttaatgagccagagacacctgtccgaagaggtggacatcgacgttcatcaagtgattcttttgcgtacatagacactgttaatgcatctaacctcaattatgctagtcaggacgaatataaatataagaatatgatgtctattccaccttggtcacctcaagattttgactgcagcaaagatgctcgtcatgtgcctgtttatgcagaaatgaactccacaaaacagaaaaataggtcatgggactctttttcaaatgccatgacaaatccagttggtgttccctcaggcaaagacagtgctgcttttcagagttcaggattgcaatgtacaccacatgaagcagatgctcttccaccagctgcaagtgaaaagcatgattcagtagaattgggtttacaggatgcaaaatcctttcctgaaaaaaaggacatttcacatgcaaagtcatctgcctctgaaactgatacaaaacgtgctaaacagcaatttgctcaacgttcacgggtccggaaacttcaatacatagcggagctggaaaggaatgtacaagctttacaggcagaagggtctgaagtctcagccgagcttgagtttcttaaccagcagaatcttatcctgagtatggagaataaagcactcaagcaacgtctagaaaatatagcacaagagcagcttatcaaatatttggagcaggaagtactggaaagagagattggaagattacgtgcattgtatcaacagcagcaacaaccaccacagacacagccacaacagcaaccatctggtagtcacagacgctcgaacagtagagaactcgaatctcagtttgcaaacctttctctaaaacacaaggacaccaattcagggcaagaccctgctctcagaatttag

SEQ ID NO: 368 - DNA, 1425 bp, Glycine Max
atggcaaccattctatctccaatccaaaccctcaaattccgttctcccaatcccaaacctctcttctctcccaaaccgcctcccatctccacacctctcaccttccgcgccgataaactcactctcttcgtctcctccgccacctcctccgccaccgtctccaccaacggccctccctctcctccctcccctgctcgctcaaaggttcggcgacacacgatttccgtgttcgtcggcgatgagagcggaatgataaaccggattgctggcgtgttcgcgaggagaggatacaacatcgagtcgctcgccgttggcctcaatgaggacagggcgctcttcaccatcgtcgtgtcagggactgataaggtgctgcgccaagtcatggagcagcttcagaagctcgtcaatgtcttaaaggtagaggatctttcgagggaaccgcaggtggaacgtgaactgatgctcataaaagtgcatgcggatccgaagcaccatgcggagttgaagtggttggtggacatcttcagagctaagattgtggatatctcgcaacattcggtgacaattgaggtcactggagatccagggaagatggctgcggttcaaagaaatttcagcaagtttggaattaaagagatagccagaactggaaagattgcattaagaagggaaaagatgggtgcatctgctccattttggcggtattcagctgcttcttatccagatcttgaaggaagaacacctgtgaatgccatggtgggagcaaaaaatatgaaacctgttgccaaacatgatacacctgtggggggagatgtttatcctatagagccaccagatggttttacagtcaatcaagtacttgatgctcactggggtgtcctcaatgaagaagatactagtggaattcgatcacacactttatccatgcttgtgaacgatgctcctggagttctaaacattgttacaggagtttttgctagaagaggctataacattcagagtttagctgtaggacatgcagaagttgaaggactttctcgacttacgactgtggttcctgggacagatgagtcaattagcaagttggtgcagcaactctataagctagtagagctacatgaggttcgtgatatcacccacttgccatttgctgagcgagaattgatgctaataaagattgctgtaaatgctgctgcacggcgtgatgtccttgatattgctagcattttccgggctaaagccgttgatgtatctggtcacacaataactctggagcttactggagatttggacaagatggttgcattgcagagattgttagaaccatatggcatttgtgaggtggcacgaactgggcgaattgctctagtccgtgagtcaggtgtggactccaagtacttgcgtggatactcttatcctttgtaa

SEQ ID NO: 369 - DNA, 798 bp, Glycine Max
atggcaagtttagaggaagacgagttagtacaaatggtgcaagattttatagaatccgaatcaacatcccccacaagttccacgtcctcaaattgccacaccttaaaccaccgaacccaatattttattctacaggatgttctaaggagtgagggtgatacaggatgtgaggctaaggtattgaagtgtgtattgaaccatatgagaggtagaaagggtgcggagaagactaagacaagtctcagtaaatggcttgttatgaggatgaaaatggatggccttgatgcttctgtatgccacacctcttgggccacctctttgggttgtcctgctggtgagtacgagtatattgaagtgataatagaggatgaccagaattgtggtaaacctacgaggctgatagtagatatagactttaggtcccaatttgaagttgcgaggccaacacaaaactacaaggaattgacagactcggtcccagtgattttggttgggactgagaacaaactgtgcaagataatttccctgctatgttctgctgccaaacagtgcctaagagagaagggtctccacgtgccaccatggagaaccgcttcatacatgcaagccaagtggctctctgtgagtcgtaaagagcctagccatgatgtcattggttatgatgatcatgaacatgctgatgctgatattattggtaactgggtacctccatcactgaagccaaagaaaagggatttggatggtggtggatctggtttgtctagtcaattatctaacatgagtgtaaattgttgctag

SEQ ID NO: 370 - DNA, 1314 bp, Glycine Max
atggcaataacaccttttagtagtacatctgctgcacaatggggaattcatcctcagctgttactaagatccagtatcacgggcaaggttgcatcatccagccacaattctactggcagggtaagttttatggctgcaacaagttcaagctttttttctcaagattccacactactcaatgtgggtgcaccccaaacttttaatcatcgcaagggatcaaggttaattgttagagcaaatgctgattattattctgtccttggggtttcaagaaatgctagtaaatctgaaattaagagtgcatatcggaagcttgcccggaattatcatccagatgtcaacaaagaacctggtgctgaacaaaaatttaaggaaattagcaatgcctatgaggtgttatcagatgatgagaaacgatccatatatgacaggtttggagaggctgggcttaaaggttctgcaatggggatgggggatttcagcaatccatttgatctgtttgaatcactgtttgagggcatgaatcgtggcgcaggttccagaggttcttggaatggagcaattgatggtgaagatgagtattacagtcttgttttgaactttaaagaagcagtttttggcatagaaaaagagatagagataagccgattagagagctgtggaacttgcaatggttcaggggctaaaccagggactacaccatccagatgtagcacttgtggaggtcaaggccgggttgtctcatcaacaagaactccattaggcatcttccagcagtcaatgacatgctcttcatgcaatgggactggagaaatttcaacaccttgcaatacatgttctggggatggtcgggtaaggaaatcaaaacggataagtctgaaggttccagctggtgtggactctggtagtcgtctaagggtccggaatgaggggaatgctggaaggaaaggtggttcccctggtgacctctttgtagttattgaggttatcccagatcccatccttaaacgtgatgacaccaacattttatacacctgcaaggtttcgtatattgatgcaatcctggggactacaattaaggttcctactgtagatggaacggtcgatttgaaaattcctgctgggacacaaccgaacacaacacttgttatggctaagaaaggtgttcccttcctgaataaagacaatatgaggggtgatcaattggttcgtgtgcaagttgaaatccctaaaagactgagcaatgatgagagaaagcttattgaagaacttgctgatttaagcaaaggcaaaactgccaccggtaggagataa

SEQ ID NO: 371 - DNA, 402 bp, Glycine Max
atggcacacatcacaaaccttcccatgacgccactgatgccggccagcacttcctcaaacaacatcaaagaaatcgcgtttaagactgctccttcagcttccaaggtcgaaatcaagcgtttcctcgaaaccttctacgggttcgaggtcgaaaaggtgcgaactctgaacatgaagggcaagaagaagcgttacgcgggatcgttggtagcaaaacccgattacaagaaggcctacgtcaccctcaagaaaccactttccttctctcagaacccttacccctttggttccaccgtagaagacaagaagaaagagaatatcttccatatacagacagagactcccaaatgcagcaatacaagtatacaagtaaacttacctgaaaagaaaacggaaatgtga

SEQ ID NO: 372 - DNA, 3240 bp, Glycine Max
atggcaccgattctatcatcagccagtgatgacaatcttgatcttcaagaagttatttctaagggctcattagattttgacgaatggactttactgatttcagagatcgagaaactatatcctgatgacgcagagaaaatatgtctggtttataaccatttcttatccaaatttcctttgtgtcatgggtattggaggaaatatgctgcccacatgacatgcttatgcaccacagataaggttgttgaagtatttgaaaaagctgttttagcagcaacatattcagtgggcatgtgggttgattactgtagctttggcatgtcagcttttgaggacccatctgatattcggaggttgttcaagagagccatttcctttgttgggaaggactatttatgtcatatcttgtgggacaagtatattcactttgagttttcccagcagcagtggatttctcttgctcacatttatatacaaactcttaagttcccaaccaaaaagttgaatcagtattatgatagttttaaaaagttgctaacctttttggaggagggcatagcaagcctggaattgcaatctgaatcatgttttgatggtgaaattcctatgactacctgttacaaggatgatgagatttattgcattatcaatgatatcatggattcatctgttggattgactagttcaatagccctaaaaaggtacagggtcattggagaactgctttatcataaagcttgtgagttgtattcgaaaattagtccttttgaggctaatattcgaagacattactttcatgttcggcctcttgatgcaaatcaattgcagaattggcataattatctggattttattgaacctcaaggggactttgactgggctgtgaaactttatgagagatgcttgattgtgtgtgccaactatcctgaatactggatgcgttatgtggacttcatggaagccaagggaggaagagaaattgcaaactattctttagtccgagcgactgaaatttatttgaagaaagtgccagaaatccatttattcaatgccaggtttaaggaacaaataggagatgttttagctgctcgtgctgcatatattcagagtggtaaagagacagattctgactttgtggaaaatgttatatcaaaagctaatatggaaaaacgtttgggaaatacagagtcagctttcagtatatacaaagaagcactaaaaatggcatcagcagagaaaatgttacatgccctccctattttatatgttcatttctctcggctaaaatatttgagtacaaacagtgtggatgctgccggagatgtcttaattgatggtgtcagaactttgcctcaaaacaaattgcttctggaggaattgataaagttcttaatgatgcatggggggacaaagcacatggctgtaatagattcaattattgctgatacaatatctccaaggtctgagggatctcaaggttttagtacagaagatgcagaggatatatcaaacttatatctagagtttgtggactattgtggaaccatacatgatgtaaggaaggcgtggaatcggcacataaaattatttccagactctgtccggactgctaaacgtagaagattgattaatttgatggacaagagagaagaggtttttgttgtcatgcctaatcaagcatctagggattctagttctgatttggatgctgcacatttacataaaaaagacaagaaagtgttattgctgaaatattgtgataatcagtctgatgctactaaagatgaattaatgctgacaaaaaatcataatgctcggtctaataatgatacagatacatgcaatcttcaaattatggaatcagaatacaaaatagaagaaaatgggagagaattacctctcccaatttctgaggagccaagagacaatgatcctgaaaataatgtgtcatctgccaatttagtggaagttaaagagcgatcaataaccaagaatttaaaaaatagttgttcttctgaatctgatgtttcatcagaggaattattacgtcaaactgcctgtggaaaccaatcctcacaagctttgcaaataccctctaaggaaaatactgctttttctaagggaacgtgtgagcttgagcctgaagaacttaagccgctttctccgtcaagcatatcattaaacccccaggaaagcacatgtcctgattcaggaccgatggtgtctcaggaggagtgtgatgcaattccggaaagctgcaagtcaaatagtagagcagtagttggtggtcataccacaaatcaagacaactctgcaagcactcaagattccgagtctgcccaaatccccattgaaattaacagtccatattcagcacgccatcgagaccagagagcaagaaaaccacttctgcctccacggtcttctggtaatagtggtggaaactggcataaaatgagaaatgctggtcaatttcgtagaggccccaaatttggctatcggggaaatacacataggaaacagcaccaacggcagcagctgcctcctcaacagattcatccccctgaaaggggttcacaaatggctgtggctccaggttactcttctcaacctgtattgcaaatccagcaatgcaatcaaggacaaaatcagtttcactctgctgctactcctactgattttgcagcagctagttgttggcctatgcaaaacatgcagatacagaacacttcatctcagtctcaaacacctgccaatactacatcacatgtattacaacatgcaatgcaaggcaatgagcgatatggatatatgcagaatgaccaagaatataatcagttatggcaatactatcagcagcaacagcaacagctgcaactacaacaacattatattcaattacagcagcaatcgttccagcagggactgtcacaacaacagctccaacatagcctgctggaacctcttcaaccacaacagctccaacaacaggttctgcagcagcagcagcagcaatactttcaacagcagcaacctctgcagcaagaacaccctgaaaaccttatgcagcaacagcagccatcaacacagagcagcagtcatcccgtagcagaccaagggcaggcaatagtgacattgcagggccacggagcagtattatcgcaacaatcagacaaacttgggccgatttcttctccagttgtgcaccatcctcaagagaaatctacccaacaagagtga

SEQ ID NO: 373 - DNA, 570 bp, Glycine Max
atggcacctgcaacactgtctctgtctctcctcctcctgttctcactcagcatcgccgtaaccgttagatcgagcgactacgactacgattgtgtgtacactgcatacgttagaaccggttcggtgttgaagggcggaacggactctaagatcgggctgaagctgtacgacaagtacggctactacatctacattaaaaacctcgaagcatggggcggcttgatgggcaagggctacgactacttcgagcgcggcaacctcgacatcttcagcggaaggggaccctgtcttgacggacccgtctgtgccgttaacgttacttctgacggatcgggttctcaccacggctggtaccttaactacgtccaggtcacctccactgggccccacctttcctgcgctcaggatcagtacgaggtggagcagtggctcgctctcgacacttcgccttaccagctttgggccgttaggaaccactgccgctacagtttggaccgggcccagcccgtttcggagcgccccggatccggatccggatctgcgttctctattttgaatgcacgagcctga

SEQ ID NO: 374 - DNA, 978 bp, Glycine Max
atggcactctcaacccctctcttctctttctcttcttcttttcttcattcatcttctcctctatgtcttccaaagcccctcttcccttatttgacagtgagcaattcaaccttccagaccaccagtctcgccgttcgctccgaaatgggttcttcccctgagcccatcaatttcaggaagtccgagattccgtccatgtctcacttgagactctcaatgaacgaaagtagcaagccttcatttaaatggcgaagggttttgctcaaagttagcggagaagcacttgctggagaccactctcagaacattgaccctaagataaccatggccattgcaagggaggtggcagcagtgactcgccttggcattgaggttgcactggtagttggtgggggtaacatcttccgtggatcctcctgggctggaagtagcggactagaccgctcatctgctgattatattgggatgttggccactgttatgaatgctatatttcttcaagcaacaatggagagtataggcattcctactcgggtgcagaccgcatttcgtatgtctgaggttgcagaaccgtatattcgcagaagggcagtgaggcatttggaaaaaggaagggttgtcatttttgctgctggaactggaaatccattctttaccacagacactgctgcagcactccgatgtgcagaaattaatgccgaggttgtactcaaagcaacaaacgttgatggagtttttgatgaggacccaaagcgtaatccacaagcacgtcttcatgagacactaacctatcaggaggtaacttccaaagatctgtcagtgatggacatgactgccataactttatgccaagaaaataatattccagttattgtctttaatcttaacaaacctggtaacattgagaaagctattaaaggagaaagagttggcactttgattggggccacctggaattctaccgtatcaagagcatga

SEQ ID NO: 375 - DNA, 630 bp, Glycine Max
atggcactctcagtctcctcaccctcatgcgtacgcgttccttcatgtttttggaaaccaaatggcaagagttgcaaagagcgtactaaggtttcatgtgcagctcacaatgataataagaatccgttggttggaatcggtattggggttgtaacgtcttgtgtgatgggtttaactgcattggatgcggacgccacgagaatcgaatactacgcaacagtggcagagcctttgtgtgagtacaactatgttaagtctggcctcggctactgcgatattgctgagggcttcggtgacgaagctccactgggtgagcttatcaatgttcactatactgcgagattcgctgatgggatagtattcgatagcagctataaacgtgctagacctctcaccatgcgcattggtgtgggcaaggtaatcaagggactggatcaggggattttagggggtgaaggagtacctccaatgcggataggtgggaaacgcaaactgcagattcctccgcacttagcatatggccctgaacctgcagggtgcttctcaggtgactgcaatatacccgccaatgccactcttctgtatgatattaattttgttgaggtttattcggggaacagatcaaagtga

SEQ ID NO: 376 - DNA, 630 bp, Glycine Max; identical to SEQ ID NO: 375

SEQ ID NO: 377 - DNA, 726 bp, Glycine Max
atggcactctcttctcgtctcttttccaaatccaaattgatctatggctgtcaaatacttctgcaaaaggagcatgctattccagttcgtcactttgctaaagagtctgcccctcctgcccttaagggagatcagatgctgaagaacatttttgtggaggtgaagaacaaatttgagactgccataggaatattaaagaaggagaagatcaccattgacccagaagatccagctgctgtttctcattatgcaaaggtcatgaaaacagttagagagaaggcaagcttgttgtcggagtcccaagacatactatccaccattgaaattgagactcaggatattccagatgctcggacctatcttctgactttgaaggaaataagagtcaagaaaggtcttacagatgatcttggtgcagaggctctgatgatagatgcattggacaaaattgaaaaggatttaaaaaaacctttactgagaaatgataagaaaggaatggaccttctcttggcagagtttgataagattaataagaaaattggaattcgaaaggaagatctaccaaagtatgaagaggagctagaacttaaagtagccaaagcacaactggaggagctgaagaaggatgctctcgaggcaatggaaactcaaaagaaaagggaggaattcaaggatgagcctgaatcggtcgatgtcaaaactttggacatcagaaacttcctttaa

SEQ ID NO: 378 - DNA, 669 bp, Glycine Max
atggcactctcttctcgtctcttttccaaatccaaattgatctatggctgtcaaatacttctgcaaaaggagcatgctattccagttcgtcactttgctaaagagtctgcccctcctgcccttaagggagatcagatgctgaagaacatttttgtggaggtgaagaacaaatttgagactgccataggaatattaaagaaggagaagatcaccattgacccagaagatccagctgctgtttctcattatgcaaaggtcatgaaaacagttagagagaaggcaagcttgttgtcggagtcccaagacatactatccaccattgaaattgagactcaggatattccagatgctcggacctatcttctgactttgaaggaaataagagtcaagaaaggtcttacagatgatcttggtgcagaggctctgatgatagatgcattggacaaaattgaaaaggatttaaaaaaacctttactgagaaatgataagaaaggaatggaccttctcttggcagagtttgataagattaataagaaaattggaattcgaaaggaagatctaccaaagtatgaagaggagctagaacttaaagtagccaaagcacaactggaggagctgaagaaggatgctctcgaggcaatggaaactcaaaagaaaaggtattactaa

SEQ ID NO: 379 - DNA, 1134 bp, Glycine Max
atggcagatgccgaggatattcaaccccttgtttgcgacaatggaactggaatggtcaaggcaggatttgctggtgacgatgctcctagggctgtctttcccagtattgttggccgacctcgacatactggtgttatggttgggatgggtcaaaaggatgcctatgttggtgatgaagcccaatccaaaagaggtattcttactctcaagtatcccattgagcatggtatagtcagcaactgggatgacatggaaaagatctggcatcacacattttataatgaacttcgtgttgctcccgaggagcacccagtgcttctcactgaggcccccctcaacccaaaggccaacagagaaaagatgacccaaatcatgtttgagaccttcaatgtgcctgccatgtatgtggccatccaggctgttctctccttgtatgcaagtggtcgcacaactggtattgtattggactctggtgatggtgtgagtcacactgtaccaatctatgaggggtatgcactcccccatgccatccttcgtttggatctcgctggtcgtgatctaactgatcatttgatgaagatcctcactgagagaggatacatgttcaccacctctgctgagcgagaaattgtccgtgacatgaaggaaaaacttgcatatgttgccctagattatgagcaagaactcgagactgcaaaaagcagttcatcagttgagaaaagctatgagcttcctgatggacaagttatcacaattggggcagagagattccgttgcccagaagttcttttccagccatctatgattggaatggaagctgctggaattcatgagaccacctacaattctatcatgaagtgtgatgtggatatcagaaaggatctatatggcaacattgttcttagtggtggctcaactatgtttcctggtattgcagaccgtatgagcaaggagatcactgctcttgctcctagcagcatgaagattaaggttgtagctccaccagaaagaaaatatagtgtctggattggaggatcaatccttgcatccctcagcaccttccagcagatgtggatttctaaaggtgaatatgatgagtctggcccatccattgtccacaggaagtgcttctaa

SEQ ID NO: 380 - DNA, 1104 bp, Glycine Max
atggcagctttggatctcacaataagcatgttggcactcatagttgttgttgtttctcttggcttgtggggtggtgttcaaggtgcgccacaagttccatgctacttcatttttggtgattctttggttgataatgggaacaacaaccagctccaatctttggctagggctgattacttgccttatgggattgacttccctggtggaccttctggaaggttttccaatggaaaaaccactgttgatgcaattgctgaacttttgggattcgatgattacatacctccatatgctgatgctagtggcgatgctatcctcaaaggagtcaattatgcttctgctgctgctggaattagagaggaaactgggcagcaactgggagggcgcattagttttaggggacaagtgcaaaattaccaaaacacagtgtctcaagtggtaaatttactgggaaatgaggactcagctgcaaattacttgagcaagtgcatatactcaattgggttgggtagcaatgattacctcaacaactacttcatgcctcaattctattccagcagcaggcagtactcaacagatgagtatgctgatgttcttattcaagcatatactgaacaactaaaaactttgtataattatggagcaaggaaaatggtgctgtttggaattggccaaataggttgcagcccaaatgaattggcccaaaacagcccagatggtaaaacatgtgtggaaaaaattaacactgcaaaccaaatattcaacaacaaactgaaaggtctcactgaccaattcaacaaccagctgcctgatgcaaaagtcatctacattaactcgtatggcatctttcaagatattataagcaacccttcagcctatggtttcagtgttacaaatgctgggtgctgtggggtaggaaggaacaatggtcaaattacatgtcttccaatgcaaacaccatgccaaaacaggagagagtacttgttttgggatgcttttcatcctactgaagctggcaatgttgttgtggctcagagagcttacagtgctcaatctgcatcagatgcttaccctgttgatatccaacgcttagctcagatctga

SEQ ID NO: 381 - DNA, 261 bp, Glycine Max
atggcagggttagttgcacaagttcaaagcaatccttgcacaagcacattcttctctgcactagtgcaactcattccttgtagggcagcagttgctccttttagccctattcccccaaatgatgcttgttgcaatgccctaaagggactagggcagccatgtttgtgtgtccttgttaatggccctccaatttctggggtagaccgtaacatggcctctcagctcccagaaaagtgcacagctaactttgatccattttag

SEQ ID NO: 382 - DNA, 714 bp, Glycine Max
atggcaggtgcaggaggagggtatggggacgcgaaccagaggatagactacgtgttcaaggtggtgctgataggggactcggcggtggggaagtcgcagatactagctcggtttgcgaggaacgagttcagcttggactccaagtccaccatcggtgttgaatttcagacaaggaccttggtcatagatcacaagaccgttaaggctcagatctgggacactgctggccaagaacgatacagagcagttacgagtgcatactacaggggtgctgtgggggcaatgttggtttatgacatcactaaacgccaaacctttgatcacataccacgttggttagaagaactgcgcaaccatgctgacaagaacatagtcatcattcttataggaaacaaatgtgatcttgagagccagcgtgatgtacccaccgaggatgcaaaagaatttgctgagaaagaaggtttatttttcttagagacctcagcactagaagcaactaatgttgaaacagccttcataactgtcttgacagaaatatacaacattgtcaacaagaagaacctaactgctgatgaaaatcagggaaatgggaactcggcatctttgtctggccagaagattattggaattaatcctttacaattaaatataaagtgtaaggatttacttaaagatataccatactctaatttagtgatcctccaaattgtataa

SEQ ID NO: 383 - DNA, 306 bp, Glycine Max
atggcataccaaaactacaacaactatgggtggcgatgcccctctgacgagtaccaagtgtacgaccccccagtagaggcaacatatcctaggcaaaatcatcacaagaagggtcatgtggcattcagaaccaactatgaggattctatagctgaagtagaatccaacgttgaggctcgagaacataacagcaggttatggaatcacagtgcttacaaaagcgtggaccaagaggctgaggcgtttattcagtatgagcataagaggatggaattagccaggcttatgtcaacaagggctgtctga

SEQ ID NO: 384 - DNA, 579 bp, Glycine Max
atggcatcaacaatatcagcaatggccatgatcaacgccaaatgcgtcaacccaaagttccccaaccccaccaagctcgtaccatcaaaaccttcccttcaggtcaaccttccaaagggcctaatagcctcacccgaaaacaccaaactttccactgcgacagcaatcgcaggagcaatattcacaaccctcggaacctgcgacgccgctttcgccgttcaacaaatagccgacatagcagaaggcgacaaccgcggtctggcactgttgctgcccataattcctgcaatagggtgggttctgttcaacattctgcagccggcgctgaaccaactgaaccgcatgcgcagcaccaaaggcgtgatcattgggttggggcttggcggcttggctggcttggtggctgcgccgcatgcatcggcggcggcggcttctgaagtggcggcgatggctgaagctgcctcgaacgacaacaggggacagcttctgctgtttgtggttacgccggctattgcttgggttctttacaacatcttgcagcctgctcttaaccagctcaacaggatgagatcccagtga

SEQ ID NO: 385 - DNA, 2217 bp, Glycine Max
atggcatcgcgagcaattttgagaaggaggagaagtttaatccatcaatacttgaataactgttttgcttcttcttcgccgtctcccagtaatcgctctctggaattcgctatagctacgacgtcacctttgtttccttgtaagcatggaacgacgccgtacagagacggtttgttccatcgtttcggattgggacaacttgttcctagattcggaagcgccgttccgctggacggtttttcgggattgaacgcgccgataggtgttcggtggttgtcgcagtcggcggcggcagcggcgaaacgtcatgaaccggacgagaacgatgagacggtggcgaagaagcggaaagaagcgtcgcctgaggagtgcgatcaagccgtcgaaggcttgaccactgcgaaggccaaagccatggcgaaacgggcgcaagaggagtcgcagaaagacgtgcagagcgtgttgcggagagtgtggactgcgtttttgggaattggtcctgcgttgagagctgtcgcgtctatgagtagggaggactgggcgaaaaaactggttcactggaaaggggaatttgtgtcgacgttgcagcattattggttgggttctaagctgctgtgggctgatgtgaggatcagttccaggttgttgttgaagcttgcgggtgggaggagtctctccagaagggagaggcagcaactgacgcggactactgccgatatctttaggctagttccttttgctgttttcattattgttccctttatggagttactcctgcccgtgtttctaaagttattccctaacatgttgccgtcaacatttcaagataagatgaaagaacaggaagcattgaaaaggagactaaaggcaagaatagagtatgcaaggttccttcaggatacagtcaaagaaatggcaaaagaagttcagaactcccgcagtggagaactaaagaaaacagccgaagatcttgatgaatttttaaacacaattagaagaggtgcaactgtctctaatgaggaaattttgggctttgctaagttgtttaacgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcaggaagattgcagagagcgaggcatgcttggaatgctttctgttgaagaaatgcgccaacagcttcgagattggttggacttatctctgaatcactctgttccatcatctcttttgatactttcaaggtcatttactgtgtctgggagattgaaaccagaagaagctgtgcaggctacactttcttctctccctgatgaggttgtagatactatacaggttacatctttaccctctgaggattctgtctcagagaggaggaggaaattggagttccttgaaatgcaagaagaacttattaaggaggaggaagagagagaggaggtggtgcaaaggatggagagtagttctagtcaagatgataaggccctgaaagagatgaatgtttcaacggcaaaagaagctcaccaacttgccagagacagagcatttgaaaacaaagaacaactgtgtgaacttagtcgtgcattagctgttttagcttctgcatcgtctgtaagtacagagcgtgaagattttcttagactggttaacaaagagatagaactctataacagcatggtagaggaagagggcccaaatggtaaaaaagatgcctttaaggcatataaagctgcccgagaggaacatgaacacactaatgagttggatgaaggggataaggtgtcatcagcactcattgggagagttgatgctatgcttcaaaatcttgagaaggaaatagatgacgtcgatgcaaaaattggtgaccgttggaggctgctggacagagattatgatgggaaagtaactcctgaggaggtagcctctgctgcaatgtacttaaaggatacattgggcaaagagggtatccaagaacttgtcagcagtctttccaaagatagagatgggaaaatacttgttgaagacattgttaagttgggcagttggagggaagatggtaatgctcatgaagatgatgagaccagggagaggctatga

SEQ ID NO: 386 - DNA, 2088 bp, Glycine Max
atggcatcgtctcatggtaatgcccactcggatgctgcaaagatggaacaaataatcaccgagttcttcgccaagagcctgcacataatactcgaatcaagggcactctatgtgtcctcacgcaattcctatggtgatcaagctgtttcgtctccgtgttcgtcgtcttcatcttcgtcgagtgtgcggccgagggataagtggttcaatttggctctccgggagtgcccggcggcgctggagaacattgacctctggcgccagaacaatcttgagtgcatagtgatagatgtgattttggtgcagaggcctctggattgggatcctgtgactgtgagtttttctccaaagagggttcttcctaggagttcttcactgaaggaaagatgcccttttggctggaacactgatcaggaagaattgggggttgtgggaaggagtgaaaagattgtggagaggtggcttgtgcagtatgagagtaggaagacaagggattctaattctggcagtaggagatcaagcaatgtttctttacataacttgtataagaaatcaactttgcttctgaggtctttgtatgccactgttagacttttacctgcctataaacttttccgagagcttaattcgtctggacagattagggactttacccttggtcaccgtgtgtcttcttttgttgagcccttcacccggaaacaagaggctgaaatgatgaaattcgggttcacccctgtggatacttcttctggtaggctgtgtctcagtgtgatgtattgcccctcagcatcagatgtgagttctgaaccttccactccgatgtccccacaagttataactgattatgttgggagtccattggctgatccattaaggaggtttccttctcttcctgtggcaggtttgccatcttcaaggcagcgtagttggagtttcgatcattatagagcctcacctccttcttatttaccttcgcctactcattcagaatcactctcgtcagggtataatgcatgtttgcggcgtttcccccctgcaagtttgcctcctcatccatctgagatgtctttgattcagaagaagaatacaaattttgatgattattatccctctgcatcaccttcaacctctaattctgggccgttaccatgcaaaccccttttacgatctgaaagtgctccagtcagcatacctactgctgaagttgataattcccctggatactccaataggcataatttgcctccatctcctcccctaagaatttcgaggggcattggtaagattgataaaaacccaatgcaaacaggagcaacagctgagaagttgttttctcttggaaaagacgagtctcgaaaatattctggagtgaagatatcagctaacagctcgccccagatttcaatttccagaagctcaagtaggtcttatcaggatgattttgatgatactgattttacttgtccatttgatgtggatgatgatgatatgacagatccaggaagcagaaatcctccaagaaagaaaaagaaaatacaccagagtgaatatgagaaatccaagagttctgctgtggtccccaatctctttgcatatttgaaacttcaaatagaaattcctttgaaacagccagaaggagaataccaaagagaggtcagtaggtcaccaacacaacatgctgagacgcttgaagctggaggattctttcccattagaaagtctcaagatgctgctgttggtgcgcttgtacatatgctgaagaaagcgccacctctgcatcaagatttctccacctcacaacacctctcacaaggtgcataccctgaaacctggaaaaataacactcaagggaccaatcagatcctagaggcatcatcaaggccagtgagcataatgtcttctgggatcatagctactaggaaaacaacagctgatgcattggaagagttccatggttacaaagagatgaaaaacttgttgcttaggcgaggtagtacgtttgggggttgtgggtattctcattgtattcctacaacttgcagtctttggacacgcaactatagtccaagacttgaacctttgttttga

SEQ ID NO: 387 - DNA, 594 bp, Glycine Max
atggcatctgcgacgcgtctggtgcactgcgagctgcgctcggcgaggcccgcggttcggccgagggaaccggccggtccggttcaggttacgatccccaaacccaaacccaaagcggcggaggcggaaggcgcgaacatcgttttgcagccgcggttgtgcactctcagatcctacggttcggatcgagccggggtgcttatcaagactcgcaaggagggtgaccatgatgacgtgtcacccttcttcgccgcgctttccgactatattgagagctctaagaaaagtcaagattttgagatcatctctggtcgtctagctatgatggtgtttgcagcgacggtgacaatggaagtggtgacagggaactctgtgttcagaaagatggatattgaaggaatcacagaggctggtggggtgtgtttgggtgcagtaacttgcgcagcactctttgcatggttctgcagtgcccgaaacagagttggtagaatcttcaccgtaagctgcaacgcattcattgactctgtaattgaccaaatcatcgatggtttgttctatgaaggcgaccctactgattggcctgatgaaccgtga

SEQ ID NO: 388 - DNA, 435 bp, Glycine Max
atggccaccacagcagctctatccggaaccatggtgagcacctccttcatgaggaagcaacctatgacgaccaagagcctaaagacattccccaacgctctttttggtctgaaaggtggacgaggtggtcgtgtaacttgcatggcctcgtacaaggtgaagctcataaccccagaaggagaagtggagtttgaatgcccagatgatgttttcattgttgacaaggctgaggaagaaggcattgaacttccctactcgtgcagggctggttcttgcgtttcatgtgttgggaaaattgtgaaaggtgacgtggaccagtcagatggtagcttccttgatgatgaacaaatagaaagtggatgggttctcacctgtgttgctctacctaggtcagacgttgtcattgagacacacaaggatggagagatcgaatga

SEQ ID NO: 389 - DNA, 2124 bp, Glycine Max
atggccactgttgctagtcccgcggatcaagcaactgatttgctgcagaagctatcgttggaaactcagcccaagcccttggagattcctgagccaaccaagaaggccactgggaatcagtatggatcagttgattcaggaaatgctgcgaatggccagatcccatcgtatgatcggtctgtaaccccagtgttgcaggattttattgatcctactatgtgttacctcccaaatggttacccatccactgcctattattatggtggttatgatggaactggtaacgagtgggatgattattctagatatgtgaattcggaaggagttgagatgacttcgggagtttatggggataatgggtctctactttatcaccatggatatggatatgcaccctatggcccctattcgccagcagggtctccagttccaaccatggggaatgatggtcagttgtatgggcctcaacactatcagtaccctccatattttcaaccgctaacaccaaccagtgcaccattcacacctactcctgctgtccttcctcagggtgaggtttccacctctgttgctgctgatcaaaagcctcttcctgttgaagcagccaatggaaattctaatggtgtctcaaatggtggcaatgcaaaaggtaataacgctgctgctcctattaaacaggccaatcagaattcatcttttagttccaaagcatcaaatgaaagggttgctatgccaggtcgtggtccaacctcaggttatcaggatccaagatttggttatgatggagttcgctcacctatcccctggctagatgccccactattttcagatgggcaaccaaggcctgtaagtagcacaaccatcacttcttcgatatcaggtggcaacaacactgcctcaaggagccagactttccgccctaattctcagttcatgggcttgcaccacccaagaccaatgcctgccatgggagccacccatagcttcataaataggatgtaccccaacaaattatatggtcaatatgggaacactgtcagatctggaatgggttatggtacacatgggtatgattctcgggctaatgggcgggcttggttggctgttgacagcaaatacaaaactaggggaagaagtggtggctattttggctatggaaatgagaatgtagatggcttgaatgaactgaacagaggccctagggccaagggtggcaaaaaccaaaaaggttttgcaccaactattttggcagtcaaagggcagaacttgcctgcaagtttaggcaccgatgaagagaaagacaagactagtaccgttccggaccgtgatcagtataacaaagctgattttccagaagaatatactgatgctaaattttttgtcatcaagtcttacagtgaggatgatatccataagagtattaagtataacgtgtgggccagtacccaaaatggcaacaagaagcttgatgctgcatatcatgaggcacagcagaaacctggtggctgccctgtttttctctttttctcagttaataccagtgggcaatttgtggggcttgctgaaatgattggtcctgttgattttaacaagagtgttgagtattggcagcaagacaagtggaatggctgctttcctcttaagtggcacgttgttaaggatgttcctaacaatttgttgaggcacattaccctggataacaatgagaacaaacctgtcactaacagtagggatacacaagaggtaatgttggagcctggcctgaaattaatcaaaattttcaaggaatataccagcaagacatgcattctggatgattttggcttctatgaggcccgtcagaagactattttggagaagaaagcaaagcaacaattcccaaagcaggtatgggaagggaaacctgctgatgagaagattgagataaatggggaagtcaatactcaaaaatctgaagttagctcggaagtgctcaaggagtcccttgctgagaaggatagtgatgaccacaaagttcccgagaatggatgtgctacaaaaactggagatgccccaaagggtgctaaaccagttgttcctgagagcaagattgtagccaatggggttgtttctaatggttgctaa

SEQ ID NO: 390 - DNA, 2037 bp, Glycine Max
atggccactgttgctagtcccgcggatcaagcaactgatttgctgcagaagctatcgttggaaactcagcccaagcccttggagattcctgagccaaccaagaaggccactgggaatcagtatggatcagttgattcaggaaatgctgcgaatggccagatcccatcgtatgatcggtctgtaaccccagtgttgcaggattttattgatcctactatgtgttacctcccaaatggttacccatccactgcctattattatggtggttatgatggaactggtaacgagtgggatgattattctagatatgtgaattcggaaggagttgagatgacttcgggagtttatggggataatgggtctctactttatcaccatggatatggatatgcaccctatggcccctattcgccagcagggtctccagttccaaccatggggaatgatggtcagttgtatgggcctcaacactatcagtaccctccatattttcaaccgctaacaccaaccagtgcaccattcacacctactcctgctgtccttcctcagggtgaggtttccacctctgttgctgctgatcaaaagcctcttcctgttgaagcagccaatggaaattctaatggtgtctcaaatggtggcaatgcaaaaggtcgtggtccaacctcaggttatcaggatccaagatttggttatgatggagttcgctcacctatcccctggctagatgccccactattttcagatgggcaaccaaggcctgtaagtagcacaaccatcacttcttcgatatcaggtggcaacaacactgcctcaaggagccagactttccgccctaattctcagttcatgggcttgcaccacccaagaccaatgcctgccatgggagccacccatagcttcataaataggatgtaccccaacaaattatatggtcaatatgggaacactgtcagatctggaatgggttatggtacacatgggtatgattctcgggctaatgggcgggcttggttggctgttgacagcaaatacaaaactaggggaagaagtggtggctattttggctatggaaatgagaatgtagatggcttgaatgaactgaacagaggccctagggccaagggtggcaaaaaccaaaaaggttttgcaccaactattttggcagtcaaagggcagaacttgcctgcaagtttaggcaccgatgaagagaaagacaagactagtaccgttccggaccgtgatcagtataacaaagctgattttccagaagaatatactgatgctaaattttttgtcatcaagtcttacagtgaggatgatatccataagagtattaagtataacgtgtgggccagtacccaaaatggcaacaagaagcttgatgctgcatatcatgaggcacagcagaaacctggtggctgccctgtttttctctttttctcagttaataccagtgggcaatttgtggggcttgctgaaatgattggtcctgttgattttaacaagagtgttgagtattggcagcaagacaagtggaatggctgctttcctcttaagtggcacgttgttaaggatgttcctaacaatttgttgaggcacattaccctggataacaatgagaacaaacctgtcactaacagtagggatacacaagaggtaatgttggagcctggcctgaaattaatcaaaattttcaaggaatataccagcaagacatgcattctggatgattttggcttctatgaggcccgtcagaagactattttggagaagaaagcaaagcaacaattcccaaagcaggtatgggaagggaaacctgctgatgagaagattgagataaatggggaagtcaatactcaaaaatctgaagttagctcggaagtgctcaaggagtcccttgctgagaaggatagtgatgaccacaaagttcccgagaatggatgtgctacaaaaactggagatgccccaaagggtgctaaaccagttgttcctgagagcaagattgtagccaatggggttgtttctaatggttgctaa

SEQ ID NO: 391 - DNA, 735 bp, Glycine Max
atggccagtggcgtgactacagtggactgcgagaaacaggtgagatcatggaggctgctacgttctctcatgcaactactaatccccacatgcaactgcgccaccattatagaagacgaccaagatctaacaacaacaacaaacgagaccctccgaaacacaagaagcaaatattataattattatacaccatcgtcatcatcactgatgagctccaccaccaatatcacaggcacgatcttcggataccgcagaggaaaggtgagcttctgcattcaggcaaacgccaactccaacaacccaattctcctcctggagttggcagttccaacagccatcttggccaaggaaatgagaggagcaaccctcagaatcgccctagagagcggtcgtggtgatggtgacgacgacggcaaagcagacacacttttgtcgacgcctttgtggaccatgtactgcaatgggaggaaagtgcggtatgccgttaagcggaggccctccaacactgatttcgaggcgctgaggttgatgggttcggtagttgtcggaaccggggttatgaagtgcaaggagttggtgagttggaagaaattagaagaagatgatcaactaatgtaccttagagcgagctttaagagggttcgtggctcagacaactgtgaatctttccacttgattgatccagagggagacatcgatcaggagcttagtgttttcttttttaggtccagctga

SEQ ID NO: 392 - DNA, 1248 bp, Glycine Max
atggcccacttaatcatacaaccggaatcctcctccgattcgttcttccccggtggtctcttcctccaccctcacacgcttccttcatccttcgcttccttcattccttcagaccatgtaacagtatcatgttttttttggaggcccaaaacaaggttgagggtcgaagagaggctttgcggcggtgcgttcttgtcgttgagtttgtcctttaacggaaccggtgcggatcagaggtatggtcgagaatcgggtgaaattctgggacagcatcacaaggtggaagatgatggtgtgtgtcaagaagagaaagagaaagagaaggttgggctcaatggatcgggtgctatgaatatgaccaaacatctttgggccggtgctgttgctgccatggtttcaaggacttttgttgcgcctctagagagacttaagctggagtacatagttcgtggtgagcagaagaatctttatgagctcattcaggcaattgcagcttctcaagggatgagaggtttttggaaagggaattttgtgaatattcttcggacggcaccctttaaggctataaatttttatgcatatgatacgtatagaaataagctgacaaggatgttggggaatgaagaatctactaattttgagagatttgttgcgggtgctgcagctgggattacagccaccttgctctgcttgcccatggacactatcaggacggtaatggtagcacctggtggtgaagccttgggaggtgtgattggtgccttccgccacatgattcaaacagagggcttcttttctctttacaagggtttagtaccctccattatcagcatggcaccttcaggtgctgtctactatggtatttatgatattttaaagtcagcatatctgcattcacctgaaggaatgaaaagaatccaacacatgaaagaagagggtgaagagctgaatgcactggaacaactggaattgggtcctgtcagaactttattatatggtgctattgctggttgttgttctgaagctgcaacttacccatttgaagttgtaaggagacagcttcaaatgcaagttcgggcaacaaggttgaatgcactggcaacttgtgtcaagattgttgagcaaggaggtgttcccgccctctatgtaggacttattcctagtttattgcaggtgttgccatcagctgctattagttattttgtttacgagttcatgaagatagttctcaaagtagaatcaacatag

SEQ ID NO: 393 - DNA, 1986 bp, Glycine Max
atggccggcaccggcgaccttgatgccgatgcggtactcagcgacgtcgaggacgacggcggcgatccgattccgctcgagacgaaggctccctcgccggaagacgtctccgtcgagaaactccgggatgttctcgccgaactcgatagggagcggcaagcgcgcatcgccgcggagaatacgaagtcggaattgcaggtttcgttcaacagattgaaggcgctagcacacgaggcaataaagaagcgcgatgagttcggtcgccagcgagacgacgccgttcgggagaaggaggagacggcgaagcaattagaagaaaccgcgaaggaacgcgacgcgctgcgatcggagattgggaattcgagccacatgctggtcacgggtatggagaaaatctcggcgaaggtcagcagcttcgccggcaacgcgctgccgctgccgcggtcacagaaatacacaggcatggcggcggtggcgtacggcgtaatcaagcgcgcgaacgagatcgtggaggagcttttgaagcagaacgaggcgaccgcgaaggcgaggaacgaggctcgggagcagatggagcagcggaattacgagattgccattgaggtttctcagcttgaggccacgatcagtggcttgagggatgatgttgcaaagaacgcttcgattgttgaggatttggagagggacttagctgttagggatcagaggctgaacgaggtttcggagaatttgagtaaggagcaaagcgaggctttgcagttgaaggagttcgttgctgagtgtgaggagaagttgagtaacttggaatctcggatggaatcgcaaaggcctttgttgattgatcagttgagttttgtttccaaaattcataaccagatatgcaatgttgttaagatacttgatgacggtggcacctcggagctgtctgaatcgttgtttgtcccgcaagaaacagacgttgaggagaatattcgtgcctctttggctgggatggagtccatatatgagttgaccaagattgttgttcagaaagctaaggatgtgcttgaggagaaggatcgtgagattaagagtttagatgagacggtggctcagttagttagggagaaggatcaaattggttctttgcttaggagcgctttgtctaagaggatggcagttgatccatcttctagaaagagtgagctgtttcaagctgcagagaatgggttgagggaggctgggatagatttcaaatttagtaagcttcttggagatgggaaggttgcagcttcaaatgacaagtcagatacaacggaaaaacaagaggatgaaatatattccttggccggtgctttggaggatgttgttagggcatctcagcttgagatcattgagcttaagcatactgtgggtgaattaagggcagagttgagcttacttaagcagcatatagaagctcaggtcaaggagcttgaccatagaatgcatcggatagaggaacttgaagagaaggagagagtggcaaacgaaaatattgagggactgatgatggacattgctgctgctgaagaagaaattaacagatggaaagtggcagcagagcaagaagctgccgcaggcagaggcgtcgaacaggaatttgtggcacagttgtcagcacttaagcaggaacttgaagaggcaaagcaatccatgttagaatcagagaagaaactaaaattcaaagaagaaacagctgctgctgccatggcagccagagatgctgcagaaaagtctcttaagttagcagacttgaggtcatctagactaagagacagagtagaagagcttactcatcagctcgaagagtttgagaacagggaagattcaaggagccgtaatcggcctagatatgtgtgttggccatggcagtggctcggcatggattttgttggatttcagcagcgacccgatacacaacaggaggcttctaacgaaatggaactttctgaacctctattataa

SEQ ID NO: 394 - DNA, 1986 bp, Glycine Max; identical to SEQ ID NO: 393

SEQ ID NO: 395 - DNA, 1986 bp, Glycine Max; identical to SEQ ID NO: 393

SEQ ID NO: 396 - DNA, 585 bp, Glycine Max
atggcctcagaaaatggagacaaactagaacttgctttcagtgttgttcctgatcccaagcccaagaaggattgggtcaatttgtcccttagggtggtcgcatttttggccacagcatctgctacgcttgttatggcattcaacaaacaaaccaaaagcatggtagttgccaccattggcactaacccagtaacaattactcttactgcaatgtttcagcacactccagcttttacattcttcgtgatagtcaatgcaattgccagtttctataacatggtggtgataggagtggagatattaggaccacaatatgattacaaagaacttcgtcttggactgattgcaatattagacgtgatgacgatggctctagcagcaactggagatggtgcagcaacattcatggcagaattaggaaggaatggtaattcacatgcaaggtgggataagatatgtgacaaattcgaagcatactgcaaccgaggtggtgttgccctcattgcctctttcgttggcctcattctcctcctcgttgttacagtgatgtctatcaccaagatgctcaagctaaatcgcatttag

SEQ ID NO: 397 - DNA, 3021 bp, Glycine Max
atggccttgttctctcattttcttgttcattttgccttattactcattttcctccctcttgagctacacaaccttttgattggtgtatcatcagccactttaagcatcaccacagacagagaagccttgatctcatttaagtctcaactgagtaatgagaatcttagccctttatcttcttggaaccataattcatctccttgcaattggactggtgttctatgtgacaggcttggccaaagagtaactggcttggatctttcaggctatggactctcaggtcacttaagcccttatgttggtaacctttcctctcttcagtctctccaattgcagaataaccaattcagaggagtgattcctgaccaaattggcaacctattaagtcttaaagttctaaatatgagctataacatgttagaaggaaagcttccttcaaacatcacccacttgaatgagcttcaggttcttgatttatcctcaaacaagattgtcagcaagattcctgaagacatcagcagcttgcaaaagcttcaggctttgaaactaggaaggaacagcctctttggtgcaataccagcatctctaggaaacatttcttccctaaaaaatatcagctttggcaccaactttctcactggctggattcccagtgaattgggcaggctccatgatttgattgagcttgatctcagtctcaaccatctcaatgggactgttccacctgctatatacaacttatcttcccttgtcaactttgccttagcttcaaactctttctggggtgagattcctcaggatgttggtcacaaacttccaaaactcatagttttctgtatctgcttcaattatttcacaggtagaattccagggtctttgcataacctcaccaacattcaggtcattcgtatggcttccaaccatttggaaggatcagtgccacctggtttgggaaatctcccatttctttgcacgtataacattcggtataactggatagtgagttcaggtgttagaggtttagacttcattacttctttgacaaacagcactcacctgaactttctagcaattgatggaaatatgctggaaggtgtgattccagaaaccattggcaatctctccaaggatctctcaacactatacatgggacagaatcgtttcaatggaagcataccctcctccattggtcgtctcagtggcttgaagttgttaaacttaagctacaattcaatctcaggagaaatcccacaagagttaggccagttagaggaactacaagagctatctctggctgggaatgagatatcaggaggtattccaagcatacttggtaatctcctgaagttaaacctggttgatttgtcaagaaataaacttgtggggagaatacctaccagttttgggaatttgcaaaacctgctttacatggacttatccagcaaccaactcaatggaagcatacctatggaaatcctcaatctcccaactttgagcaatgttctgaacttgtcgatgaactttttgagtggaccaatacctgaagttggcagattgagtagtgtggcctccattgacttttctaacaaccaattgtatggtggcatccccagctcattcagcaattgtctcagcttggaaaaactgtttttgcctcggaatcagctttcaggtcccattccaaaggctcttggagatgtgagaggcttggaaactttggatctgtcctccaaccaactctctggaaccattcctattgaacttcaaaatttacacgggcttaagctcttaaacctctcgtacaatgatatagaaggagccattcctggtgctggagttttccaaaatctctctgctgtccatttagaaggcaatagaaaactctgcttgcatttctcatgcatgcctcatggccaaggaagaaaaaatataagactttacatcatgatagccatcacggtaacattgatactatgtctcactattggcttattactatatatcgagaacaaaaaggtgaaggtagcaccagttgcagaatttgaacagcttaaacctcatgcaccaatgatctcttatgatgagcttcttttggcaactgaggagttcagccaggaaaacctattaggagttggaagctttggctcagtttataaaggccatctaagtcatggagctaccgttgcagtgaaagttcttgacaccctaagaactggctctttgaagagtttctttgccgaatgtgaggctatgaagaactcaaggcatcgaaatctggttaagctgatcacatcatgctctagtattgactttaaaaacaatgattttctggctctggtgtacgagtacctgtgcaatggtagcttggatgattggatcaaggggaggagaaagcatgaaaagggaaatgggttaaaccttatggaaagactgaacattgctctagatgttgcttgtgcattggactacctccacaatgatagtgaaattccagtagtgcactgtgatttgaagcctagcaacattctattggatgaagatatgacagcaaaggttggagactttggattggctaggttgctgattcaaagatcaactagtcaagtttccataagctccactcgtgtccttaggggttcaattggttacatacctccagagtatggatggggagagaaaccatctgcagctggtgatgtatatagttttggtatagtgttactagaaatgttctctggtaaaagtccaacagatgagtgtttcacaggagacctaagcataagaagatgggtgcaatcatcatgtaaagacaagatagtgcaagtgattgaccctcagttactatccctcatttttaatgatgacccttctgagggagaggggccaattctgcaactttattgtgtggattcaattgtaggagttggcatagcttgcactacaaacaacccagatgaacgcattggcatcagagaagctgttcgtcgactaaaagctgctagggactctcttttgaattag

SEQ ID NO: 398 - DNA, 1326 bp, Glycine Max
atggcgaaacgggcgcaagaggagtcgcagaaagacgtgcagagcgtgttgcggagagtgtggactgcgtttttgggaattggtcctgcgttgagagctgtcgcgtctatgagtagggaggactgggcgaaaaaactggttcactggaaaggggaatttgtgtcgacgttgcagcattattggttgggttctaagctgctgtgggctgatgtgaggatcagttccaggttgttgttgaagcttgcgggtgggaggagtctctccagaagggagaggcagcaactgacgcggactactgccgatatctttaggctagttccttttgctgttttcattattgttccctttatggagttactcctgcccgtgtttctaaagttattccctaacatgttgccgtcaacatttcaagataagatgaaagaacaggaagcattgaaaaggagactaaaggcaagaatagagtatgcaaggttccttcaggatacagtcaaagaaatggcaaaagaagttcagaactcccgcagtggagaactaaagaaaacagccgaagatcttgatgaatttttaaacacaattagaagaggtgcaactgtctctaatgaggaaattttgggctttgctaagttgtttaacgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcaggaagattgcagagagcgaggcatgcttggaatgctttctgttgaagaaatgcgccaacagcttcgagattggttggacttatctctgaatcactctgttccatcatctcttttgatactttcaaggtcatttactgtgtctgggagattgaaaccagaagaagctgtgcaggctacactttcttctctccctgatgaggttgtagatactatacaggttacatctttaccctctgaggattctgtctcagagaggaggaggaaattggagttccttgaaatgcaagaagaacttattaaggaggaggaagagagagaggaggtggtgcaaaggatggagagtagttctagtcaagatgataaggccctgaaagagatgaatgtttcaacggcaaaagaagctcaccaacttgccagagacagagcatttgaaaacaaagaacaactgtgtgaacttagtcgtgcattagctgttttagcttctgcatcggtgagaatttga

SEQ ID NO: 399 - DNA, 1617 bp, Glycine Max
atggcgaaacgggcgcaagaggagtcgcagaaagacgtgcagagcgtgttgcggagagtgtggactgcgtttttgggaattggtcctgcgttgagagctgtcgcgtctatgagtagggaggactgggcgaaaaaactggttcactggaaaggggaatttgtgtcgacgttgcagcattattggttgggttctaagctgctgtgggctgatgtgaggatcagttccaggttgttgttgaagcttgcgggtgggaggagtctctccagaagggagaggcagcaactgacgcggactactgccgatatctttaggctagttccttttgctgttttcattattgttccctttatggagttactcctgcccgtgtttctaaagttattccctaacatgttgccgtcaacatttcaagataagatgaaagaacaggaagcattgaaaaggagactaaaggcaagaatagagtatgcaaggttccttcaggatacagtcaaagaaatggcaaaagaagttcagaactcccgcagtggagaactaaagaaaacagccgaagatcttgatgaatttttaaacacaattagaagaggtgcaactgtctctaatgaggaaattttgggctttgctaagttgtttaacgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcaggaagattgcagagagcgaggcatgcttggaatgctttctgttgaagaaatgcgccaacagcttcgagattggttggacttatctctgaatcactctgttccatcatctcttttgatactttcaaggtcatttactgtgtctgggagattgaaaccagaagaagctgtgcaggctacactttcttctctccctgatgaggttgtagatactatacaggttacatctttaccctctgaggattctgtctcagagaggaggaggaaattggagttccttgaaatgcaagaagaacttattaaggaggaggaagagagagaggaggtggtgcaaaggatggagagtagttctagtcaagatgataaggccctgaaagagatgaatgtttcaacggcaaaagaagctcaccaacttgccagagacagagcatttgaaaacaaagaacaactgtgtgaacttagtcgtgcattagctgttttagcttctgcatcgtctgtaagtacagagcgtgaagattttcttagactggttaacaaagagatagaactctataacagcatggtagaggaagagggcccaaatggtaaaaaagatgcctttaaggcatataaagctgcccgagaggaacatgaacacactaatgagttggatgaaggggataaggtgtcatcagcactcattgggagagttgatgctatgcttcaaaatcttgagaaggaaatagatgacgtcgatgcaaaaattggtgaccgttggaggctgctggacaggtttgcactagctcttcaactctaa

SEQ ID NO: 400 - DNA, 984 bp, Glycine Max
atggcgaacacactatataacggcgccacatgccgaatccctctccgtgatgaatccctggccttctctcgccacgtttccagatccctctctttcctcctcaaaacacgtgcgggaaaacaatcatacgcatttgcggttaaggcttcttcgcactctgacttcgacgttgacctttcgctcagtccacgtgtcaatgccgtcaagccttccaaaaccgtcgccatcagcgaccacgccaccgctctcttccaagccggcgttcccgtcattcgcctcgccgccggcgagcccgatttcgacacgcccgctcccatagctgaggctgggattaatgcaattcgcgaaggttacacgaggtacacgcccaatgccggaaccatggaactgcgccaagcgatttgtcgcaagcttaaagaggagaatgggattagttatactcctgaccaagttgtggttagtaacggagccaaacagagcattgctcaggcagtgcttgcagtttgctcccccggagatgaggttattattccagctccattctgggttagttacccagaaatggcaaggttggctgatgcgacacctgtgattcttccaaccttaatatctgataatttccttttggatcccaaacttcttgaatccaaaattactgaaagatcgagactgctcattctttgttcaccatctaacccaacaggatctgtctaccctaaagaattacttgaagagatagcccggattgttgcaaagcaccccaggctcctggttctctccgatgaaatttatgaacacataatttatgcaccagcaactcacacaagttttgcatctttaccaggaatgtgggacagaactcttactgtgaatggattttccaaggcctttgcaatgactggttggcggcttggatatattgctggtccaaaacattttgttgcagcatgtggaaagatccaaagtcaggggccagtagtatag

SEQ ID NO: 401 - DNA, 1002 bp, Glycine Max
atggcgaacacactatataacggcgccacatgccgaatccctctccgtgatgaatccctggccttctctcgccacgtttccagatccctctctttcctcctcaaaacacgtgcgggaaaacaatcatacgcatttgcggttaaggcttcttcgcactctgacttcgacgttgacctttcgctcagtccacgtgtcaatgccgtcaagccttccaaaaccgtcgccatcagcgaccacgccaccgctctcttccaagccggcgttcccgtcattcgcctcgccgccggcgagcccgatttcgacacgcccgctcccatagctgaggctgggattaatgcaattcgcgaaggttacacgaggtacacgcccaatgccggaaccatggaactgcgccaagcgatttgtcgcaagcttaaagaggagaatgggattagttatactcctgaccaagttgtggttagtaacggagccaaacagagcattgctcaggcagtgcttgcagtttgctcccccggagatgaggttattattccagctccattctgggttagttacccagaaatggcaaggttggctgatgcgacacctgtgattcttccaaccttaatatctgataatttccttttggatcccaaacttcttgaatccaaaattactgaaagatcgagactgctcattctttgttcaccatctaacccaacaggatctgtctaccctaaagaattacttgaagagatagcccggattgttgcaaagcaccccaggctcctggttctctccgatgaaatttatgaacacataatttatgcaccagcaactcacacaagttttgcatctttaccaggaatgtgggacagaactcttactgtgaatggattttccaaggcctttgcaatgactggttggcggcttggatatattgctggtccaaaacattttgttgcagcatgtggaaagatccaaagtcaggtatgctacattttttattggccactttcgtaa

SEQ ID NO: 402 - DNA, 1395 bp, Glycine Max
atggcgaacacactatataacggcgccacatgccgaatccctctccgtgatgaatccctggccttctctcgccacgtttccagatccctctctttcctcctcaaaacacgtgcgggaaaacaatcatacgcatttgcggttaaggcttcttcgcactctgacttcgacgttgacctttcgctcagtccacgtgtcaatgccgtcaagccttccaaaaccgtcgccatcagcgaccacgccaccgctctcttccaagccggcgttcccgtcattcgcctcgccgccggcgagcccgatttcgacacgcccgctcccatagctgaggctgggattaatgcaattcgcgaaggttacacgaggtacacgcccaatgccggaaccatggaactgcgccaagcgatttgtcgcaagcttaaagaggagaatgggattagttatactcctgaccaagttgtggttagtaacggagccaaacagagcattgctcaggcagtgcttgcagtttgctcccccggagatgaggttattattccagctccattctgggttagttacccagaaatggcaaggttggctgatgcgacacctgtgattcttccaaccttaatatctgataatttccttttggatcccaaacttcttgaatccaaaattactgaaagatcgagactgctcattctttgttcaccatctaacccaacaggatctgtctaccctaaagaattacttgaagagatagcccggattgttgcaaagcaccccaggctcctggttctctccgatgaaatttatgaacacataatttatgcaccagcaactcacacaagttttgcatctttaccaggaatgtgggacagaactcttactgtgaatggattttccaaggcctttgcaatgactggttggcggcttggatatattgctggtccaaaacattttgttgcagcatgtggaaagatccaaagtcagttcacttcaggggccagtagtatagctcagaaagctgcagttgctgcattaggactaggccatgctggtggggaggcagtttctaccatggtgaaagcatttagggagcgaagggatttcttggtaaaaagttttagagaaatagatggtgtcaagatatctgaaccccagggagcattttatctattccttgatttcagcttctattatggaagagaagctgaaggattcggtaaaattgaggattctgagtccctctgtcgatatctactggatgtgggccaggtagccctggtgccagggagtgcatttggagatgacacttgcatccgcatctcttatgcagaatcccttactaccctacaggcagctgtagaaagagttaagagagcacttatcccgctgagctctgctgcacttgtttaa

SEQ ID NO: 403 - DNA, 648 bp, Glycine Max
atggcgaagaagcgaaagtcggtggcaacgcgccttgacgaagtggatcgaacgatgtactccactttctgcagcaccgccaactccctctctcatctctacacccacgccatgaaccaacaaaaactctcatttcaggccggtgaacgacacgctcttgagaaattgtatcaatggattctcaggcaacagcaagaaggatctagggtggccaccattgatattgttacccatttgcagaatgagcttgaatatggaggagaggaggcaccagtgtccccaaggcagccaatgcatcaacagaattcccagactgcaatgcacaacactaactttggtgcgtccataccctctaatgcatttggagcaactgtggcaggacaggggatacgtgctggacaacctgatcaacaaccaaagaactcagtgttctcaaatgcactctctagtcctattcgacgcagccttcagccatatcatttggcacaggggagctttccttcatgtaatatcatgtcttcaggaaatggaacccggaatagtgacatgacttatcctaatggccagaacagggacacaaattcttccaactccagtgattgcatggatatgcattcagatagtcctggtcatgatttttcatactga

SEQ ID NO: 404 - DNA, 648 bp, Glycine Max; identical to SEQ ID NO: 403

SEQ ID NO: 405 - DNA, 1119 bp, Glycine Max
atggcgaaggcccaacaagcgcttcctgaggagctgatagtggagattctgtcatgggttccggtgaagcctctgatgcgtttcaagtgcgtttccaaaacttggaactccctcatcttccaccccaccttcgtgaaattgcaccttcaaagagccgccacaccttgctccgtacttcgtttgcttgaggagaatccatcacccgctcctcatgatgatcattaccaattcaatgatgtttactctttcgtaggttcctgcaatggcttgatttgcttgcgtttttttactgttagtggcagaggtaattttgaatactgggtacgattttggaacccagccacaaggatcacgtcccaagaatctccacacttacgtctccgtcgacgcgattatatgcttttagaggattatgtgaagtttgggtttggttacgatgatgtgagtgacacttacaaggtggtggcacttgtcttcaatactaaatcgcaaaattgggaggtgaaagttcactgtatgggagatacttgttggataaacattttaacttgccctgcttttcccattagtcggaggttactcgatggacatcttgtcagtggcaccgttaactggttagcatttcgcatgttgggtattgattatgaatggaacaatgtcactgtccatcaattagtaattttttcatatgatctaaagaaggagacttttaaatatttgtcgatgcctgatggtgtttctcaagttcctgattatcctcctaagattggggttttgaagggttgcctgtctctttcctacactcacaggagaagaacccatttcgttgtttggctaatgaggcaatttggagttgaaaaatcctggactcggttgttgaatgtaagttatctgaattttcaactctctccaactaacgaattagattggttgccgaccacgcctttgtgcatctctgaaaatgatgatatgatgttgctggcaaactgcgtgtatgatgaatttgttctccataatcgaagagataatagaatagacagtattggaagtttcgacggcaaagtgccaatgtgctcctatgattatgttccaagcttggttttgccatattgtaattaa

SEQ ID NO: 406 - DNA, 1344 bp, Glycine Max
atggcgaagtcaaagaacaatgctaagaagttgtcctacatatcagttccatctcagatcatcaactccatatcatcatcttctctgcaatctcttcttgactctcccaagaagtcttcaaggaacaccaacaacaacaggttctttatcttcttcaccaacagcaccagcaccatcatcttcagaaaacaaagactctggtttttcacactctttctctttggtttccttggcatgctcaagtttggcctcacccttcacacccctttccccccctacccatgtgccaccacaacccttctgccacagaacatgatctcaaccaccccacattcaaagtcaaaccttggtgctgttttgagagagaacaatgaccaaaaaaaagatgaggtcttgttgtctcatgtggagctgagagcacagggattggagaaggtggaaggtgatgagggtgttgagaagagtgagttttgggagaagccagatgggttgggatacaaaccttgcttgagttttagcagggattatagaagagcaagcgaaggggttctgaaggataggagaaagtacctcatggtggtggtttctggagggttgaatcagcagaggaatcagattgttgatgcagttgtcattgctaggattcttggagctgctttggttgttcctatattgcaagtcaatgtcatttggggtgatgaaagtgagtttggtgatatatttgatttggagcacttcaagagagttcttgccaatgatgtgcgagtggtttcagcattgccatcaactcacctaatgacaaagccagtggagggtagtcctccacttcatgtcactcctagttggatccgttcaagatatctcagaagattcaacagagaaggtgttttgctcttgcgtagtttggattcaaggctgtcaaaggatctcccttctgatcttcaaaagcttagatgcaaggttgctttcaacgcactacggtttgctcagccgattcaggaactcggtgacggcattgcagagagaatgcaaagcaagggaccttaccttgttcttcatctaagaatggagaaggatgtgtgggtgaggaccggatgcctccccggtttgagtcccgaatttgatgagattgttaacaatgagaggatacaacggccggagctcttgactgcaagatcaagcatgacttaccatgaaaggaagatggctggtctatgccccttgaatgctgtggaggttactaggagctccaaagaatgcaagaatttactgggctggaggacaaccattgggtggaaaaaaagccttgcttccattgatccaagagtttcctcatttttatag

SEQ ID NO: 407 - DNA, 1734 bp, Glycine Max
atggcgaagtcaaagaacaatgctaagaagttgtcctacatatcagttccatctcagatcatcaactccatatcatcatcttctctgcaatctcttcttgactctcccaagaagtcttcaaggaacaccaacaacaacaggttctttatcttcttcaccaacagcaccagcaccatcatcttcagaaaacaaagactctggtttttcacactctttctctttggtttccttggcatgctcaagtttggcctcacccttcacacccctttccccccctacccatgtgccaccacaacccttctgccacagaacatgatctcaaccaccccacattcaaagtcaaaccttggtgctgttttgagagagaacaatgaccaaaaaaaagatgaggtcttgttgtctcatgtggagctgagagcacagggattggagaaggtggaaggtgatgagggtgttgagaagagtgagttttgggagaagccagatgggttgggatacaaaccttgcttgagttttagcagggattatagaagagcaagcgaaggggttctgaaggataggagaaagtacctcatggtggtggtttctggagggttgaatcagcagaggaatcagattgttgatgcagttgtcattgctaggattcttggagctgctttggttgttcctatattgcaagtcaatgtcatttggggtgatgaaagtgagtttggtgatatatttgatttggagcacttcaagagagttcttgccaatgatgtgcgagtggtttcagcattgccatcaactcacctaatgacaaagccagtggagggtagtcctccacttcatgtcactcctagttggatccgttcaagatatctcagaagattcaacagagaaggtgttttgctcttgcgtagtttggattcaaggctgtcaaaggatctcccttctgatcttcaaaagcttagatgcaaggttgctttcaacgcactacggtttgctcagccgattcaggaactcggtgacggcattgcagagagaatgcaaagcaagggaccttaccttgttcttcatctaagaatggagaaggatgtgtgggtgaggaccggatgcctccccggtttgagtcccgaatttgatgagattgttaacaatgagaggatacaacggccggagctcttgactgcaagatcaagcatgacttaccatgaaaggaagatggctggtctatgccccttgaatgctgtggaggttactaggcttttgaaaggtctaggagctccaaagaatgcaagaatttactgggctggaggacaaccattgggtggaaaaaaagccttgcttccattgatccaagagtttcctcatttttatagcaaggaagatcttgccttgccaggagaactacaaccatttgcaaataaggcttctataatggctgccatagattacatagtctctgagaagagtgatgttttcatgccatctcatgggggaaatatgggccatgcaattcagggtcatcgagcatttgccgggcacaagaaatatataaccccaaacaagagacacatgctcccttattttcacaattcttccctccctgaagaagagttcaacaggattatgaaagagttgcaccaagactcattggggcagccagaacttagaactatcaaagctgggagggatgttaccaagtttcctattcctgagtgcatgtgcaatgactccaatgctcaatcctga

SEQ ID NO: 408 - DNA, 1545 bp, Glycine Max
atggcgaagtcaaagaacaatgctaagaagttgtcctacatatcagttccatctcagatcatcaactccatatcatcatcttctctgcaatctcttcttgactctcccaagaagtcttcaaggaacaccaacaacaacaggttctttatcttcttcaccaacagcaccagcaccatcatcttcagaaaacaaagactctggtttttcacactctttctctttggtttccttggcatgctcaagtttggcctcacccttcacacccctttccccccctacccatgtgccaccacaacccttctgccacagaacatgatctcaaccaccccacattcaaagtcaaaccttggtgctgttttgagagagaacaatgaccaaaaaaaagatgaggtcttgttgtctcatgtggagctgagagcacagggattggagaaggtggaaggtgatgagggtgttgagaagagtgagttttgggagaagccagatgggttgggatacaaaccttgcttgagttttagcagggattatagaagagcaagcgaaggggttctgaaggataggagaaagtacctcatggtggtggtttctggagggttgaatcagcagaggaatcagattgttgatgcagttgtcattgctaggattcttggagctgctttggttgttcctatattgcaagtcaatgtcatttggggtgatgaaagtgagtttggtgatatatttgatttggagcacttcaagagagttcttgccaatgatgtgcgagtggtttcagcattgccatcaactcacctaatgacaaagccagtggagggtagtcctccacttcatgtcactcctagttggatccgttcaagatatctcagaagattcaacagagaaggtgttttgctcttgcgtagtttggattcaaggctgtcaaaggatctcccttctgatcttcaaaagcttagatgcaaggttgctttcaacgcactacggtttgctcagccgattcaggaactcggtgacggcattgcagagagaatgcaaagcaagggaccttaccttgttcttcatctaagaatggagaaggatgtgtgggtgaggaccggatgcctccccggtttgagtcccgaatttgatgagattgttaacaatgagaggatacaacggccggagctcttgactgcaagatcaagcatgacttaccatgaaaggaagatggctggtctatgccccttgaatgctgtggaggttactaggcttttgaaaggtctaggagctccaaagaatgcaagaatttactgggctggaggacaaccattgggtggaaaaaaagccttgcttccattgatccaagagtttcctcatttttatagcaaggaagatcttgccttgccaggagaactacaaccatttgcaaataaggcttctataatggctgccatagattacatagtctctgagaagagtgatgttttcatgccatctcatgggggaaatatgggccatgcaattcaggtatgtttcttaagttgttatagtgattcttctattaattga

SEQ ID NO: 409 - DNA, 1326 bp, Glycine Max
atggcgaatacggggaatttagacgcggcgatagagcaattgctgaacgtggagaagcagatgaggctcgccggtgacgtggcgggtaccagaaaagcagccaccgatattttgcagctctgcttcgatgcacgagcctggaaaacactcaatgaccagattgtcgttttgtcaaaacgacgtggccagctcaagcaggctgtaacagctatggtgcaacaggctatgcaatatattgacgagacaccagatatcgaaactcgcatagaactcatcaaaacgttgaacagtgtgtctgcagggaagatatacgtggaaattgagagagctcgattgatcaaaaaacttgcaaagattaaggaagaacaagggcttatagctgaagctgctgatttgatgcaagaaattgcggtggaaacattcggtgccatggccaagactgagaaaattgcgttcattcttgaacaagttcgtttgtgtctagaccgccaggattatgttcgtgcacaaatactctcaagaaagattagcccaagagtatttgatgctgatttatctaaggaaaagaaaaagcctaaagaaggtgataatgttgtagaagaggcccctgcagatataccatctttgctggagttgaagcaaatctattacgaactaatgattcgatattattcccataacaacgattatcttgaaatttgccgttgctacaaggcaatatatgagattccatctgtcaaagaagaccctgccaagtggattccaatcctaaggaaaatatgttggtacttggttctagcgccctatgatccaatgcaatcaagctttctcaattccaccttggcggataagaatctatctgagattccaaacttcaagctactcttgaaacagctggttaccatggaggttatccaatggacaactctatgggatacatataagagtgattttgagaatgagaaggcctctgggaaatctttgggagaaaaagcagcagaagatctaaggcaaagaataattgaacataatattcttgttgtatcaaaatactatgcaagaattacattgaagagacttgcagagcttttgtgcctcagtgtacaggatgctgagaagcatctctcagatatggttgtgtctaaggcgctggtggcaaagattgatagaccattgggaatagtctgtttccaaacagcaaaggatagcaatgacattcttaactcatgggcagcaaacttggagaaattacttgatcttgtggagaaaagttgtcatcagatacacaaggaaaccatggtccacaaagctgctttgaaggtttaa

SEQ ID NO: 410 - DNA, 624 bp, Glycine Max
atggcgacggtgtcccctctcgccaaatacaagctcgttttcttgggcgatcaatccgttggcaaaaccagcatcatcacccgcttcatgtacgacaaatttgacacaacctaccaggcaactattggtattgactttttgtcaaaaacaatgtaccttgaagatagaactgttcgcttgcagctttgggatactgcagggcaagaaagatttagaagtctcattccaagctacataagagattcttctgttgcagttatagtatatgatgttgctaacaggcaatcatttctgaacactaacaagtgggttgaggaggttcgtacagaacgtggcagtgatgttattattgtgttggttggaaacaaaactgatcttgttgaaaaaaggcaagtttctatagaggaaggagatgcaaagtcccgtgagtttggaatcatgttcatagaaaccagtgccaaagcaggcttcaatatcaagcctttgtttcgtaagattgctgctgccttgccagggatggaatctctttcttctacaaagcaggaagacatggtcgatgtaaatttaaaacccacggtgaattcatcccagacagagcaacaaggaggaggttgctcatgctag

SEQ ID NO: 411 - DNA, 948 bp, Glycine Max
atggcgacgttgaaggttcctgcacaacttccttctccattggaagacagtgagcaattgcgaaaagcttttcaagggtggggaacgaatgaaggattgataatatcaatcctgggtcacagaaacgcggctcagcgtaagttgattcgtgaagcttatagtacaacccatggagaagatcttcttaaagatttagacaaagaactttcaagtgactttgagcgggctgtgatggtttggacattggatccttctgagcgtgatgcctttttagcaaatgaagccactaagatgttgacttcaaacaattgggtcattttggaaattgcttccactagatcttcacttgacctcctaaaggcaaaacaagcatatcaagcccgtttcaaaaagtcccttgaagaagacgttgcctatcatactaaaggggacatccgcaagctattggttcctcttgtgagcacattccgttatgagggggatgaggtgaacatgacattggcaaaatctgaggctaaactgcttcaccagaagattgcagagaaggcctacaacgacgaggacctgatcaggattttgtcaacaaggagtaaagcacagttaacagcgacactaaatcagtacaacaatgagttcgggaatgccataaacaaggatctgaaaactgatccaaaagatgaatatctgcaattattgagggcagccattaagtgcttgacttaccctgagaaatattttgcaaaagtcttgaggctggctataaacaagctaggaactgatgaaggggcccttactagagtggtgacaaccagagctgaggttgatttgcagcgaattgctgaggaataccaaagaagaaacagcattcctctggaccgcgcaatagccagtgacacttctggagactatcagagcattctccttgcactggttggacatgaggattaa

SEQ ID NO: 412 - DNA, 948 bp, Glycine Max; identical to SEQ ID NO: 411

SEQ ID NO: 413 - DNA, 651 bp, Glycine Max
atggcgcaaggcatggcgagtaaccgaaaccggaacccttgcgcgcaagaagcgcgcaaggtgatggtggtggcggacccgacgcgggaatcggcgggcgcgttgcagtacgcgcttgcgcatgcggtgatcgaacaggacgagctgattctgctgcacgttgagaaccctagctcgtggcgaaacaccatatcgacgttcctgaagatgccttcgttgggaagcagcaccactgcgtcgctggacctcggaggaggtggaggagggggagcagccgcggcgccggacggagaagggttggattttctggaggagatgaagcatgcatgtagcgtttctcagccgaaaatgaaggtgcgtgtggtgaaggtggagatggatggaagagacaaggctagcattgttctctcgcagagcaaaacgcatggggttgacgtcgtagttataggccagaagcgcaatattacttcggccatattaggatacaagcgacctgcaagtggatctatgaaaggggtgaaagcgatagacactgctgagtatttgattcaaaacagctcgtgcacctgtgttagtgtacagagaaaaggccaaaatggaggctttgttctcaactccaaaacccacagaaatttctggctcttagcctaa

SEQ ID NO: 414 - DNA, 984 bp, Glycine Max
atggcgccaccggcaccacccaagtcaagtcagggtcaggtgatgaataatgcaaggattcacttcttttccattctcctcgctctccaatacggtgctcaacctttgatctccaaacgcttcatcagacgtgaagttattgtgacttcatctgttttgacttgtgagcttgcaaaggttatatgtgcagtgttttttatggcaaaagatggtagtctgaggaaattgtataaagagtggactttggttggtgcgttgactgcatcaggacttcctgcagctatatatgcattgcaaaatagtttgctgcaaatttcttacaagaatcttgattcactcacattctcaatgctgaatcagaccaaaatatttttcaccgcgctctttgcatatttcatattgaggcaaaaacaatcgattgagcaaattggagccttgttcttgttaatagttgcggcagttcttttaagtgttggcgaaggctctaccaaaggttctgctattggcaatgctgatcaaattttattttatggaattattcctgtattagttgcttcagtgctctctggattggcttcatccttgtgtcaatgggcctctcaggttaagaaacactcatcatacttgatgactatagaaatgtctattgttggaagtctatgtttgcttgccagtactttgaaatctccagatggggaagctatgagacaacatgggtttttctatggttggactcctcttactttgatcccagtaattttcaatgcccttggaggaattcttgtcggtttagttacaagccatgctggtggtgttcggaaggggtttgtcattgtttctgctttactcattacagcattgctacagtttattttcgatggaaagacaccttcattgtattgccttttggctcttccactagtggtcactagcatttcaatataccagaaatacccctaccaggttaagaagaaggagtcatag

SEQ ID NO: 415 - DNA, 699 bp, Glycine Max
atggcgccgaagaagccccgaaccacgtcgaggaaccctgatttggtcaggggaattggcaaatattcgaggtcgcagatgtaccacaagaggggcatctgggccatcaaggccaaaaacggcggtgttttgcccctccacgatcccaagcccaaacccgaggccccggcccagaagccgcccaagttctacccggccgatgacgtgaagaagcccctcgtcaacaagcacaagcccaagcccgcgaaactcagggctagcattactccagggactgttctgatcctgcttgctgggaggttcaagggaaagagggttgttttcttgaagcagcttccatctggattgcttcttgtaacaggtccctttaagatcaatggggttcctctgagaagggtgaaccaatcgtatgttattggtacatccacaaaggtggatatctctgatgtcaatgttgataaatttgatgacaagtactttgccaaggaagctaagaaaaagaaaacaaagggcgaaggcgaattctttgaggcagagaaggaggagaaaaatgtgcttccccaagaaaagaaagatgaccaaaaaaccgtggacactgctttgttaaaggccattgagagtgttccagagctcaagtcttacttgggtgctaggttttccttgaaggcaggagtgaagccccatgagctagttttctag

SEQ ID NO: 416 - DNA, 579 bp, Glycine Max
atggcgccgaagaagccccgaaccacgtcgaggaaccctgatttggtcaggggaattggcaaatattcgaggtcgcagatgtaccacaagaggggcatctgggccatcaaggccaaaaacggcggtgttttgcccctccacgatcccaagcccaaacccgaggccccggcccagaagccgcccaagttctacccggccgatgacgtgaagaagcccctcgtcaacaagcacaagcccaagcccgcgaaactcagggctagcattactccagggactgttctgatcctgcttgctgggaggttcaagggaaagagggttgttttcttgaagcagcttccatctggattgcttcttgtaacaggtccctttaagatcaatggggttcctctgagaagggtgaaccaatcgtatgttattggtacatccacaaaggtggatatctctgatgtcaatgttgataaatttgatgacaagtactttgccaaggaagctaagaaaaagaaaacaaagggcgaaggcgaattctttgaggcagagaaggaggttaaaaaatgtgcttccccaagaaaagaaagatga

SEQ ID NO: 417 - DNA, 570 bp, Glycine Max
atggcgccgaagaagccccgaaccacgtcgaggaaccctgatttggtcaggggaattggcaaatattcgaggtcgcagatgtaccacaagaggggcatctgggccatcaaggccaaaaacggcggtgttttgcccctccacgatcccaagcccaaacccgaggccccggcccagaagccgcccaagttctacccggccgatgacgtgaagaagcccctcgtcaacaagcacaagcccaagcccgcgaaactcagggctagcattactccagggactgttctgatcctgcttgctgggaggttcaagggaaagagggttgttttcttgaagcagcttccatctggattgcttcttgtaacaggtccctttaagatcaatggggttcctctgagaagggtgaaccaatcgtatgttattggtacatccacaaaggtggatatctctgatgtcaatgttgataaatttgatgacaagtactttgccaaggaagctaagaaaaagaaaacaaagggcgaaggcgaattctttgaggcagagaaggaggttagtttgacaatcgttttgttttga

SEQ ID NO: 418 - DNA, 699 bp, Glycine Max
atggcgccgaagataacacgcaaggtcagcagaaaccccgaattgataaggggaatcggaaagtactcgaggtcgcagatgtaccacaagaggggcatttgggctatcaaggccaaaaacggtggcgttttacctcgccacgaccccaaacccaaacctgaaactcccactgaaaaaccacccaaattttaccccgctgatgatgtcaagaaaccccttgtcaacaagcacaaacccaaaccagctaagctcagggctagcattacccccggaacagtgttgattcttcttgctggtagatttaagggaaagagggtagtgtttttgaagcagctaccttctgggttgcttcttgtaacaggtcctttcaaggttaatggagttcctttgagacgtgtgaatcaggcctatgttattggcacatcaaccaaagtagatgtctctgctgttaatgtcaacaactttgatgacaaatactttgcgaaggaagcccagaggaagaagaagaagggagaaggggagttctttgaggcagagaaggaggaaaagagcgtgttaccccagcagaagaaagatgaccagaaaacagtggatgctgcattgttaaaagccattgagagtgtgccagacttgaagtcttatttgggtgccaggttttctctaaaggctggcgtgaaacctcatgagctagtcttctag

SEQ ID NO: 419 - DNA, 690 bp, Glycine Max
atggcgccgaagataacacgcaaggtcagcagaaaccccgaattgataaggggaatcggaaagtactcgaggtcgcagatgtaccacaagaggggcatttgggctatcaaggccaaaaacggtggcgttttacctcgccacgaccccaaacccaaacctgaaactcccactgaaaaaccacccaaattttaccccgctgatgatgtcaagaaaccccttgtcaacaagcacaaacccaaaccagctaagctcagggctagcattactcccgggacagtgttgattcttcttgccggtagatttaagggaaagagggtcgtctttttgaagcagcttccttctgggttgcttcttgtaactggtcctttcaagattaatggagttcctttgagacgtgtgaatcagtcctatgttattggcacttcaaccaaagcaaatgtctctgctgttaatgtcgaacagtttgatgacaaatactttacaaaggaagcccagaagaagaagaagggagagggcgaattctttgaggcagagaaggagagtgtgttgccccagcagaagaaagatgaccagaaaactgttgactctgcgttgataaaagccatcgagagtgttccagacttgaagacttatctgggtgccaggttttctctaaaggctggcgtgaaacctcatgagctagtcttctag

SEQ ID NO: 420 - DNA, 696 bp, Glycine Max
atggcgccgaagataacacgcaaggtcagcagaaaccccgaattgataaggggaatcggaaagtactcgaggtcgcagatgtaccacaagaggggcatttgggctatcaaggccaaaaacggtggcgttttacctcgccacgaccccaaacccaaacctgaaactcccactgaaaaaccacccaaattttaccccgctgatgatgtcaagaaaccccttgtcaacaagcacaaacccaaaccagctaagctcagggctagcattactcccgggacagtgttgattcttcttgccggtagatttaagggaaagagggtcgtctttttgaagcagcttccttctgggttgcttcttgtaactggtcctttcaagattaatggagttcctttgagacgtgtgaatcagtcctatgttattggcacttcaaccaaagcaaatgtctctgctgttaatgtcgaacagtttgatgacaaatactttacaaaggaagcccagaagaagaagaagggagagggcgaattctttgaggcagagaaggaggaaaagagtgtgttgccccagcagaagaaagatgaccagaaaactgttgactctgcgttgataaaagccatcgagagtgttccagacttgaagacttatctgggtgccaggttttctctaaaggctggcgtgaaacctcatgagctagtcttctag

SEQ ID NO: 421 - DNA, 570 bp, Glycine Max
atggcgccgaagataacacgcaaggtcagcagaaaccccgaattgataaggggaatcggaaagtactcgaggtcgcagatgtaccacaagaggggcatttgggctatcaaggccaaaaacggtggcgttttacctcgccacgaccccaaacccaaacctgaaactcccactgaaaaaccacccaaattttaccccgctgatgatgtcaagaaaccccttgtcaacaagcacaaacccaaaccagctaagctcagggctagcattactcccgggacagtgttgattcttcttgccggtagatttaagggaaagagggtcgtctttttgaagcagcttccttctgggttgcttcttgtaactggtcctttcaagattaatggagttcctttgagacgtgtgaatcagtcctatgttattggcacttcaaccaaagcaaatgtctctgctgttaatgtcgaacagtttgatgacaaatactttacaaaggaagcccagaagaagaagaagggagagggcgaattctttgaggcagagaaggaggtgggattgtctattttcttattttgttga

SEQ ID NO: 422 - DNA, 696 bp, Glycine Max
atggcgccgaagataacacgtaaggttagcagaaaccccgaattgataaggggaatcggaaagtactcgaggtctcaaatgtaccacaagaggggcatttgggctatcaaggccaaaaacggtggcgttttacctcgccacggccctaaacccaaacctgaaactcccgctgaaaaaccacccaaattttaccctgctgacgatgtcaagaaaccccttgtcaacaagcacaaacccaaacccgcgaagctcagggctagcattactcccgggacagtgttgattcttcttgccggtagatttaagggaaagagggtcgtctttttgaagcagcttccttctgggttgcttcttgtaactggtcctttcaagattaatggagttcctttgagacgtgtgaatcagtcctatgttattggcacttcaaccaaagcaaatgtctctgctgttaatgtcgaacagtttgatgacaaatactttacaaaggaagcccagaagaagaagaagggagagggcgaattctttgaggcagagaaggaggaaaagagtgtgttgccccagcagaagaaagatgaccagaaaactgttgactctgcgttgataaaagccatcgagagtgttccagacttgaagacttatctgggtgccaggttttctctaaaggctggcgtgaaacctcatgagctagtcttctag

SEQ ID NO: 423 - DNA, 3144 bp, Glycine Max
atggcggagcttccttcacaggacattttagcattgttggaattcaagaaaggcatcaagcatgaccctactggttatgtccttagttcctggaatgaggactctgttgatgttgatggatgtccatcttcatggaatggagtactgtgtaatggtagtgatgttgctggtattgtacttgataaccttggtctcgccgctgatgccaacttgagtgttttctcaaacctcacaaagctagtaaaactctctatgtccaacaattctatctcaggaaaacttcctggcaacattgctgaattcaaaagcctcgagtttctggatgtttctaataatctcttttcttcatccttaccggtgggaattggcaagttatctagcttgcagaatctttcattggctggaaataacttctctggctcaatacctgactctatttctggaatggcttcaatccaatctttggacttgagctgcaattcattttctggaccactgctagcatcattgactaagctgactaacctggtatcatttaatttatctcataattgcttcactggaaaaattcccaaaggttttgagctgattttttcccttgaaaagattgacttgcatgggaatatgcttgagggtcatttagatgatgaatttatacttttttcaagtgccagctatgttgattttagtgagaatatgcttgtgagttctaattctcagcagcagaagtctctgccacaattatctgaaagtattaagtatttgaatctaagccataaccggctaactggatcattggttagtggaggcaagcaaccaaattttgaatacttgaaggtgttagaccttagttacaatcaattatccggagaattgcctgaatttgattttgtttatgaactcatggtccttaagctcagcaacaacagattttcaggatttgttccctctggtcttcttaaaggagactctttggttttaactgaactggatttgagtggcaacaatctcttagggccagtaagtataattgcatcaacaacactgtactttcttaatctgtcatcaaatgggtttactggtgagctgccattgcttactggaagctgtgctgtacttgatttgtcaaataacaaattagaaggaaatttaactaggatgatgaaatgggggaatattgaatttcttgatctcagtaggaatcacttgataggatccatccccgaggtaactcagttttttcgattaaattatctaaatctttcccataactttcttagcagctcccttccaaaagtcttaacacagtatccaaagcttagaatgcttgatgttagttccaaccagttagatgggaaatttctaattgatctggtcacaatgcccactttgcaagagcttcatcttggaaataatacgatttctggtggcattagtttatcatcctttcctcctcgtcctttcaatcttcagattcttgaactttcttataaccattttaatggttcttttcctgctgagtttgggtcattaacaggcctgaaagtgctcaatattgctggaaatcatttttctggttctctgccaaccacaattgctaacatgagttccctagattccttggatatatcagaaaataattttacaggccctttaccaaataacataccaaaggggctaaaaaaattcaatgcttcaaacaatgatctgtctggagttgtcccagaaaaccttaggaagttccctagttcttctttctatcccggtaatgataggttgcattttccaaacgacccttctggatcaaccaataaatctgatgaaagttccaataggaagtctatcagctctattgttaaagtgatcatcatagtatcatgtgtggttgctgttctcttcatgttagtactgctcgttgtcatcatacactacactcgaatatcaagatctccatcagaatatgctactgctaaggatatgagagagcatgctcaaccacaaaccactggccctggtcacgcaaaagattcgattggtgctttggttgtatcagccgaggattttgtgacctcacagaaaggttcgtcatctgagattatcagccatgatgaaaaaatggcagctgcaacaaggttctccccatcaaaaaatagccacttttcatcaccaggatctagtgattcagtttctgtaggaaatcatgcaagactatatgcaagatcagcagataaattgactggagaactttattttcttgatgatgcaataacattgacacatgaggagctgtctggagccccagctgaagttttggggagaagcagtcatggtacatcttacaaggcaactctggagcatggtttgttattgagagtgaagtggctaagagaaggaatggcaacaaagagaaaagaatttaccaaagaggctaaaaaaattgcaaacatcaggcatcccaatgttgtgggattgaaagggtactactggggtcctactcagcatgagaagcttattatttcagattacatctctccaggaagtcttgcaagttttctttacgatcgaccaggacaagaagatccaccattgacttgggctctgagactaaaaatagcagttgatatagcacgtgggctgaactatctacacttcgatcgtgctgttcctcacggcaacctcaaagcaacaaatgtgttgttagatacatgtgacttgcatgcacgtgtagctgattactgccttcacaagcttatgactcaggctggtacatttgaacaaatgcttgatgctggggtcttgggatatcgcgccccagagctttctgcttccaagaagccaatgccttccttcaaatcagatgtttatgcttttgggattatacttttggaacttttaactggaaggtgtgctggtgatgttgtgtctggcgagaaggaaggtgttgatctggcaaattgggtaaggttgcatgttgcacaaggtagaggatcagaatgttttgatgatgcactggtgcaagaaataagtaattcaattgttgaaaagggaatgaatgaggttcttggaatagccattcgatgcataagatctgtttctgataggccaggtatcaggactatatatgaagatctttcgtctatatag

SEQ ID NO: 424 - DNA, 1428 bp, Glycine Max
atggcggcgatgcagaggccactcaagagaaccattgcaatcgccaagctacgcgcgtgcttttcctctctccgacccgccgccgccgccgacatcgtcgcgtctcctccgccgcagctcccgccgttcgatcaccagccgcacccttacaacggtcccttcgccgatgaagtcctcgccaagcgcaaaacgttcctcggtccttccgtcttccactactataagaaacctctgaatatcgtggaagggaagatgcaatatctgtatgatgatagtgggaggcgttaccttgatgcatttgcggggatagttactgtttcttgcggacattgccaccctgaaatcttgaatgccatcacggagcagagcaaacttctgcagcatgctacaaccatatatctacatcatacaataggtgattttgctgagtcattggcagcaaaaatgcctggaaaccttaaggttgtttattttgtaaattctggttcagaagcaaatgaattagcaatgatgatggcccgtttatatactggtagtcttggtatgatttctttgagaaatgcatatcatggggggagttctagtacacttggtttgactgctctgaacacgtggaaatacccaattccagagggccatgttcatcacgttatgaatccagatccatatcgtggagcctttggtgcagatgctgctagttatgcaaatgatgtccaagaccatattgactatggaacttctggaaaagttgctggatttatagctgaaacaatgcagggagttggaggagctgttgaactggcaccagggtatttgaaacttgtttatgacattatacataaggctggtggtgtctgcattgccgatgaagttcaaactgggtttggtcgaacaggaagccattattggggatttgagacacagggtgtcattcctgatatagttaccatggcaaagggtattggcaatggtctgccattaggagctgtagttacaactccagaaattgcaagtgtgttggcccaaaagattcaatttaatacctttggtgggaaccccgtttgctctgctggtggacttgcagtgcttagggttcttgataaggagaagcgtcaagctcactgtgccgatgttggatctcatttgcttgaacgattgagatttctcatggaaagacatgacatcataggaaatgtaaggggaaggggcctaatggtaggcatagagttggtcactgaccgagacaacaagacacccgcaaaggctgaaactgctgtcgtgtttgaaaaactcagagagcttggtgtgctagttgggaaaggaggacttcatggcaatgttttcaggatcaagccaccaatgtgtttctccaaagatgatgcagattttcttgtggatgccttggattattctctatcaaagttgtga

SEQ ID NO: 425 - DNA, 939 bp, Glycine Max
atggcggcgtgcatcagcttcaccgccacgcgcgaccgctgcttccgcttcaccttctccaacgcaggcctcaaatccgccaccacggacctcggcgacggcaccatcatgcactggtgggcccccaaggcccccaaggactccaagcccaacctcctcctcctccacggcttcggggccaacgcaatgtggcagtggaacgacgtcctctcgcccctcacgcgccgcttcaacgtctacgtccccgacctcgtcttcttcggggactcccacacgacccgccccgaacgctccgaggccttccaggcccagtgcgtcgcggccctcctcctggcccacgggctccatacaaccagcgttgtcgggataagttacggcggcttcgtggcgtacagcctggcggcgcagtttccggagcttgtggagaaggtggtgctatgctgcgccggggtgtgcttggaagataaggacttggatgaagggatgttccaggtgaaaactgttgatgaggctgtggatattttgctgccgcagacgccggaaaagttgaggcagctcgtgcaaatcgcgtttgccatgcctgtcaaagccattcccacttgcttcctcaatgattacattaacgtgatgtgtactgaaaaccgccaagagaggaaagaattaatcgaaacattacataaggatagaaaactatctaatcttcctaagataacccagcctacgttaataatctggggagaaaaggacctggtattcccaatggaactagcttatagactacaaaggcatttgggagagaacgcgcgactagtggttattaagaatgcagggcatgctctcaatgtacagaagcccaaggagatgtacaagaatttaaaatccttcctcattgatctcactactccaactgtgccaaaaaaccaaagtaatggtacctaa

SEQ ID NO: 426 - DNA, 1638 bp, Glycine Max
atggcggttgttgctcaaacccctgacatcgccggcgagcggcagtccggccaagacgttcgcacccaaaacgttgtggcatgccaagccgttgccaacatcgtcaaaagctctttaggccccgttggcctcgacaagatgctcgtcgacgacattggcgacgtcaccatcaccaacgacggcgccacgattctcaagatgctggaagtggagcatcctgctgccaaggttttggttgaactcgccgagcttcaggatcgagaagtcggagacggcactacttctgtcgtcattgtagctgctgagcttctcaaaagggcaaatgaccttgtcaggaacaagattcatcctacctcgattatcagtggatatagacttgctatgcgagaggcttgtaaatatgtagaagaaaaactagctgtcaaggttgaaaagctgggaaaggattcactaattaactgtgccaagaccagtatgtcctcaaagttgatagctggtgatagtgacttctttgccattttggttgtagatgcagtgcaagctgtaaagatgaccaatgctcgaggtgaagttaaatacccaatcaagggaatcaatatcttgaaagctcatggaaaaagtgctagagacagctttctgatgaatggttatgctctaaatactggccgtgctgctcaaggaatgcctcttagggttgcccctgcaagaattgcctgtcttgatttcaatcttcagaagacaaaaatgcagttgggtgttcaagttttagttactgatcctagggagctagagaaaattcgtcaaagagaggctgatatgactaaggaacgtattgaaaaactgctgaaggctggagctaatgttattctgacaactaaaggaattgatgacatggctcttaagtactttgttgaggctggggcaattgctgtaagacgtgtgcggaaagaggacatgcgccatgttgccaaggctactggtgcaacattggtctcaacatttgctgatatggaaggggaggaaacatttgaaccatcttttcttggatatgctgatgaggttgttgaggagcgaatttctgatgatgctgtagttatgatcaaagggaccaaaactacaagcgcagtcactttgattctaagaggtgcaaatgaccatatgcttgatgagatggacagagctctgcatgatgcattgtcaattgtcaagagaactcttgaatcaaatacggtggtagctggtggaggtgctgttgaggcagcattatcagtttatttagagtaccttgctacaactttaggatctcgggagcagttggctatagcagaatttgctgagtctctgttaattattccaaaggtgctttctgttaatgctgctaaggatgccactgagctggtcgcaaaattacgggcctaccaccattcagcacaaactaaagccgataagaaacatttatcaagtatgggtttggacctttctgaagggaaaatcagaaacaacttggaggctggagtcattgagcctgcaatgagcaaagtaaaaattattcagtttgcaactgaagctgccattactatccttcgaattgatgacatgatcaagcttatcaaggatgaaagtcaaaatgaggattaa

SEQ ID NO: 427 - DNA, 818 bp, Glycine Max
atggctaatccacacattgcactgctgaaactcacctccatcttcattgtcatttttgcctcagagtttcctctattcccaactgtcaatattcctatttggattaatatactaaaaaaaatatttctactgaatagttttcttggttcatcactaacacaatttggtaactacaataagactttcactctagtaaattactgcaaggagacaatatggcctggcataacgcgcagtgacaaccacagtggcgacggcttcgcattgaaatcaggacaaacaactgtatatactgctccagatggatggagtgggaggatatgggctagaacaggctgcgactttgacaacaacggcaatggaaagtgcaaaacaggtggctgtggcaccagcataaactgcactggccctggaagccctccagcaacaagtgctgacttcacccttggtgaacctgatttctatgatgttagccttgtggatggcttcaacttgcctatagtagtgaaagctattaatggcacagggaactgcagcactgttggctgtgatggagatttgaggcagaactgcccttcagagcttgcttctaaggacaatgacaaagttattgcttgccggagtgcatgtgatgtcttcaatactgatgattattgctgcagagggacttatggaaaccctgcaacatgtttggcttcaaactactccaagatcttcaaacaagtgtgccctgcagcatatagttttgcacttgatgacccaacaagtctaataacttgttcaaaagcagactttgttgtgatattctgtggatcaag

SEQ ID NO: 428 - DNA, 483 bp, Glycine Max
atggctaatgagcaaatgaagcctattgccacccttcttttggggctgaacttctgcatgtatgccatagttttgggcattggtggatgggccatgaacagagcaatagatcatggttttattataggtccagaattaaaactgccagcacatttttcacccttgttcttcccaatgggaaatgcatccactggattctttgtcacatttgctttgcttgctggagtggttggtgctgcatcggcaatttcaggaatcaatcatatccggtcatggacttcagagagcttgccatctgcagcttcagttgctacaatggcttggactcttacactcctggccatgggctttgcctggaaagagattgagattcatatcagaaatgcacgcctgaaaacaatggaggcttttgtaattatactttcagctacacagcttttctacatagttgctattcacggtgctgctgcatatagaagataa

SEQ ID NO: 429 - DNA, 780 bp, Glycine Max
atggctacgctctctctcactctcaactgttggagtaccgtggaacttgctcacaccagattttcttctaccttcacctccctcggtcgcaggagtagatatagcatatgttcttttgccaagaagtcattgaagaaatccagaagagatgtaacagaggcagctggagatctcttagatgataagagtgctgtgcttcaagcttgcataataacttgtggtctcatagctgctttgggaatagtgattcggcaggtgtctcatgttgcgtcagtggaaggattgccagtctttgactgctctacagaagtatcatttggctttgaaatgtggcatcttgagttgattacaggacttgtagtattaatatcatcatgtcgctatttgctattgaagacgtggccagattttgccaagtctagcgaagcagccaatcaacaggtccttagctcacttcagcctttggattatattgttgttgcatttttgcctggtattagtgaggaactacttttccgaggagcgattcttccacttttgggaatgaactggaatagtattgggattgctgccttgatttttggtgttttacacctaggcaacggtcgaaagtattcctttgccatctgggcaacctttgttggtcttgcttatggatatgctacaattttatcctctagtgttgcggttcccatggcttctcatgcagtgaacaacctgattggagggcttttatggcggtacacatcaaatacaccaaaccagaaactaaatgagtga

SEQ ID NO: 430 - DNA, 852 bp, Glycine Max
atggctacgctctctctcactctcaactgttggagtaccgtggaacttgctcacaccagattttcttctaccttcacctccctcggtcgcaggagtagatatagcatatgttcttttgccaagaagtcattgaagaaatccagaagagatgtaacagaggcagctggagatctcttagatgataagtttgttcagaatgacaacttggacacttctcttaatccagctgccccgaattctaaccctttaccttccaggagtgctgtgcttcaagcttgcataataacttgtggtctcatagctgctttgggaatagtgattcggcaggtgtctcatgttgcgtcagtggaaggattgccagtctttgactgctctacagaagtatcatttggctttgaaatgtggcatcttgagttgattacaggacttgtagtattaatatcatcatgtcgctatttgctattgaagacgtggccagattttgccaagtctagcgaagcagccaatcaacaggtccttagctcacttcagcctttggattatattgttgttgcatttttgcctggtattagtgaggaactacttttccgaggagcgattcttccacttttgggaatgaactggaatagtattgggattgctgccttgatttttggtgttttacacctaggcaacggtcgaaagtattcctttgccatctgggcaacctttgttggtcttgcttatggatatgctacaattttatcctctagtgttgcggttcccatggcttctcatgcagtgaacaacctgattggagggcttttatggcggtacacatcaaatacaccaaaccagaaactaaatgagtga

SEQ ID NO: 431 - DNA, 852 bp, Glycine Max; identical to SEQ ID NO: 430

SEQ ID NO: 432 - DNA, 639 bp, Glycine Max
atggctacgctctctctcactctcaactgttggagtaccgtggaacttgctcacaccagattttcttctaccttcacctccctcggtcgcaggagtagatatagcatatgttcttttgccaagaagtcattgaagaaatccagaagagatgtaacagaggcagctggagatctcttagatgataagtttgttcagaatgacaacttggacacttctcttaatccagctgccccgaattctaaccctttaccttccaggagtgctgtgcttcaagcttgcataataacttgtggtctcatagctgctttgggaatagtgattcggcaggtgtctcatgttgcgtcagtggaaggattgccagtctttgactgctctacagaagtatcatttggctttgaaatgtggcatcttgagttgattacaggacttgtagtattaatatcatcatgtcgctatttgctattgaagacgtggccagattttgccaagtctagcgaagcagccaatcaacaggtccttagctcacttcagcctttggattatattgttgttgcatttttgcctggtattagtgaggttaaaggagactactctcttcttggcttattttgtctttctcatttatttttcatcatttga

SEQ ID NO: 433 - DNA, 990 bp, Glycine Max
atggctactacggctacggcttcggcgtcgtgggaggaactgacgctgaaagtgaaatggatcggcaacgagtacaccgtcagagtctgcgccgacgacaccgtgggcgaactcaagcgccgaatctgcgagctaaccaacgtcttaccccttcggcaaaagctcttgtaccccaaactcggttccaaactcaacgacgactctctcttcctctcccagctccccctcaactcctctctcaagatgaccatgatcggtactacggaagaggacttgctcgtggatcccgtggagtcccctgagatcctcgatgatttggagcttcccaaggacgaagctgttgacatcaaagatatggaagtcaacaagctgaagttgaatagacgcattcatcacttcaagattgagcttcaaaattcctgtcgccaagggaagaaactgcttgttctggatattgattacactctctttgatcaccgctccactgctgagaaccctcttcaactcatgagaccctaccttcacgagtttcttacttcagtttattctgagtatgacattatgatatggtcggcaaccagcatgaagtggattaaagtcaagatggaacaacttggggtgttggacaatcctaactacaaaatcaccgcacttcttgaccacatggcaatgatcacggttcagacttcttctcgtggggtctttgattgcaagcctcttggtttgatctgggctaagttccctgagttctacaatgcttcaaatactatcatgtttgatgaccttagaagaaattttgtgatgaacccacagaatggtttgacaattaaaccattcaggaaggctcatgccaaccgagatagtgatcaggagcttgtgaaacttacccagtacttactagccattgcagagcttgatgacttgagcaacctcgaacataataattgggagttattcacagaggacaacactaaaaggcgtaggcactga

SEQ ID NO: 434 - DNA, 1320 bp, Glycine Max
atggctcaactcaatcacagaaagctactactcttctatgttcttttattcctttctctttctgtttgcttcggtgccagctcgttggaacctcaacatagtagaagaatgttgggtgcccaaaaacaagagcaagagaagcctttgaaaaacaaaaccaccgccaaaaaccaaaccaagccaatcaagcccactaatagtatttcctcaacgaaccacaccaaaaccacaaaatcaccccacaacatttcctccaaaaaccaaaccaagccactcaagcctagctccaccaattcagcttccaccgacactgccctcgccaagaagctcaatagtaagatcaagaagctcaacgtcacatccaaaacctcaccctcaaaacccggtaccagcgtttccatttccagcaacaagaaaacattggatctcgccaaaccaactaacaaaacagcaaaagacaacaagcaacccagaacagcaaaagtagatcaaactcacgacgcaacaacaaacaagaaacaaaagactcccccgaaccaactactacaacaaacgaagaagaaaccagctccgaaacaagcaccaccgagttggatcgtggaggaggatgaggacgaatatgatttggtttcagagttgacagatctacccaacaagttccaccgaacactcctccccgacctggaacgaatctccaccacttccaaagcctacatcaccaaagccaacagcgaaattaccaaaggcttcaaaccctacgttggcaaaaaatacgcacccaccgtcgccaccattatctctagcgccttcatactcatccctctcctcttagtctctctcctctgcacaagaatcaaagcctatttctccctccagaagatcctaatcttcatccaagtctatctctctttctacttcaccattctctgtgtcacttcgttcttcaccggcttcgaacccctcaggtttctatactctacttcgcagtccacgtatctgtgcctgcaggtgctgcagactctcgcttacgtcttctacttgctgctgcttctcatgtacctcgtgctcgtgttctccacggactgtgggctgggctccaagttcttgggcctggcccaggtcttcgtgggctttgccgttgggctgcattactacgtcacggtgttccacagggtggtgctgcagcaaccgcccaagacgaattggaagatccacgcgatttacgccacgtgttttctgctcatctgtgtgcttgctagagctgatagaaggaaaaagaattacgtggaggacggtggaggagaaggcaagaaaaattga

SEQ ID NO: 435 - DNA, 1092 bp, Glycine Max
atggctctcctccacaagctcgcacctttcacctctctctacaccaataccccccattccccaccaccccgccgccacgtcatcatctccttctccgtctcacccttcaccgagaagcactccacagagcgctaccagagggaccaatgggtctaccagagcaccactcaagagggtcaacctcaaacgacgccgtttcctcctctcccgtgcgattcagcgtccttaagagacgacgacatagcgttgcagctgccagagctgaagaagctgcttcaggttctgagggagaagagggagtgtatcaatggagagggttgtgagccggggaatgtgttcttggtgggaacgggacctggggaccctgagcttctcactctcaaggctgtgagagtcatcaagagtgctgatcttttgctctatgacaggttggtgtccaatgatgtgctggatttggttggccccggtgctaggcttctctatgtgggcaagactgctgggtatcatagcagaacacaggaggaaatacatgagcttcttttgagttttgcagaagctggggcaactgttgtgagacttaaagggggtgatccattggtgtttggcaggggtggggaggaaatggattttttgcaacagcaaggtatccaagtgaaagttattccaggtataactgctgcatctggaatagcagcagagcttggaattccattaactcaccgtggcattgcaaatagtgtgagattcctcacagggcattcaaggaaaggaggatccgatcctctctttgtatcggaaaatgctgctgatccggattctaccttggtggtttacatgggcttggcgaccttcccttcacttgcacagaagctaatgcatcatggtctgtcccctcagaccccagctgcagccattgagcgaggaaccacacttcatcagcgcacggtgtttgctgaactaaaggaccttcacgagaaaattacatctgctcagctggtgtcaccaacgctgattattataggaaaagttgttgaactatcaccattttggccaattcctacaaaagaagaatcatgtttaatgcaggcatga

SEQ ID NO: 436 - DNA, 366 bp, Glycine Max
atggctctgggaagaggcagtgcagtggttctactactttgcttcttggtgcttcagtctgagatggctcgtgctgccacttatagagttggagattctaggggttggacctttaacaccgttacctggccccaaggaaaacgctttagggcaggtgacacacttgcgttcaattatagtcctggggctcacaatgtggtggcggtgagcaaggctgggtatgatagctgcaagacaccaagaggagccaaagtgtatcggtcagggaaggatcagatcagacttgctaggggacaaaactacttcatctgcaattacgttggtcactgcgagtctgggatgaaaattgccatcaacgctgcatga

SEQ ID NO: 437 - DNA, 3381 bp, Glycine Max
atggctgaggccagactctacgctcccccctctcaattggatattaagcaaattattttagaagcacagcatcgatggctacgtccggctgaaatttgtgcaattctcggtaattataagaagtttcgaattgctccagaacctgcacatatgccaccaagtggttcacttttcttatttgatcggaaggtgctgagacacttcagaaaggatggccataactggaggaagaaaaaagatggaaaaacagtgagagaagctcatgagagactaaaggctggaagtgtggatgtgttgcattgctactatgcccatggagaagaaaatgaaaattttcaaagacgcacgtattggttgcttgaagataatatccagaaaggaatgaagaaaacctgggctcttcttcttatgtgttttttcttgtttgaggatggtggaactctctcacattgttctcgtccattatcgacaagtgaagtatgcacaattctccttccccctttctcaaattttgactctggaaccaaggcgaattttacaagtgctaaagaaaatgaagaatctcttccttatgctcaacaaactgataaaattatgccccaaacagagatggacacttctttatcatctactcttcatccacatagttaccaggttccttcaaaaactgtcgatacaagcatgaacagtgcccaaacatcagaatatgaagaagctgaatctgcattcaataaccatgcaagttctgagttttattctttcctcgatttaactttgatgcattatgatcaagagaagttacctattattcctggggtgaattatatctcactcactcaagacaataaaaacaaagacattcttaatgctggattgacatatgaatccccaaaaccccttggcttttcctcatgggaaggtatcttagaaaataatgctggaagtcaacatgtgcattttcagcctttatttcctggaacacagcctgataacatgggaatcaatagcaatttttctcaaggagaagagataatggtgccatatttgaccaccagcattgctaagcagcatgagaatggaagtatcattaaagctgaaggaaattggcagtgttgttggtatgatgctgcaaatatttttgacatcttaatgacttgtttcgtgtttctgcaaacatataatcaagcaatggattttgctttatgcaactgtgagcaggaagttaatgatgttgattttcagaaatccttggaacagtgtcttctacattcacacaaacaaaacaaggttctcatgcaaaatgatcttcaagaaaaacttttgaatgaaaaagaaaagataaaatcaaatctagaggcctatggaatagaagacacatatttatcttttaaaaggactctgttagatggacctccagctgaagagggtctgaagaagcttgacagtttcaaccaatggatgagtaaagagcttggagatgtggaagaatcaaataaaccatccacttctggtggttattgggatacagttgaaactgaaaatgaggttggcaacacaactattccttcccaagggcacctggacacctatgtattggatccatctgtttcccatgatcagctttttagcattattgactattccccaagctgggcatttgaagggtcagaaattaaggttatcatttctggagaattcctaagaagtcaacatgaagcagaacaatgtaagtggtcatgcatgtttggtgaggtagaagtgccagcagtgatcattgcaaaaggtgttctttgttgtcatacacctccacacaaggctgggagggtacctttctatgtaacttgttccaataggttagcatgtagtgaagtgagagaatttgatttccaagtccactatactccagaagacactacaggtgagaatagaggaagcacttttgatacttttagtatccgatttggagaacttttgtccctggggcatgcctttcctcagaattcagattcaattagtgtaagtgagaaatctcaactgagaagtaaaatcaattctttattgagggaggatgatgatgattgggacaagctactaaaacttactcaagagaaagatttttctccagaaaatttacgggagcagctgcttcaaaatcttctgaaagataagttacatgcatggctccttcagaaaataactgaagaagggaaaggccctaatgtattagatgagggtggccaaggtgtgcttcattttgcagctgctcttggctatgattgggccctagaacccacaatagttgctggtgtgaatgtgaactttcgtgatgtaaatggatggacttctcttcattgggcagcattttgtggcagggagcgcacagttgctttcctcatctctctcggcgcagcacccggagcactgactgatccatgtccagaacatccttctggtagaacaccagctgacctagcttctgcaaatggacacaaaggaattgcagggtatcttgctgagtcttcactaagtgcacacctcacaactctcgatttgaacagggacgcgggagaaaattccggagcaaaagtagtccaaagactccaaaacattgctcaagttaatgatcttgatggtttatcatatgaactgtcattgaaagattcactggctgcagtgtgtaacgccacccaagccgcagctcgtattcatcaagttttcagaatgcaatcatttcagagaaaacaactgaaggaatatgatgatgacaaacttggattatctgatgagcgtgctctttcactcataaaaatgaatgtaaaatcacacaagtctggaccacgtgacgagcctgtccatgctgctgcaatacgaatccaaaacaaattccgcagttggaagggaagaagagaatttttaatgattcgacaacgcatagtaaaaattcaggctcacgtgagaggtcaccaggtcaggaaaagctgtgggaagataatttggtccgttggaatcttggagaaggttattttacgttggcgtcgaaaaggtagtggcttgcgtggatttaaaccggaggccaattctgagggaactatgatacaagatgtatcttcaacagatgatgactatgatgtcttaaaagaaggcaggaagcaaacagagcaaaggttgcagaaagccctagctagggtgaagtcaatggttcagtatccagaggcaagagaccaataccataggctgttgaatgttgtaactgagatccaagaaaatcaggtaaagcatgagagcagttctaacaattcagaagaaccgagagaattcggtgacctcaatgatcttgaagcattgttggacgaagatattttcatgcctacagcaacttaa

SEQ ID NO: 438 - DNA, 582 bp, Glycine Max
atggctgattattcagcaggaactgaatcccaggaggtggtcgtaaatgtaaccaagaacacctccgaaacaatccaacgctcagactcccttgtctctgttcctttcttgcagaagttggtagctgaggcggtgggaacatatttcctgatatttgcagggtgtgcttcattggtggtgaacgagaactactacaacatgataacatttcctgggatagcaattgtttggggtctggttctgacggtgttggtttacactgtcggtcacatctctggtggccatttcaatcctgctgtcaccattgcttttgcctccaccagaagattccccttgatccaggtaccagcttatgtagtagctcaactcctaggaagcatacttgcaagtggaactctgagactattatttatggggaatcatgaccagttttcaggaacagtcccaaatgggactaacctgcaggcttttgtgtttgaattcataatgacctttttcctcatgttcgtcatatgcggggttgccaccgataacagagcggtaacttggctgggattgcaattgggtcgacattactgctga

SEQ ID NO: 439 - DNA, 816 bp, Glycine Max
atggctgattattcagcaggaactgaatcccaggaggtggtcgtaaatgtaaccaagaacacctccgaaacaatccaacgctcagactcccttgtctctgttcctttcttgcagaagttggtagctgaggcggtgggaacatatttcctgatatttgcagggtgtgcttcattggtggtgaacgagaactactacaacatgataacatttcctgggatagcaattgtttggggtctggttctgacggtgttggtttacactgtcggtcacatctctggtggccatttcaatcctgctgtcaccattgcttttgcctccaccagaagattccccttgatccaggtaccagcttatgtagtagctcaactcctaggaagcatacttgcaagtggaactctgagactattatttatggggaatcatgaccagttttcaggaacagtcccaaatgggactaacctgcaggcttttgtgtttgaattcataatgacctttttcctcatgttcgtcatatgcggggttgccaccgataacagagcggttggtgagttggctgggattgcaattgggtcgacattactgctgaatgtgattattggagggccagtgacaggagcatcaatgaacccagctagaagcctaggacctgcttttgtacacggtgaatacgaaggaatatggatatatttgttggcacctgttgtgggggccatagctggagcatgggtatacaacatcgttaggtacacagacaagccattgagtgagatcaccaagagtgcttctttcctcaaaggccgtgctgcctccaaataa

SEQ ID NO: 440 - DNA, 618 bp, Glycine Max
atggctgattattcagcaggaactgaatcccaggaggtggtcgtaaatgtaaccaagaacacctccgaaacaatccaacgctcagactcccttgtctctgttcctttcttgcagaagttggtagctgaggcggtgggaacatatttcctgatatttgcagggtgtgcttcattggtggtgaacgagaactactacaacatgataacatttcctgggatagcaattgtttggggtctggttctgacggtgttggtttacactgtcggtcacatctctggtggccatttcaatcctgctgtcaccattgcttttgcctccaccagaagattccccttgatccaggttggtgagttggctgggattgcaattgggtcgacattactgctgaatgtgattattggagggccagtgacaggagcatcaatgaacccagctagaagcctaggacctgcttttgtacacggtgaatacgaaggaatatggatatatttgttggcacctgttgtgggggccatagctggagcatgggtatacaacatcgttaggtacacagacaagccattgagtgagatcaccaagagtgcttctttcctcaaaggccgtgctgcctccaaataa

SEQ ID NO: 441 - DNA, 4272 bp, Glycine Max
atggctggaaaatcgggcaaggggaggaacagaaaagggtcccataatgcatccagtgcttcagaatctgcagtccattccgatgttcctgtgaaggataatgtggaagtcactttggaatcagcaaaagctgatgctgctgaagttgcagctggaggcgattctattgttgccaatcccgaggtgaaggagaatgaaacagcaactgaagggagccaacaaaagcaaggtgatcttcaactttaccctgtttctgttaaaacacaaactggggagaagcttgagcttcagttgaatcctggagactctgtcatggatgttagacagttcctcctcgatgctcctgagacatgttttattacatgctatgatttacttttgcatacaaaggatggatccactcatcaccttgaagattataatgaaatttctgaagtagctgatattactactggtggctgctccttggaaatggtttctgcattttatgaggatcgatctataagggcccatgttcatcgtacaagggagttgctttccctttctaacctccatgcttcactatcaacatcacttgccctacagaatgagatagcacataataaatctgcaaattcaggagataccttgaaacctgaagttcctgagcttgatgggcttggttatatggaggacatcgctggctcattgggtaatttattatcgtccccattgaaggatattaaatgtgttgagagcatagtgttttcatccttcaatcctcctccaagctatagaaggcttgttggagatttaatttatttggatgtgatcactcttgagggtaacaaattttgtattacggggagtacaaaaatgttttatgtcaactcaagctcagcgaacaatcttgacccaaagccaagtaaagctacttttgaagcaacaactcttgttgctctcttacaaaagattagccccaagttcaaaaaagctttccgtgaagtattggagggtagatcagctgcccatccttttgaaaatgtgcaatctttgttgccacctaattcttggcttggattataccctgttcctgaccacagacgcgatgcagccagggctgagaatgctttgacacttctttatggcaatgaaccaattggcatgcaaagagactggaatgaagagctgcagtcttgtagagaatttcctcatacctctccacaggagaggattttgcgggatcgggcactttataaagtgacgtcagactttgttgatgcagctattaatggcgctattggagtgattagtggttgcattcctccaataaacccaactgaccctgaatgctttcacatgtatgtgcacaacaatatattctttagttttgctattgatgctgaccttgagaagctgtcaaagaagcgtgtggatgctaattcaaaaacttggagctcaggcaattcgcaaaaagatcttaatggcacagaaattactcaagatgtttctccagaagctcagctggccgagaatgagcaagccacatatgcttctgcaaacaatgatttgaagggcacaaaggcttaccaagaagctgatgttcctggactttataatcttgctatggctataattgactacaggggtcatagagtggtagctcagagtgtcttaccaggcattcttcaaggggacaagtcagactccctcttgtacggctctgttgacaacggaaagaaaatttgctggaatgaagactttcattctaaggtgtcagaggctgccaaacgccttcatttgaaggaacatttagtccttgatggatctggaaatcttttcaaattagctgcaccagtggaatgcaagggcattgttggtggtgatgaccgacattatcttcttgatttgttgagggtaactcctcgtgatgccaactatactggacctggttctcgattttgtatcttgaggtcagaattaatcagtgcctattgccggaattttttttggaaggcaaaaatatgtatattattaataaacagaacagtaccaaaggtactgaagataacagatactagacacaaaagtgccaccttccaaaaaacaaacaaaacccaacaaaaacccaccacaaggacaccaatacatttaaccatgcttgcttctgtgactaccaaagcctctgatggttgcgaggatattgtttttaatcccaatgttttcactgaattcaaacttgctgggagtccagaggaaatagcagctgatgaagataatgttagaaaagttagtcaatatcttactgatgtggtacttccaaagtttatacaagacttgtgtacacttgaagtttcaccaatggatggccagacattaactgaagcattgcatgctcatggaattaatgttcgctatattggcaaagtggctggagggactaaacatctacctcatctgtgggatctttgtaataatgaaattgttgtcagatctgctaagcatattatcaaggacttattgagagagacagaggaccacgatcttgcaccagcactatctcatttcttaaattgcctatttggaagctgtcaagctcccggtggaaaagttcctgctaatttcacgcagtccaaaactcctagaaaggcatggcaacggtctccaggaaaacattccaaagggcaggctcggtggaaaggcagggcatctttaagaaagactcaacctttgtatgcgagtatcagctcggaagttctttggtcagacattcaagaatttgcaatggttaaatataagtttgaattacctgatgatgctaggtctcatgccaagaaaatttctgttatacgtaatctctgtctgaaggttggtgtaactgttgcagctcgtaaatatgatcttagttccgcaactccattccaaacatcagatgtcttggatatccgtccggtggtcaagcattcagttccttcctgttcagaagccaaggaacttgtggaaactggaaaacttcaattggctgaggcactaaccacatacaatggaaagggattgaatacaattcacattttgggtgaagtaagctacaatgttattgtgaagcctacactttattctcagaggcattctcgattctacaacaggcatgaaattctgattttgttgttactggtccgatgcatcgggaggttgctaattgctgtcggtatgtatcttgccatggttttgtatcatgctggagatatggctggggctattatgcaacaacacaaggaactaattataaatgaacgttgtcttggtctagatcatcctgatactgctcacagttatggaaatatggctctgttctaccacgggcttaaccagacagaacttgcacttcgccatatgtcccgtgctttgctattattaagtttttcatcggggccagatcatcctgatgttgcagcaacatttatcaatgttgcaatgatgtatcaggatataggaaagatgaacacagctcttcgttatctacaagaagctttaaagaagaatgaaaggcttcttggagaggaacatattcaaactgctgtttgttatcatgctcttgctattgcatttaattgtatgggtgctttcaagctctctcaccagcatgagaagaaaacatatgatatactggtcaaacaacttggtgaagatgattcaaggacacgggattcgcagaattggatgaacacatttaagatgcgtgagctacagatgaatgctcaaaaacaaaagggtcaagctctgaatgctgcttcagctcagaaggctattgatatcttgaaggctcaccctgatttgatacatgcattccaagctgccgcagttgctgggggatctggaagttcaggtgcatctgctaacaaatctctcaatgctgcagtaatgggtgaggcactgcccagaggaaggggaattgatgaaagggctgcacgtgcagctgctgaagtcaggagaaaggctgcagcaaggggcctgatgatacgtccccatggtgtaccagtccaagccttgcctccccttacccaacttctgaatattataaatccaggtgtgacttcagatgctgtggacaatggaaatgcagatcgagtaaagaaggaagcaaatgacattcctccaagtgatctaattgataccaagaaaggccaaacaactcctgtgcaacaacaggaacaagctccggttggtttgggcaagggcttgtcatcattggatgcaaagaaacaaaaatcgaaaccaaagactggtgcttga

SEQ ID NO: 442 - DNA, 1323 bp, Glycine Max
atggctgtgcatggatccaaaaggtgggctgtgaaatgggttgctgaaaaggttctggttgcttttcttcttgtttcagtctatgttgcttcttctcagcaaaatacagaccagaaaacaatctcatcagcatccaatgagacgaaaggggttgatactaaagctcatcatgctgaggtaataagaatttctagggccaagcatgagatgaaatttgggtggaaaataatagtgggcagcataattggattcctaggatcagcatttgggactgtgggaggtgttggtgggggtggcatctttgtgcccatgcttacccttattatcggattcgatgcaagatcagcaacagcaatatcaaaatgcatgattacgggtggagcaggagcaactattttctacaatctgaagcagaggcacccaactcttgacatgcctgtgattgactatgatctagcacttctttttcaaccaatgttgatgcttggaatcagtataggagttgctttcaatgtgatttttcctgactggatgctaacagctttgttaatagtagttttcataggcctttcattcaatgcattctttaagggtgtcaaaacctggaaaaaagaaaccattgttaacaaggtttctgttattgaaaacatttattggaaggaacttggaattcttgtatctgtgtggatcttgatacttgcactacagataggaaaaaattacaccacaaattgctcagcattatattgggcattgaatctactacaggtccctatcactgtaggaacaactgtatacgaggctgtgcttctatacaaagggaagagaaagatagcatcaaagggagatcaacaaacacgttggcgtgtacatcaattgattctatattgcacgtgtggcataattgctggcataattggtggcttgcttggccttggtggaggattcatcttggggccacttttcattggactaggaattcaccctcaggtgtcaagtgctacatccacttttgcgatgacattttctgcatctatgtccgttgtggaatattatcttctcaagcgtttccctattccttatgcactttactttgtagctgtagccactgctgctgcactggttgggcagcatttggtgagaaaggttattgctatactggggagaacgtctctgatcattttcatcctcgcactcacagtttttgtgagtggaatatcactaggcaattgtagtgagagtggagtaggcatagcaaaactgattgaaaagaaggtgcagatgaagtttgaaaacctttgctcgtacagggttagaaattaa

SEQ ID NO: 443 - DNA, 384 bp, Glycine Max
atggcttcacttaattcatatcattactacacaaacacctccttgctcatcatacttcttctccataatttgttctctctatctctagcttctgcctccaatcaccctcagcctgcaatttctacaagggaactgttatttgaggagaaaaacaggctaggttcaattcctcctagctgtcataacaagtgcaatgattgccatccatgcatggcagttcaagtgccaactttgccaagccatgactctaaccctccagatcttaccaaaactgcagccatggcaacttttcttaacccttcttctccgcaaggcaacaggtactccaattacaagccattgggatggaaatgccattgtggtgaccacttcttcaacccgtaa

SEQ ID NO: 444 - DNA, 2274 bp, Glycine Max
atggcttcctcttcttctttactcctactcgagttcaaatttcttgcaccgcaaattacccccaaacggcgccgttctctatctagtttttgctctcgccattccgtttctctgaactccaggtacaatgttgctctccgtacgcgaatccgcgccgtcatggaagaaggtgccgtcattgacagagtgaacgacgtcaaatggagtggaaacggagttgccgccagcgaatacggtggtaacggctccgttaacggttacgtgaacggcgtctcgggagttatggagagtgaggatgcgaacggaagattggtaaagtacgtgaacggcaatggtgtagcggcagaagtggtggaagattttgcggaatctttgaagcggaaggaagatggaagaaagaagaggttggaggagattggtaaagaggatgcctggttcaaaaaacaaactggggaagcaccaattgaggtggcggttgcgcctggtggtcgctggagcaggttcaagacttactcgatgatccagaggacgttggagatttggggatttgttataacatttatcttcaagtcttggctgaataatcgcaagttctcttataaaggaggaatgacagaggaaaagaaaatcttaaggcgaaaggcccttgccaagtggctgaaggagagcattctgagattaggtcctacatttatcaaagttggccagcaattctccacaagagtggacattcttccacaagaatatgttgatcagttgtctgaacttcaggatcaagttcctccatttccctcagagactgctgtagctattgttgaagaagaacttggaagtcctttagctagcgtctttgatcattttgagtatgaaccaatagctgctgcaagtcttggtcaggttcatcgtgcaagattaaggggacaggaggttgttgttaaagtgcaaaggcctggtctcaaagctctttttgacattgatcttaaaaacctgagggttattgctgaatatcttcaaaaaattgatcccaaatcagatggtgcaaagagggattgggttgctatttatgatgagtgtgcctctgttttatatcaggagattgattacaccaaggaagctgctaatgcagaactatttgcaagtaactttgaaaacttggattatgtgaaagtccctacaatcatctgggattataccacaccacagattctgacaatggagtatgttcctgggattaaaataaataaaatacaagctttagatcgactgggtcttgaccgcaaaaggttagggcgatatgcagttgagtcttacttggagcagattttatcacatggtttcttccatgctgaccctcatcctggaaatattgcagttgatgatgtcaatggtggaagattgatcttttatgattttggaatgatgggaagtatcagtcaaaatatccgagaaggtttacttgaagctttttatggaatttatgagaagaatccagataaggtccttcaatcaatgattcaaatgggtgttcttgtcccaactggagatatgactgctgttaaacgaacagcacagttcttcctcaacagttttgaagagcgtttggctgcacaaaggagagagagagagatggaaacagctgaacttggattcaaacagccattaagcaaagaggaacaagtaatgaagaagaaagaacgtctggctgctattggtgaggatttattagccattgcagcagaccagccctttcggtttcctgctacattcacatttgttgttagagccttctcagtattggatggcattggaaagggccttgatcctcgttttgatattactgagattgccaaaccttatgctctggagttgctaagattccgtgaggcaggagttgaagttatcctaaaggacttgagaaagagatgggacagacaatctcaagcattttacaatttatttagacaggctgatagggttgaaaagcttgctgaaatcattgaaagattggagcaaggtgatttaaagctccgagtacgaactttggaatctgagagggcattccagcgtattgccactgtccagcggacaataggaaatgcaatagctgctgggagcctaataaatcttgcaacaattctgtttcttaactcgattagggtgcctgccactatagcatatgtcttctgtgcaatctttggttttcaagttctctttggcattgtgaagatcaaaaagctagatgaacgggaaaggttgattacagggactgcataa

SEQ ID NO: 445 - DNA, 2148 bp, Glycine Max
atggcttcggctgctatcttctcgtcgctacggcggcgccggtcgccgtcgctggaggcgtttctggcgccggtcgacctctccgacgtggcgttgctggggactctcatctccgtcgccggcgacatcgcgtcctgcttctccggccaccggttccccttccagcgccggaactcgcgtgccctcatcggaaaagttgagattttccggtcaatgttagggtgtctgagagactccgccaccgccggagctcttcccccgacggcggtgctgtgcttaaaggagctctatctgcttctatatcggtcaaagattcttcttgattactgtgcccaatcgagcaagttgtggcttctgcttcagaatcattgtgtttctggtcacttccacgatttgagccaagaattttcgacccttttggatgtttttcccgttggggaagttggcctcagtgatgatgttagggaacagattgagttgttgcagagacagtccaagagggctaagttgttcatagataataaagatgatgttcttaggataaggttattttggtttcttgatgagtttgagagtgggagggttcctgattctaaggacttgagatgtttctttgtggataaattgaggattcttgatggtaagagttgtagggtggaggttgaagccttggaggagcagattgtgaaccatgagggtgatgttgagcctacagttgctgtgcttaatgggatggtggctatcacaaggtattgcaggtttttgttgtttgggtttgaggaagaattggaaattgagattcaaaagaagggggggaagaggttgattacactggaaattgctgaaacgtttttgactgttcctaaggagttctgttgtcctatatcattggatttgatgtgtgatcctgtgataatttcaacaggtcaaacttatgataggaggtctatatggaggtggatggaggaagggcattgtacttgtccaaaaacggggctattggtttctcataataggcttgttcctaatcgtgctcttaggaatttgattatgcagtggtgcagtgcacatggagtaccctatgatccacctgagggggttgatgcatctgttgagatgtttttatcagcttgtccctccaaagcttccctggaagctaaccaagggacggccacgcttctcattcagcagcttgcggatgggtcacatgctgcaaagactgtggctgctagggagataagattgctggccaaaactggaaaggaaaaccgtgccttcattgcgcaagctggggccattcctcatcttaggaacttactttcctctcctagtgctgttgcacaggagaattctgtgactgcactgctcaacctatccatttttgaaagaaataaaagcatgatcatggaggaggaagggtgtttgggatcaatagttgaggtgttgcgattcgggcacaccacagaggcaagggagaatgctgcggcaacattgttcagcctctctgctgtccatgattataagaaacgaattgcggataatgtgggagctgttgaagcattggcttggttgttgcaaaagggtactcaaagaggaaagaaggatgctgtcacagcattgtttaatctctccactcacactgagaattgtttgagaatgatagaggcaggggccgtgaaagctatggttgtggctttggggaatgaagtagttgctgaggaagcagctggtgccttggtcttgattgttcggcagccagttggtgccatggcggtggtgagggaggaagcagcgataaccggattgataggaatgatgcgttgtggaacgccgagaggtaaagagaatgcagttgcagcattgttggagctgtgcaggagtggaggtgcggctgctactcaaagagtggttagggtgccggctctggccggattgcttcaaaccttgctctttacaggtacaaagagggcaagaagaaaggcagcctcacttgctagagtgtttcagagacgtgaaaatgcatctctacattatgctggattaggtgtaggttatgcatttgctagcgattcagcttcaaccaggaatactgcaacctttgtgagtgatgtttcacttccaatgtccatttctgtttctgttttatag

SEQ ID NO: 446 - DNA, 2007 bp, Glycine Max
atggcttcgtacaccccaaagaatatcctcattactggggcggctggatttattgcgtctcatgttgccaaccggcttgtccggagctaccctgactacaaaattgttgtgcttgacaaacttgattattgttctagtctgaagaacctccttccttcaaaatcatctcctaacttcaaatttgtgaagggggatattggtagtgctgatcttgtcaactaccttctcatcaccgaatccattgacactataatgcatttcgctgcccaaacccatgttgacaactcgtttggtaatagctttgagttcaccaagaacaacatatacggaactcatgtcctattagaagcctgcaaggttactggccagatcagaaggttcattcatgtgagcactgatgaggtctatggagagacggaagaggatgctgttgttggaaaccatgaggcctctcaacttcttcccactaacccgtactctgctacaaaagctggggctgaaatgcttgtcatggcttatggtaggtcatatgggctacctgttattacaactcgtggaaacaatgtttatgggcccaatcagtttcctgagaagttaattccaaagttcatcctcctggctatgcagggaaagaatcttccaattcatggggatggttcaaatgtgaggagttatttatattgtgaagatgttgctgaggcttttgaagttgtcctgcacaagggtgaggttggccatgtttacaatatcgggacaaagaaggaaaggagagttgtcgatgtagccaaagatatatgcagacttttctcaatggacccagaaacttgtataaaatttgtagagaacagaccatttaacgaccagagatactttcttgatgatcaaaagctgaaggacttgggttggtctgagaggaccacttgggaagaaggcttgaagaaaaccatggattggtatatcaataaccctgattggtggggtgatgttactggggcattgcttcctcatcctaggatgctgatgatgcctggtgggttggagaggcatttcgagggatctgaagagggaaaacctgcatcttttggctcaagtaataccaggatagtggttccatcatccaagaacaccagctctcaacagaaacatccttttatgttcttgatctatggtagaacagggtggattgggggtttgctggggaaattgtgtgaaaagcaaggaattccgtatgaatatggaaagggtcgcctagaggaccgctcctcactcttggctgatcttcagaatgtgaagcctacacatgtttttaatgctgcaggagtgaccggcagacccaatgttgattggtgtgaatcccataaaacagaaaccatccgcaccaatgttgctggtaccttaacaatggctgatgtctgcagagagcatgggatcttgatgataaattatgctactgggtgcatattcgagtacaatgcaacacatcccgagggctctggcattggttttaaggaggaagacaagcccaatttcattggctctttctattccaaaactaaagctatggttgaggagctcttgagagactatgacaatgtatgcacactcagggttcgcatgccaatttcgtcagacctgagcaacccgcgcaacttcataacaaagatttctcgttataacaaagtggtcaacattccaaacagtatgactattttggatgaacttctgcctatctcaattgagatggcaaagaggaacttgaagggaatctggaacttcacaaatccaggggttgtgagccacaatgagatccttgagatgtacagggattacattgacccaaacttcaagtggtctaacttcacccttgaagagcaagcaaaggtgattgttgctcctcgaagcaacaatgagatggacgcatcaaaattgaagacagaattcccagaattgctttccatcaaggaatcactcatcaaatatgtctttgagccaaacaagaaaacataa

SEQ ID NO: 447 - DNA, 465 bp, Glycine Max
atggctttctctgcaatcactaccttgccctctcctcaatttctccgccttcctcaatcttcaccctctcttcgattttcaccgccaattctcaaacgccccaaacccctctccattcgatcagtttcaatccccgctgcaccagcatctggttctctggcccctgcagtttcacttacggataatgcgctgaagcacttgaataagatgaggtctgaacgaaatcaagatttatgtttaagaataggtgtcaaacagggagggtgctctggtatgtcatacacaatggattttgaagacagggctaataaaaggccagatgattcaattattgagtatgaaggttttgaaattggtatgattcatattctgttttttatcattgacatttttaatgcacaagctttagctacatcccttcattttatgcaattttacaggttgatttgtcaagattgccaatga

SEQ ID NO: 448 - DNA, 498 bp, Glycine Max
atggctttctctgcaatcactaccttgccctctcctcaatttctccgccttcctcaatcttcaccctctcttcgattttcaccgccaattctcaaacgccccaaacccctctccattcgatcagtttcaatccccgctgcaccagcatctggttctctggcccctgcagtttcacttacggataatgcgctgaagcacttgaataagatgaggtctgaacgaaatcaagatttatgtttaagaataggtgtcaaacagggagggtgctctggtatgtcatacacaatggattttgaagacagggctaataaaaggccagatgattcaattattgagtatgaaggttttgaaattgtttgtgatcctaagagcctactcttcatatttggcatgcaattagattacagtgatgctctgattgggggaggcttctctttcaagaatcctaacgcgacacagacttgtggatgtggtaaatcctttgccgctgaaatgtag

SEQ ID NO: 449 - DNA, 732 bp, Glycine Max
atggcttttccaaaccaatccatgtcatcagagtctccccagagaaagatgggaagagggaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaaccgtggccgcctctatgaatatgctaataacagcgtcaaagcttcaattgagaggtacaagaaagcaagttcagattcatctagtggtggacgatctgcttctgaggctaatgctcagttttatcagcaagaagcagccaaactgcgtgtgcagatcagcaatctgcagaatcacaataggcaaatgatgggtgagggtttgagcaccatgaatggcaaggatctcaaaaacctagagactaaattagaaaaaggaatcagcagaattcgttccaagaagaatgagatgctatttgcagaaattgagcacatgaagaaaagggagatatacttgcacaatgacaaccagcttcttagagcaaagataggagaaggtgagaggagtcaccataatgttaacgggttgtctggaaccacaagctatgaatcgatgcaatctcagtttgactctcgcggcttcttccaagtgactggattacaacctaataataataatcagtatgccgggcaagacatgtcccttcaatttgtttga

SEQ ID NO: 450 - DNA, 555 bp, Glycine Max
atgggaaagatgtgcaagaataagaaacaagctggtgggcatggacctccaagagagcaaactgatacacaggaacaagaaatggacataaggaagattatgaaagatgttgaaaattttagctactcacatatgtcatggaaagaacgcaaaaagattgaaaataggaatgttgtttctcttggtgggaagccccaaaagaatcagagattacctttaagtgtggctcgactaatgatgaagaaacaaaaggagagggagcagaaaatgctccaagagcgtttgattcttggacaatttgggggaaagcttggtggtagcagtaaaagatctgctgggaagcacaagccaggaaacaggggtctgaaatcaagcgaaggtcattttagaaatggcatactcaatgtgaagcatttgttaaattcaacagcatcaagagatcgtgaaactggaaccaatatgtccaatacatggaaagggaaaggtggtaagaagaaaaatggcaacaagggtgctggtggtaagaagcaccgttcagcgcatccttgtgaataa

SEQ ID NO: 451 - DNA, 555 bp, Glycine Max; identical to SEQ ID NO: 450

SEQ ID NO: 452 - DNA, 939 bp, Glycine Max
atgggaactgctatagacatgtacaacagcagcaacatcgtagcggatttcctagatccgtatagtgaagagctgatgaaagcacttaagccttttatgaaaagtgattatttctctgcctcttcttcttcttcactcgaatcacagccttgttctttttcatctaattctctccccacttcgtatccctcttccaaccaaatcaagctcaaccaactcaccccagaccaaattgttcagattcaggcccaaatccacattcagcagcagcagcagcacgtggcccaaacccaaacccacctgggcccaaaacgcgtccccatgaagcacgctggcacggccgcgaaacccacgaagctctaccgcggggtgcggcaacggcattggggcaagtgggtcgctgaaatcagactcccaaagaaccgcacgcgcctctggctaggaacattcgacaccgcagaggaagcagcattagcgtacgacaacgcagcgtttaagctcagaggcgagttcgcgcgtctcaattttcctcatctaagacaccacggagccttcgttttcggcgagttcggagattacaagcctctaccttcttccgtggattccaaactgcaagctatttgcgaaagcttagcgaaacaagaggaaaagccgtgttgctccgtcgaagacgtgaagcccgtgatacacgctgctgagctggcagaggtcgagtctgacgtggcaaaatcgaacgctgaatatgtttatcccgagttcgaggattttaaggtcgagcacgagaacccaatgttttctggtgaatcttcttcgcctgaatccagtgttactttcttggatttctcggacttctcggattctaataatcagtgggatgaaatggagaattttgggttggagaagttcccttctgtggagattgattgggaagctatatga

SEQ ID NO: 453 - DNA, 903 bp, Glycine Max
atgggaagcaacgataatttcggcgacgggattttcaaaacccgtccccatctggcggacgtcacgaatctcccggccaaaaggtcgttttctttggtttccggcgacggtggggacttgcagttcaccaagaaaattcgcttaggggtggaaaatttagcaaaagggaaaagccaaatgcaattcggagcacatgcctaccttaacaacgaggtcctgttgcaaccaaaagaaaaacacaccattttgttaccgttttcggatgatactttgcactcgtttcaaaatcccagtttgaccgtggagggaatggaggagcagaatccgttggatttggagaattttaaatttgggaaggaaggggacggaattgttgccactgatcgtgcggttgaaagtggtggcaaagatatttgtgacgttgagaatttgggatctcccaagtgtggggcagagcaaatgccaacaatttctgtttctaatgattctaattttctgggattgaaaccgtgctcaagttctgttactgaagctgcggacctcaaatcttgcacttgttccttttgctccaaagctggttatatctggtcggatctccattaccaggatgccaaaggtagattaagtgctataaagaagagtcagaaagaagcaaaaatgatcattcagaagttttctggattagagaatacagtcatgcatgaccagcaccgaagtgaggaatcattgaagttagaattgtcccttgtgcatcagtggaagtctctctttcttcaaatgcagaatatgtatactcaagaaagtagccaacttgaaacaagctttgagacacttaaaaatttgagagagaactgcaaaaccgatcttgagttgaatgacaatagccatcatcaaaatcaatag

SEQ ID NO: 454 - DNA, 687 bp, Glycine Max
atgggaagcgaagatgtgaagctgttgaacttttgggtgagtccatttggtaaaagggttgagtgggctttgaaactaaagggtgtggagtacgagtacattgaagaagatatctttaacaagagcaatctccttctggagttgaatccggttcacaagaaggttccggttcttgttcatgcccagaaacccatcgctgagtcattcatcatccttgaatacattgatgaaacatggaagaagtatccattgttacctcacaatccttatcaaagagcacttgctcgattttgggcaacctgtgttgaacaaaagcttgggaaggctggatgggtagcaatgtctaccagcggcgatgaacaagaagaggctatgaaagaagccaaagaaatgatggagaaaatagaagaagagattaagggaaagaatttttttggaggagacaatattgggtaccttgatattgcaattggatggattgcttacttggttcctgtttgggaggaagttggatcaatgcagataatagacccattgaaatttccagccacctttgcatggatgaccaattttctcagccaccctgtgatcaaggacagcttgcccccaagagataagatgcttgtttactaccacaatcgcaagaacaacttgccttccgtctttcgtaacttggtcaaggattag

SEQ ID NO: 455 - DNA, 678 bp, Glycine Max
atgggaagcgaagatgtgaagctgttgaacttttgggtgagtccatttggtaaaagggttgagtgggctttgaaactaaagggtgtggagtacgagtacattgaagaagatatctttaacaagagcaatctccttctggagttgaatccggttcacaagaaggttccggttcttgttcatgcccagaaacccatcgctgagtcattcatcatccttgaatacattgatgaaacatggaagaagtatccattgttacctcacaatccttatcaaagagcacttgctcgattttgggcaacctgtgttgaacaaaaggctggatgggtagcaatgtctaccagcggcgatgaacaagaagaggctatgaaagaagccaaagaaatgatggagaaaatagaagaagagattaagggaaagaatttttttggaggagacaatattgggtaccttgatattgcaattggatggattgcttacttggttcctgtttgggaggaagttggatcaatgcagataatagacccattgaaatttccagccacctttgcatggatgaccaattttctcagccaccctgtgatcaaggacagcttgcccccaagagataagatgcttgtttactaccacaatcgcaagaacaacttgccttccgtctttcgtaacttggtcaaggattag

SEQ ID NO: 456 - DNA, 687 bp, Glycine Max
atgggaagcgaggaagtgaagctgttgagcttttttgcgagtccatttgggaaaagggttgaatgggccttgaaactgaagggtgtagagtatgagtacatagaacaagatatcttcaagaagagcaatctccttctggagttgaacccggttcacaagaaggtcccggttcttgtccatgcccagaaacccatcgctgagtcatttgtcatcgttgaatacgtagatgaaacatggaagcagtgtccactcttgcctcaagatccctatcaaagggcacttgctcgattttgggcttattcggcggagcaaaagcttatagatgcagcatggattgctatgtgtaccagcggggatgaccaacaaaacgctgtgaaagtaggcagagaactaatggagaaaatagaagaagagattaaggggaagaaattttttggaggggacaatattgggtaccttgacattgcactaggatggatctcttactggattcctgtttgggaggaagttggatcgatgctgataatagaaccattgaaatttccagccatcactgcatggatgaccaattttctcagccaccctgtgatcaaggacaacttgcccccaagagacaagatgcttgtttactacagcagtcgcagaaaggcactttcttcaacttctctgggctggttcaaggtttaa

SEQ ID NO: 457 - DNA, 1831 bp, Glycine Max
atgggaattcaggggtttttgccgctattgaaatcgattatggttccagtccacatcaaggatttgaagggttgttctgtagcggtagacacctactcttggctccacaaaggtgccctctcttgcagcacggaactctgcaaagggatgcccactaccaggcacattgagtattgcatgcacagagtaaatttgctgcgccattttggggttaagcctattctagtgtttgatggagggcttctgccgatgaagagtgaacaagagaacaagcgtgccagggctagaaaggataatcttgcacgtgcagttgaacatgagtcagatggaaattcagctgctgcttatgagtgctaccagaaagcagttgatatctcacctcaaattgcatgtgagctaattcaggtcttgaagcaggagaacttgcagtatattgttgctccttacgaggcagatgcccagatgacattcttggcaattagtggacaagttgatgcagttataactgaagattctgatcttataccatttggttgcccaagaattatctttaaaatggacaagtttggtcaaggtgttcagtttcagtattccatgctacaaaagaataaggagcttagttttgaagggttcaacagacaaatgcttcttgaaatgtgtattttgagtggctgtgactatctgcagtccttgccaggtatgggtctcaaaagggcccatgcaagcattaaaaaatttagaagttatgacaaggttcttaagcacttgagatacagtggagtttccgtgcctcccttttatgaagagtcattcaagaaggctatatttactttccaatatcaacgggtttacgatccaattaatgaaaatattgtccatttgtctaatatacctgatgatattggtgatgagttagactttttaggcccatatccttcatttttaatctataccttaacctgggatacacccatgccaaaagatatagcacaaagaatagcaaaaggggatcttgatccaattaccaaaatgccatttgagggagagaatcttacagccagattagcaattgcaggaactagtcaattcaagactcaccattctgaaagtgcaaagaaaaagattgatttgcccgtgcagaagaatctcttgactaagtatttttgttttgcttctcttgaagcgaaaaggaaattcagagctcctcgggtgtcacctagtgctgctaatgaaacaaagaattctactgcatcagtaattgactctgaggattggggcagtgtccctcctcctaatagccatatattttttaacatattcttcctttctttctttaggttgaatatggttctgccacaaacatttctgaatttacagagtctccatgtcacagagaagaaaagccctgaacatacagtactgcgacagcccaggcagccaattcataaaccatgcctggggttgcataaggatcatgagcacacaaatgtcgaagacacagttgaaggaaaaaccagggaggcaacacaaaaggtaattgtaaggagtgcttattttcagcacaagcaagtggaaaagaatgtttatgatgagaaacaagattgcctatcctctggcgttgtcattgataagagaaaaaatgccttatctgataagaataatgctgaagaagaaaattttgggacaaaaatttcccatctgggccagtattcagaaatagctgagaagtctatggaaagatttgtctccgttatgtcatcctttagatgcacttctggcactcgagtcagtggtctccgtgctcctctgaaagatgttcgaaacacttctg

SEQ ID NO: 458 - DNA, 867 bp, Glycine Max
atgggagatgaaaagccatttgacttcctacgcactttatttgagggcgttattgcaggtggtacagctggagttgttgttgaaacagctttatacccaattgacacaataaaaacacgtctgcaggctgctcgcggaggagaaaaactaatattgaagggcctttattctggattggcggggaaccttgttggtgtcttaccggcatctgctttatttgttggagtttatgaacctataaagcagaaattgctgaggatatttcctgaacacctaagtgcttttactcatttgactgcaggtgccatagggggcattgctgcttcattgattcgtgttccaacagaggttatcaagcaacgaatgcaaactgggcagtttgcttcagcttctggtgctgttcgctttattgcttctaaggaaggcttcaaaggattttatgctggatatggatcttttttgttgagggatttaccctttgatgctattcagttttgcatctatgagcagattcgaataggttatatgcttgcggcacaaagaaatctgaatgatccagaaaatgcaattattggtgcttttgcaggtgcactaactggagctataactaccccccttgatgtcatcaagacaaggttaatggttcaaggatctgcaaaccaatataagggaatcgttgactgtgttcaaaccattattaaggaagaaggacctcgtgcctttttgaagggtattggtcccagagtactatggataggcataggtggttcaatattctttggtgtccttgagagtacaaagcgttttctttctgagagacgccctaccgtacctcagaacacatattcagagaagagcaaagattaa

SEQ ID NO: 459 - DNA, 1233 bp, Glycine Max
atgggaggatgtgcaacgaagccgaaggtctccaaggacgatcccgatggaatgcccaaggcaccccaaccagaaccccaacctgaactccaacccaacaaggacacccttaaaaccaaagcacccgccgcccaagtggaacaagctgctgctgctcacaacaacaaccttaatgtcaacgaaattgttgacgacgaccaagccaacaaacgacgctctctcagcttcttgttcaaggagaatgaagataaaaagggttccacagaaaatgagaaaaatacagttgaggaatctgtgaaagaagaagtgttagaggtcaagaaacctgcggaagatgctaaaagcaatgagccaatagttaagcaagaatctccaaggccagatgagaagctgtctgaggagagtagaaacaatgaatcatcaaagcaagaaaacgagactttgaagacagaaacatcacatgctgaggaaactcatgtcaatgaaccagctaaggaaacagtgaaactagagccagaggctcagaaaccttcagaggaaactcttgccattgaaccagctaaggaaacattgataatagagtcagaaactaagaaaccttcagaggaaactcttatcgttgaaccagctaaggaaacggtgatagtagagtcagaagctaggaaaccttcagaggaaactcttatcaatgaaccagccaaggaaacagtgatagtagagtcagaagctaggaaaccttcagaggaaactcttatcaatgaaccagctaaggaaacagtgatagtagagtcagaagctcagaaacctttagaggaaactcatatcaatgaaccagctaagaaaacagtgaaaccagattcagaagctgagaaaccttcagaggtaaacaatgaaagcagcaagccactgaacgaagaatttgtacaggccatggagatactttcagaggaaacacaaagcaatggactcatcaaactcaaagaagtgcctattgaaccatcagaagaaggtaagccaagtggggaatcagagaggaatgcttcagaaactgaaaaacctgaaacttccattgtgactgaggtggttcctatgcctgaggagagaagaaggttgttgatgctggaactgagattcactaagacctcaaatctgaatgagaaccatcaacaatttgaaacattgcagagtttcagattgttcttcggacctcaatcttttgtgcaaaacaagtag

SEQ ID NO: 460 - DNA, 363 bp, Glycine Max
atgggagtcttcacctttgtcgtccgcaaatccggcagcgaatggagcgccaagcaacattccggcgacatcgaggcctccgccgattccaccttcgatctccaacggaagctcgtgcaagccgctctcgccgttgattcctccggtggagttcagtcctctttctctcccgtgtctcctacctccgctgtgttccaggtgatagtgggtggtgcagtattcgttggaggtggtggtggtgctgttgcagctgcacctgcaggtggtgctgccgcagctgatgctgccccagctgctgagaaaaaggaagaaaaggtggaggaagagtccgatgatgatatgggattgggactgtttgattag

SEQ ID NO: 461 - DNA, 462 bp, Glycine Max
atgggagttggaggcacactggagtacttgtctgatctaatgggcagtggccaccaccaccacaagaagaagaagaagcagttccaaaccgtggagctaaaggtgagaatggattgtgatggttgtgagcttaaggtcaagaacgctctctcctcactaagtggggtgaaatctgtggagataaaccgaaaacagcagaaagtgacagtaactgggtatgttgaaccaaacaaggtgctgaagaaggcgaaatcaacagggaagaaggctgagatttggccctatgtgccttacaacttggtggctcatccatatgcagttccttcttatgacaagaaggctcctcctggttatgtgaggagagtggaggcccctgctcacactggaatcatcacaagatatgaagacccttacatcaccatgttcagtgatgataacccaaatgcatgctctatcatgtag

SEQ ID NO: 462 - DNA, 462 bp, Glycine Max; identical to SEQ ID NO: 461

SEQ ID NO: 463 - DNA, 462 bp, Glycine Max; identical to SEQ ID NO: 461

SEQ ID NO: 464 - DNA, 6327 bp, Glycine Max
atgggattgagagagcgtaacagcagcatggaggatccagatgggacattagctagtgttgcccaatgcattgagcagctgcgtcagagctcatcttctgtgcaggagaaagagtattccttaaggcagttgttggagcttatagatctgcgtgaaaatgcttttagtgctgttggatctcactctcaggcagttccagtacttgtttcccttctccggtccggttcattgaatgtgaagatacaggcagcaactgtcttgggctccctttgtaaagaaaatgagctaagggtgaaggtcttgcttggaggatgcattcctccattgcttggtctactaaagtccagttctactgaaggccaaattgctgctgcaaagactatttatgctgtctctcaaggtggtgtaaaagatcatgttggttcaaaaattttttcaactgaaggagttgtaccagtgctctgggagcagctgaaaactggcctgaaggcaggaaatgtagttgaaggtttattgactggtgcattgaaaaatctctccagcaatactgagggattctggaatgcaacaatacgagctggagcagtggacatattagtgaagttactggcaacgggacagcctagcagtttagctaatgtgtgcaatttacttgcttctgtaatggtggaggatgcatctgtttgttcaaaggtgttgacagcggaggtgacaaaacaacttctgaaactattaggcccaggtaatgatgactctgttagagctgaagcagctggtgctctgaattctctttctgcccagtgcaaagaggcacggcgagagatagccaatgctaatggtattcctgctttgattaatgctaccatagctccttccaaagaatacatgcagggtgagtgtgctcaagcattacaggagaatgctatgtgtgctctagcaaacatctctgggggtttgtcttttgtcatatctagccttggccaaagtcttgaatcatgcacctcacctacccaaattgctgacacattaggagctttggcatcagctctcatgatatatgataacaaggcagaatcttccagagcatcagatcctttggttgtcgagcagacattactcaagcaatttaaacctcgcttgcccttccttgtacaggaacgaaccattgaagcacttgctagtttgtatggaaattccatactttcaaataaactcgcaaattctgatgcaaaacacctgcttgttggtttgataacaatggcagctaatgaagttcaagacgagcttataaaagctctgttgacactgtgcaaaagtgaaggcagtctatggcgtgcacttcagggccgtgaaggggttcagctattgatatcccttttggggctttcatcagaacagcagcaagagtgtgcagttgccctgctttgccttctatcatatgaaaatgatgaaagtaaatgggcaattactgctgctggtggcatacctccacttgttcaaattttggagacaggatctgcaaaagcaaaggaagattcagcaacaatccttaagaacctgtgcaatcatagcgaagatatacgtgcttgcgttgaaagtgctgatgctgttcctgcattgttgtggctattgaagaatggaagtccaaatgggaaggatattgcagcaaagactttaaatcatttaatacataaatctgacactacaaccattagtcagcttacagctttattgactagtgatcttcctgattctaaggtttatgtcttggatgctttgagaagtatgctttctgttgctccccttagtgaaattttacgtgaaggtagtgcttccagtgatgcatttgataccatgataatattattgagctctaccaaagaagaaactcaggaaaagtctgcatcagctctggcaggaatttttgaaacaaggaaagatgtgcgtgaaagtagcattgctgttaaaactcttttgtcagccatgaaattgcttaatgctgaatctgaaagtatcctgattgagtcctcacactgcctggctgcaatatttctttccatcaaagagaacagggatgtagctgctgttgctagagacacattatccaccctagttgcactagcaaactcttcagttttggaagttgcagagatggccacgtgtgctctggcaaacctcattttggatagtgaaattgcagagaaagctattgcagaagaagttatcttacctgctactagaatattatgtgaaggcacaatttctggaaaaacccatgctgcagcagcaattgctcgtctcctgcattctcgggatgttgattatgctgtaactgattgtgtgaatcgtgctggaactgttcttgcattagtttctttcttagattctgctgttaatggatctgttgccacatcagaggctctagaagcacttgccatcctgtccaggtcagaagagaccagtgcaaatattaaatctgcttgtgcagttttggctgaattccctaaaagcataagcccaatagtcttgtgtattgttgattcagagccaacattgcaagataaaacaattgagattttatctcgattgtgtaaggatcagcctgttgttttaggcgatactatcgtgtcagcacctggatgtatatcttcaatagctaagaggataattagttccacagatgtcaaggccaaaattgggggagcagcacttcttatttgtactgcgaaagccaatcatcagagactggtggaggatctccattcgtcaaacttgtgtgccgatcttattcggtctcttgttgatatgcttacttctgcacagccttctttgggttacctggatgatgacaacaaggaattcattagcatatgcaggtacacaagagaagaggccaatggttgtgaatccaacactagcactagcattatatgtggtgctgacttggcgatatggttactgtctattctggcttgtcatgatgaaaaaaataaaattgcaataatggaggctggagcaatcgatgttctcattgacaggatctcaaattgtttctcacaatattctcagattgaatacaaagaagatagcagcatgtggattcatgctttgttgttggcaatattatttcaaaatagagatatcatacgggcacatcccaccattaaatctgtaccagcacttaccagtttattgaagtcagaggaatcagcaaacaaatattttgctgcacaatcaatagctagccttgtctgtaatggtagcaggggaacacttttgtctgtggcaaattctggggcagcaggtggacttatctctttgcttggctgtgctgatactgatatacaggatcttctggaattgtcagaggaattttctttggtgcgttatcctgatcaagtggctcttgagaggttgtttagagttgatgatataagagtgggagccacttctcggaaggcaatacctgctctagttgatctgctcaaaccaattccagatcgtccaggagcaccatttttggcacttgggcttttgactcagcttggtaaagattgtccttcaaatatgagtgtaatggtggagtctggggccttagaggcacttacgaagtatctttcactgagtccacaagatgcaactgaagaagctgctacagatctgctaggaatcctgtttagcagtgctgaaatacgaaaacatgaatcagcatatggtgctgttgctcaacttgtagctgttctacgtttaggaggaagaggagcaaggtatagtgctgcaaaagccttggaaagtttgttttctgctgaccacattagaaatgcagagattgctcggcaagctgttcaaccattggtggagattctcagtaccggttcagaaaaggagcagcatgctgctattgctgcattggttgggttactgagtgaaaacccatcaagagcacttgctgttgctgatgttgagatgaatgcagtggaagttctttgtaggatcatttcatcaaattgttcaatagacttgaaaggggatgctgctgaattatgctgtgctctttttggaaatacgaggattcggtccacagcagctgctgcatgctgtgtcgaaccacttgtctctctccttgtgactcagttcagtcccgctcagctttcagttgtccgggcattggataggcttgttgatgatgagcaactggctgaattagttgctgcacatggtgcagttgttcctcttgttggtctactgtctggtaggaactatatacttcatgaggctatttccagagctctggtcaagttaggaaaagacaggcctgcttgtaaagtggaaatggtgaaagttggagttattgaaagcgtacttgacatcttacatgaaggacctgattatctatgtgcagcttttgctgaactgttgcgtatattgaccaataatgctagcatagctaaaggaccatctgctgctaaagtggttgaacccttgtttttgttgttgacaagacaggaatttgggcctgatggacagcacagtgcattgcaggttttggttaatatcttagaacatccacagtgtcgtgctgaccattcattgacttctcgccaagttattgaaccacttatccatttgcttgactctccaatttcagcagtgcaacagttggctgctgagcttctttcacatctacttgtagaagaacgccttcagaaggatccagtgacacagcaagccattggccctctcgttcgagttcttggttctggtatacacatattgcagcaaagagctgtaaaagccctagttagtattgcactaacatggcctaatgaaattgctaaagagggtggtgttattgaaatttccaaagtgatattgcaagctgacccttcccttcctcatgctttatgggaatctgctgcctcggttttgtcaagtattctgcagtttagctctgaattctacttggaagttcctattgctgtattggtaaggttgcttcgatcaggctcagatagcacagttgttggtgctttaaatgctcttttggtgttggaaaatgatgacggaactagtgcagaagctatggctgaaagtggtgctatagaggctctcttggagctcctacgatctcatcagtgtgaggaaattgctgcaagacttttagaagtattgctgaacaatgtgaagattcgagaaacgaaagtaacaaagtcagctatcgtaccattatcacagtatcttttggacccacaaactcaagcacagcaggcaaggttgttggcaactttggctcttggggatctgtttcagaatgaggctcttgctcgaacaagtgatgcagtttcagcttgtcgtgctttagtgaatgtgcttgaagagcaaccaacagaagaaatgaaagttgtagccatatgtgctttgcagaatcttgtgatgtacagtcgatcaaataggagagcagttgcagaggccggtggtgttcaggttgtattggatctgataggttcaagtgatccagaaacatcaattcaggcggcaatgtttgttaaacttctcttctcaaataatactattcaagagtacgcttctagtgaaacagtcagagcaattactgccgctattgagaaagatttatgggcttctggaactgtgaatgacgagtatctgaaagccttaaattctctatttaccaacttcccaagacttagagcaactgaaccagcaacccttagcattccccatctggttacagccttaaagacaggttcagaggcttgtcaggaagctgcattggatgcacttttcctgctcagacaagcttggtcagcatgcccagctgaagtttctagagctcagtcaattgcagctgcagatgcaattccattgctgcagtacttaatccagtctgggccacctcggtttcaggagaaagcagaatttttattgcagtgtttgccagggacattggtggtgatcatcaagcgtggtaacaatatgaagcagtctgttggaaacccaagtgtttactgcaagcttacacttggcaacactccaccaaggcaaacccaggtggtttcaactggccctaatccagagtggggtgagagcttttcatggacctttgaaagtcctccaaaaggccagaagcttcatatttcttgcaaaaataagagcaaagtgggaaagagtaaatttgggaaagttacaatccagattgatcgagtggtaatgcttggatcagtagctggagagtatgctttgttgcctcaaagtaaaagtggccccccacggaatctagaaatagaatttcagtggtctaacaagtga

SEQ ID NO: 465 - DNA, 1353 bp, Glycine Max
atgggcaagactcctttctcctttcgtcgctccgcctctcgccgccgccccaagaagaccgccgccccgccccctcctccctctccgccgcaacatccctacgcggccggattcgccgcctcacccgacgacaacaaccgtctcatcgccgccgccgccggcagcagcgccttgacgaaggcgaagaagaagaccggcaacgtccgcttgtggatgaggtttgaccggtccggccggtcagaactggtggagttggagaagaacgccatcgtccgccacgcagcgattcccgctagagacttgcgaattttgggccccgtcttctcccactcctccaacatcctcgctagagagaaagcaatggtggttaatttggagtttataaaggcaattgtgactgctgaagaagtgttattgcttgatcctcttcggcaggaggttcttccctttgttgagcaactcaggcaacagcttcctggcaaaagtcaacctaaacttctcggcggcacggaagagcaggaaggcgaaatgcatgtctctaatggaagacaatggttgcctacaccggaggcagccgatggtttgcagtctgagcttccgtttgagtttcaagttctggagattgctttggaggctgtgtgcacttatctggactcgaatgtggcggaccttgagcgaggtgcttaccctgtgttggatgaattggctaggaatgttagcaccaagaatcttgagcatgtgcggagtttaaagagtaatcttacgcggttgctggcacgagtgcagaaggtgcgagatgaaattgaacatctgttagatgacaatgaagatatggcacaactatatttgacaaggaagtggttgcagaatcaacaatttgaggaggctcatttgggtgccacaacctcaaataactttcctaatacctcacgttctgttcgtcaacttggttctatcagaagtgaaagtcttgtgaccagccattatgaggatgataacaatgtggaggacttggagatgttgcttgatgcatatttcatgcagttggatggaactcgtaacaaaatattatcagttagggagtatattgacgacactgaagactatgtcaacatccaacttgataaccaccgaaatgaacttattcagctgcagttgacgttgactattgcatcatttgctattgctattgaaactttgattgctggtgcatttggtatgaacattccttgtaacttatataacattgatggagtattttggcccttcgtttggaccacgtctgcggcttgcgtattacttttcttgcttattttagcatatgcaagatggaagaagttgctgggatcataa

SEQ ID NO: 466 - DNA, 162 bp, Glycine Max
atgggcgtgacgaaggaagaagttgaatcatccttgaaggccaaactgaacccttctcatctttggttgatacatctggagggtgcggtgcaagttttgtggtggagattgtatcagaacaatttgaaggcaaaaggctacttgagaggcatcgaatggtga

SEQ ID NO: 467 - DNA, 1437 bp, Glycine Max
atgggcttcaactgtgtcaggctcacttggcccacacttttggccaccaacgactctctcgcttctctcagcgttagacgttcttttcagagccttggcctccttgaatccgttgctggtgtccaaaccaacaacccctccatcatcgaccttcccctcatccaagcttttcaggcagtggtgaagagtctcggggacaacgatgtgatggtgattttggacaaccacctgaccaacccaggatggtgctgtggttactccgacggcaatggcttcttcggtgacaaatttttcaacccagaccagtggatattcggcctcaccaagatggccacccttttcaatggtgtcactaatgtcgtgggcatgagcttgaggaatgagctccgggggcccaaacagaatgtcaacgattggtacaagtacatggtgaagggagcagaagctgttcatgcagcaaatccagatgttctagtcattctatctgggataaattttgacacaagcttgtcattcattcgggacagaccagtgagcctcacgttcaaagggaagctagtatttgaggtgcacaggtatggcttcactgatggtggagcttgggctgatgggaacccaaaccaagtatgtggaaaagtgactgcagatataaagcaaacatctaccttcttagtggaccaaggatggccattgtttgtgagtgaatttggtggagacttgagaggtaccaatgtgaatgacaatcgataccttaactgttttctggcactggtagctgagcttgacttggattgggcctattggactcttgttggtagttactactttagagaaggggttataggaatggaagagttttatggccttctcacttgggattggactcaggttaggagtaccagtttcttaaatagaatctctgccctccaaattccatttcgaggaccaggcatcatagaaggcagtgcatacaaactgatattccaccctttgacaggtctctgtgtcataagtaaatcacagctaacatcactaacgttgggtccttgctcttcttctgatgcctggacatacacacctcaaaagaccctattgataaacaatacaaatttctgcatacatgcagagcaagaaggaaagcctgcaacacttagcataacatgctcagatgctaactctaaatgggaaatgatctcagattcgaacatgcacctttcatctaaactaagcgacggttctaatttatgtctagacgtagatgataacaacatcattgtgaccactgcttgtaaatgcttgaaccaagataagacatgtgaccctgcaagccaatggttcaaacttattgatagcggaaggaggtcaatctcgacaacctcaacattatccatgctgaattcaccggacattttgtggcaaccattgagctctatataa

SEQ ID NO: 468 - DNA, 435 bp, Glycine Max
atggggaacagagctatgttaaccttgctactactcctcttcttctcgaccaatttggttccttccgcccttgctatctggctgacgttacccaccactggcactaagtgcgtctccgatgaaatccaacacaacgtcgtcgttttggccgactacgtcgttatccccagtgatcacgcccacaacctcaccatcgccgtcaaggtgacatcaccgtatggaaacaatcttcatcacaaggagaacacaacacatggtagtattgcatttacaactcaagaggctgggaactaccttgcatgcttctgggtggatagccctagtcaaggagttggtgaggttaatgtaaaccttgattggaaaattggaattgcagctaaggattgggattcagtgctagaaaagagaagattgagggagttgagcttgagctga

SEQ ID NO: 469 - DNA, 813 bp, Glycine Max
atggggaataacagacaaaggagattcagaactcatcgcgcacaatcaagtcgacaccaccaccaacaactcttactagaggacgattctcaaagctctcttccagaaaatggtgagggcgaggaagaggaggaggaactcacggaacctaaaataaagcttgctatgtgggattttgggcaatgcgatgccaaaaagtgcactggacgcaagctttcaagattgggcatgctaaaagagttacgtgtgagtaatggttttgggggcattgttttaagtccggctggaaatcaatgtgtctcaagagaagattactctttaatccagaagaaaggattggctgttgtggattgttcatgggcacgcttagatgacgtgcctttcgtaaggctgcgctgtactgctcctcgcctcttgccatggcttgtagcagcaaatccagtaaattatggtcggccatgtcagctatcttgtgtagaggctttatctgctgctttgacaatatgtggggaagaaaaaactgcaaatttgttgcttgacaagttcaaatggggccatgcttttatgtctctgaatggggaattactgagggcctactccaaatgccaaaatagtgctgaaattatatctgttcaaaatgcttggctgtcacaagagagtcagattccaagggctcctactgacagtgaagttacgacacctgaaagtgaggataaaatccagaactcttccgattctgaagatgggcttccacctcttgaaaagaacatgaatcatttgagcatagtcaacagtgatgaagagagtgaatag

SEQ ID NO: 470 - DNA, 816 bp, Glycine Max
atggggaataacagacaaaggagattcagaactcatcgcgcacaatcaagtcgacaccaccaccaacaactcttactagaggacgattctcaaagctctcttccagcagaaaatggtgagggcgaggaagaggaggaggaactcacggaacctaaaataaagcttgctatgtgggattttgggcaatgcgatgccaaaaagtgcactggacgcaagctttcaagattgggcatgctaaaagagttacgtgtgagtaatggttttgggggcattgttttaagtccggctggaaatcaatgtgtctcaagagaagattactctttaatccagaagaaaggattggctgttgtggattgttcatgggcacgcttagatgacgtgcctttcgtaaggctgcgctgtactgctcctcgcctcttgccatggcttgtagcagcaaatccagtaaattatggtcggccatgtcagctatcttgtgtagaggctttatctgctgctttgacaatatgtggggaagaaaaaactgcaaatttgttgcttgacaagttcaaatggggccatgcttttatgtctctgaatggggaattactgagggcctactccaaatgccaaaatagtgctgaaattatatctgttcaaaatgcttggctgtcacaagagagtcagattccaagggctcctactgacagtgaagttacgacacctgaaagtgaggataaaatccagaactcttccgattctgaagatgggcttccacctcttgaaaagaacatgaatcatttgagcatagtcaacagtgatgaagagagtgaatag

SEQ ID NO: 471 - DNA, 1809 bp, Glycine Max
atggggagagacggtgagattgacggcggagtgcggcggagaggatgcacgttcaggcggaacgacttcttcccggaggagtcgttcaagagttggggaaactacgctcgagcggtgctggagacgccgtggaggctgaaggatcgtgtggtgacgcgatcggaggaccagacggagttggtggagatgaaggctcgtagcaaccacgagatgaagaaaacgctgaactggtgggacctcatgtggttcggaatcggtgccgtcattggctccggcatattcgtcctcactggcctcgaggcaaggacggcggtcggacccgccgtcgtgctctcctacgtcgtttccggcgtctccgccttgttctcggtgttctgctacaccgagttcgccgtcgaaattcccgtcgcaggcggatcatttgcgtacttaagagtcgaactgggagactttgtggcctacatagctgccggaaacatcctcctcgagtatgtaataggcggcgctgctgtggctcggtcatggacctcttatttcgccaccctttgtggcaaacaccctgatgactttcgtataatagcccacaacatgaaccccaactatggccatcttgaccctatagccattggagtcctcatagccataactatccttgcagtgtacagcaccaaaggctcttccatcttcaacttcattgccacaatctttcacttaattgtcattgtcttcatcatcatcgcaggcctcaccaaggccaacaccgaaaactacgccaactttactccttttggagttcgtggtgtgttcaaagcttcagctgttcttttcttcgcttatgtgggctttgatgctgtctcaaccatggctgaagaaacaaagaaccctgccagggacattcccattggtcttgtgggctcaatggtaattaccaccttggcatattgcttgctagcagtgacactatgcctcatgcaaaactacactgacattgacaaggatgctccctactctgttgcgtttagtgctgtgggaatggattgggctaagtacattgttgcatttggggctttgaagggaatgaccactgtgttattggtgagtgcagtgggtcaagctcgttacctaacccacattgcacgtacccacatgatgcccccatggtttgctcatgttgatgagagaactgggacacccatgaatgccacaatctcaatgcttgcagctacagctgtgattgctttcttcactgatcttggaattctctccaaccttttgtcaatttctactcttttcatctttatgcttgtggctttagcgcttctagtgcggcgctattattcaagtgggttaaccacaaaagagaaccaagtgaagctcattgtgtgccttatgctgattttggggtcttcatgtgctatttctgcatactgggcaagcagtgatggttgggttgggtatgcagtttctgtgccgttgtggattttagggactgggggtctttggctttttgttccacaggcaaagcaaccgaaactttggggggtgcctttggttccatggctaccttctttatctattgctattaacatattccttcttggctctattgataaagattcatttatcaggtttggggtctggacagggtttctcttggtatactatgtgctattggggttacatgcttcttatgacacggcaaaagtgttcgagagcaagaaaagttctgtggatgttgacaagcagtggaataaggtggaagaaggagcaaaaggggaagtatctcttacagcagtttcaaatgattga

SEQ ID NO: 472 - DNA, 1194 bp, Glycine Max
atggggatcagttctcgaagttcttccaacagaaaaccaagtgatagtatgaggcttattgtgacaacttttgttggaatagtttttggcttctttataggagtatcatttccagcattgactacaaagttgaatctcccatccagcctgcttcctgccattgatatttcttacattcaagagaaatatgctggtggcaatgcaccgtcttttgtgaagaataataacagcatctcatcaaagcatcggttaataaacgatacattcaagatatgggttccatcaaatccaagaggtgcagaaagattacctcctgagattattgaagctgagacagacttttatttgcgtagattgtggggtcagcccagtgaggatttaacatcaaagccaaagtaccttgtgactttcactgttggttataatcagagatataatattgatgcaaatgtgaaaaagttctcagagaactttacaatagttctatttcattatgatggccacacaactgaatgggatgagtttgagtggtcaaagcgggcaattcatgtgagtgttcgcaaacagaccaaatggtggtatgccaagcggtttctgcatcctgacattgtggcaccatatgactatatttttatatgggatgaagacctgggtgttgaacattttaatgcagaggaatacttaaaactggtgaagaagcacgggttggagatttcacagcctggtttggaacctaataaaggattgacatggcaaatgacaaagagaagaggtgatcgtgaagttcacaaagaaacagaggagaaaccaggatggtgcgctgacccccatctgcctccttgtgcagcatttgttgagattatggctccagtgttttcacgagatgcatggcgttgtgtctggcatatgattcagaatgatttggtccatggctggggccttgattttgctcttagaaaatgtgttgagcctgcccacgagaaaattggagttgttgattctcagtggattattcatcaaagtgttccctcactagggaatcagggagaatcacaacctgggaaagcgccatggcatggggtgagggagaggtgtaaaagggagtggacaatgttccagagtcggttggcaaatgcagaagacgcatattacagggccgtgggaggggatatgtttaattcgactactccttag

SEQ ID NO: 473 - DNA, 282 bp, Glycine Max
atggggtggttctatccaaaaaagaggagtgtagaaggatacacaagccagaacatgaccactgctgtttctccttctccaaatttccatttggttgtgatatttggcattgtctttagcttattgtggctctcaaattacacagccatttaccttcagtttctcctcatgctgtctcccatacttgggattctcttcttgatttcatattcaactacttgtggtggaaggctcaactttagtttcacacgtttgaagaatgtggtgtctcatggaacgtag

SEQ ID NO: 474 - DNA, 1254 bp, Glycine Max
atgggtaaaaagcaatcttttcggagcaaagcagcctacttcgtttctgatctcaccactggtcttctcaaccctatttctgacaacaacaacaacaacaacaaacccccttctctccctccttccggagaagaagaaaaagaagatgtgggtgagtcaaagggtggtagtgatgatgtgataattgatgggcctgatacttcgtccttcactgcgtttctctattctctgttgtctacttcggattccggggataaagttggtgaagctgataagaagaatgatgatgaggtggcaggtgatgactctttactatcagactcagccacgaaggaaagttttgttgtgaagaaaagtttgttttccaggagcaaacattcacttggtagggccattcaccaaatgggtggatttagcaacagggatagcaattacaccgacgaaggtggcgttgagatgaagcgcattgtgaaagagccattggctgtggctgtgtctggggttggtgatcatctgcctcaaatttctgagccttcaatgcttgtttccgagggtgtgcgaaatgcggtgtatgcttcactgccggcacttattcgtggccggaaatggtttatgctgtacagcacttggaaacatggtatatcactttcaactctttaccggcgaagcatgctttgtcctggaatgagcttgctggttgttggagatcgtaaaggggcagtgtttggtggcttggttgaagctcctctaagaccatccaacaagagaaaataccagggaacaaacaattcatttgttttcacaaacacctctggttgtcctgttatatatcacccaacaggagtaaaccgctacttcacactttgcaccactgacttcctagcaattggtggcggaagtcattttgcactttatttggagggtgatctattgaacggatcaagttcggtttcagaaacttatgggaatccttgccttgcacattctcaagaatttgaagtgaaggaagtagagttgtggggctttgtatttccttctaagtatgaggaaatagtggaattgagcagaacagaggcacctgggatctgtcgctgggatgcaaagttgattgatagacgttatggtgaagaaattccatgtagcatgcttgtaaatattagcaaggctgtatacactatatacaggaaaacgaaggataaccctattgctcaagcattgttgaagttagctgttctgcaaaccaagatgctttag

SEQ ID NO: 475 - DNA, 897 bp, Glycine Max
atgggtaaaaagcaatcttttcggagcaaagcagcctacttcgtttctgatctcaccactggtcttctcaaccctatttctgacaacaacaacaacaacaacaaacccccttctctccctccttccggagaagaagaaaaagaagatgtgggtgagtcaaagggtggtagtgatgatgtgataattgatgggcctgatacttcgtccttcactgcgtttctctattctctgttgtctacttcggattccggggataaagttggtgaagctgataagaagaatgatgatgaggtggcaggtgatgactctttactatcagactcagccacgaaggaaagttttgttgtgaagaaaagtttgttttccaggagcaaacattcacttggtagggccattcaccaaatgggtggatttagcaacagggatagcaattacaccgacgaaggtggcgttgagatgaagcgcattgtgaaagagccattggctgtggctgtgtctggggttggtgatcatctgcctcaaatttctgagccttcaatgcttgtttccgagggtgtgcgaaatgcggtgtatgcttcactgccggcacttattcgtggccggaaatggtttatgctgtacagcacttggaaacatggtatatcactttcaactctttaccggcgaagcatgctttgtcctggaatgagcttgctggttgttggagatcgtaaaggggcagtgtttggtggcttggttgaagctcctctaagaccatccaacaagagaaaataccagggaacaaacaattcatttgttttcacaaacacctctggttgtcctgttatatatcacccaacaggtatctatttttcattgagtttgaatattccattctttatcaaaatcaatgattag

SEQ ID NO: 476 - DNA, 897 bp, Glycine Max; identical to SEQ ID NO: 475

SEQ ID NO: 477 - DNA, 1005 bp, Glycine Max
atgggtaaaaagcaatcttttcggagcaaagcagcctacttcgtttctgatctcaccactggtcttctcaaccctatttctgacaacaacaacaacaacaacaaacccccttctctccctccttccggagaagaagaaaaagaagatgtgggtgagtcaaagggtggtagtgatgatgtgataattgatgggcctgatacttcgtccttcactgcgtttctctattctctgttgtctacttcggattccggggataaagttggtgaagctgataagaagaatgatgatgaggtggcaggtgatgactctttactatcagactcagccacgaaggaaagttttgttgtgaagaaaagtttgttttccaggagcaaacattcacttggtagggccattcaccaaatgggtggatttagcaacagggatagcaattacaccgacgaaggtggcgttgagatgaagcgcattgtgaaagagccattggctgtggctgtgtctggggttggtgatcatctgcctcaaatttctgagccttcaatgcttgtttccgagggtgtgcgaaatgcggtgtatgcttcactgccggcacttattcgtggccggaaatggtttatgctgtacagcacttggaaacatggtatatcactttcaactctttaccggcgaagcatgctttgtcctggaatgagcttgctggttgttggagatcgtaaaggggcagtgtttggtggcttggttgaagctcctctaagaccatccaacaagagaaaataccaggtccaccactcacctcttttccctactatcaaatgttgttgggcattgtctgcttcattttgcaacatgttattttttttcatcttattcgcattaaattttgcacagggaacaaacaattcatttgttttcacaaacacctctggttgtcctgttatatatcacccaacaggtatctatttttcattgagtttgaatattccattctttatcaaaatcaatgattag

SEQ ID NO: 478 - DNA, 1149 bp, Glycine Max
atgggtaaaaagcaatcttttcggagcaaagcagcctacttcgtttctgatctcaccactggtcttctcaaccctatttctgacaacaacaacaacaacaacaaacccccttctctccctccttccgtaatcatttttattattattgaattaatcctatgtagtaattttagacacggagaagaagaaaaagaagatgtgggtgagtcaaagggtggtagtgatgatgtgataattgatgggcctgatacttcgtccttcactgcgtttctctattctctgttgtctacttcggattccggggataaagttggtgaagctgataagaagaatgatgatgaggtggcaggtgatgactctttactatcagactcagccacgaaggaaagttttgttgtgaagaaaagtttgttttccaggagcaaacattcacttggtagggccattcaccaaatgggtggatttagcaacagggatagcaattacaccgacgaaggtggcgttgagatgaagcgcattgtgaaagagccattggctgtggctgtgtctggggttggtgatcatctgcctcaaatttctgagccttcaatgcttgtttccgagggtgtgcgaaatgcggtgtatgcttcactgccggcacttattcgtggccggaaatggtttatgctgtacagcacttggaaacatggtatatcactttcaactctttaccggcgaagcatgctttgtcctggaatgagcttgctggttgttggagatcgtaaaggggcagtgtttggtggcttggttgaagctcctctaagaccatccaacaagagaaaataccagggaacaaacaattcatttgttttcacaaacacctctggttgtcctgttatatatcacccaacaggagtaaaccgctacttcacactttgcaccactgacttcctagcaattggtggcggaagtcattttgcactttatttggagggtgatctattgaacggatcaagttcggtttcagaaacttatgggaatccttgccttgcacattctcaagaatttgaagtgaaggaagtagagttgtggggctttgtatttccttctaagtatgaggaaatagtggaattgagcagaacagaggcacctgggatctgtcgctggtaa

SEQ ID NO: 479 - DNA, 984 bp, Glycine Max
atgggtaaaaagcaatcttttcggagcaaagcagcctacttcgtttctgatctcaccactggtcttctcaaccctatttctgacaacaacaacaacaacaacaaacccccttctctccctccttccgtaatcatttttattattattgaattaatcctatgtagtaattttagacacggagaagaagaaaaagaagatgtgggtgagtcaaagggtggtagtgatgatgtgataattgatgggcctgatacttcgtccttcactgcgtttctctattctctgttgtctacttcggattccggggataaagttggtgaagctgataagaagaatgatgatgaggtggcaggtgatgactctttactatcagactcagccacgaaggaaagttttgttgtgaagaaaagtttgttttccaggagcaaacattcacttggtagggccattcaccaaatgggtggatttagcaacagggatagcaattacaccgacgaaggtggcgttgagatgaagcgcattgtgaaagagccattggctgtggctgtgtctggggttggtgatcatctgcctcaaatttctgagccttcaatgcttgtttccgagggtgtgcgaaatgcggtgtatgcttcactgccggcacttattcgtggccggaaatggtttatgctgtacagcacttggaaacatggtatatcactttcaactctttaccggcgaagcatgctttgtcctggaatgagcttgctggttgttggagatcgtaaaggggcagtgtttggtggcttggttgaagctcctctaagaccatccaacaagagaaaataccagggaacaaacaattcatttgttttcacaaacacctctggttgtcctgttatatatcacccaacaggagtaaaccgctacttcacactttgcaccactgacttcctagcaattggtggcggaagtcattttgcactttatttggagggtgatctgtaa

SEQ ID NO: 480 - DNA, 1146 bp, Glycine Max
atgggtaattgctggtgtaggtgggagtcatcagagtatagagtttcatccaatgtaaagtcagaacaaaaccagggaaccaaacagaggcatgatgatagtaagttaccatcaaatcctgaagaagtagaagacctacggcgtgactcagctgcaaatcctttgattgcattcacttatgatgagttaaagattatcacagcaaattttaggcaagatcgtgtgttggggggaggaggatttggaagggtttacaaaggattcatttctgaggagttaagggaagggcttccaacacttgctgtagctgttaaggttcatgatggtgacaacagtcatcaagggcacagagaatggctggcagaagtcatatttttggggcagctttcacatccaaatctagtaaagttaattggatattgctgtgaagacgaacatagggtgctaatatacgagtacatgtcccggggaagtgtggaacacaacttgttctcaaaaattttgcttcccttgccatggtccataagaatgaagattgcgtttggcgctgcaaagggacttgcatttcttcatgaagcagagaaacctgtcatctatcgagatttcaagacatcaaatattttattggaccaggagtacaattcaaaactttccgactttggccttgctaaggatggaccagttggagacaaatcccatgtttctactcgagtaatgggaacatatggttatgccgcacctgaatacataatgacaggtcatctgactcctagaagtgatgtttacagctttggtgttgttcttcttgaacttctcactggaagaaaatctttagacaagttaagacctgctagagagcagaaccttgcagaatgggctcttcctttgctgaaggaaaagaagaaatttctaaacatcatagatccaaggttggatggtgattatccaattaaagcagttcacaaggctgcaatgcttgcatatcattgcttgaaccgcaacccgaaagcaaggcctctaatgcgagatattgtggattcattggagcctttgcaggcacacacagaggtccctattggaaaaacattgaccataatcagtgaggttcctgaatctggtttgaaaatgaaagatgatgcaatatga

SEQ ID NO: 481 - DNA, 426 bp, Glycine Max
atgggtgataggctagtagttgaccaacagcacacgggtgatgcacaacttccatcttctcctccctcaaaagatgatatggtttcgtgtgttatggctttggaggctgctttgcttccctgtttgccagccagagaacttcaagcaatagaccgttccccccacccttcacatcaaattgatgtggataggtatgcaagagattttatggaggctgccaagaagcttcagctttattttatcagcctgcaacgagaggataagccaacaaaacttgaaatgcttagaaaggaggttgctctcatggaagaggagcttaacaaaaaaaatgagctgataaaaaagcaagaaaatttaattcaggagtggaagaaagagttgaaagatcagttggacaaacacaagattgagttggatagggtttag

SEQ ID NO: 482 - DNA, 474 bp, Glycine Max
atgggtgcgacggaggccaacacgacacttcaagctcgtcccgaaacgacgtcggagaatatcgaagcattgcttgatgctgcaagatacgatgacatggatgatgttaagagcttagaagccagtggtgttcctcttgattccaaggatgaacaagggaggacagctcttcatatggctgcagctaatggacatattgatattgtggagtatttaatcagtagaggggtggatcttaattcaccaaatgaggaaaagaatacacctcttcattgggcatgtctcaatgggcatgtggaggctgtgaagaaattaatcatggctggagctaatgttagtgtcttaaacagtcacgagaggactccaatggatgaagcagtgagtgggggaaagccagaagtgatggatgcgattaatgaagcagtggcactagttgaacttcgtggtgctatggtttttgcacaggaaacttga

SEQ ID NO: 483 - DNA, 1986 bp, Glycine Max
atgggtgctacgaactcaagagcggaaaagaatgaagctctaagtttgtgcaaggaaagaaagaggttcgtcaaggtggctattgactcaagatatgctttagcagctgcacatgtttcctacattcaatctcttcgaaacgttggcattgctctccggaggtatgctgagtctgaggtagaggtagagtcatctctgtctatatctgacaaaactccttctcaaactagttacccttctccatcatcaccttctcatgttgctgaggttgaggttttggagtcacctttgcacaatgagagtcctctttcgccacctgtggccaccactcttagttacatgaggtcaggtggtagtgctgctgtcactgttaggatcaatgcctttggtaacaactatttggatgatgagtccactgtggttccaatgcctccacctcctcctgagtcaggtgcatcttgggatttctttgaccctggggaggacagtgagagctttagggatgaagaaaagggtgatcaatggttacatgttggttctgatgggcattgcatggtgcaaccactcctggatgacaagtttggtggaaacttgagcaatgctggaatgggaaatgagtgtggcaactcttatgcacactgcaatgatcattctactgtttcaagaggagttgaaggtggaaatggaattgttgatggagaattgcgagagctggagttgccaagtgctgcagaaagagaggatccttcagagttcataacacacagagctaaagattttctctccagcataaaggatatagagcataggttcgttcgagcttctgagtctggtagggaggtcttgaggttgttagaggcaaacaaaataaagggaagtcatctaccacggcgttgttgtctgccgtccagcctgtttgttgcggtagaaaggcttcacctgttttccagggtaaagcctgcccaaaaaattattagttggaaaaggacagcatcttctcgatcatcctcatccaggaatgctttggctacaaaaacaaaggaagatattgatgatagtggaagtgactttgttgaagaattctgtatgattgctggaagccattcatccactcttgacagactatatgcctgggagcgaaaactatatgatgaagtaaaggctagtgaatccataaggaaggactatgaccgaaaatgtcaccagcttaggcatcaatttgctaaagatcaaggcactcatgtgattgacaagacccggtcagttgtgaaggatctgcattcacgcttaacagtggctatatattctgttgattcaatatcgaaacgaattgagagaatgagggatgaagagttgttgccacaacttttggagttaacagaagggcaattgagtgttaaagctttaactactaattacttaggaaactactggagcacaccaggaaccttgcaaggatatgcacgcagagacataatgactcagctgctagaagaagttgagttctttggtctgagttttgctaactggattaacagcctcacctcatatgtggaagctgtcaatgcgtggctgcaaaactgtatactgcaaccaagggagcgtaccaagagcagaagaccgttctctcctcgccgagttctggccccacctatttttgttctttgccgtgactggtctgctgggatcaaggttttaccctctgaggaactaagtcagacaatcagaaactttttgtctgatcttcacttgcggacagagcagcataatgaccaacttctcaagaaacagaattctgtcaatgcaaagaatgaagacgagtccacgaatttgagctgcatacatgcaagattaacaaaggttcttgatcggctgaccaaattttctgaggcatcattgaagatgtatgaagatatccggcaaaaaagtgaatcagctcgaaatgcataccataattgcagaactatcagggccgaaaaattttaa

SEQ ID NO: 484 - DNA, 1110 bp, Glycine Max
atgggtgctgccggctccaagcttgagaaggctctcggcgaccaattccctgaaggagaacgttactttggcctcgagaatttcggcaacacttgttactgcaacagcgtcttgcaggcactatacttttgtgttccctttcgcgaacaattactagagtattatggaaataacaaaagcatattggacggggaagaaaatcttttaacttgcttggcggacttattttcgcagataagttcccagaagaaaaaaactggtgtcattgctcccaaacgatttgtacagaggttgaaaaaacagaatgaactcttccgtagctatatgcaccaggatgcccacgagttcttgaactttttgctgaatgaacttgttgacattctggagaaagaggctcaggctgcaaaaactgatcaggagacatctccaccttctgaaaaggctgttaacgggcccaagaatggtcaagctaatggtgttcacaaagagcctttagttacttgggtacacaaaaattttcagggaatactcaccaatgagacaaggtgcttgcaatgtgagacagtgacagctagagatgaaacatttttggacttgagtcttgatattgagcaaaacagttcaattacaagctgtttgaaaaatttcagttccactgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatatcgagtattctctatttgcagtagttgttcatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttattctatgagagcattggctctggtaacaggagttag

SEQ ID NO: 485 - DNA, 2463 bp, Glycine Max
atgggtggtggggggagaggaggcagatcccgaactcagagaaagcacttccggcagagcagagataacgtgtggaagcgttccaaatcggatcccaatccttcttccaacgaaaacaatcccccgtggactcccttcgccactgagaacgccgctttcgatttctactacaaagagcaggggatagtggacccgcaacactgggaccaattcgtcgcagttctcagaactccattgcccgcaaccttcagaatcaactctagtagccagttttccgacgaccttcgttctcaattggagaatgacttcctgcattctcttcgcgacgaggttgttgaaggaggtgagacggaggctattcggccgttgctgtggtaccctgggaacttcgcttggcattctaatttttccaggatgcagctcaggaagaaccaaacacttgagaggttccatgaattcttaaagctagaaaatgagattggaaatatcacaagacaggaagctgtcagtatggttcctcccctcttcttggatgtgcattcagatcattttgtgcttgatatgtgtgctgcaccaggttcaaaaacattccaattgcttgagattatacaccaatcatctaaaacaagatcactacctgatggaatggttatagcaaatgatctcgatgtccaaagatgtaatcttctcatccaccaaacaaaaagaatgtgcacagccaacctaattgttacaaatcacgaagctcagcacttcccaggatgccgtttaaacaggaattatgaaaggatggagttagataacaatattagccaactgttatttgatcgtgttctatgtgatgtcccatgcagtggagatggtacccttcgtaaggcacctgatctatggaggaaatggaacacagggatgggacatggccttcacagcctacaggttttaattgctatgcgaggtttatctctacttaaaattggtggaagaatggtctattcaacatgctcaatgaatcctattgagaatgaagctgtggttgctgaggttttgcgaaggtgtggagggtctgttaaacttcttgatgtctctagtgagcttccacaacttattcgtcggccaggtctcaggagatggaaggtatatgacaagggcacttggttggtctcttacaaagatgttcctaagtatcgtagaagtgtaattctttccagtatgtttccttctggcagaggccatcatgatcttgtggatagtagttgtagtgttgatccagagggcgttactaatggtattaatggaaatgctggagatggtgttcaagcagttgagaatcctgtgatgtccgagtctggtgcggaagtttgcgatttccctctagagcgttgcatgaggatagtgcctcatgatcagaacactggagccttcttcattgctgtactgcaaaaagtttctcctctgccagcaattacagaacaaacaaaaataaaaaatgatgagcaatatgtagaacccgcaaaccagagtcttaatgatgcacaagtaccacatattacttcatcagaaagtgcacacgaagaagtcttcaaagcagtgtctgaggaaaatgtagatgacgctgaacccaacactgaagatttggaagttggtcctgttacatgtgaagaacagaattccaaggaaactcaagaacctgataatgtacaaaacacagcaaagagggttccaggcaaaagaaagctacaaattcaaggcaaatggaggggtgttgaccctgttgtctttttcaaagatgaaacaattattaatagtataagggatttctatggaattgatgagcgttttccattcaatggtcaccttgttacaagaaacagtgatacaaatcatgtgaaaagaatttattatatctccaagtcagtcaaggatgttcttgagttgaacttcaaagttgggcagcaacttaaaataacatcaattggcctgaagatgtttgaaagacaaacagcgcgagaaggtagctctgcatcatgtgctttccggatatcatccgaaggattgccccttattctcccatacataaccaaacagattctgcatgcatctcctgcagacttcaagcatattctgcagaacaaagaagtaaaatttgaagattttaatgatgctgagtttggtgaaaaggcagcaaacctattgccaggctgttgtgtggtaattctgcatatagggaacacacttgctgcagagtctctccaagtggatgagtcaacgatagccattggatgctggaagggtagggcgagattgtcagtgatggttactgcaatggactgccaagaactacttgaaaggcttttaatacggtttgacactgaaaagggttcctctgggcatgcagacaaatcctctaatgatgtgcaagagttgaacagtataaatgatggcgtgaaagttactgtgagttaa

SEQ ID NO: 486 - DNA, 291 bp, Glycine Max
atgggtgttggttttaaattcatatttgacagttttgggcttgacaacccactgataagtgccattattgttctcgtgaacaagttcagtggtttcatagttgtacacggactgaatctcagtctctgtgtacttcacgttaggactctcaaccttgaaactctcgatgaacattttttttgctttgagaaaaggaagaactacttaattgggaaaagcgcgcagaaagaaaagcaaaagctcttaataacttttaagagaagaagaagaaggttgttactcatacaataa

SEQ ID NO: 487 - DNA, 1257 bp, Glycine Max
atgggttctagttgtggttgtggtgtaactcttgttcttgttttctgcttatggggtgtgttgatctccctctcttctgctgctaggctcagtgcttcaaggcagaagcttgaggttactaagcatttgaatcgcctgaacaagcctcctgttaagaccattcagagtccagatggggatacaatagactgtgtacctgtttcgaagcagcctgcatttgaccatcctttcctcaaagatcacaagattcagacaagacctactttccaccctgatgggctttttgaagagaacaagttatctgaaaagcctaaagcaaaagcacatacccccatcactcagctgtggcatacaaatggtagatgccctgaggacacaatacctgtcaggagaaccaaggaggaggatgttctgagagcaagttcagtgaaacggtatggtaggaagaagcacagagcaatccctaagcctaggtctgcagaacctgatctaattaaccaaagtggtcatcagcatgcaatagcatatgttgaaggagacaagtattatggagcaaaagccactataaatgtgtgggaacccaagattcagcagactaatgagttcagcttgtctcagctttggatattaggaggctcatttggtcaagatcttaacagcatcgaagctggctggcaggttagcccggatttatacggtgataacaacacacggctattcacctactggacgagtgatgcatatcaagctactggctgctacaatcttctttgctcgggatttattcaggtcaacagtgaaatagcaatgggtgcaaccatttccccagtttctggataccgaaactctcagttcgatatcagtatccttatctggaaggatccaaaagagggacactggtggatgcaatttgggaatgactatgtattggggtattggccttctttcctgttctcatatttggctgacagtgcttccatgattgagtggggaggtgaagttgttaactctgagcctgatggtcagcacacatcaactcaaatgggaagtggtcatttccctgaagagggttttggcaaagcaagctacttcaggaacattcaagtggttgatagctccaataatctcaaggctcccaaaggcattggcaccttcactgagcaatcaaattgttatgatgtccaaacaggcagtaatggggattggggccattacttttactatggaggccctggtaaaaatcccaattgtcaatga

SEQ ID NO: 488 - DNA, 738 bp, Glycine Max
atggtagattcattgttttctttgtttctcctttcctctattgtaaggataatgtgtcttgatagagtagctatagtatccgattatgagagtaaaagtggtgactattctaatccatggagactttgcaccgtgacccaggtggaggaattgaaaatcttgatctgcgtgtttccaatttgggccaccaggatcatttttgctgcagtctatgcccagatgtcaacatttgtggttttgtgggtccctctctatgacaggataattgttccaatcataaggaagttcacaggcaaggaaaggggcctctcaatgctgcaaagaatgggaattggccttttcatttcagttctgtgcatgttatcagctgctgttgtggagattatgcatctgcagctcgcaaaagagcttgaccttgttgataagcatgttgccgtgccccttagtgtactttggcaaatccctctgtatttctttttaggggcagcagaagtattcacatttgtggggcagcttgagttcttgtactgcaatgacacttctgaacttttcattgggaaattacttgagttctttcattcttactatggtaacttcaccacacaaggtggaaagcctggttggattcctgataacttgaacaaaggtcatctcaattactttttattgtttttagctggacttggcttcttaaatatgtataagaaaaaaaaatcatcctcaagaatcatattctaa

SEQ ID NO: 489 - DNA, 768 bp, Glycine Max
atggtcactaagctagttcagccaccaatgacagattcccatgtgagtcctctcatttatagaaccatgaatgtcatgaagctccaaaattttgtcccagctagaaatcatccaagaataaacacctcaagatttggtgagagaccattatggtttagacccattacaatcattaaagttgcagaacacaattctggctcaggcttagttgagcttgaagcacttgctcagaagaaaagagagctttaccaggcggtggaaggaatcaataggggaattttcggaatcccatctaccaagaaatctgaaattgaaagtttggtgaagcagctagaatctctgaatcctactccattcccaactctagaactggagaaggtggctgggtgctggaggcttgtttacagtacaatctccattttgggatcaaagaggaccaagttaggcctcagagattttatctcattggatgatttttttcagtcgattgatatatccaagagcaaagcagttaatgtgataaagttcagtgcaaggggattgagtttgttgtctggacaacttagtattgaggcctctttcaggatttcttcctcaacaagggttgacattaatttcgaaaactcaacgatcactcctgaccggttgatgaatgtatttcggaaaaattatgatcttttgttgggcgtcttcaatccagagggatggctggaaatcacgtatcctaattctttgaagattttttttccttttcttttattggtttag

SEQ ID NO: 490 - DNA, 642 bp, Glycine Max
atggtcactaagctagttcagccaccaatgacagattcccatgtgagtcctctcatttatagaaccatgaatgtcatgaagctccaaaattttgtcccagctagaaatcatccaagaataaacacctcaagatttggtgagagaccattatggtttagacccattacaatcattaaagttgcagaacacaattctggctcaggcttagttgagcttgaagcacttgctcagaagaaaagagagctttaccaggcggtggaaggaatcaataggggaattttcggaatcccatctaccaagaaatctgaaattgaaagtttggtgaagcagctagaatctctgaatcctactccattcccaactctagaactggagaaggtggctgggtgctggaggcttgtttacagtacaatctccattttgggatcaaagaggaccaagttaggcctcagagattttatctcattggatgatttttttcagtcgattgatatatccaagagcaaagcagttaatgtgataaagttcagtgcaaggggattgagtttgttgtctggacaacttagtattgaggcctctttcaggatttcttcctcaacagttaaaactccacttcttgtttggtcacttatttctctgtaa

SEQ ID NO: 491 - DNA, 540 bp, Glycine Max
atggtcactaagctagttcagccaccaatgacagattcccatgtgagtcctctcatttatagaaccatgaatgtcatgaagctccaaaattttgtcccagctagaaatcatccaagaataaacacctcaagatttggtgagagaccattatggtttagacccattacaatcattaaagttgcagaacacaattctggctcaggcttagttgagcttgaagcacttgctcagaagaaaagagagctttaccaggcggtggaaggaatcaataggggaattttcggaatcccatctaccaagaaatctgaaattgaaagtttggtgaagcagctagaatctctgaatcctactccattcccaactctagaactggagaaggtggctgggtgctggaggcttgtttacagtacaatctccattttgggatcaaagaggaccaagttaggcctcagagattttatctcattggatgatttttttcagtcgattgatatatccaaggtacaaaaacaatgtagttctcaattttgtatgatatag

SEQ ID NO: 492 - DNA, 225 bp, Glycine Max
atggtccagtacacggttcagtacacccaaggcctcatcctcctccaaaaattactcgatactccgcgccacatatacataaaccaaaaccaccaaacgtggcaacaacaaacacctatgcagcaaagaagcctccaactaaaggttgaactgttaggctatgatcaaaggttttgcaacgtcaagggagtatattacaacagtaatcgcaatttgaaaccttga

SEQ ID NO: 493 - DNA, 462 bp, Glycine Max
atggtctggtttcgaggaccagtgcctccagaagaagagaaggaaaaagagagaaatcagaaatcgttattcttgtctcccttgctaccagcagcaatcttgcagcatcattcttcaggatcaggattatcaaacgtaatccttaaggtcaaagaaaaattctttgctttcttgctctttgcactgagttatcaaaacaagacaactacttgggtgttgcaggtcaaagaaaaattctttgctttcttgctctttgcactgagttatcaaaacaagacaactacttgggtgttgcaggtgaaagaaacattctttgctttcttgctctttgtactgagttatcaaaacaactctgtggaggatgatgctaccaagtaccttctttgctttcttgctctttgcactgagttgcttcagatggctggaatatgcagaatcaaaactaccccaagtggagggtaa

SEQ ID NO: 494 - DNA, 195 bp, Glycine Max
atggtgaaagtggcgacgtacttcgcgatgacgcttggagccttcgtgttctggcagtccatggacaaactccatgtctggatcgctcttcgtcaagacgaaaagaaagagaggttggagaaggaagcggagatcagaagggttagagaagaattattgcagcagcaggccagtcagaaggattctctttcttga

SEQ ID NO: 495 - DNA, 2064 bp, Glycine Max
atggtgatctgttataaacagctgggagaatatcatttctttcttgttttgcttctcatttcagtccaatgcgttattgccgcaaataacattttgaagcccggagatacactgaatacgagaagccagctatgttcagaaaacaacatatactgcatggatttttccccattaaacacaaatcctattgtaaactacactcacttaagcatcagtgacaacagaaaggacgataattccgcagtgtgggttgctaatagaaatcaacccgttgacaagcattctgcagttctgatgctaaaccactctggtgtactcaaaattgaatcatccaaagatgccaaacccatcatccttttttcttcacctcaaccactgaacaacaacaacaccgaagccaagctgttggatacaggtaactttgtggtgcaacaacttcaccccaatggaacaaacactgtgttgtggcaaagttttgattaccctactgatactcttctccctgggatgaagttaggagttaatcacaaaactggtcataactggtcacttgtttcgtggttggctgtatccgaccccagaatcggggcattcaggttcgagtgggaacccataagaagagaattgatcatcaaggaacgaggaagattgtcctggacaagtggagaactcagaaacaacaatggatccattcacaacaccaagtacacgattgtctcaaacgacgacgaaagctacttcacaattacaacaacaagcatagcggtgatgcatttgaaaccagggaagtttactgattgccgggatatttgctgggaaaattgtgcttgtaatggatacagaaattactatgatggtggaactgatctggaatcacatttacataactacttatattggatatggataactgtagcagtagttgttccatttgtgatatgtgctttcattctatttctggccttgaagaaaagaaaacatctgtttgaagagaagaaaagaaatagaatggagactgggatgttggattcggcaattaaagatcttgaagatgagttcaagaagagacaaaatctaaaagtatttaagtatacttcagtactgtcggcaaccaatgatttttcaccagaaaacaagttaggacaaggaggctttggaccagtttataagggaatcctaccaactgggcaagaagctgctattaaaagactttcaaaaacatctagacaaggggttgtggaattcaaaaatgagctaatgctcatatgtgaacttcaacacatgaatcttgtacaactacttggatgctgcattcatgaagaagagaggattctaatttatgagtatatgccaaacaaaagcttggatttctatctattcgaagattgcactcgaagcaagttactagattggaagaagcgtttcaacataatagaaggaatttctcaaggattactctatcttcacaagtactcgagactcaaagtcattcacagagacttaaaagctagtaacatacttcttgatgagaatatgaatccaaaaatttctgattttggattggcaagaatgtttgaggaacaagaatctacaacaactacgagtaggatcattgggacatatggttatatgtctcctgagtatgctatggaaggaattgtttctgtaaagtctgatgtttatagctttggagtgttggtccttgaaattattagtgggagaagaaatactagcttcaatgacgaccgcccgatgaatttgataggacatgcatgggagttatggaatcaaggtgtgcctctacaattaatggatccatcgcttaatgatttgtttgatctcaatgaagtgacaagatgcattcacattggtctcatatgcgtagaaaaatatgcaaatgatcgacccacaatgtctcaaataatttcaatgttaacaaatgaaagtgtagtagttcccttgcctcgaaaaccagcattctatgtggaaagagaaattttactcagaaaagcatcttccaaagagttatgtacaaactctactgatgaaattactattacctag

SEQ ID NO: 496 - DNA, 216 bp, Glycine Max
atggtgccatgtgcgaccctgcaagcaatacaagcgggtttatcaagtgtgctgatccccattactccatccgtacaccccacaataaaaatgtggttttgttttaagaaaaaaagaaagggggtttgcattctcaggaagcaaacacagcctacgtgtcgtgcatcttcttattggctgttcgtggggttgctttctctttattttttttcataa

SEQ ID NO: 497 - DNA, 1170 bp, Glycine Max
atggtggagattcacgaagaaatcaacccctttgatcaagaagaaaatgaagacattggagaggaagaaatcgactatgaccagcttaagaagcggatgtggaaggatcggatactgctgcagaagatgaaggagaaacggcccaaagaagagccagtccaagaagcaaaacaagaagcatctaggcggaagaagatgtcaagagcgcaagactcggtcctcaagtacatgatgaagattatggaagtttgcaatgctcaaggttttgtgtatgggattgtccctgagaagggaaagccagtgactggttcttctgacagcttgcgtgagtggtggaaagaaaaggtaaagtttgatcaaaacgcaccaagttccattgcagaatacttgccactccttgaaacagatgagttggatccaagttcctacatacatctccttaacgacttgcaagacactactttgagttcactactttctgctctgatgcaacattgcatacctccccaaagaagattccctcttgagagaggcttggctccaccttggtggcccacaggggcagagaattggtggggtgaacaaggccttctggcccatgaacatggcccacctccttataagaagccccatgacctcaaaaaggcttggaaagtgtctctcttggctgcagtcatcaaacacatgtctcctgatttgtataaacttagaaggtcggtgactcagtccaagactttgcaagataagatgacaaccagggacacggcaacttggtccaaggtcatgaaccaggaagaaactctgctgcaactggccaacaagtgcctcaaaatatctccatcagaggaagatgataaaaatgagtgtgaaagctctactagtagcagtactatcatccatgaagggagtcatttagatgctgttattgataagctatatgcttgccaatactatcagtgtccacaaagtgaaatgggtatgggatttcttgacaaaaacacaagaatgaaccatgagtccctctgtgcttaccggactaatgaaggccaacgccctacaaatattaagttcctcgccccatgcttggatcaattgtgcactgctataaagtgttgtcaacaattttttatttacctatctttattaaaaactgaaaagccatctagctag

SEQ ID NO: 498 - DNA, 129 bp, Glycine Max
atggtggcagtggttggccacggagttgccagccctctcaagtctgcatcttgggaacaagtcatgcttcacactgttacgtaccctctcaaattttctttccttcagttattatatcaaattcaatga

SEQ ID NO: 499 - DNA, 3423 bp, Glycine Max
atggtgtattacaaaatatcacatgttgatggtcgtataactaatccggaacaaagaattgccagtgatgtgccaaggttctgttcagagttgagtgagattgtacaggatgatctaactgcggtcactgatggactgctatacacttggcggctgtgttcgtatgcaagccctaaatatatcttctggatattggcctatgtactcggagctggggctgctatccgaaacttctctcctgcatttggtaaacttatgtccagagagcaggaattggaaggagggtatcgacagcttcactcacggttaaggactcactcggaaagtatagcattttatggtggagagaagagagaagaagctcatattcagcagaagtttaggaccttagttagacatattaatagagtgctacatgaccattggtggtttggcatgattcaggattttttattgaagtaccttggtgctactgttgctgttattttgatcattgaacctttcttttctggccatctaaggcctgacagttcaactttagggcgtgcagagatgctaagcaatctaagatatcatactagtgtcattatttccctatttcaatctctaggaactctttctatcagtgcaagacggctcaaccgactcagtggttatgctgatcgcattcatgagttaatggccatatcaagagagctaagcctggagaatgggaaatcttcactgcaaagacaaggaagtagaaattgcataagtgaagctaactatgttggattttatggtgttgtgacccccaccggtaatgtattagtgaatgatctgacccttaaggttgagtcaggatcaaatcttttgattacaggtccaaatggcagtggaaagagctcgttattccgggttttaggaggtctttggcccttggtatctggacatattgtgaaacctggagttggatctgatcttaataaggaaatcttttatgtgccacaaagaccatatactgctgtaggaacacttcgtgatcagttaatttaccctcttactgttgatcaagaggttgagccacttacagatagcaggatggttgatcttgagtatctattggatcggtacccgcctgaaaaagaggtaaactggggtgatgaactttcattgggtgagcaacaacgattgggcatggccagacttttttaccataagcctaaatttgccattcttgatgagtgcacaagtgctgtcacaactgatatggaagaacggttttgtgctaatgttctggctatgggaacatcatgtattaccatatcacatcgtccagcattagttgcattccatgatgtggttttgtctttagatggtgagggaggatggagtgttcatcatagaagagaggactcttctactgaattggggaatgatatgatgaaggcttcggagaccaaaagacagagtgatgccaaggctgttcaacgagcatttgctatgaacaaaaaggattctgcattcttaaattcaaaggcacaatctgatatttcagaagtgataatagcatcatctccgtctatgaagcgtaatatttcaccatctgctgtaccccaacttcatggtaatacaagggcattgccaatgagagtagctgccatgtgcaaagtattggtgcccaccatatttgataaacaaggagcacgattacttgctgttgtttttcttgttgtttcaaggacatgggtctcagatcgtattgcatcactgaatggtactactgtgaagcttgttttggagcaggataaagcttcctttattcgattaattggtttaagtgttcttcaaagtgctgcgtcttctttcattgcaccttctataagacacttgactgcaaggctagcccttggggggcggactcatttgacgcaacatctactcaagaactacttaagaaacaatgcattctacaaggtattccacatggcaagcaaaaacattgacgctgatcagaggataactcatgacttggagaagttaacaacagacttgtcaggactggtcactggaatggtaaagccatctgtggatattttgtggttcacttggagaatgaagatgttaacaggtcggaggggagttgccatactctatgcttacatgttgcttggtttgggatttctaagaactgttactccagattttggtaatttgattagtcaagaacaacaacttgaaggaacatttaggttcatgcatgaaagactttgtactcatgctgaatctgttgctttctttgggggtggtgctcgagaaaaagctatggtcgagtctagattcagggagcttctcacccactccgagtaccttttaaaaaagaagtggctgtttggcatcctggatgattttatcacaaagcaacttccacataatgtgacttggggcttgagcttaatatatgccatggaacacaagggagaccgtgcatcagtaactactcagggtgagctagcacatgcactgaggtttttggcatctgttgtttctcaaagctttttagctttcggtgatattcttgaattgaataaaaagtttgtagagctctctggtggaattaatcgtatttttgagcttgaagaacttctagatgcagcacaatctgagaatttcacgagtgttagtgctatacctccaatgagggatgttcattccagtgatgtaatttccttctcaaaagttgatatcataacccctgctcaaaagatgttggtgagggagttaatatgtgacattaagcgtgggggaagcctacttgttactggtccaaatggaagtggaaaaagttccattttcagagttcttagaggactctggccaattgccagtggaagactctctagaccatctgaagttgtggatgaagaggatggatctggttgtggcatcttctatgttcctcaacggccatatacatgtttgggaaccctaagggatcaaattatatatcccctttcccgtgaggaagcagaggttaaagcactgaagatgtatgggaaaggtgaaaagcatgctgacaccagaaatttgttggacacacggttaaaagttatcctagagagtgttcggttgaattatcttctagaaagggagggtagcaactgggatgccaatttaaaatgggaagacattctttctcttggagaacagcaaagattggggatggcacgcttgttctttcacgagcccaaattcggtatccttgacgagtgcaccaatgcaactagtgttgatgttgaagaacacctatacgggcttgcaaaagatatgggaatcacggttgttacttcctcacaacgtcctgctttaataccatttcattccatggaattgcggctgattgatggtgaaggtaattggaagcttcgattgatcgagcaatga

SEQ ID NO: 500 - DNA, 348 bp, Glycine Max
atggtgtggaacagcatggtggtgttgagagtggcacgtgcctcagcggaagcgtggcaatgcattgcggagcctctgaacagtgagcagatattggatctgttacaagtgtgcttattaacaagtacagaaacacgaatggtcaagggaataccattcgtgggagcattagttcaattgccattacactatagttattttcttttagataacaaaaacatcttttgccaccactactacattgctgccactcaataccacgacacgagatcctcaattgcagtctctggtttctcactcagtcccttatctgatgatgaaagctttttcttttctttttcagaataa

SEQ ID NO: 501 - DNA, 1257 bp, Glycine Max
atggttagagacgatctatgcatcaccgttcccagcttcttccgctgccctatctccctcgacgtcatgaaatcccctgtcagcctctgcaccggcgttacctacgaccgttccagcatccaacgctggctcgacaacggcaacaacacctgtcccgccaccatgcaggttctccaaaccactgatttcgttcccaaccgaaccttacagaggctcatccagatctggtctgactcggtcactcaccgagtcgactcgcccgactcacctacctccaccgagtcccaatcactcctctccaaggaccacatcctcgtcgccatctccgatttgcacactcgcagcgacaatcggttcaactcgctctcgaaaattgctcgtttcgcacaagattccgaggagaaccgcgattttctcgtcagaacggaatgcttcgtgccggtgctggttggcttcctcgacaatgtcaatggcggcgtcgaatttctccaacaggttgttacggcgttggatttggttatcagcaaaatggaagatcgcgaggggatgaaaaacttgatactgaagaggcaaggcgagggagaaaaacagagcgtggattctctgcttctggttctgcaacaaggaagccatgcctcaaaaatcgcatcggctagggttttgaaatcagtcgccgtagacgcggaatcgaagctgctgttagcggagaaggaaggtttagtatccgaattgctgaatctaatcacgccggagaaagatcctgatcttattgagaactgtttatcgtgtctggtttcaatttcgacgccgagacggagcaagatgaagctggtgcgtctcggagcggtgaaggtgttctcgaaccttctttcggctccgggcctgagcgtgtcggtgaaggagaaggtgctgaagctggtggaaacggtgtcgtctacgaaggaagggaggtcggagatttgcgaggattcggcgtgcgtttcggcgatagtggacaaggtgctgaaagtgtcgagcgtggcgacggaacacgccgttacgacgctgtggagtgtgtgttatctgtttagggatcagaaggcgcaagaggccgttaccaaggctaacggattgaccaagattctgcttctgatgcagagcaattgctcaccgcaagtgcgtcaaatgtcttcggatttgcttaagatatttcgggttaattctaagtcgtgtctttcttcttatgacaccaaaaccactcatattatgcccttttga

SEQ ID NO: 502 - DNA, 1347 bp, Glycine Max
atggttccatacccaagtcagggtcacataaacccaatgctccaattcagcaagcgcttgagcaccaaaggagtgagagtcactatggtcacaaccattttcatttccaagtccatgcatcttcaatcttcttccttgttaggaaatgttcaacttgatttcatatcagatggctgtgatcaaggtggttttggtcaagctggtagtgtgtcaacctatttatctcgcatgcaagaaataggttccaataacttgagggaactcataaaaaaatacaactcttcagatcaccctattgattgtgtggtatatgaccctttggttatatgggtattggatgtagccaaagaatttgggttatttggagctgcttttttcactcaaatgtgtgcagtcaattacatatattatcatgtctaccatggacttcttaaggtccccatttcatcacctccaatctctattcaagggcttcctttgcttgatctaagagacacaccagcctttgtttatgatcctggattctatccagcttactttgacttggtcatgaatcaattttctaacatccacaaagcagatatcattcttgtcaattccttctacaagctggaggagcaggtggtggattccatgtcaaagctatgtccaatattgatgattgggccaacagttccatcctttcacttggacaaggcagtcccaaatgacacagacaatgttttgaatctctttcaagtagattcatcagccattagttggctgagacaaaagcctgcagggtcagttatttacatatcatttggcagcatggtgtgcttcagctcacagcagatggaggaaatagcattgggcctaatggcaactggcttcaacttcttgtgggtcatccctgatttggaaagaaagaatctcccaaaagagttgggggaggaaattaatgcatgtggaaggggtttgatagttaattggaccccacaattggaagtgctatcaaatcatgctgtcggttgttttttcacacactgtggatggaattcaacacttgaagcattgtgcttaggggtgccaatggttgcactgccacagtggactgaccagcccacaaatgcaaaatttgttgaggatgtatggaaagtgggaatcagagtcaaagagaatgagaatgggattgtaacaagagaagaggttgagaattgcatcagggtagtaatggaaaaggacctaggaagagaaatgagaattaatgctaagaaatggaaggaattggctatagaagcagtgagtcagggtggtacttcagacaacaacatcaatgaatttataaataatctgaaaagatcctaa

SEQ ID NO: 503 - DNA, 2547 bp, Glycine Max
atggttctaataccttcctcgtgtcaaagtgatgcaactacaactgtgtacattgttactctgagacaagctcctgcttctcactatcatcaacatgagttgatcacagtgggcaacaactctagacatggttcatctgggagaagaagaactagagttcacaaaccaagacatcagaatgttacaaagccagataggaaacgtggttcatacttttcccgagttcacgactcgttgttgaataaagtgtttaatggggagaaatatctgaagctctatagctaccattatttgattaatggatttgctgtgctggttacccaacaacaggcagaaaaactgtcaaggagaagagaagtgtccaatgtggttttggatttttctgtgaggactgcaaccacacacactccacaatttttgggtctgccacagggagcttggtcgcaagcaggtgggtttgaaactgctggagaaggaatcaccattgggtttgttgacactggcattgatcctacacatcctagttttgctgacgataaatctgaacatccattccccgttcctgctcatttctctggcatctgcgaggttactccggattttccgtcccgttcttgcaataggaagcttgttggggctagacattttgctgcttctgctataaccagaggaatatttaactcatctcaggactatgcttctccctttgatggcgatggccacggcacgcatacagcttctgttgcagctggaaaccatggaattccagtggtcgttgctgggcaattttttggaaatgctagtgggatggctcctcattcacacattgccatttacaaggcactatacaagagatttggaggatttgcagcggatgttgttgcagctattgaccaggcagctcaggatagggttgacataatatgcttgtcaatcactcctaataggcgtccttctggtattgcaactttcttcaatccaatagatatggcattgctatcagctgcgaaagctggtatttttgtagtgcaagctgctggcaatactggaccatcacctatgagcatgtcctccttcagtccatggatctttactgttggtgccacctctcatgatcgagtttatatcaactccctatgtcttggaaataatgtgactatacctggtgttggacttgcacatgggaaagtaattactttatatatggcttattattttattcttttaacaagaaagtcacactctagcattaatactcacattgtcgtgcttcttctgcacgacttgcctggtttacatgctttgaacaaaaacacaacagttactgatgatatgtatattggtgagtgtcaagattcaagtaagttcagtcaggatttggtccagggcaacctcctgatctgtagctattcagtccaatttgtgcttgggctctccaccattcagcaggccttagaaacagccatgaatcttagtgcagttggtgttgttttctccatggatccttttgtgacttcttttcagcttaacccagttccaatgaaaatgcctggcataataattccatctgcaaatgattccaagatattactgcaatactacaattcttcactgcaaatagatggggattcaaataaaattgttaaatttggggctgttgctagtattggtggtggattagaagcgaactgcaataatgaggccccaatggttgtgtattactctgccagaggaccagatccagaggacagtcttcctcatgaagctgacattatgaaacccaatttggtagctcctggaaattttatatgggctgcttggagttctgttgccactgattctgttgaatttctaggtgagaattttgcaatgatgtctggcacaagcatggctgcacctcatgttgctggtcttgctgcactagttaagcaaaagtttcccaactttagtcctgcagccattggatctgcactttccactacagcttctctgtatgacaacaataggaggccgataatggctcagcgatcctatccctccatagaccttaacctatctccagcaactccctttgacatgggaagtggttttgtgaatgcaactgcagcattaaatccaggattgctttttgattctggttatgatgattacatgtcattcctatgtggtatcaacggttcaactcctacagtgctaaactacactggtcaaaattgctggacttataattcaacactatatggccctgatctgaacttgccctcaatcacaatagcaaggttgaaccaatctagagtagtacaaagaacaatccaaaacattgctggaaatgaaacttacaatgttggttggagtgctccatatggaacttctatgaaagtgtttcctaatcacttctctcttgccagtggggagagactagtcttgtctgtgatcttcaatgcaaccagcaacagttctgctgccagctatgggagaattgggctgtatggtaatcaaggtcatgttgtcaacattcctgtggcagtcatttttaaaatcttataa

SEQ ID NO: 504 - DNA, 948 bp, Glycine Max
atggttgataatagagaagagcaaagagaggggccactcactgtgagagaaacacagccaagcatagaagacagaaaaagaggagagagaaacagcggcaaagacagacccaaggcgatgagaaaactgcacatcatttgcaacgatcctgatgctactgattcatccgaagatgagttggagaggattcagaacccgagaagagtaaaaagaagtgcatgtgagatccctcttcctcacacattcaccactcctgaaatgagggttagcactaaagatcaaccccaaagtaagaagagggctttgactcataccccatcagcgaggaggaacacttctaggaaatatagaggtgttaggcagagaaaatggggaaaatgggccgctgagatatataacccatttcagagtactcgtatatggataggcactttcagcactgcagaagaggcttcccaagcctatgaggccagaaggcttgagtttgaagctatggcaaaggctcaagcttacaaaactggttctcgttctgctgctgaacctttggctacaacttctgagaagagtaactgccgtaactcctcttctgctgctgctgcagttgatgtgtctgtatctgagaaggtttctactacttctgatgactcagacaaaaagctagagataccagatttgaatctgttgaacttgccgccaccaccatctgctgctgttccatctgagattgagccaaactttgggcttgattttgattggctatcgttcgatgattatggacagggttttgatgattttggtggcttggaagatattcatatttgtgggtttgatgacaatgagcctagtgagcttcctgatttcgattttgctagagcagtgagatggggggagaatcctttgggttttcccgtgctgttacagagacatccaagggatctcaaacaatga

SEQ ID NO: 505 - DNA, 357 bp, Glycine Max
atggttggtgtgcttccaaagagaataatactcatgcgggatagagagtcgcagggaagcaggatatggcaacgtacaccaccacacctgaccacaacattcagtcaaagacgcaaggcatggcctaagccctctgcgccgacgagcacctccaccaagaggatcatcgacttgagggaagagttgcgggttcgagaacatgattttgagaactttcaggtggaagaaagaatggaggtgataaaggaaacacacgaacattttgaaagattcttttatcaagaagagaatttcaatttctcaccttttagaagaaaattaaaattccacatttttaagacatcccctggagagcaa

SEQ ID NO: 506 - DNA, 717 bp, Glycine Max
atggtttggacattggatccttctgagcgtgatgcctttttagcaaatgaagccactaagatgttgacttcaaacaattgggtcattttggaaattgcttccactagatcttcacttgacctcctaaaggcaaaacaagcatatcaagcccgtttcaaaaagtcccttgaagaagacgttgcctatcatactaaaggggacatccgcaagctattggttcctcttgtgagcacattccgttatgagggggatgaggtgaacatgacattggcaaaatctgaggctaaactgcttcaccagaagattgcagagaaggcctacaacgacgaggacctgatcaggattttgtcaacaaggagtaaagcacagttaacagcgacactaaatcagtacaacaatgagttcgggaatgccataaacaaggatctgaaaactgatccaaaagatgaatatctgcaattattgagggcagccattaagtgcttgacttaccctgagaaatattttgcaaaagtcttgaggctggctataaacaagctaggaactgatgaaggggcccttactagagtggtgacaaccagagctgaggttgatttgcagcgaattgctgaggaataccaaagaagaaacagcattcctctggaccgcgcaatagccagtgacacttctggagactatcagagcattctccttgcactggttggacatgaggattaa

SEQ ID NO: 507 - DNA, 234 bp, Glycine Max
atggtttttcataggagacctctgattctagttatcatgtggttgttcttgtttctcttcttattgggtcactgccatggttctagagccacaacaaccgtcttcaaattcaagcccaaatcacaacatcatggccacttctctgggttcttgcctaaaaggatgcctataccgtattcaactccttcaaggaaacacaatgacattggcttaagaagttggagatcaccctga

SEQ ID NO: 508 - DNA, 1563 bp, Glycine Max
atgtacaagagattaaagacaagagagaccaataaaaacatgataaaggcaatgcttcaaattaagcataggaacatcatagcactaaaaggactaagtaagattttcaattttggaaacagctctctgtatctaaagagacataatggctgtgcatgtactatcacaaaggtgggatgtgaaatgggttgctggaaagtctccgctaagaacacaaccttagaatccaatgagaccacaggggttggtaccggttattatgctaaagtattttacaaacacacttggccgagcatggaatatgggtggaaaataatagtgggcaccatggttggattcctaggatcagcatttgggaatgtgggaggtgttggtgggggtggcatctttgtgcccatgctaaccctcattattggatttgatgcaaaatcagcaatagcaatatcaaaatgcatgattacgggtggagcaacagcaactgttttctacaatttgaggcaaagacaccccacccttgatttgcctgtgattgactatgacttggctcttctttttcaaccaatgttgatgcttggaatcagtattggagtttctttcaatgtgatttttcctgactggatgctaacaaccttgttaataatattttttaccggaatttcagttaaatccttctttaagggtgttgacacatggaaacaagaaacccttatcgtgaaggaagctaggaagaattcacagattgatggtaggggcggatctacatgtataacaactaatcaattgtcctcacaaaatattggaagtcctgaagatgctgcacattatattcaaacaggagacccggtcaaggacaataccaatcaatcaaggaaaaaagtttctgtcattgagaatattcattggaatgaacttggacttcttttcgctgtctggatcatgatacttgcattagagattggaaaaaattacacaacaacttgctctggagtatattgggtgatcaatctactgcaggtccccatagctgtagggatgagttcataccaggctatgcgactatacaaagggcagagaatcataggatccaagggagatcaacaaacaaattggcgagtgttgcagttaattctattttgtgcttgtggcatacttgccggcacgattgctggtttgttaggccttggtggaggattcatcttggcacccctttttcttggaataggaatccctcctcaggtggctagtgctacatccattttggcaatggcattttctgcatctatggcagtggtggaatattaccttctcaaacgtttcccaatttcttatgctctttactttgtagctgtagccactgctgctgcacttgttgggcagcatttggtgagaaaggtgattgccatattggggagagcatctgtgatcattttcatcttaactctcacactttgtgttagtgcagttttactaggtggagtaggcgttgcaaacatgatcaagaggattgaaaataaggagtacatggggtttggaaacctttgcacgtacaaggttcaaaaataa

SEQ ID NO: 509 - DNA, 1668 bp, Glycine Max
atgtatcagagcagcattggcgcacaccgcctcgcataccgctctcaaatatcaaaactggtcaaagccggtctcatcaaccaagccatctacctgttcgaccaaatgaccgaatcaaattgccgcgtcttcagcgtcgactacaaccgcttcattggcgtcctcctccgccactcccgcctccatctcgcccaccactactaccgccgccacgtcatcccccgcggcttttccctcctccccttcacctactcccgcttcatctccgccctctgctccgcccccaacaacattaacctccccctcatccacagcctcctcctcgacatggactccctcggtttcgtccccgacatttgggccttcaacacttacctcaacctcttatgccgccaaaatcgcttagaaaccgccctcgaactcttccactccatgccctccaagggaagagaccccgacgtcgtttcctacaccatcatcattgacgcgctgtgcaatgctaaacgctttgacgaggctgctaaggtttggcgtcgtttgattgacaaagggttaagccctgattataaagcctgtgttgctcttgttgttgggttgtgcagtggagggcgcgttgatttggcttatgagcttgttgttggtgtgatcaagggtggggtgaaggttaatagcttagtttataatgctttgattgatgggttttgtaggatggggagggttgacaaggccatgaagattaaggcgtttatgagccgcaccgggtgtgtgccggatttggttacttataacatactcttgaattactgttgtgaggaagggatggtggatgaggccgtgaggttggtggagaccatggagaggagcggggtggagccggatttgtatagctataatgagctcttgaagggtttttgcaaggcgaatatggtggacagggctcatttgatgatggtggagaggatgcagacaaaagggatgtgtgatgttgtttcgtataataccgttattacggcgttctgtaaggcgcgccggactaggaagggttatgagttgtttgaggagatgtgtgggaaggggattaggccagacatggtgacatttaatatacttatagatgcgtttctgagggaaggaagtacccatgtggtgaagaagctgcttgatgaaatgacaaagatgcgtgttcttcccgattgtatattctatacagcagtagttgatcatctgtgtaagaatgggaaggttgatgtggctcatagtgtttttcgtgacatggtggagaatggggttaatccagatgttatctcttacaatgcacttctaaatgggttttgtaagacttctagagttatggatgccatgcatctatttgatgaaatgcagagcaaaggtttgtaccctgatgaggtaacttacaagttgatagttggagggcttataaggggaaaaaagatttcactggcctgtagggtatgggatcagatgatggagagaggctttacacttaacagacatctctctgagactctagtcaatgccattcaatcaagtaatgacgcctgtaaatcaagttatcctatttttatgacgctcgtggtgcaatcccataccttttatgtgtctctgccagcttcttgtaaaggatccatacagagggaagtgctgtaa

SEQ ID NO: 510 - DNA, 1566 bp, Glycine Max
atgtatcagagcagcattggcgcacaccgcctcgcataccgctctcaaatatcaaaactggtcaaagccggtctcatcaaccaagccatctacctgttcgaccaaatgaccgaatcaaattgccgcgtcttcagcgtcgactacaaccgcttcattggcgtcctcctccgccactcccgcctccatctcgcccaccactactaccgccgccacgtcatcccccgcggcttttccctcctccccttcacctactcccgcttcatctccgccctctgctccgcccccaacaacattaacctccccctcatccacagcctcctcctcgacatggactccctcggtttcgtccccgacatttgggccttcaacacttacctcaacctcttatgccgccaaaatcgcttagaaaccgccctcgaactcttccactccatgccctccaagggaagagaccccgacgtcgtttcctacaccatcatcattgacgcgctgtgcaatgctaaacgctttgacgaggctgctaaggtttggcgtcgtttgattgacaaagggttaagccctgattataaagcctgtgttgctcttgttgttgggttgtgcagtggagggcgcgttgatttggcttatgagcttgttgttggtgtgatcaagggtggggtgaaggttaatagcttagtttataatgctttgattgatgggttttgtaggatggggagggttgacaaggccatgaagattaaggcgtttatgagccgcaccgggtgtgtgccggatttggttacttataacatactcttgaattactgttgtgaggaagggatggtggatgaggccgtgaggttggtggagaccatggagaggagcggggtggagccggatttgtatagctataatgagctcttgaagggtttttgcaaggcgaatatggtggacagggctcatttgatgatggtggagaggatgcagacaaaagggatgtgtgatgttgtttcgtataataccgttattacggcgttctgtaaggcgcgccggactaggaagggttatgagttgtttgaggagatgtgtgggaaggggattaggccagacatggtgacatttaatatacttatagatgcgtttctgagggaaggaagtacccatgtggtgaagaagctgcttgatgaaatgacaaagatgcgtgttcttcccgattgtatattctatacagcagtagttgatcatctgtgtaagaatgggaaggttgatgtggctcatagtgtttttcgtgacatggtggagaatggggttaatccagatgttatctcttacaatgcacttctaaatgggttttgtaagacttctagagttatggatgccatgcatctatttgatgaaatgcagagcaaaggtttgtaccctgatgaggtaacttacaagttgatagttggagggcttataaggggaaaaaagatttcactggcctgtagggtatgggatcagatgatggagagaggctttacacttaacagacatctctctgagactctagtcaatgccattcaatcaagtgatggcacaacatga

SEQ ID NO: 511 - DNA, 696 bp, Glycine Max
atgtatgcttcaacttcctttacttcacaaatggtccatgaccttctcatggacacaaactcaagaaagttactccttcaagatccacttcttcaccaatcaatgaactcagccaactccccagatgccatgagttacaacacaacagactcatacttcaaaggtcgcgacttcgatgcaaatgttgtcatgatactctcggtcctgttatgtgctgttatttgctcactcgggttgaactccatcataaagtgtgtcctaagatgttcaaacatagtcatcaataacaatgacccttcttcttcaagtgtgagctacaacaacccttcaccgagattggccaacacaggaatcaagaagaaagccctcaagacttttcctactgtgagctactcaacagagatgaaacttcccggtttggacacagagtgtgtgatttgcctctcggagtttgccaatggtgataaagtgcgcattttgccaaagtgcaaccatggtttccacgttcgctgcattgacaagtggctaagttcacactcatcatgccccaagtgcagacagtgcctcattgagacatgtaagaaaattgttggatcccaaatacaaccagtgccacctgtgccagaaagtaccattataaggatccaaccactagaacctgaaggtctggagcgtaactatagagaagtatgttag

SEQ ID NO: 512 - DNA, 1311 bp, Glycine Max
atgtatgtatgtgaattatgtttctcacttctcaggggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggttccaccgagtacgccagtggttaatgcactgtcaaagcagcgagctatgctggaaaacatcctaagggcttgtgttggattagctcctgagaacaacatgatcctggagtacaagtga

SEQ ID NO: 513 - DNA, 1775 bp, Glycine Max
atgtatgtggtgaagagagataggagacaagagacggtgcattttgataaaatcaccgcgcgtctcaagaaacttagttacggtttaagcgcccaacactatgaccccattcttctcttctcctgcattttgatgtggttgaattgtcgtttacaatggttaaattgtgactgtttcgtgattaaggttatgtattaccattttaatgagaggtatgcgatgaaggctcctctgattgttgatgacatctatgaaattatcatcaagaatgttgctcgattggacagtgagataatctatgatagagactttgactatgattactttggtttcaaaacccttgagaggtcatacatcctgaaggttcaaggaaaggttgtggaaaggcctcagcacatgttgatgagggttgttgttggaattcataaggatgacattgattctgctgtcagaacttaccacatgatgtctcagagatggtttactcatgcatctccaacacttttcaatacagaacacctaggcctcagattaatatggcgaccttatgtagttggatctgtttatggaatatatgacactttgaaggagtgtgttgtcattagcaaatcagcaggaggaattggtgttagtattcacaacattcatgccacaggcagttacatttgtgccacacctgggacatcaaatggtattgttccaatgctgcgtgtgttcaatgatactgctcgctatgttgatcaggggggaggtaagaggaaaggaagagcaacgtgctcgagatttttttctatgctctttgggtgtctgatatctttatggaaagagttcagagcaatgggcaatggtctttgttttgccccaatgaagtgccagaatttgagaaactctacactcagtatgaaagagaacaaagaaggttgttcaggcacagaatctctctggtttgaaattttgaagtcccagatagaaactggaactccttacatattttttaaggacacttgcaataggaaaagcaaccaacagaatttgggcacaatcaatccaacagaaacggctgtgtgcaacttggcatcaattgctctgccgcaatatgtaagagagaagctagatcaacttgttcttcctgatttaggatgctcaaaaaatcgatattttgactttgataaactggaagaggttactgcaatggtgacaacaaacctcaataaaataattgatgttaattactacccagttgatactgcatttgtggaactgctttttgatctacaatttaagctagatgctcagcagttgaacaaggatatatttcagactatatactatcatgcactaaaaacttcatctgaattggctgcaaaagaaggtccctatgaaacatttagtggtagtcctataagcaagggaattcttcagccagacatgatgggtgtgatggcctcgagtcgttgggataggggtgcactttggaagatgatatcaaagacgggtgtgagaaactcacttcttgttgcccctatgccaactgcatcaactagccagattcttggcaataatgagtgttttgagccatatacttctaatatctacagtcgtagacatttacttcatgacttgacacaatcaagaataatattatctctgaggatgatgttttatgctaaactcagtttgaaattaggatgctacatagaccagagtcagagcttgaatattcacatggatcaacccaactttggaaagttgacttctttgcatttctatgcatg

SEQ ID NO: 514 - DNA, 708 bp, Glycine Max
atgtcaacaacttcccatcccattgttcaccacagcttattcgatgagcaggaccagatacctacacagatgggtttcttttcctttccaacaaaccttactttccctcctttgggttgccatcaatcctctttgaaagcctttagttccatagcaccttcttcacttgctatatctcaacaagattctgcatcaaatctaacagcagaaaccctattctcaaccactgctcaaaagtcaagagaagacctcacttctagctttggaggaggtcaattcctatccttgcatagatcaagtgtaaatccatgggcattgggagaagtggctgaatgcttcagcagtaaaagaagtggatttgatgatcatcatttccgaatttcagccatgaagatgaagaaaatcaaggcaagaaggaaggtgagagagcctaggttttgcttcaagaccatgagcgatgtggatgtattggacgatggctacaagtggaggaagtacggacagaaagttgtgaagaacacgcagcaccccagaagctattaccgttgcacacaagataattgtcgtgtaaagaaacgcgtggaacgcttagccgaggatccaaggatggtgataaccacatatgaagggagacatgttcactctccatcaaatgatctcgaagactctcaaactccatctcaacttgatagcttcttattatggtag

SEQ ID NO: 515 - DNA, 705 bp, Glycine Max
atgtcaacaacttcccatcccattgttcaccacagcttattcgatgagcaggaccagatacctacacagatgggtttcttttcctttccaacaaaccttactttccctcctttgggttgccatcaatcctctttgaaagcctttagttccatagcaccttcttcacttgctatatctcaacaagattctgcatcaaatctaacagcagaaaccctattctcaaccactgctcaaaagtcaagagaagacctcacttctagctttggaggaggtcaattcctatccttgcatagatcaagtgtaaatccatgggcattgggagaagtggctgaatgcttcagcagtaaaagaagtggatttgatgatcatcatttccgaatttcagccatgaagatgaagaaaatcaaggcaagaaggaaggtgagagagcctaggttttgcttcaagaccatgagcgatgtggatgtattggacgatggctacaagtggaggaagtacggacagaaagttgtgaagaacacgcagcaccccagctattaccgttgcacacaagataattgtcgtgtaaagaaacgcgtggaacgcttagccgaggatccaaggatggtgataaccacatatgaagggagacatgttcactctccatcaaatgatctcgaagactctcaaactccatctcaacttgatagcttcttattatggtag

SEQ ID NO: 516 - DNA, 543 bp, Glycine Max
atgtcaacaacttcccatcccattgttcaccacagcttattcgatgagcaggaccagatacctacacagatgggtttcttttcctttccaacaaaccttactttccctcctttgggttgccatcaatcctctttgaaagcctttagttccatagcaccttcttcacttgctatatctcaacaagattctgcatcaaatctaacagcagaaaccctattctcaaccactgctcaaaagtcaagagaagacctcacttctagctttggaggaggtcaattcctatccttgcatagatcaagtgtaaatccatgggcattgggagaagtggctgaatgcttcagcagtaaaagaagtggatttgatgatcatcatttccgaatttcagccatgaagatgaagaaaatcaaggcaagaaggaaggtgagagagcctaggttttgcttcaagaccatgagcgatgtggatgtattggacgatggctacaagtggaggaagtacggacagaaagttgtgaagaacacgcagcaccccaggtatatctga

SEQ ID NO: 517 - DNA, 660 bp, Glycine Max
atgtcaagaatggcaatgcgtgtgtctccttcagcttcaagtgcactctctctcctaaactgcaagcaaccacctccagtttcatgcatccgtgtaccttgtctctctcgctcctcgccgccatcgctctcctacaccttcaatcctcttagaaggtccttcatcggtcacggcggaagcagaagcccagggtttcgtgtccattgctacgctcctgctcctctcactcctcccaatctgcaatggatctctaccatttcctcagtggttttgatactggcgagaggcaccgcggtgccgaaatcgtatattgttccgttgtttgctctgcaagcacctgcaggtgtcgtttcctggatcaaaggtagatatggtgtgtggacagcattcttggcacttctgattcgtctattcttctatattcctggtgaacttgagttgccatttctggcattgctcttgctgatggtagctccctacgaggctatgaaattaaggtatacaaaagaaggtgctgtgatttcattattaatctcggtgtatctggctttccagcatttctcaagaacaagcttacaacaatcatttgaccaaggttcaattgttgccaccttagctgtcatttgtatcactgttgtatctttgttgcttctaatctga

SEQ ID NO: 518 - DNA, 657 bp, Glycine Max
atgtcaagaatggcaatgcgtgtgtctccttcagcttcaagtgcactctctctcctaaactgcaagcaaccacctccagtttcatgcatccgtgtaccttgtctctctcgctcctcgccgccatcgctctcctacaccttcaatcctcttaggtccttcatcggtcacggcggaagcagaagcccagggtttcgtgtccattgctacgctcctgctcctctcactcctcccaatctgcaatggatctctaccatttcctcagtggttttgatactggcgagaggcaccgcggtgccgaaatcgtatattgttccgttgtttgctctgcaagcacctgcaggtgtcgtttcctggatcaaaggtagatatggtgtgtggacagcattcttggcacttctgattcgtctattcttctatattcctggtgaacttgagttgccatttctggcattgctcttgctgatggtagctccctacgaggctatgaaattaaggtatacaaaagaaggtgctgtgatttcattattaatctcggtgtatctggctttccagcatttctcaagaacaagcttacaacaatcatttgaccaaggttcaattgttgccaccttagctgtcatttgtatcactgttgtatctttgttgcttctaatctga

SEQ ID NO: 519 - DNA, 1089 bp, Glycine Max
atgtcaggtgttcctctcttcaacctggctcctaatctcacagtgtcgaggctctgcttaggaagcatgagtttcggggagcagaacacgctggcggagtcgttccagcttatggaccaagccttccatgccggcatcaacttcttcgactccgccgaaatgtatcccgtgcctcagcgcgctcacacgtgcggcaggagcgaagagtgtctcggccgttggatttctcaacgaaaaatccccagggatagcctcgtaattgccactaaggttgctggaccttctgggcagatgacttggattagagggggtcctaaatgtttggatgccgctaatattactgaagccattgataatagtttgttgcggatgcaaatggattatattgatctttatcaaattcattggcctgatcgttatgttccaatgtttggagaaactgagtatgacccagtccaacaatatgcttcaatcagtatagatgaacaacttgaagctctcagtgcagctgtgaaagctgggaaggcaagtggtattatcagatatgttggtcttagtaatgaaacaccttatggcttgatgaagtttattcaggttgctgaaaaatatgcttcacacctgaagatagtatctctgcagaattcatatagcctgctatgtagaacttttgattctgcaatggccgaatgctgccatcaggagagtattagcttgttggcctacagtcccctggcaatgggtatactttcagggaaatatttttctccaggcggtggtccaacagaagctcgtttaaatctgtttaaagggaagtattcagaaggagaatctaggtacaacttgtccaagaaaattataaaggctgctaccatggaataccttgatattgcaaaaacatatggtcttcatcctgtatctctggctatagcttttgttttgcgacacccccttgtcgctagtgctgtttttggggctaccaaatcatggcagcttcaggaggttctaaatgcatgcaagatcgagctcgcatctgaagtaattgaagatattaacaagattcatttaaggtttccaaatccatgcccctga

SEQ ID NO: 520 - DNA, 1023 bp, Glycine Max
atgtcattgcctaccaccactagtggtcactcatctctttactctgcatttacattgccaagaaccactcaaattcacccaaccttgttttctcccaccaccaagttattttcttccagaagcccctcatattcaggtgtttcccattgtttctcaaacaccctttcgccaagaccgctgccttttgctgttaaggcttcatctggggttggctcagaagcatccaaacaggagaatgacaatagtgaagaagaagaagaggaaccgtatgaagagtatgaggtggaaattgagcagccttttggactcaaatttgcaaagggtagggatgggggaacttacattgatgctattgcaccaggaggatcagctgataaggctggagtcttcaatgttggggataaagtaattgccaccagcgcagtttttgggaccgaaatttggccagctgctgaatatggaaggacaatgtacacaattcgccaaagaattggcccattactcatgaaaatgcagaagagatatggaaagaacattgattctggtggtgagttaactgaaaaggagattatcagagctgagaggaactctgggtttatcagtaacagagtgagagaaattcaaatgctaaatgctttgaggaaaagggaacagaaagagcgcagggaaagggatttgagggaaggattacaactgtataagaatggaaaatacgatgaagcactagagaaatttgagtctattttgggatcaaagccagaacccgaggaagcagcagttgcaagttacaatgttgcttgctgttactctaagctaaaccagattcaagctgcactttcttcactggaagaagctctgaatgctggttttgaagacttcaagagaataagaactgatcctgacctggctaacgcaagggcatcagaggaatttgatcctttattgaaaagatttgatgaatctttcatcaatgagaatgccatcaatgccattaaatctctttttggatttggtaagaaataa

SEQ ID NO: 521 - DNA, 1656 bp, Glycine Max
atgtccaaaccctggggcaacatcggagcctgggccgccgattccgagcgggccgaagccgaagaggccgaggcccaggctgcggccgcggcggttgagccccaaagctttcccagcctcaaggaggccgtgaactccaagcccaagaagaagaagggaaccaccatcacgctttccgagttcaaccgtggcggtttcgaccagggccttacgcgcgacgagatgctcacccttccgaccgggcccaaggagcgttccgccgaggaaatgcagttcaaccgcctcggcggcggtttctcctcctacgaccgctccggcggtcgctcgcgcgaccgcgacggtggcaacaacgaaggttcgtggggcggaggaggcagaagatcctacggtggattcgacgaggagcgcaggggtccgaatcctagggtttcggaactcgatcagccgtccagggctgatgaggttgataattgggcgtccgtgaagaaatctctccctgcctacgattccggtcgccagaatcgctatggtggtggcggaggcggcggttttggtggtagttctggtggtggtggttttggtggtagttctggtggtggtggttttggtggtggcggcggttttggtggtggtggtggtgggggcggatttggaggcgcgtctagggctgatgatgtggacaattgggcggttggtaagaagcctgctcctgttagatcttccaatttcggttccagttttcgcgattccggcgtggagcctgatcgttggacgagaggggatccgccgcgtgaggttgagcagcggacggagaggccaaggctggtgttggatccgcctcgaggcgatggtttggtgaatgagtctccggtgaaggcgatggataaggcgaatccgtttggggcggcgaggccgcgggaggaggtgttggctgagaagggtttggattggaaaaagctggattcggagattgagactaagaagacgagccgtcccacgagttcgcactctagcaggccttccagtgctcagtccaatcgttctgagggtcccgggttgcaggggaccgatgctgtggttaaatccaggcccaaggtgaacccctttggggatgccaagcctagggaggctgtgctgggcgagcgaggcatggattggaggaaaattgatcttgaattggagcgtcgctctgttgccaggcctgagacaatggaggaaaaattattaaaagaagaaattgataatttaaagaaggaacttgagaaagagtctacaataaattcaaataaggaatctgtggatgaggctggtggagaccaaaccagtagacatgcaatattacaacagaaagaaaaggagctggaacttcttatccatgatttggacggcaaagttcgttttgggcagaaagccgttgaaaggccaggttcatcggcagggaagtcttctactttttctgatcggccaccttctagatctggttcctttgaggattctagaagtgtggattttacagacagacctcgatctcgtggtacaggagatatgtggatgcgtcctagtgatgacagaagacagtttcaaggtggtagcagggaaaggggatggttttcttctggcagcagaaataggtcaacgtcaagagagagatggtga

SEQ ID NO: 522 - DNA, 1635 bp, Glycine Max
atgtccaaaccctggggcaacatcggagcctgggccgccgattccgagcgggccgaagccgaagaggccgaggcccaggctgcggccgcggcggttgagccccaaagctttcccagcctcaaggaggccgtgaactccaagcccaagaagaagaagggaaccaccatcacgctttccgagttcaaccgtggcggtttcgaccagggccttacgcgcgacgagatgctcacccttccgaccgggcccaaggagcgttccgccgaggaaatgcagttcaaccgcctcggcggcggtttctcctcctacgaccgctccggcggtcgctcgcgcgaccgcgacggtggcaacaacgaaggttcgtggggcggaggaggcagaagatcctacggtggattcgacgaggagcgcaggggtccgaatcctagggtttcggaactcgatcagccgtccagggctgatgaggttgataattgggcgtccgtgaagaaatctctccctgcctacgattccggtcgccagaatcgctatggtggtggcggaggcggcggttttggtggtagttctggtggtggtggttttggtggtagttctggtggtggtggttttggtggtggcggcggttttggtggtggtggtggtgggggcggatttggaggcgcgtctagggctgatgatgtggacaattgggcggttggtaagaagcctgctcctgttagatcttccaatttcggttccagttttcgcgattccggcgtggagcctgatcgttggacgagaggggatccgccgcgtgaggttgagcagcggacggagaggccaaggctggtgttggatccgcctcgaggcgatggtttggtgaatgagtctccggtgaaggcgatggataaggcgaatccgtttggggcggcgaggccgcgggaggaggtgttggctgagaagggtttggattggaaaaagctggattcggagattgagactaagaagacgagccgtcccacgagttcgcactctagcaggccttccagtgctcagtccaatcgttctgagggtcccgggttgcaggggaccgatgctgtggttaaatccaggcccaaggtgaacccctttggggatgccaagcctagggaggctgtgctgggcgagcgaggcatggattggaggaaaattgatcttgaattggagcgtcgctctgttgccaggcctgagacaatggaggaaaaattattaaaagaagaaattgataatttaaagaaggaacttgagaaagagtctacaataaattcaaataaggaatctgtggatgaggctggtggagaccaaaccagtagacatgcaatattacaacagaaagaaaaggagctggaacttcttatccatgatttggacggcaaagttcgttttgggcagaaagccgttgaaaggccaggttcatcggcagggaagtcttctactttttctgatcggccaccttctagatctggttcctttgaggattctagaagtgtggattttacagacagacctcgatctcgtggtacaggagatatgtggatgcgtcctagtgatgacagaagacagtttcaaggtggtagcagggaaaggggatggttttcttctggcagcagaaataggtga

SEQ ID NO: 523 - DNA, 636 bp, Glycine Max
atgtcccggggaggtctggacaactatttgttcaaatatgcacctgccataccaccattgtcctggtccatgagaatgaagattgcatttggcgctgcaaagggacttgcatttcttcatgaagcagagaaaactgtcatctatcgatgtttcaagacatcaaatattttattggaccaggagtacaattcaaaactttccgactttggccttgctaagtttggaccagttggagacaaatcccatgtttctactcgagtaatgggaacatatggttatgccgcacctgaatacttagcgacaggtcatctgtatatcaaaagtgatgtttacagttttggtgttgttcttcttgaacttctcactggaagaagatccttagacacgacatttgatggagagcagaaacttgcagaatgggctcattctttgctgaaggaaaagaagaaacttctaaaaatcatagatccaaggttggatggtgattatccaattaaagcagttcacaaggctgcaatgcttgcatatcattgcttgaaccgcgacccgaaagcaaggcctctaatgcgagaaattgtacattcattggagcctttgcaggcacacacagaggcacctattggaaaaaaacgttga

SEQ ID NO: 524 - DNA, 1959 bp, Glycine Max
atgtccctgggtacatccaaggcagtttttcaggttctgtccagggctgtgcctcaaactgggtataatgattctcttgtgaactcttcagatttagcattacattcccagtttcgagtaaaatgtatcaagaaaagatcctcaaggcatagggatttaattgagtgttctagcatgcttcagagtaggttaataactcaacaatttcagtggatgggtgtcagtttccatgactacaagacctatagtcgtccacggctgcagacatgcaaatgccaacaggctgaaagtgcgagtggaataactacaggagatgaaaatggatcaagacttgtgaatgatggtgaaacatcaaattcagtaagcaatgggatgagtgcaaagcatatcctagagtttgaggatgtcgaagcccaacagttgaaacaggaaaaggaggttttgtcatctaatcttacaaatggatctattacagacagctttgacacaattggccgcaactctattgaggaagaagcatgggacctactaagggaatctgtagtttattattgtggcaatccaattggaactattgctgcaaaggacccaaccagttccaatgttttgaattatgaccaggtctttattcgtgatttcattccttctggaattgccttcctattgaagggggagtatgatattgttcggaattttatcctttatacacttcagttgcagagctgggagaaaacaatggattgtcatagtccaggacaaggtttgatgcctgctagttttaaggttaggacagttcctttggacggtgatgattctgcaacagaagaagttttggatcctgactttggagaggcagccattggtcgtgttgctccagttgattcaggattgtggtggattattttattacgagcatacggaaaatgctctggtgatctatcagttcaggagagagttgatgttcaaacaggaattaagatgattttgaagttgtgtcttgctgatggctttgacatgttcccaaccttattagtaactgatggttcttgcatgatagatcggaggatgggaattcatgggcatcctttggagattcaggcactgttttattctgccttactttgtgcacgtgagatgcttactccagaggatggatcagctgatcttatacgggcactgaacaaccgtctggtagctctttcatttcatattagagaatactattggattgatatgaaaaaattaaatgagatttaccgttacaagacagaggagtactcatatgatgcagttaataagttcaacatatacccagaccagatttctccttggttagtggaatggatgccaaacaaaggaggctatttaattggcaacctacaaccagctcacatggatttccgatttttttcactgggaaacttgtggtctgtcgtaaacagtttggccactgaggaacaatcacatgccattttggatcttattgaggccaaatggtcagatttggtggcagagatgccattcaagatttgttatcctgctcttgatggtcaggagtggcagataatcacaggcagtgatcctaagaacacgccttggtcctaccataatgcaggctcctggccaacactgctctggcagctcaccgttgcatgcataaagatgaagagaacacatattgctgcaaaagctgttgagattgccgagagacgcatattaagagacaggtggccagaatattatgacacaaagagatctcgattcgtcggaaagcaatctcgactatatcagacttggtcaatcgcaggataccttgtggcgaagctgctgcttgcagacccaagtaaagcaaacacattgatcactgaagaggattctgagcttgtgaatgccttgataagtgccaaccctagaggaaagcgagggcgcaaaaatttgaggcagacttacattgtatga

SEQ ID NO: 525 - DNA, 990 bp, Glycine Max
atgtcgggtagaaaccgcggacaaccccttcctccgccgcacgcggcgggaatatcgccgccgctccacgatccgctgtacggcccgcgggcccaccaccaccaccatcatcatcatcatctagtgggccccgtcccgccccacccccaccaccttctagaagacttccgcgactcgcagctagggctgggcccaacgcgcggcgggtccatcccattgcacccggcggcggcgatcatcgaggagcgccttgccgcccagcatcaggacatccagggtctgctgggcgacaaccagcgcctcgccgccacccacgttgccctcaagcaggagctcgaggccgcccgccacgagctccagcgcgtggcgcacttccgcgagtcgctccgggccgataccgaggcccgcatgcgcgagctctacgacaaggcggcccagctcgaggccgagcttcgtggcgctgaggccgcccgcaccgagctcctccaggtccgctccgacgtcaaggagctcaccgccgtccgccaggacctgtccggacaggtgcaggccatgacgcaggacttggcccgcatgaccgcagacgcgaaacgggttccggcgctgagggctgatgttgaggccatgaaacaagagttgcagtgtgcaagggctgccattgagtatgagaagaagggatttgcagaaaactatgaacatggtcaagtgatggagaagaaattggttgcgatggctcgggagatggagaagcttcgtgcggagattgccaatgcagagaaaagagcacgggctgctgcagcggctgggaatccaggtcaagggtataatgcaaattatggcactgctgatgttggatatgctggaaatccttaccctggcatttatggcatgaatccagtacagcctggagtggagaattttcctcagtatggacctgggcctgctgcttggggcgcatatgacatgcagcgagttcaaggacaccgataa

SEQ ID NO: 526 - DNA, 297 bp, Glycine Max
atgtcgttgtgctacgccatcgaggtcaccctcacaacctcaccttctacctctgcctcagtgagtcttccccgccgctgcgccatcgttcctcagcaacttcgggtcgtccttgcacaacgccgtcgaggttgccctcacggcctcagcttctacttctgctttagcgagtcttcccctccgctaccgctgcgccgtcgtgccacaccaacgtcgggtcatctttgcacgacaccgtcgaggtcgccctcaccctcaccctcaccctctacctctccattctcgaacaaggtatga

SEQ ID NO: 527 - DNA, 684 bp, Glycine Max
atgtctaatttgtgtttgcaaaaggaggaggaatgcggcgctaatgctggctcgggagtgaaaaaaatatcctgtcctaggaacggaatattaatgttaggttcaggccgtcacgggagtatcatgccccctgaatccacaaccataattttgaatgatataatgacggctttgagacaaccaaatattggcatacttgggatgtatggatcgagtaatgcgaacacggaaaatgcagtggagaaagtcaccagaagagttgagagggacggattgtttaatgtggttgtgaagacatgcgtgatgaaaaagtcagatttgaaaaaaattcaaggagaacttgggaacgcattgggtctacaactccatcagaaaactctagtggaaagagctacccgtttgtgtgagaggattaagatggaggacaacatccttatcatccttcatgatcttcaagctcaaatcaacttggccaagattggaataccctttgggaatgaccacaagggttgtaaaatcttgttagtagctaagaataaagaggtgttgtcccacaaaatgaaaacccaaatagaatttgctgtggacgaggagccgtcaagttctggtctaacgaggagccatcaagttcaaactcgtggagtaattgtatggatcaaaaggtggtggtgtcctgtccagtga

SEQ ID NO: 528 - DNA, 1542 bp, Glycine Max
atgtctacgctcgaaattgaagctcgagatgtcatcaagattgtgcttcagttttgcaaagaaaattcgttgcatcagacttttcagatgctgcagaacgaatgccaggtttctctgaacaccgttgacagcattgagacctttgttgctgatattaatagtggaaggtgggatgcaatattgcctcaagtttctcaactcaagcttcccaggaataagttggaggatttgtacgagcagattgtattagaaatgattgaacttcgagaactggatactgcacgtgctattttaaggcaaacacaggtgatgggtgtaatgaaacaagagcagcctgaaagatatttgcgtcttgaacatctcctagttagaacttattttgatccaaatgaggcttatcaagactcaacaaaagagaagcgacgtgcacaaatagcccaagctcttgcagcagaagttactgtagtgccaccatcccgattgatggctttaattggtcaggctttaaagtggcagcagcatcaagggttacttcctccaggaacgcagtttgatttgtttcgtggaacagctgctatgaaacaagatgtggatgacatgtatccaacaactctttctcacacgataaagtttgggacaaaaagtcatgcagaatgtgcttgcttttcaccagatgggcagtttcttgtatcatgctcagttgatgggtttattgaggtgtgggattacataagtggaaagctgaagaaagatctacagtaccaggctgatgaagtgttcatgatgcatgatgatgctgtgctttgtgtagactttagcagagattcagaaatgcttgcatctgggtctcaagatggaaagattaaagtctggcgtattaggactggtcagtgcttgcggcgtcttgaacgtgctcattctcaaggtgtcacaagtgtttccttctctcgtgatggaagccagttattaagcacttcatttgacagcacagcaagaattcatggcctcaaatctggaaagatgttgaaagagttccgtggccatacatcttatgtgaatgatgcaatttttacaaatgatgggagtcgtgttattactgcctcaagtgactgtacaatcaaggtctgggatgtgaagactacagactgcatacaaacttttaagccacctcctcctttaaggggaggtgatgcttctgtcaattctgttcacattttccccaagaatactgatcacattgttgtttgtaacaaaacgtcatccatatatatcatgacacttcaaggacaggttgtgaagagcttctcatctggtaaaagagaaggcggagactttgttgcagcctgtgtttcacctaaaggagaatggatttactgtgttggtgaagataggaatatatactgcttcagctatctatctggcaaattggagcatctaatgaaggtccacgagaaggaagttataggtgtcactcatcatccccataggaatcttgttgcaacttttagtgaagactgcacaatgaagttgtggaagccatga

SEQ ID NO: 529 - DNA, 1413 bp, Glycine Max
atgtctacgctcgaaattgaagctcgagatgtcatcaagattgtgcttcagttttgcaaagaaaattcgttgcatcagacttttcagatgctgcagaacgaatgccaggtttctctgaacaccgttgacagcattgagacctttgttgctgatattaatagtggaaggtgggatgcaatattgcctcaagtttctcaactcaagcttcccaggaataagttggaggatttgtacgagcagattgtattagaaatgattgaacttcgagaactggatactgcacgtgctattttaaggcaaacacaggtgatgggtgtaatgaaacaagagcagcctgaaagatatttgcgtcttgaacatctcctagttagaacttattttgatccaaatgaggcttatcaagactcaacaaaagagaagcgacgtgcacaaatagcccaagctcttgcagcagaagttactgtagtgccaccatcccgattgatggctttaattggtcaggctttaaagtggcagcagcatcaagggttacttcctccaggaacgcagtttgatttgtttcgtggaacagctgctatgaaacaagatgtggatgacatgtatccaacaactctttctcacacgataaagtttgggacaaaaagtcatgcagaatgtgcttgcttttcaccagatgggcagtttcttgtatcatgctcagttgatgggtttattgaggtgtgggattacataagtggaaagctgaagaaagatctacagtaccaggctgatgaagtgttcatgatgcatgatgatgctgtgctttgtgtagactttagcagagattcagaaatgcttgcatctgggtctcaagatggaaagattaaagtctggcgtattaggactggtcagtgcttgcggcgtcttgaacgtgctcattctcaaggtgtcacaagtgtttccttctctcgtgatggaagccagttattaagcacttcatttgacagcacagcaagaattcatggcctcaaatctggaaagatgttgaaagagttccgtggccatacatcttatgtgaatgatgcaatttttacaaatgatgggagtcgtgttattactgcctcaagtgactgtacaatcaaggtctgggatgtgaagactacagactgcatacaaacttttaagccacctcctcctttaaggggaggtgatgcttctgtcaattctgttcacattttccccaagaatactgatcacattgttgtttgtaacaaaacgtcatccatatatatcatgacacttcaaggacaggttgtgaagagcttctcatctggtaaaagagaaggcggagactttgttgcagcctgtgtttcacctaaaggagaatggatttactgtgttggtgaagataggtatcctaatttatgtatataa

SEQ ID NO: 530 - DNA, 1566 bp, Glycine Max
atgtctagtctatcttcttgctcttcttctccttcatttgcagcaagttacggcactattacccatccacgcgcggccccactgagtcgaatttcatgcggtggtccgagaccccctaagagcaagaaaagcaacctcaattcagaagcgcaagagcttgttcgcttactcacgagcaagataagaagcaacgacaaagaggttctgctgaagaccttgaacaagtatgtgaagcaggtccgaacccaacattgcttcttgctcttcgaagaactcggcaagcacgacaactggctccaatgccttgaggttttcagatggatgcaaaaacaacgatggtatattgctgataatgggatttactcaaaactgatatccgttatgggaaagaaagggcaaaccagaatggctatgtggcttttctcggagatgcgtaatactggttgtcgtcctgatacttctgtctacaatgcgctaattacagctcaccttcgttcacgggacaaaataaaggctttggctaaagccattggctactttcaaaagatgaaaggaatggagcgctgtaagcccaacattgttacttacaacattcttttgagagcttttgctcaagctcggaacgtggagcaggtcaattctttgtttaaggatcttgatgagagcattgtttcgcccgatatttacacttttaatggtgtgatggatgcatatggtaaaaatgggatgatccgtgaaatggaagcagtgcttgctcggatgaaaagcaaccagtgtaagcctgacctgattacctttaacttgctgattgattcctatgggaagaagcaggcgtttggtaagatggaacaggtgttcaagagtttgttgcactccaaggagagaccatcactgcccacgtttaattcaatgattttaaactatgggaaggcacggcttaaggataaagcagaagatgttttcaagaagatgactgacatgggttacacgctgagctttgttacacacgagagtatgatctatatgtatggcttctgtgattgtgtctccagggctgcacaattgtttgatgagctggttgagtctaaagttcatataaaagtttcaaccctaaatgccatgcttgatgtttactgcttaaatggtttaccgcaggaagcagattcactgtttgaaagagcaattagtataaaaatacatcctgattcatcaacatttaaacttctttataaggcttacactaaagccaaccagaaggagcttcttgataaattgctgaagcatatggataaagatggtattatcccaaataagaggttcttcttggatgctttgggtgctgcttcacatgttgtccgactttgcctttttatgaccgggttcatttttgttcataggtatggatgtatttccattttccagctcattgccccttgtcttggcactatggtctatgaaatgaagaacgcttcagacctgacagctgccaaagctaattatactgaaaataaccgagtaatgaaagaatttgttgaaaacttctgttgttcacttaggagtatttga

SEQ ID NO: 531 - DNA, 975 bp, Glycine Max
atgtctcgtcgagaaaccaaccctcatttttctagatcatcacagcctgaatatgtagatgatcatgataccgaaccttatccacttgtgccacgacgaaaacgccatggcaaaccatccacacaagtagctgcacctataccacacgaagatcatgttccattgcaacctgccaccaaacctattccccaagatcatccacacccaccaccacctattccccaagagccacgccatggcaagcaaagaagtccacgtagacagccaacaaaccaaggcttccggccggttaagccaaaggtaaattttcaagaacctcctccctcggccgatgtccctcccgagcctcgacagcagcctcaccgcgatccccgcctcagcggtataaagttgcctaaggaacagaagtctcaacccttgacatggttaggtgcttgcttgtgtgtaatattttggctcatcataatcataggaggcttaatagtccttatagtgtacttggtttttcgcccccaaagtcctcattttgatgtgtctagtgtgaccttaaatgctgcataccttgaccttggatatctactcaatgctgatctaacaatgctggctaacttcacaaatccaaacaagaaggtgcatgtggacttcagctcagtgatcatttatctctactatggaagtacccttattgcgactcaatatgttgagcctttcaatgctgcaaggcttcaatcaaggtttgcatatattcatttggtatctagtcaagttcagcttccattaagagagagccagaggcttgtgaaacaaatggaaggcaatggggttatacttgaagtgaggggagttttcagggcacggtccaaattgggaagcatcttaaggtattcatataatctttatggccgttgcagtgtcatgctaacacgccctcctgatggcattttgctcaaaaagaaatgcagaacaaagcgctga

SEQ ID NO: 532 - DNA, 219 bp, Glycine Max
atgtctgacattgctatgctggtggctgaggagtacgagaggagggtcaagagtttaagaaagtccggtggtggaactggagccggggaatttgacatggtttcttgtgtttcggtgatagtgtcgaggctcaaggaaaagaaacaacttctgcaatgggttttggagcccaagactcaagtcgctatggctgcttccaacagcttcttctctgcttaa

SEQ ID NO: 533 - DNA, 1137 bp, Glycine Max
atgtggagatttaagccattcagtcacaaagagcagactggtcttgaaggccgcactatagatgttggcaatcttaaaatacatgtcattaaggccattgccgaaggagggttctcttgtgtctacctagctcgagatgctgtacatatgtcaaagcaatatgctttgaagcacatgatatgcaatgacgaagaatcacttggattggtaaagaaggagatatctgtgatgaaggtgctggcaggacatcccaatgttgtcacacttcatgcacatgccatcttcgatatgggtaggacaaaagaagcattccttgtgatggagttttgtgagaggtctctggttaatgtgctagagagccgaggagctggttattttgatgagaaacaggtgcttttgatattcagggatgtgtgtaatgcagttcttgccatgcactgccagtccccacctattgcacaccgagacttgaaagcagagaatcttttattaggttcagatggcttatggaagttatgtgattttggaagcacttccaccaatcacaaacgttttgaaaagccagaagaaatggggattgaggaagacaatatcaggaagtacacaacccctgcctacagggcccccgagatgtgggatctgttcttgagagaagttattaatgagaaggtggacatatgggctcttgggtgtctcctttttcgcatatgctacttcaaaagtgcttttgatggggagtcaaagctccaagtcttaaatggaaactaccgcattcctgaattaccaaaatacaattcacctgtgacggacttgataagagacatgctccaagctagaccagataacagaccagatatcacgcaggcaagcgctttgcttgattggccattcatctccatcagtttaggttggtctggtttcgtgttaatgagcaactacctattaatttacagaagtcattacctgacagaccacctgaattgccctcatccaacgatcatgaaggtgacgcaaaatattaccctagatttgtatatacaatttcttccctacatattgactgagaaaattgatccattgctatattttggcaggtgtgtcaatgccctcaaacagatcacctccaatgcctcgtag

SEQ ID NO: 534 - DNA, 736 bp, Glycine Max
atgtggaggctaaaaatagcaaatggaggaaaggatccgtacatatttagcacaaacaactttctgggttgggaaatatgggagtttgatcctgaggcatgcattgaagaggagaaagctgaggttgaagcagctcgtgaaaatttctatgacaacctcttcaactttagagcttgtggtgatcgactttggtggtttcagattctaaggaaaaaaaattacatacggaaaactaccatcacattgaagagggttattcattacttatcggcactacaaactagtgatggttattggcctgctcaatttgttggtcctctctttcctacggcgctattttacccggttgatttggaattgcatctttatctcatcatgtttttaagatgcgctaattggtcatgtgtatgtacattaagtggcatgctgactttatatttccagaagagtaacgcaaagagattttgtgttacatatattgtcaccaggtacacttctttatgtatttataacttgaataaagatggaggttggggactaaatatagatggtatgtatgcggatttgggagaaggaccgaatgtagctcataacaatgcttgtgctaaagcaaaaaagtggattcatgaaaacatatccatacatatgtatgtacgtggcgtagttgattggtgtggaagtaatcctttgcccccaaagttttggattcttcctacttttttccctatgcatccag

SEQ ID NO: 535 - DNA, 891 bp, Glycine Max
atgtggcgaagaacggttagcggtgtgggacttgttgacatggcttcttctacactcgctctgactctcagcctctccaccaccaccaccacctccaccacctcctactcctatcaacaccggtttccatgtcctagaataaagttattctcttccaagcaccgctccttctccgtctcagcttctgcttccacctcaaattcgcttcaggctctcatattcgactgcgatggcgtgatcctcgagtctgagcacctgcatcgccaggcctacaacgatgcctttgttcacttcaacgttcgctgcccttcttcttcttctccgggcccactcaattgggacgttcaattctacgacgaactccagaacctcattggtggaggcaaacccaaaatgcgatggtactttaaggaacatgggtggcctacgtccacgttgttccagacgcctccgactaatgatgaggatcgggccaagttgattgacactcttcaggattggaagactgagagatacaaagaaataatcaagtcaggaactgtaaaacccagacctggagttctgagattgatggatgaggctagagatgcagggaaaaagctagctgtttgctcagcagcaactaaaagttcagttattctctgtcttgaaaaccttataggaattgagcgctttcaaggccttgattgcttccttgctggtgatgatgtgaaggaaaagaagcctgacccatcaatatacgtgacagcttccaagaagctaggtatatcagagaaagactgcttggttgtagaggatagtgttattggattgcagcaacacaagcagggatgtcatgcgtggttacctacacaccttccacagcagaacaggatttcaaagaagccatag

SEQ ID NO: 536 - DNA, 972 bp, Glycine Max
atgtggcgaagaacggttagcggtgtgggacttgttgacatggcttcttctacactcgctctgactctcagcctctccaccaccaccaccacctccaccacctcctactcctatcaacaccggtttccatgtcctagaataaagttattctcttccaagcaccgctccttctccgtctcagcttctgcttccacctcaaattcgcttcaggctctcatattcgactgcgatggcgtgatcctcgagtctgagcacctgcatcgccaggcctacaacgatgcctttgttcacttcaacgttcgctgcccttcttcttcttctccgggcccactcaattgggacgttcaattctacgacgaactccagaacctcattggtggaggcaaacccaaaatgcgatggtactttaaggaacatgggtggcctacgtccacgttgttccagacgcctccgactaatgatgaggatcgggccaagttgattgacactcttcaggattggaagactgagagatacaaagaaataatcaagtcaggaactgtaaaacccagacctggagttctgagattgatggatgaggctagagatgcagggaaaaagctagctgtttgctcagcagcaactaaaagttcagttattctctgtcttgaaaaccttataggaattgagcgctttcaaggccttgattgcttccttgctggtgatgatgtgaaggaaaagaagcctgacccatcaatatacgtgacagcttccaagaagctaggtatatcagagaaagactgcttggttgtagaggatagtgttattggattgcaggcagcaacacaagcagggatgtcatgcgtggttacctacacaccttccacagcagaacaggatttcaaagaagccatagcaatctaccctgacttgagtaacgtaagattgaaagatttggaattactacttcaagatgttgtagctgctaaatag

SEQ ID NO: 537 - DNA, 912 bp, Glycine Max
atgtggcgaagaacggttagcggtgtgggacttgttgacatggcttcttctacactcgctctgactctcagcctctccaccaccaccaccacctccaccacctcctactcctatcaacaccggtttccatgtcctagaataaagttattctcttccaagcaccgctccttctccgtctcagcttctgcttccacctcaaattcgcttcaggctctcatattcgactgcgatggcgtgatcctcgagtctgagcacctgcatcgccaggcctacaacgatgcctttgttcacttcaacgttcgctgcccttcttcttcttctccgggcccactcaattgggacgttcaattctacgacgaactccagaacctcattggtggaggcaaacccaaaatgcgatggtactttaaggaacatgggtggcctacgtccacgttgttccagacgcctccgactaatgatgaggatcgggccaagttgattgacactcttcaggattggaagactgagagatacaaagaaataatcaagtcaggaactgtaaaacccagacctggagttctgagattgatggatgaggctagagatgcagggaaaaagctagctgtttgctcagcagcaactaaaagttcagttattctctgtcttgaaaaccttataggaattgagcgctttcaaggccttgattgcttccttgctggtgatgatgtgaaggaaaagaagcctgacccatcaatatacgtgacagcttccaagaagctaggtatatcagagaaagactgcttggttgtagaggatagtgttattggattgcaggcagcaacacaagcagggatgtcatgcgtggttacctacacaccttccacagcagaacaggggaattactatccacttaaactggctgcacgatga

SEQ ID NO: 538 - DNA, 900 bp, Glycine Max
atgtggcgaagaacggttagcggtgtgggacttgttgacatggcttcttctacactcgctctgactctcagcctctccaccaccaccaccacctccaccacctcctactcctatcaacaccggtttccatgtcctagaataaagttattctcttccaagcaccgctccttctccgtctcagcttctgcttccacctcaaattcgcttcaggctctcatattcgactgcgatggcgtgatcctcgagtctgagcacctgcatcgccaggcctacaacgatgcctttgttcacttcaacgttcgctgcccttcttcttcttctccgggcccactcaattgggacgttcaattctacgacgaactccagaacctcattggtggaggcaaacccaaaatgcgatggtactttaaggaacatgggtggcctacgtccacgttgttccagacgcctccgactaatgatgaggatcgggccaagttgattgacactcttcaggattggaagactgagagatacaaagaaataatcaagtcaggaactgtaaaacccagacctggagttctgagattgatggatgaggctagagatgcagggaaaaagctagctgtttgctcagcagcaactaaaagttcagttattctctgtcttgaaaaccttataggaattgagcgctttcaaggccttgattgcttccttgctggtgatgatgtgaaggaaaagaagcctgacccatcaatatacgtgacagcttccaagaagctaggtatatcagagaaagactgcttggttgtagaggatagtgttattggattgcaggcagcaacacaagcagggatgtcatgcgtggttacctacacaccttccacagcagaacaggtgaggcagttaactttcaaataa

SEQ ID NO: 539 - DNA, 900 bp, Glycine Max; identical to SEQ ID NO: 538

SEQ ID NO: 540 - DNA, 987 bp, Glycine Max
atgtgggtgacaaccatggctaacacatctcttcttcccaaaccatattattaccgtaatttccattatcaacatcaaagatgcttcaagatcaacctcccaaaatggacaactagagcttcctctgctgcccctggggtcgacctcaacactctcgaatctgccatttccaagaaagacagtgatgctgttaaagaggcacttaatcagcttagtgaagttggttgggccaagaaatggagttctcagccatatgtttcacgtcgtacgacatcactccgggagctgacaagtctaggaattaaaaacgcagagaatcttgcaattcctagtgtcagaaacgatgcagcttttctttttactgtggttggaacaacaggatttctgggtgttctggctgggcaacttcccggggattggggcttctttgtaccatacttgattgggagtatttcattagtggttttggctgtaggtagcatatccccagggcttctccaagctgctattggcagcttttcaacactttttcctgattatcaagaaaggattgccaggcatgaagctgctcactttttgattgcttatctgcttggcctacccatttttgactattcactggatattgggaaagagcatgtcaatctcattgatgagaggcttgaaaagcttatctatagcggacagcttgatgccaaagagctagatagattggctgttgtgtcaatggctggactggcagcagaaggtttaacatatgacaaggtggttggtcaatctgctgatcttttcagtctccagagatttattaacagaaccaagccacccctcagcaaagatcagcaacaaaatctcacaagatgggcagttctgtttgctgcttctatcttgaaaaacaacaaggtgactcatgaagccttaatggcagcgatggcaaagaaggcaagcgtactggagtgcattcgggtaatcgaaaatgcagcatag

SEQ ID NO: 541 - DNA, 2163 bp, Glycine Max
atgtgggtgttttacctgatctctttgcccctcacagtgggtatggtactattcacgctcagatactacgctgccccacacgtccctcgctacgtgcttctcaccgttggatacacctggctctcttccctctccatcatcatcctcgtccccgccgacatttggacgacaatatcttccaaccatgataacggaggcatttccttcttttggagctggtcatattggagtacgtttttgcttacatgggctgttgtgccccttattcagggttttgaagatgctggggacttcactgtttcagaaagattgaagactagtttacatgttaacttgatcttttatctaattgtgggatccattggcctttttggattcattcttctcattatgatgcataagcgctggagtggaagtcttttgggattagccatggcctgctcaaatacttttggacttgttactggtgcatttcttcttggctttggtttaagcgaaattcccaaaagcatttggagaaatgctgactggacaacccgccagaaagttctttcccacaaaattgctaaaatggctgttaggcttgatgatgctcaccaagaactttcaaatgctattgtggttgctcaagacacatctaaccagatgtccaggcgtgatcctctgagatgttacatggatgtaattgatgatatgctaactcaaatgtttagggaagatccatccttcaaaccacaaggtggccgactaggagaaagcgacattgattatgatactgacgagaagtcaatggcaacactaagacgtcatcttcgaggagctactgaggagtactacaggtataaaagtgtgtatatgacttacgtgttagaagcccttcaattggaagacaagataaagaattatgaacgccgcaactcaactggatggaaatatatttcaagctttagacctgctcggactggcaagtttgggtctttatgtgacactttagaatttttctggcaatgcattttaagaaagcaagttcagaaaggcttggctgttatacttggtgtcatgtctgttacaattcttttagctgaggcaactcttctacctagtgttgatctatcacttttctcgattcttataaaatctgttggaacacaggaggtgcttgtgcaggtacttgcttttgttcctctcatgtatatgtgcatctgcacgtattactccttgttcaaaattggaacattggtgttttactcattgacaccccgacagaccagctcagttagcttgcttatgatatgctctatgattgctcgatatgctccccccatctcatacaacttcctcaatcttattcgccttggttctgataaaacaactatatttgaacagcgaatggggaacattgataatgctgtccctttctttggagataagtttaacagaatctatccacttattatggttatatacacccttttggttgcaagcaatttctttgatagggtatttgattctcttgggagctggaagagatatgttttcgaaactgaaactgaagatatggatggttttgatccatcagggttaattatcttgcagaaagaaagatattggcttgagcaaggaggcaatgtaggcgagcaagttgttccactagtgaggaattttaatggaattgatgttgaatctagtgacaatattatggtgaagaatggtgttgaaatgaagggaaattctgctttagttaataaagaaacagatggaaatctgcctaaaactttgaaggaagagacaaggagatatagctcaagcagggaagccatcagcagcaagtatgctgctgtcagacagcagagtgaattaacatctgcgaaggtttccttgcttgatcacggcaatgctcattctagtaatgctgctggaacttcaggcttggcttcgacatggcaaacaatgacaacaggttttcggagttttggggctaacttagggggaaaaggatttttgcccatacggcaaacacaggaagctaagatgtctcgtgtgtcctcatctgagtcccttgatgatatatttcaaagactgaaacggcctgcattggaccaaaatattgacaatgacaaggataatttgaagaggggcaatatttctggtccttctagatga

SEQ ID NO: 542 - DNA, 1176 bp, Glycine Max
atgtggtggatgatgaacgagactggaggcaattactgttctaagaagagcgatgatttgtgcagcaatgtttgtgatcaggaatcaagtcaagtattgggcatgtcacgaattcgctgtattctgcgtggtttggatgtgaaaacctatatattcatgtttgctgttatcccaatgtgcgtctttggattctatatacacgggcagaagatctcctactttctgcgaccgctgtgggaaaaagcacccaagcctttcaatgtcatccctcattactataacgaaaacatcaccatggagaatctctgcagacttcatggctggggagtccgggagtaccctagacgtgtttatgatgccgtgttgtttagcaatgagttggaaatactaactttgcgctggagagaattgtacccttacataactgaatttgttgttcttgagtcaaattctaccttcactggattgcctaagcctctggttttcaatagcaatagggagcagttcaaatttgttgagccgcggttaacttatgggaccattggtgggagatttaagaaaggagaaaacccatttgttgaggaggcgtatcagcgtgtagcattggaccatctcctcaagatagctggtattactgatgatgacttattgattatgtctgatgtggatgagataccaagtgctcacactattaacctcctgaggtggtgtgatgaagtaccctcaatccttcatctgcagctgaaaaattatctctattcatttgaatttcgcgtggatgataagagctggagggcttcaattcacaggtatcagactggtaagacgaggtatgcacattatcgccagtctgatgacatattggcggatgctggctggcattgtagcttttgcttccgtcggatcagcgatttcattttcaagatgaaagcctacagccattatgatagagtcaggttctctcactatttaaatcccgaaagaattcagaaggtaatctgcaaagggaccgatttatttgacatgctgccggaggagtacactttcagggatatcattggtaaaatgggatcaataccccattcctattctgcagttcaccttcctgcttttcttctggaaaattctgagaagtataaatttcttttgccgggaaattgcaagagagagagatga

SEQ ID NO: 543 - DNA, 360 bp, Glycine Max
atgtgtccccaataccagaagaaaaggcttttgggtgtgagattctgttccttccaattttgtatcaatctcttcaagttccgaaatttcaggattctactctattcttcaaagttcaaacgttttggaccttccttcaaatcacaatctttagtactactaaggtggggtagggtggcgtgggagagagagggtggggcggacgggcggcacggcgacttggatctggatggggtggaatgggtgatgcggcgcaacccaaaggagaggctggggtggggtggcgcgggagagaagtctgaggggaaggtgtgtagggatttgggcaaaagaaggatttcacaaggaatggtagtgtga

SEQ ID NO: 544 - DNA, 1383 bp, Glycine Max
atgttagacactgctgaacgtgattctgaggtgagtttggagaccgtctattcttccacacttggaagctcaatgagcagcgagagcatttgtagcaccagtttcagccgtctttccttcgatctcctccctccctctccggagactctctccatcaagcctcaccgctcctccgacttcgcctactccgccgccttccgccgcaaagccgcacttaccttccgcgacttccacctcctccgccgcatcggcgccggcgacatcggcaccgtctacctatgccgcctccacaacagcaaccaattgaagaatcaggatgaagacgaagaagatgtttcttgtttatacgccatgaaagtggtggacaaagacgcagtggcattgaagaagaagtcgcagagagcggaaatggagaaaaaaatcctcaagatgctcgaccacccgttcctccctacgctctacgccgagttcgaagcttctcatttctcttgcatcgtcatggagttttgttccggtggagacttgcactccctgcgcttcaagcaccctcacaaccgtttccctctctcctccgcaagattttatgcggcggaggtgctggtggcgttggaatacctccacatgctgggaatcatctacagagatttaaagcctgagaacgtgttggttagatcagacggtcacatcatgctttctgatttcgatctttctctttactcagaggcaatcccagccgttgaatcctccccagattccttaccatcttcaaatgcattaccattaccttacgcttacactcgctcgcattcttttatgagtccattctcctgcttctcaaaccggtcgcgcgaggttcgaactattgaaccgaatcggctttttgttgccgaaccggtttcggctcggtcctgttcctttgttgggacccacgagtacgtctcgccggaggtcgcttctggccggtcgcacgggaacgccgtggactggtggtcgtttggagtatttatctacgagctcatctacggtcgcacgccgtatgcgggtccatcgaaagaggctacgctgcggaacatcgtaaagaaaccactggcgttccccacggccacaccaacgagcaatcttgaactgcacgcgcgggatttgatatccggcttgctgaacaaggatccggcgcgccggctcggctcgaagcgcggcgccgctgacgtcaaaaagcaccccttctttaaagggctcaacttggcgctgattcgcatgcagacgccgcccgaagtgcctggctccagaagaaggaccaaaacgacgtcgctgtaccccgtgaagggtaacggcaacaacaaccataaacaacaacagacggcgtcgtttgatttttacttctaa

SEQ ID NO: 545 - DNA, 1965 bp, Glycine Max
atgttaggagaagagagtaacaacaacaacgaccgcgccggcggtcaccggagaacaacacattcccggtcagtttcctggaccgaccggtctccggttacccggaaaccgccgcgtccgcttcagcctctcgccatccacaaacgcagcgttttggagtggcccagcgccggctgcgacgatctcggtgattggtctcttccaccgacccctagagggtccaccaaaacaccagattcgggttcgggtcaagttttccagttcaagaaagactattacgcgttctacgacaaggaatgttcgagaatcgcggagcacgtgtacctggggagtgacacggtggcgaagagcgtcgagcttctgcggcggcacgggatcacgcacgtgctcaattgcgtcgggttcgtgtgccccgagtatttcaaaaccgacttcgtctacaagaccctctggctgcgtgactcaccctcggaggacatcaccagcattctctacgacgtcttcgattacttcgaggatgtccggaaccagggtgggcgcgtgttcgtccactgctgccagggcgtgtcgcgctctacctcgctcgtcatcgcgtatctcatgtggagggaaggccagagcttcgaggacgcctttcactatgtcaagatcgcgcgtggcgtaacgaaccccaacatgggcttcgcgtgccagctgttgcagtgtcagaagcgcgtgcacgccatgcccgcgagtcctagttctgttctcaggatgtataggatggctcctcattctccttatgaccctcttcatcttgtgcctaagttgattgatcatccttcctcacgcgctcttgactcgcgtggcgcatttgttgtgcatgtgcctaatgctatatacgtgtggattgggaaggagtgtgggtcggtgatgtgttgcaatgcaagatcagcggctgctcaggttgttcggtatgagagggcaacggagaagattgttagtgtgtttgaggatgaagagcctaaggagttttggattgctctttctaccaaggaagtggtggtggtggagaatggagaggtgaagaatgtggtggagagaattgagattgatgtggggattcgtcccaggagagttgaggagtatgatttggattttgggatttttcataaggcgcttgctggtggggttgttccacctttttctttgtctaatgctggatcggaaaattgccttcctgccagggaaaatgggtgggggagattgacaaggaagcttgctagtggtatcatgaaagggttgttcacatcctctaagtgctgtgagtctagtgtgaacatcattgaagagggaaatcaacataagaatgttgatcctcctttgccaccatcttctaacaatgtgggtggttcgtggagttcctttgagtgttttgtagataatggcttagagaggggaaaggatagtgttcaacaagtcagggatcagtttgttgttcctagcgttgggtcatcaatgccgccaccatcgcctcatagtcgagcagcatcggattcttttgcttgttttctaagtaacagctccaaattcagttccaaatctccaccactttcacccgccagttcggattatgcaagttcctttacattttcgccttcatcgactgatttgtcaatcgtgtcttctcggcagtcatcgccttccggtctggaatcagctgaacccaatcatgtgaaagatgcatcttcctcagagagtcgctctttagttcagaaagaaggtgaggcatttctggctaatcacaccttggtaggggcaaagtccagtttgccgcgcaaaggatcttccctctccattgcagagcgcagagggagtaacccgccacctcgcatgatgctacccttggccagtgaatcatcccgtgtcagcaaggtccgggtaagatccaggtctttctcattgcctgccttggatgatacttag

SEQ ID NO: 546 - DNA, 1581 bp, Glycine Max
atgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggtaagtataatgtatctgattcataattgttcagtgaattttttcatcccccctttgattaattttctcaaattgtgtgaacaacaattattaaattacaggttccaccgagtacgccagtggttaatgcactgtcaaagcagcgagctatgctggaaaacatcctaa

SEQ ID NO: 547 - DNA, 1533 bp, Glycine Max
atgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggttccaccgagtacgccagtggttaatgcactgtcaaagcagcgagctatgctggaaaacatcctaagggcttgtgttggattagctcctgagaacaacatgatcctggagtacaagtga

SEQ ID NO: 548 - DNA, 288 bp, Glycine Max
atgttccatgccatggtgctgaagtccaaggcagtgttcctggtcctcttggtccttgttgtgtgccaactctcttgtgggttgggggaggattggtctactaggagactcagtaggcataataataataataaggtgattcctccaagctgtggagagctggtgttgaagtcacagtgctcagagaactcaaagtgcaggtggtgcaccagtgaggaccttgatgacatgtgcttctctaaatctgaggcattgaggttgcctcaccaggttttctcttgtgcctga

SEQ ID NO: 549 - DNA, 1278 bp, Glycine Max
atgttccattggctttttggtattgcaagaaattttggttttgttcgtggttatcaacaaggatacatttaccagcagaagtttagtctggtgaacataaagttgaaatgggtgaaagataggacattggatgctgttgttactggtcagagggatcttaaggcagctgggattcttgtctccatcatttattcttcttctgaatgctgccttccaatataccatctttctcgccaccgtggacaacttggtcttcccagtgacctcaaactttccacctttataagaagatatcccaacatatttaatgagtcctcttttcttgatagtggaggctctcctgttccgtgtttcagtttgagtcctgaagccttggagctccatcatgaggaagtcaacatccttcagcaaaatcagttggaactcagggataggctgtgcaaactgcttatgctcacaagtgatagaatccttccactacaaaccattgaccagttaaaatgggacttgggtttaccatacgattaccagcattcttttgttccaaatcatcctgaaagtttcttatatgttcgccttcctgatgatcgtattggcctgaaattgttattttgggatgacaagcttgccatctcagagttacagaagaatacttctctacaacaaaaggcagaagacataaaaaatggatccttagcatttccaattagtttcaccaggggttttggtttgaaaagaaaatgcatggagtggttgaaagattggcagaaactcccttatacttcaccttacatcaatgcctctcatttggatccccgtactgatgtatctgagaaaaggatagttggagtcttccatgagctccttcatctcacactccataagcaaactgagcgcaagaacgttagcaacttgcgtagacccttggccctacctcagaagtttactaaagtatttgagcgtcatcctggtattttttatatttccaagaggagtgatacccaaacagttgttcttagggaggcctataatggtcaggaacctgtgcagaatcatgcccttgtacaaattagagaggaattcgcaagcctgctgaagaaagggctattggataggagtaagggtgtatacaaaaaaagcagacacactaatttggtggagggttttagaaaggaggtttgcattgctaaaaaaactaaccagcttagttctcaggatgaatcagattccatgttttctgaatatgattcggatggccctccacaaaacccatgctga

SEQ ID NO: 550 - DNA, 1002 bp, Glycine Max
atgttctggagggaccgtgagagggagaacaaggagttgaacggtggggtcctttgtggccaggtcagagtcctcgttgttggtgattcaggtgttgggaagacttctttagttaacctgattgtaaaaggttctccaattgctcgccctcctcaaacaattggttgttcagttgatgtgaagcatattacttatggaaattcaggcagctcttccagtagccttaaaggtgattctgagagagacttctttgttgaactgtgggatgtctcaggacatgaacggtacaaagattgccggtccctgttttattcacagattaatggtgtaatttttgttcatgatctttcacaaagaagaacaaagactagcttgcagaagtgggcagctgagattgctgccactgggacattttcagctcctttgggatctggtggtcctggtggccttcctgttccttatattgttattggtaacaaagctgatattgctgcaaaagatggtccaagaggaagcagtgggaatcttgttgatgttgcacgccaatgggttgagaagcagggtttgcttccttccagtgaggagcttcctttgactgagagttttcctagtaatgggggccttattgctgctgccaaagaagcaaggcatgacaaggaggctgtggtgaaatttttccgcaagttgatcaggagaagatatttctcagatgaaatacaaataccttcaccagcatggtccattccttctgttcagagacaagctcagcgtatagatgaaaatttcacagaagatgatcaatcttataatacaagtgatccttacaagtataacatgcttcccccacttccagcacaacgaaatctaacgccgccacccacactctatcctcaacagccagtttcggtgtcggaaaactatagtttccctagattttccttgtcaggctcctcagaaatcagtactgtggcgagaacaaagcgatcagatattaatgtctga

SEQ ID NO: 551 - DNA, 1773 bp, Glycine Max
atgttcttcgaatcccgatccctcctcttcccgctccttttctctctcttcctttcttccgccttcgcttcagactcagatcacaagtatcaacacgatgaaccagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaaattgaaataaagttccaaagaaatgtggataagactgtcttttgccagatagatctcgatgaagcaaaggtgaaacagttcaaggatgcaatagagaataattactggtttgaattcttcatggatgatctacctttgtggggatatgttggtgagttacatcctgataagaacagtgataatggcaagcatgtcatttatacacacaaaaacattattgttaaatacaacaatgatcagattattcatgttaatctcactcaggatatcccaaagcctttggaagtgggaaaacatttggacatgacatattctatcaaatgggattctaccaatgtcacttttgggcgtcgctttgatgtctacctggatcatcctttctttgagcatcagattcattggttctccatttttaactctttcatgatggtcatcttccttactggattggtgtcaatgatattgatgcgaactctgagaaatgactatgcaaagtatgctcgggaagatgatgatttggaaagtctggagagagatgttagtgaagaatctggctggaaacttgtgcatggtgatgtttttcgaccgcctcgcaacttagttattctttcagctgttgttggcacaggtgctcagcttgcgttgctggttcttcttgtcgtcttgttggctattgttgggatgttgtatgttgggcgaggagccatcatcactactttcattgtgtgttatgctctcacatcttttatttctggttatgtgagtggggggatgtactcacgaaatgggggtaaacactggattaaatccatgattcttactgcttctctgttcccattcatgtgctttggaattggatttatcttaaacacaatcgctatattctatgggtctctagcagcaattccatttggcacaatggtggttgtatttgtcatttgggctttcatctctttccctctagcacttcttggcacagttgttggaagaaactggagtggtgctctgaataatccctgtcgcgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttgtgattcttatcatcgttaccatttgtgtgacaattgtggggacatactttttgttaaatgctgagaactaccactggcaatggacttctttcttttcagctgcctcaacagctgtttatgtttatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaatatcaagtgcgattaa

SEQ ID NO: 552 - DNA, 486 bp, Glycine Max
atgttgagtctctcagttgcttcaccttcttcttcaaccatttcctttctcccaaagccattcaatggcattcagctccgtcgcactgccacatgctccatcccacccacgaagcgcagctcatttgtgccggtggtggtgatgtctaagaggacggaggaattgaaggaaattagacaaatgactacggaacgaattaacgaagaggttgtcgaccttaagggcgagcttgtcatgcttcgccttcagaaatcggctcgcaacgagttcaagtccagcgatttcggtcgcatgcgcaagaggattgctcgcatgcttactgtgaagcgggaaagagaaattgaggagggtatcaataagaggttgtctagaaagcttgataaaaaatggaagaaaagcattgttgtaagaccacctccgtctttaaagaagcttcgggaggaagaagcagcagcagaagctgcagaaactgaaaaagctgcatga

SEQ ID NO: 553 - DNA, 1266 bp, Glycine Max
atgttgcagagtgacataaaattggtgaaagacattgggttggactccttcagattctccatctcttggacaagaatatttcccaaggggaaaggagccgttaatggcttgggggttgaattctacaacaatctcatcgatgaggttctatcaaatgatttaaaaccttttgttactcttttccactgggacttcccacaagctcttgaagatgagtatggaggatttcgtagttctaatgtagtggaggattttcgtaaatatgctgacttttgctacaagacctttggagacagagtgaaacattgggtcactataaatgaacccttatcatatagcatcaatggctataatggtggcacctttgcaccaagtagatgttctaagtacgttgccaattgcagtgctggtgactcatccattgaaccctacattgttggtcactacttattacttgctcacgaggctgctgccacattgtacaagaaaaaatatcaggctcgtcaaaaaggacaaattgggatcacccttccgactcacttctttttgccaaaatcaaatagtgttgccgataaacaagcagcaaatcgagctctggactttttctttggctggcatgctcgtccagttatatttggtgactatcctgagagtatgaaatcttcagtgggttctagactacctaaattcacaaaagctcaatctgaaggtctcaaaagttccattgattttcttggtgtaaattattacaccacatattatgcagaaaatgctgcacctgtaagagccaacaggaccttcaacacagatatgctagtcactctcagtacggaaaagaatggtgtggctattgggaccccgactgatttggattggctctatatctatccgaagggaattcatcttcttatggtacacataaaggataaatacaagaatccaaatatttacgtcaatgaaaatggcattgctgaagcaaggaatgactcaataccagtcgatgaagcccttaatgatggtatcaggattagataccttaagagccaccttagactccttcttcaagcgatcaaggaaggtgttaatgtgaagggctactatgcatggtcattttcggacagctttgaatgggatgctggttacacagttcgatttggtcacgtatatgttgattacaacaacaatttgaaaagatacctcaagtcctctgcgttttggctgaaaaagttccttctcaacgacaataataaagtcttatcctattag

SEQ ID NO: 554 - DNA, 1398 bp, Glycine Max
atgttggctagtcccattagaaaagtgaaattcagtttcaagtttgataaagtgagggctgtgatatctggagaaggagatatactatctcatcctaacaactataacagtccaagacaagatgtcttaatagacaaattggcagaagaaccaattagaattaggcagcaacttgatacattttcttttggaacagtcgctgatgagataagtcctacaatcaatggcttctttgctgatagaaatgaatatgatctggattgtcctacacaggggttttcttctatccctgaggccattgaagatattcgtcagggaaagttagttattgttgtagatgatgaagatagagaaaacgagggggatctgataatggcagcatcaatggtgacaccaactgcaattacatttattgttgagtatggaactgggatagtgtgtgtaagcatgaaagaagacgacctagagaggctgcaactcccactgatggtgacactgaaggataatggagaacaacttggcaccgcattcacaatgacagtggatgcaaagcaaggcactacaacaggagtgtctgctcaagatagagcaacaacaatcctgaaacttgcatcaagaaattcgaggcctgatgatttcaataggccaggtcatatatttcccctgaagtacagagaaggaggggttcttaaaagaccaggacacacagaagcttcagttgatcttgctgtgttggctggcttggaacctgctgcagttttatgtgagatagtagatgatgatggttcaatggctaggttaccaaagcttcgacaaatggcaaagcaagaaaacttgaaaatcatatccattgctgatttaataagcagatacaggagaaagagggagaagttggtagagtgtgcttcagctgcactgataccaaccttgtggggacatttcaaagcttattgctatcagtcatttctggatgggattgagcatattgcgatggttaaaggtgagataggtgatgggcaggacgtacttgtgagagtacattctgaatgtctcattggggacatttttggggcaacatgtcaatgtaaaaaccaattaaaacttgcattgaagcaaattgaagcagcaggtaggggtgtcttggtgtatctccgaggaaatgaaggtagaggtattggcttaagccacatggtccgtgctagcccattggaagatgacaagtatgaggaattgcagttacctgttgattctagggagtacggtattggagcacagatactacgagatctcggggttcatacaataaggttaatgacaaaatatcctgctgagtacgacgggctcaaaggttatggcttaacagttgcaggagaagttcctcttttgacaccagactaa

SEQ ID NO: 555 - DNA, 4725 bp, Glycine Max
atgttgttgaatattggttcagcctttgctgacactcctcagagacccaagaatgttcaaacttcactccgtgctaagtggtctggaacccccctgcttttggaagctggtgaattattatctaacgagaaaaaggaccttttctgggacttcattgagatttggctaaatactgagaaggatgctgttagctctcgaacagctaaagattgcctgaagaaaattttggaatgtgggcgccctcttctaagggaaccattaaaatcattatttgaattgtctcttatgctgagatcagcatcccctaggctggtgctctaccagcaattagcggaggaatctctcacatcttttcccctaggaaaatgttgttgggtagatactggtgaacacttgtttctggatttttatgaattactggcgtggcttcaggactctgctgagcaggtaggtgattcgtttcagagacctgaaatatttgattttgatcacgtctattatgagttaagcgttggaagtccagttgctatcctttacggtgcaattggaaccaattgttttaaggagtttcatgttgctttagttaaagctgccaaagaggggaaagttaagtatgttgtacggccagtgttgcctgctggatgtgaattaaatatcaatcattgtggttctgttggtgctggtgaatcagtgaacttgggtggttatggtgtggaacttgcactgaagaatatggaatataaggccatggatgacagtacggtaaaaaaaggtgtgactttggaggatcctcgaactgaagatcttagccaggaagtcagaggattcatattctctaaaattctggtgcgtaaacccgagttagcatctgaggtcatggcttttcgggattatctattgtcatcaactgtatcagacacacttgatgtttgggaattaaaggatctaggacatcaaactgtacagagaattgtccgtgcttctgatcctctgcagtcaatgcaggaaataaatcaaaatttccctagcgtagtttcttccttgtctcgcatgaagcttgaggattctgttcgagatgaaataatggcaaaccagcggatggtcccacctggaaagtctttaatggctctaaatggtgctttagtcaatgttgaagatgttgacctctatctgttgtttgacttgatccatcaggatctcttgttggctgatcaattctcaaaattgaagattcctcaaggcactttgaagaaattgctctcaacttcacctccttcagagtccagtatacctcgagttgattttcgttctagccatgttcattatctcaacaacttggaagaagatgctaaatataaacagtggaggaacaatttggatgagatcttgatgccagtcttccctgggcagctacgttacatccgtaaaaaccttttccatgctgtctttgttcttgacccagcaacccgttgtggtctggaggcaagtttttatttcctcaagcttaacattttcacattattcatttccattgatatgatcatatcattgtatgaaaatgattttcctgtgagatttgggattgtgttgtattcttcgaagtttgtcacacagttagaaaatcatgctacaaaagagcacagcgatgaagatatttctactatgatcatatgtctcttcagttatatcaatgagaattatggtgctgagatggcttaccagtttttgagaaatgttaacaaattacacattgagtcagatggcgatgctgacgaagctcttgaaacgcaccatgttgaaggagtgtttgtggaaacaatattatcaaaggtaaaatccccacctcaagagatattactaaagctgtataaggatcaaaagttgaaggaattgtcacaagaaagctctaagtttgtatttaagcttggtttgtctaagcttcaatgttcatttttgatgaatggccttattattgatcccactgaggaagctcttatagatgccttgagtgatgagactcaaagaatacaggaacaagtatattatggacaaatgatgtctgacactgatgtattagctaagtttctatcagaagctggtatacaacgttataatcctaagtttctaatgctaatcctttggttcatacctctgtcaatgtttactcttggggaggaatctgtactaaatgacattgtctacttgcattctcctggaacaattgatgatacaaaggctgtgacgcatcttcttgctgttgatatcacttcaaggaatgggatgaaattacttcaacaaggcatacattatctgatagaaggatccaaaaatgctcgtgtaggtcttctgtttaatgccaatccaagtcctaatttgtttagcctcctatttgttaaggtctttgaaatcactgcatccttatatagtcataagacaaacgtattggacttcttggatcagctatgctcactatatgagaagaattacatcctttcacctgctatggaagctgagagcactgaagcatttgttgatatggtttgcgagcttagtaaagctaatgggttaccgtctaagggctataggtttgccctcccagaatttcctgctggtgaagtgagaaaacattttactaaggtgcagaattctttctatttcatagtaacttatccaattgacaaaagcacatttttgactgctgatctgcatcttctggaatcaatagaatttaaacaaaggacaaagcacattgtggaaattattgaagaggtggaatggcgtgatgttgaccccgacactataacaagcaaattcattagtgatattgtcatggccttatcatcttcaatggccaagcgggatcggaattctgaaagtgctcgttttgagattctgaatgatcagcatagtgccattattctaaataatgaaaattcaagtattcatattgatgcggttcttgatcctttaagtccaaccagccagaggttgtctggaattcttcgagttttgtggaaatacattcagcccagcatgaggattgtactgaatccagtgagttctcttgctgatcttcctctgaagagctactacagatatgtagtaccaacaatggatgattttagcaacactgactctgcaataaatggtccaaaagcattctttgcaaacatgccgttgtctaagactctcaccatgaatcttgatgttcctgagtcttggcttgttgagcctgttattgcattccatgacctggataacattcttcttgagaaccttggcaacacaaggacattgcaagcagtttttgagcttgaagctcttgtcctcactggtcatttttctgagaaagatcatgaccctcctcggggacttcagctgatccttgggacgaaaactacaccccatttagttgatacccttgtgatggacaacctgggatattggcaaatgaaagtctcacctggagtttggtacttgcagcttgctcctggaagaagttccgagctttacattttaaaggaagatagtgaaggaaattatgataaaaaatcatcaaaactcattactattaatgattttcggggtaaagtatttcatatggaagtagtgaaaaaaaagggcaaggagcatgagaaattactccttcttgatgacaatgcacaagataataagaaaggaagtggcttgaattccaacttcttaaaatgggcttctggtttcattggcagcaacaaatcatccaaaaaggctgaaaaaagtccacaagagaaaggaaagggtggacgacatggaaaaactattaatatcttttctattgcttctgggcacctatatgaacgctttatgaagattatgattctaagtgttctaaagaatactcatcgtcctgttaaattctggttcataaagaactacctctctcctccttttaaggacttgattccacacatggccctagagtatggttttgaatatgaactagtcacatacaagtggcccacatggttgcataagcagaaagaaaagcagcgaagaatttgggcatataaaatcttattcctagatgtcattttccccctttctttggagaaggtcatttttgtggatgctgatcaagttgttagggcagacatgggagtactctatgacatggatataagaggaaaacccctggcatataccccattttgtgataataataaggagatggatggatataggttttggagacaaggtttctggaaggatcatttgcggggaaaaccataccatattagtgctttatatgttgttgatctgaagaagttccgagagactgcagctggagataatcttagagttatatatgaaacactaagcaaggatccaaatagtctagccaacttggatcaggatcttcctaattatgctcagcataccgtgcctattttctctttgccacaagagtggctatggtgtgaatcatggtgtggtaatgctacaaaatacaaggcaaaaaccattgatctgtgcaacaatcccatgacaaaagaacccaaactgcagggtgctagacgaatagtttctgagtggccagacctggattttgaggcaagaagattcacagcacgaatcttgggtgatgatcaagaatcagaatcaatacaaccccctaatcaatccaaggacttgaatagtgaaggttcatcgaatgaggacagggaatccagggctgagttatga

SEQ ID NO: 556 - DNA, 1890 bp, Glycine Max
atgttttattctcaaacctttttggcgcgaaagggcccactctccaccgtgtggatcgccgctcacctccaacaccgcctcaagaaatcgcactacaccgccaccgacatcccctccaccgtcctgcgaatcatggaccccggtgtccccatagcgctgcgaatgtcgggacaccttctcctcggcgtcgtgaggatatactccaagaaagtggaataccttcaccaggactgcaaggatgcactcaccggtctccacaaggcgttcgccacgcttcagttcgcccagccggaggaggccaggccggcaccgtttcaatcggtgactctccccggaacgttcgacctcgatgcgcaaaacatagacgaccaaatagagtacatcagcgacacgtcaaggttggtaaaatgcacaaaaaatgaaaacttagttggtaaaattcgcagaataatgaatgttgggtggttaaatgtgcaattaagccttctttattttgattttgtattagtccctggaggttttaagttatggttagtcctagaaagatggaaattgtcgtttcggaatctgaaagatgaaaaagttgatcaatttaaattttttaacacttctcaatgtgcagatctaattcctgtcacaatggatgagtatgtagctgtatcttttgatgaggtgcagccttattccttgatattaactatgtgtaactcctgtcattcttttgaatatgttcacagtccttcacagggaacccaagttgaggttggtcgggatgccaacaatgatgataatgtagaaaaccctcaggtatttacaaatcgtgaggataatgatgttgctgaaccaaacggaggtcttgaccaaactacgaatgaaaaggatcatgttcctggaatgatgcgtgatttgaattttaggatgtctgtgccatctcctatgaatccactaactccacctacctctcaaggagagattaatgttcccgattttgtggtccgtgaaagtccacccatacagcagccacaacggagaggaagaaaaagaaaacaattctttgatgaacccatagtgttaacaaatggattcatgaggagtgcacttaataacactcgtgatatactgcggaaaagaagggatgttccttcatctagtttgggtacctggaaattgaacaatattcgaagaaaagaacacatttttgaccagcccttatttttgtaccatgtaactcttttcaacatatctcatttggtcatctttgaggaagatcatgcagatgttaggatgggtgaagaaactctttctccaactaacgaaccccctgaagaatcattagctgctactaatgaaccccctgaagagccaatagctgctactaaccaaccccctgaagagccaatagctgctactgaccatccccatgaagagccaatagctactactgaccaaacctctgaagaggcaataactgctacttctcctgttactgatatgcaagttgaacacaatcgaaatgttgctgtcaccccccctgccaccgcccaagcaccacatgaagatgattatacgagccctaatagaagagattgcttcaatatgccttcatctcataacatatccattgcttctttgaatacaaatattgcatctgagagaatgcatacattagattatgcagtgtcacctggagttcatggattggaggcaatgcaaacaccagattcagatactcatgacttgatgagttctgataaaacagattacaatgtgtctattctgattacttttttggtagaaggaatgaatgaacttactccaaagagtaactcaaagagtttttcctcatcttcacacttcattttcttgaaatctaatggttctaacaactaa

SEQ ID NO: 557 - DNA, 960 bp, Glycine Max
attggcaggtttcttacaggtaaaagaagattgcaggatttattgcttcaaaaagataatcgcttttgtgctgattgcaatgctccagatcctaaatgggcgtcagccaatattggagttttcgtatgcttaaaatgctgtggtgtgcacagaagtcttggctctcagatatcaaaggttttatctgtgacattggatgaatggtcaagtgatgaaatagatgcaatgattgaagttggaggaaattcttctgctaattcaatttatgaggcttattttccagaaggatttacaaaacctggaccagatgccactcatgatcagcgtgtgaaattcatccggttaaagtatgagcatcaagaatttttgcaacctagtttgcgcattgtgtcaggaaaaagcaaccccccaaaaagtatatccaaagggattatggatagttttcgaattacaagtgattcacagcatatggaaggaatggtagaatttattggaatgttaaaggtgaaagtgatcaaaggcacagatttagctatcagagatatgatgacaagtgatccatatgttatcttgaaacttggccaacagactgttcagacaactgtaataaagagtaatttgaatccagtctggaatgaggaacttatgctgtctgttcctcagcaatttggaatattgaatttgaatgtatttgattatgacttgttttcggctgatgacataatgggggaagcagatattgatcttcagcccctgataacatccgcaatcgcatacggtgatgctagaatgtttgatgatatgcagataggaaaatggctgaaatccaatggcaatgcgcttatagatgatagcatagttaatatagttgatggtaaggttaaacaagtcatatcactcaagctccagaatgttgaatctggagaattagacttagaactcgagtggatgcctcttgat

SEQ ID NO: 558 - DNA, 254 bp, Glycine Max
attttacaggcttgcaagaagcttaagcagatagaacttgcagattgtgaaatctatgcttcttgtgaaccttgccccatgtgctttggtgcaatccacctttctcaaattaagtggttggtttatggagcgaaggctgacgcagcaattgctattgggtttcatgatttcattgcagatgcactgcgagctgatggtaatgaggtcatcattgctgaagaggtttttgagaaaacaaaggaaaaattccaact

SEQ ID NO: 559 - DNA, 147 bp, Glycine Max
catgaagaacaagaggtaacagctggcaatgtgttcgcttgtgttgggtggaaagtgaactgtgaaccacgcgatgccctaaacacaaatttcactatacacataacacataacacattacacaccaaatctaaaagagttttatag

SEQ ID NO: 560 - DNA, 750 bp, Glycine Max
catttgcgcattaaacgagaattagggtttgtagtgcagcaggaagaagcaataatggcgccgaagataacacgtaaggttagcagaaaccccgaattgataaggggaatcggaaagtactcgaggtctcaaatgtaccacaagaggggcatttgggctatcaaggccaaaaacggtggcgttttacctcgccacggccctaaacccaaacctgaaactcccgctgaaaaaccacccaaattttaccctgctgacgatgtcaagaaaccccttgtcaacaagcacaaacccaaacccgcgaagctcagggctagcattactcccgggacagtgttgattcttcttgccggtagatttaagggaaagagggtcgtctttttgaagcagcttccttctgggttgcttcttgtaactggtcctttcaagattaatggagttcctttgagacgtgtgaatcagtcctatgttattggcacttcaaccaaagcaaatgtctctgctgttaatgtcgaacagtttgatgacaaatactttacaaaggaagcccagaagaagaagaagggagagggcgaattctttgaggcagagaaggaggaaaagagtgtgttgccccagcagaagaaagatgaccagaaaactgttgactctgcgttgataaaagccatcgagagtgttccagacttgaagacttatctgggtgccaggttttctctaaaggctggcgtgaaacctcatgagctagtcttctag

SEQ ID NO: 561 - DNA, 690 bp, Glycine Max
cccgagatcgttttctttgatttggaaactacagtgcccaaaaagggtggagagcgtttctgggttctggagtttggtgcaattgtggtcacaccccacaaactcaccgagattgagagctacaccacgctgataagacccaaagacctatctgtggtgtcagtgaaatccagcagaagtgatggaataactcgtaaagctgttgaaaatgcaccatcttttgaagatgttgcagacagaatattcagtatcttgaatggaagggtgtgggcggggcataacatccagagatttgactgtgttcgaatcaaagaggcctttgatgatatcaataggccagcaccggttccagttggaatcattgattctcttggggtcctaactgagaagtttggaagaagagctggtaacatgaagatggcaacactggcttcttattttggcctgggccaacaaaaacacaggagcctggatgatgttcgcatgaacctggaggtgcttaagcactgtgcaacggtgttgtttctggaatctagtctaccaaacatgttgcatagcaaatcgcatggatctcccagcgaagagactagcagaaaatctcccccagctacgttaggatatcagaggacagtcccctatgctaggggaagtttgggaaaggttttacttttattttatacattgacataa

SEQ ID NO: 562 - DNA, 1599 bp, Glycine Max
cctataaaatatataaattggatcaggcatgagctaatttttggattaagtttaaagcctttcgtaacactactccattacgatcatccccaaagcatagaagatgcatatggtggctttttgagcccaaaagtagtgaaggatttcacggactatgcagaggtgtgcttcaaagcatttggtgacagagtgaaatactggatcacaataaatgggccatcgattttctctcaacagggttatacaaatgggatatatgctccaggaagatgttccaactggttgcaattgaactgtacaggtggtgattctgctactgagccctaccttgtttcccaccatcagcttcttgctcacgctgctgctgtcaaagtttataggcaaaagtaccagaaaacacaaaatggacaaatagggttagtccaggcagttgactggactataccattatcccaatcctcggcagacattgatgcaacatttagggccagagctttcaagttggactggactatggaaccactaaattctggttcgtacccacttgagatggttcactatttgggggaaagactgccaaagttttctaaagagcaatcagatatggtgaaaaattcttttgattttattggcatcaactattactctacaacctatgcagccgatgctgaatgcccaagaaaaaataaatcctacctcacagatttatgtgctgagcttacttatgagcgtgatgggattccaatcggcccaagggctgcctcggaatggatatacatctatccacaaggaatcgaagaatcgcagcctctgcacaacttcgccctccccttcttgaaatggggcgctagcagcaagaacaacaccaccaccacttccaccgcccctccgaccccaactcccgcccccatcgcctcggatccagaaccgcgcgcaaccgattctcactccctctcaaaccaccgccaccaccacaattgcacgaagccgaacacgacgacgcagacgacgccgtgcagaagccatggaaacagcgccctcgcaagcccgcgcttctccccaaggccacaatcaagattggcaccggaccttcccgaaaccaccaccacgccaccaacaacggagaattccactaaggcggcagcggcggcgacaacaacaaccccgcaccgaagttgctgtggctccgcgggttttctgtcaatagtggaaatttcttctttgttaattgcctttcagtggggagtttcttattttatttggttttatagtgagcgcaaattcaacaatccagtcatatacataacagagaatggttacgataattttaatgatgaaaaagtatcacagctcaaagaccaagagagaatagattgccacattcaacatatttcttatgttcgtagtgctatattgaatggtgtcaacgtgagaggctactttgcatggtcgcttttggacaatttcgaatggtcagatggttacactgttcgatttgggattatttatgttaactatacggatggattgaagagatgtcccaaagattcagctaaatggtttaagagctttctccatcaagaatttgaatcccagtga

SEQ ID NO: 563 - DNA, 2007 bp, Glycine Max
cctctcctgtcttcaccgttcctctctttttccgacgcgcaaacactcacacaaatttcgtttctatttccgactacaactctctttccccaattctccgatgaccggcggcgacgagcgtcaccggacggagacctaaaaacatctctcacacacacactcattctccggcaggcatgtccgaggacgcggacctcgctctgcagaccttccgcgcgctggtggagagcgcggaccggaagttcggccgtccagtatcagcagcagcaccacgcgttccagaaggtgttcaaggcgtacacgaggctctggaagcaccagcaggagaaccgcgcgaagctggtagagtgcgggttgaagcggtgggaacttggtgagatcgcgagccgaatcggacagctgtatttcgggcagtacatgaggagcagcgagtgcaggttcctcgtcgaggcctacgtcttctacgaggccatactcagtagaaggtacttccaaggatccgaactcaacgccaaagatctcggagtgaggtccaaggagttgaggttctacgcgcgctttttgctcgtttcggttattctcaaccgcaccgagatggttaagcacctcgtcgaacgctttggggctttggttgaggattgcaggactacctttcgggaaactaactttaaggaatggaggcaagtggtgacagaaattaaccgtttcacgaaagttgataagggctttagtttcaggcccatgcgttattgtgccacatttgatactcatcgagcttctcttccttatgtggctcgttttcatgcaaagagggtattgaaatttcaagatgcactgttgacaagctatcatcgaaatgagatcaagtttgctgagcttacattggacatctatagaatgatacaatgtttagaatgggagcctagtgaaacattctaccaaaagcatacagttaaacctaaggagaatggtgacataattgatcattcaggagcttctgggataatagacatgaatcttactgcagatatgactgatccaactatacctcctaatcctagaaaggctaccctgtaccgtccatctgtgacacatgtgatagcagttttggctacaatttgtgaggagctgccaccagactgtgttgtgctagtatatctttcagcctcagggaaggctggtcttaataatgtctctcaggtggaaaattctggcggttcatccaaatattcaagacacaaagtcctttctcagacttccctaggacagaattctggaccttctgaaactcaaagtaatggcaagagagaactgagctattatgacaattatctgtggtttggtcccaagggaaatagtggtttaaataatctctaccctggcgatcttatcccctttactaggaaacctcttttcttaattattgacagtgataacagccatgcattcaaggcaggatattccttgaatctatttttacttgctaatggcttgatgacatttgttttacatggggctgaaaggggtgaaacggctgctctatttctttcacctttaagaccgattttcaagaatccatctgatgtaaattcaaatagtggaagccaatttacctattttttgactgctcctttgtcagcattttgccaaatgattggtctcacccccaatgaggctgatacagatgtctacaatgaagcagagaacattatcgctaatgctttcacggagtgggaaataattctttgctcatcaactaccatggatttagtatgggcgcaggttataagtgatccatttctaaggcggcttattctaagatttattttctgccgatccgtgatatcttttttctgcacacctgaggaaagtgaacagtaccttccactttgtttaccctatctaccctcttctgttgcaccaacgtctgaagccgtgcgttctgctgttgtgcaacttgccatgcactttgacgttgctgactcctttcactttactgaaacataa

SEQ ID NO: 564 - DNA, 639 bp, Glycine Max
cctggccgccacgccccagccgcaggcacgtacatcgtgcagttcccgaaggaccaagtgtaccgcgttccaccacgcgagaacgcgttgatcgtggaacagtaccgcaacccggccaccgcgaaaaaaagacgcggcggttgttgttgctgttgcaaccgtcgtgtcttgataaccttcgctctcgtggttaccacaatcgttgccgtggttggcatcacgttggccacgttgtactttattttcagccccgcgggtcccaagtttactgtctcccatgtggcggtgaataggaacaacaagaactcgcagggggcggcggcgcagtatgaggtttcgttgagagcgaggaatccgaacgagaagttggcgattcagtaccaggaaggggacgtgtcgctgttgttgttcgatgagagtaaggttgccgaggggaagtttccaacgttggagcaagggggaggtgaggcgagtgaggttaagcttgagctgaccggatccagtggagcgtttcccaggggaatgcatggtggggacgcagccgtggatttgaaattggagatcaaacttgcgataaggattaggaccgcgggtctcgaaacgtggggtatgagctccaatgtggcgtgtcagtttaag

SEQ ID NO: 565 - DNA, 249 bp, Glycine Max
cgtgacccagtgactggaaaggagcccgatttgcagactttttggcagttgacacacaaaagggacaacggggaatggattgacgaagcatctaaggaaatcaatgacaaagttgctgaacaaattaatgagaagagatgtcaaatagaagattctcaggaagtggtggaaacaatggaacaagaaattattaatactgccttcaagacagtggttgggaaggaatcatttatgcaagctacaggctga

SEQ ID NO: 566 - DNA, 867 bp, Glycine Max
ctactcataatctcatgcctcggtttgatcgtcacactcaaccgcttcatctccttcttcacatggatcttccgaacctgtttccgatccgagaagaatctcctccgaagctacggttcgtgggctctggtcaccggagccaccaacggcatcggaaaagccttcgctcaccaactagcgcagagaggactcaaccttattctcgtgagtagaagcttccagaagctcaaaaccgttgccggtgaaataaaagcaaaacaccccggcacgcgcgtgaagatcgttgagatggacttcgccggcgacctgacggagggtctccggcgcgtggaggaggcgagtgagggtttggatgttggcgtcttgatcaacaacgtggggataacgtatccgagggcgatgttctttcatgaggtggaggagaaagtttggaggaacattgttagagtgaacatcgaaggaaccacgagagtaacgaaaattgttttacgtgggatgttacaaaggagaaagggtgcgattgttaacattggatccggtgcttctgtggttgtgccttctcatcctctctttaccatctatgctgcttcaaaggcttacgtggaccagttatcaagatctctgtacgtggagtatggacaatacgggattcatgtgcaatgtcaggtaccactatacgttgcaacgagtatggtatcaagggtggcatgtattgagagagattctttgttcataccaacagctgaggcttatgctagagctgcaattggtgaaattgggtacagaccaaagtgcacaccttattgggctcactcaattcagtggtgttttgcaaacttaatccctgatccactacttgatgcttgg

SEQ ID NO: 567 - DNA, 1683 bp, Glycine Max
ctattgattctgtgtttctttgtcattttggggaattttcacaaagctgaggccagaattagacattacaaatgggaggcgaagtatgagtttaggtcccctgattgctttaagaagctggttattacaatcaatggcaaaactccaggacccagcatccaggcacaggagggtgataccattattgttcaagttaacaatagtttagtcacagaaaacctttccatccactggcacgggatcagacagattggaactccttggtttgatggaacagaaggggtaactcagtgtcccatattgcctggagacacatttatttatcagtttgttgtagacaggcctggaacatatctttaccacgctcactatggaatacaaagggaagcagggctatatgggatgatgcgggtggcaccccgtgaccctgaaccctttgcttatgaccttgaccgaagcattattctcaacgattggtaccacagtagcacttatgaacaagctgctggattgtcttcaattccatttcgatgggtgggagaacctcagtcacttctgattcatggaaaaggaatattcaactgctctaaatccccaagcttaggcactgatgtttgtgacgcatcaaaatgttctccctttgtacaaactgtgatcccgggaaaaacataccgactcagaattgctagtttgactgctttatcagcacttagcttccaaatagagggccataacatgacagtggttgaagcagatggtcactatgtggaaccatttgtggtgaaaaacctgttcatatactctggtgagacctattcagttacagtgaaaagcgatcaagatccgtcaaggaactattggataacctcaaacgtggtaagcagaaacagaagcaccccagcagggttaggcatgttcaactactaccccaaccacccaaaacggtcccctccaacggttccaccttctcctcctgcttggcatgacgttgagccaaggctggcacaaagcttctccatcaaggcacgccaagggtacatccacaaacccccgacaacctcggacagagtcatagtactcctcaacacgcagaacaacataagcgagtaccgccattggtcagtgaacaacgtctctttcacactccctcacaccccttacctcattgcccttaaagagaacattaacggtgcgtttgactccactcctccacctgatggctatgactttgcaaactatgacattttcagtgtggctagtaacgcgaatgcaacttctagtagtggcatttatagactgaagttcaacaccacggtggatattatacttcaaaacgccaacaccatgaccaaaacgaatagcgagacacacccgtggcaccttcatgggcatgacttttgggttcttgggtatgggaagggaaagtttgacgtgaacaatgacaccaaaaaatataatttggagaaccccattatgaagaacacggttccggtgcacccctttggttggaccgcattgaggtttaggacggataatcctggagtttgggcttttcattgccatatagagtctcacttctatatggggatgggagtggtttttgaagaaggggtagagagggttgggaagttgccttcatctatcatgggttgtggtcaaaccagaggttttcacgggccataa

SEQ ID NO: 568 - DNA, 820 bp, Glycine Max
ctattgctggcccctctcttgatgtgtctctttggagtcactgctgagggtgatttctttgaagatattgacatcacttggggtgaacatggtggtgtaaatatactaggaagcaactctctcgtgctttctcttgaccagtcctctggctctggctttcgatccaacgcagaatatctatatggtagaatagacatgcagattaaacttgtctctggtaactcagctggcacagtcactgcatattatctatcttctgaagggccaaaccatgatgagattgattttgagttcttgggaaatctcagtggagaaccctacatagtccacaccaatatctacactcaaggcatagggaatagagaacaacagttctatctttggtttgaccccacaaaatatttccacacttacactattgtatggaaccctcagcgcatcattttcatggtagataatgtccctattagagtcttcaacaactatgaagccaggggagtaccatttgctagcagccaggccatgaggctatactccagtctatggtgtgcagatcaatgggcaacaagaggagggcttgtgaaaaccaattggtcctatgctcccttcaaagcttactataggaactttgatgctaaagcatgtgtgtggtccaaaggatcatcttcctgtccttcaagcccaccttccatgactcataatacttggcaagctcaagatttggatgctgatggtagaagaagtctgagatgggtgcaaaagtattacatgatttataactactgcaaagattacaagagattccctcaaggtcgacctc

SEQ ID NO: 569 - DNA, 249 bp, Glycine Max
cttcctccgccgccaccacctcctcctccaccaccgcctcctccaccaccatcgtacctcctaccattgctgcctccatacttgccaccaccacccattgcctctgttgtacctgtctctacttcctccttggctgtagtccctagccagatgtcccgattcaccacagttaaaaaaaaaattcttgcgtgtaatttcacccagcaacaagtacatgtggcatcactcatcgcatgtcaacgtgtctag

SEQ ID NO: 570 - DNA, 309 bp, Glycine Max
cttggtcttctccatgaggtggctttctgtatccatggattgaggcactggccaagaacaagcctgagctactctttcggtctatccaacggtttcgcgaagaagcccatgctctcaatgacggtggtggagtcgagagacttcctcatcccgctctctgaatccatcgcgttccacagactccctttcttcgagaccatcgcggtcatcaccaaggccaagggagctaacctcttttgctggaaccaccgccgtggattcctctgcttagccaggcagaagcacatttgcatctttcgacacgacggt

SEQ ID NO: 571 - DNA, 1962 bp, Glycine Max
gaactatccctcagggctgttacttctcttactcaaggtgaaactgaaccaccaacttgggtccatgcagaacagcctcagcctctagctatttttgttgcacccattgtgtcctcttacaatgagagaatacgtccagttctcgatgctatggaaaatctgaggcgccttaacattacaaaggagggaattcagtttccttccattgttgttgttggcgatcaatcttcaggtaaatccagtgttcttgaatctttggctggtattagtctgccacgtggccaaggcatttgcactagggtgcccttggttatgaggctccaaaatcaccctcttccaaccccagagcttgtgttggagttcaatggcaagaccatttcaacagatgaagcaaacgtttctcaagccataaatgctgccacggaagagcttgctggccatggcaaagggatttccaacaaccctttgacgttgttggtgaagaagaatggcgttcctgatctttctatggttgatcttcctggtataactcgggttccagttcatggtcaacctgagaatatttatgaccagattaaggatatgatcatggagtatataaagccgaaagaaagtattatactgaatgttctctctgctagtgttgattttactacttgtgagtccattaggatgtctcaaagtgttgataaagctgggctcaggacattggctgtggtgacaaaggctgacaagtctcctgaaggcttgttagagaaagttaatgctgatgaggtcaacattggtcttggctatgtttgtgtcagaaaccgcattggtgacgagtcttatgaggatgctagagtgaaagaacagaggctgttcgagttccatccacttctttccaaaattgacaagtctattgtgggtgttccagctatgagcatatctaaaactttgccagaaatagtgaaaaagatcaatgagaagctggctaataatttgtctgagttggaaaaattgccaacaaacttggcttccgttgctgatgccatgaccgctttcatgcatattattggattgacaaaagaatctcttagaaaaattattcttagaggagaatctgatgagtacccagaagataaaaacatgtattgtactgcacgtttggttgagatgttagattcctattcaaatgatctttatcgttgtgctgaaagtgatgcaagtaagaattttcttatgcaagagataaaggtactggacgaagcaaagtggattggtcttccaaatttcatgcctcgcactgcttttctttctatattgcaagggaaggtgaatggaattgcaagcaagccaataggtttggttgaaaatgtgtggaactatcttgaggatgtgctgatttctgttatcacgcgtcattccgaaaactactatcagcttttgatttctacctatcgtgcaggccaccatgtaatggaggccattgaaatggagaagcataccgattacacatgtaaccctgagtttgtgcaggaatacaataagttaatatctcagcaagatgcttttctgaatgacgttttgaacaatccggataaaccatcacatgtgagtcttgaaggtgtgggcaaaattgaagtcggtcatttgaggcaatacccatctttgcttactcaagcctttgatttgaaggttaggatgatttcgtactggaagattgtgcagaaaagattgattgacacaattgcgttacatcttatgctgagtattaacaatcttgttaacaaggatttgaaaaacgagattgttcatgatctgttatctcccagtggtggtgggattgaaaggttattggaggagtcaccttcaatttctgggaagcgtgaaaagctgcagaggagtgtcaatgtccataaagagagcaaagaaaccgttgcaaacatcattgaccgtattggcagctgcagtgattattga

SEQ ID NO: 572 - DNA, 2349 bp, Glycine Max
gaagactacaatctgagggagaccgatccacagcttggtggggagcggtggcctaatgccacaagagggtggatgagtggtggtgaaagattctcaagcacacatgaccttgttgagcagatgttctatctgtatgttagggtggtgaaagccaaagatctttcccccagcactctcacctcaagctgtgatccttatgtggaagtgaagctggggaactacaaaggaagaacaaagcacatagagaagaaaaccaacccggaatggaaccaagtctatgctttctccaaagacagatttcaatcttctgttttggaagtcattgtgaaagacagagaaatgctgggaagagatgattatattggaagggtggcatttgatctcaatgaggttccaaccagagttcccccagacagtccactggctcctcagtggtacagactcgaggaccggcgaggagaagggaaggtgaggggtgatatcatgcttgcagtgtggatgggaactcaagctgatgaagccttctcagaggcatggcattctgatgctgccactgtgtatggagagggtgttttcaatgtcagatcaaaggtttatgtgtcaccaaaactgtggtatctaagggtgaatgtcattgaagcacaagatgtgataccaagtgacagaaaccggctgccagaggtttttgtcaaggctcagatggggagccaagtgttgaggaccaagatatgtccaagtagaacaaccacaccactttggaatgaagatttggtatttgtggcagctgaaccatttgaggagcagttgacaatcactgtggaggatcgagtgaacccttcaagagatgaagtacttggtaagataatcttgccactgaccctctttgagaagcagctagaccaccggccagttcattcgcgctggttcaatcttcagaagtttggttttggaatgatggaagctgataggagaaatgagctcaagttttcaagcaggattcacctaagaatttcccttgaaggtggataccatgtccttgatgagtccactttgtactccagtgaccaaagaccaacagctagacagctatggaagcagcctattggggtgcttgaagtaggcatcttaggagcaaaaggactcctcccaatgaagatgagggatggccgtggcaccctggatgcatactgtgttgccaagtatggccagaaatgggtcagaaccagaacaattcttgacacttttagtccaaaatggaatgagcaatacacatgggaggtttatgatccttgcactgttataacacttggtgtctttgacaactgccatttaggtggaggggaaaaagccactgctggcactgcagccagggattcaagaattggaaaggtaagaattaggctctcaacacttgaagctcataggatatacactcatagttatccacttcttgttttgcaccctcatggtgtcaagaaaatgggtgagcttcagctagcagtgaggttcactagcctctcactggctaacatggtttacatttatggccaacccttgcttccaaagctgcattactttcgccctttcaccgttaacctagtagagagtttgaggtaccaagccatgaacattgtagctgttaggcttggaagagctgaacctcccctcaggaaggaggtagtagagtacatgttagatgttgattcccatatgtggagcatgagaagaagcaaagccaacttcttccgaatcatgtcacttttctctggattcatcacaatggggcaatggtttacccaagtttgccattggaagaaccccatcacatcaatcctagttaacattctcttcctaatactcatttgctaccctgaattgatacttccaaccttgttcctctacatgttcttgattggcctgtggaactataggtttaggcctagacacccaccccacatggacacaaaactctcatgggcagaagttgttcaacccgatgaactcgatgaagagttcgatacattcccaacttctagaccacatgatgtggtgagaatgaggtatgacagacttagaagtgtggcaggaaggattcaaacagttgttggggacatagcaacacagggagagaggtttcagtctctactgagttggagagacacaagagcaaccagcctctttgtagtgttcagcttttgttctgctgtggttctctatgcaacaccaccaaaagtggtggctatggtagcaggcttgtactatctgcggcacccaaagtttcgcagcaagcttccttctgtgccaagcaacttcttcaagaggcttccagctagaacagatagcatgctg

SEQ ID NO: 573 - DNA, 1497 bp, Glycine Max
gaagcagatgcaaactttcaagggaaagtgcatgagttctcttctacagctgaggagcacagacccagagaagctgattcacaagaagaatttcaggattttaatatgagtaaaagaaagaggaaaaactggtggaagcgctttgtgaacatcaggaaaggcggtgaaggaaatgcagggacaaataaaactcgaagaataaaggtgaggcagaataaaaagaggtggctggagttcagtggcctataccttggacaagaggttagagcacacaaaggcctaatctggaaaatgaaatttagtccctgtggtcagtatttagcaagtggaggtgaagatggtgttgtttgcatatggcgtgttacatcactggataagtccagtatttgttccaccacagaagacagtacttctaatagtaaagtggaatgtgacaactcttctcctcggaacaaacactcaagtcaacccttcattttccttccaaatagtatttttcaaattgaggaatcaccactgcaagaattctttggtcattccagtgatgtcttggatttggcttggtctaattcagatattctcctttcatcttctatggacaagactgtccgcttgtggcaaattggttgtaatcaatgtctaaatgttttccatcacaatgactatgtgacatgcattcagttcaaccctgttgatgaaaattacttcattagtgggtccattgatggtaaggttcgaatatgggggatacgtgaagagcgagttattgactgggcagatatacgagatgtcataagtgctataagttaccagcaagatgggaaaggatttgtagttggttctgttacaggcacttgttgtttttatgttgcttctggaacatatttccagcttgaggcacagatagatgtccatggaaaaaagaaagtgtcaggcaacaagattaccggcattcagttctcccaaaaaaacagtcagagaataatgatcacatcagaagattctaaaatttgtatatttgatggcactgagcttgttcagaaatacaaaggaagtcagatgtctggttcatttacatcaagtggaaaaaatataatctcagttggagaggactcccatgtatatatttggaactttgatgacatgggaaatgcttcttcgaaacagacgaaatctgaacgctcctgtgagtactttttctctaaagaaatgccaacccaacagctagaggttgcccctgagactagagatcacgaacttttttctcttggtaattggttcaccactgatggctcgtgtcgaggttctatgacttggcctgaggagaaacttcctagctgggatttacctatagcagaagaagaccagcagttatctcacaaagataattgccatgacagaagtgtatcagaaacatggggactatcaattgtggcagctggttgtgatggaactatcaagacattccacaactttggattgcccgttaggctttaa

SEQ ID NO: 574 - DNA, 1416 bp, Glycine Max
gaatttgacaagtgcggaatatcatggcataagcccacagttaaacgatcttttcagaaccttgaatccattgctggtgtccaaaccaacaacccctccatcatcgatcttcccctcactcaagcttttcaggcagtggtgaaaagtcttggggacaacgatgtgatggtgatattggacaaccacataacccagccagggtggtgctgtagtaactccgacggcaatggattcttcggtgacaaatttttcaacccagaccagtggatattgggcctcaccaagatggccacccttttcaatggtgtcactaatgtggtgggcatgaacttgaggaatgagctccgagggcccaaacagaatgtcaacgattggtacaagtacatggtgaaaggagcagaagcgattcatgcagcaaatccagatgttcttgtcattctatctggcctaaattatgacaaagacttgtctttcattcaaaaacggccagtgagcctcacatttaaggggaaattagtatatgaggcacactggtatgccttcactgatggtcaagcttgggttaatggtaatccaaaccaggtatgtggacaagtggcaggaaatatgatgagaacctcaggcttcttggtgaaccaaggatggccattgtttattagtgagtttggtggagacttgagaggtaccaacgtgaaccacaatcgctaccttaattgcttcttagcactggcagctgagcttgacttagattgggcactgtggacactcgttggtagctactactttagacaaggagttataggaatggaagagttttatgggattcttagttgggactggatccaagttagaaatactactttcttaaacagaatctctgccctccaacttccatttcgagtattgagtttgccaccatcgatgtatatgtccaggcataacaagaggcaatccatacaaattgatattccatcctttgactggtttgtgtgtcataagaaagtcattactagatcgattgacattgggtcctgctatttatctgatggttggaaatacacaccccagaaaattctatcaataaagggtacttacttctgcatgcaagcggggagtgaagggatgcctgcgacacttgggataatgtgctcagatcctaactctagatgggaaatgatctcagattcgaagttgcacctttcatcaaaactcagcgatgattctaatgtatgcctagatgtggatgacaacaataacatcgtgaccaatgcttgcaaatgcttaagcaaagatcgtacatgtgaccctagtagccaatggttcaaacctattgacagcggaagcaggtcaatgttgacaacctcaacgtcatccatgctatataaattcatcggaccttttatggaagccgtttag

SEQ ID NO: 575 - DNA, 1365 bp, Glycine Max
gacttaccctccttacatacaatagttcattttctccattttaatttctttatttcttttctttttatgtggaatgagcagacaagatttgggatcacagctccggggaaatatcgaataatttttttcatcgatagaatttcgcagagtgacataaaaatagtgaaagaaattgggctggattcctttagattctccatctcatggagccgcatattaccaaagggcaaaggagccgttaatcccttgggggggttaaattctacaacaatctcatcaatgagatcctggaaaatgatcaatttcttcagtcaattatattttttttatccacaaaaattgaacacaatatcaaacgtttatagcatgggtacattctgtttaaccaaggtggattttcataattatgctgacttttgcttcaagacatttggggatcgagtcaaacatagggtgactttgaatgagccaggatcatttgcccttgctggctacaatgctgctactttgcaccaggtagattctaaatatgccggaaattgcactgttggtgactcagccactgaaccctacattatctcccataatttaatacttgcacatggaacggctgctacattgtacaagaagaaataccaggtaactagtggttcacttattgaatatcttgtatttttaagacatttttgttattggtttgacacattactgtatgctcatccaattacatatggtcactatccccagagtttgagatctttagtgggttctagactccccaaattcacaaaagcagaatcagcaagtctgaaaggttctcatgattttcttggtgtgaattattacagcacacattctgcagaatatgctgcaccagtcagcaccaataggaccttctacacagcggaaaggaatggtgtagctgttgggacccggactgatttgaataggctctttatccatccgaaaggacttcataatcttacggcatacgtaagggatacttacaagaacccacccatttacattactgaaaatggaatgactcgataccaatcaaccaagcccacaaggatagtatcaggattaaatatcatgatagtcatcttaaaagatggtattaatgtgaagggctactatgcattgtctttttcggacagctttgaatgggatgctggttacacagttcgaattggcctcgtgtatgttgatttcaagaacaatttgagaagatatcccaagtactctagtttttggctgaaaaagtttcttctcaagggacctagattcattgttccaagggggttcggaaaattagagaaattgaaaaatcagaaacttgagagaaagagaggcccaccgtaa

SEQ ID NO: 576 - DNA, 195 bp, Glycine Max
gagaagcgcgttgccaagtttgctcgtcgctcctccctttccaacctctccatcctcgtcatcgactttactgtctttgtcggctcccatgtctccctctccctcaagcattatggcaacgacatcctcggcctcaataatttcagttactaccacaccccctctctcaagtgcaccttccagtgcctcctgtaa

SEQ ID NO: 577 - DNA, 720 bp, Glycine Max
gagagtgctttgatattgattcgtcatggggagtctttgtggaatgagaagaacttgttcacgggatgttgcgatgtacctttgaccaatagaggtgtagaggaagctattgaagctggtcagaggattagctatatacccattgatatgatctttacgtccgcactcattcgtgcacagatgaccgctatgcttgcaatgactcagcactcccagaagaaggttcctattatcatccatgatgagagtgaacaggcaacaacttggactcaagtttacagtgaaaaaaccaccaagcaatctattccagttattacagcatggcagttgaatgaaagaatgtatggggagttacagggtcttaataagcaggagactgcagaaagatacggaaaggagaaggtgcatgaatggcgtcggagttttgacattcctcctcccaagggtgagagcctggaaatgtgttttcagagagctgttccgtattttaaagattttattgaaccccaactaaaatcaggaaagcacgtgatggttgctgctcatggaaactcattgaggtctattataatgtatctggacggattaacttctcaagaggtcactagtttagagatatcaactgggataccattgctttacatatacaaagaggggaagtttaacagtagaggaagtcctgtggggcctacagaagctggtgtttatgcatacactcag

SEQ ID NO: 578 - DNA, 1317 bp, Glycine Max
gagtcgatcatgggaggtaagagttcaaaagggtctgaaagaaggcatgtttcatcatatggatctgctggttcttcatcttcatgggatgactacgaataccctcaatcaccaaatgcatacccacaacaaaatccttatcatacgcctcttcaccaccgtgcaccggctccattccacgactattcacagccaaaaaggaaattggataggagatattcaagaatagctgatgattaccattccctggatgaggttaccactgctctttcacatgctggcctggaatcttccaatctcattgttggaattgattttacaaagagcaacgagtggacagggaagaggtcattcaaccgaaaaagtttacatcatataggaagtggtcagaatccttatgaacaagcaatctcgatcattgggaaaacattaagtgtttttgacgaggataacttgattccttgttttggatttggagatgcatcaacacatgatcaagatgtctttagtttccattcagatgagaggttctgcaatggatttgaggaagttttgtcaagatatagagatattgttcctcgcctgcgtctagcaggacccacttcatttgcccctattattgagatggccatgactatagttgagcaaagtggtggccaatatcatgtcctgctaataattgctgatggacaggtgaccagaagtgttgacacacaacatggccagctaagtccacaggaagagaagacaattggtgcaattgtaaaagccagcgggtatccactttcaatagttttggtaggggttggagatggaccgtgggatatgatgagggaatttgatgataacatcccagctcgagcatttgacaattttcagtttgtgaattttacggaaataatgtcaaagggtatagactcaagcagaaaagagacagagtttgcgctatcagctttgatggagataccttctcaatataaggcaaccatagatcttggcatattgggtagtgcacggagaggacattcaccagacagggttcctctacctccacctcattatgagagggcttctagcagcagcacaacatcttttcgatcaaacagttttcagcatagcacaccaacatatgataatgtaaacgcagaatcgtcttcaagaagctcatatgataataaggtttgcccgatttgtcttactaatgggaaggatatggcatttggttgcgggcatcagacttgttgtgactgtggagaaaacctcgaatgctgccccatttgccgaagcacaatcactaccagaataaagctttactag

SEQ ID NO: 579 - DNA, 204 bp, Glycine Max
gagtgctcggtttgcctcggagagttcgaacacaacgagagtctaaggttgttgcgcaagtgtagccacgccttccacattcatcaatttaccatgggaaaatatataacacaaacggttctatggtcgacctgggttcgactcccggtaggaccttttccgtcttctaatgaagcctttttttttttaattctgtctgaataa

SEQ ID NO: 580 - DNA, 2631 bp, Glycine Max
gagtttgaagacacacttggttacatagctaagattcgcccccaagctgaactttatggcatatgtaggattgtccctccagcttgctgggtaccaccttgccctcttaaggagaaagatttatgggaaaatgcaaaatttcccactcgtattcagcaaattgacttgcttcagaacagggagcccatgagaaagaaaattaggggaaggaaacgaaaacatagaaaacagtcaaagatgggcatgggtaggagaactgccaaatcaggttctgaagctaatgttgcttctgagcctgaggagaagtttggattccaatcagggtcagacttcacacttaaagactttcagcaatatgctagtgtttttaaagattgctactttggattgaatgatgccaatgaacatgaaaaagttagtgataatagtcaccagcagagatggaagccctctgtggaggaaattgaaggcgaatactggcgaataatagagcaaccaactgatgaggttgaggtgtattatggagctgacttggaaactggatcacttggaagtggttttcctaagatatcatccttaactaagaacgagtcagatagatataccttgtctggttggaatctgaataacttcccgcgactgtcaggttctgcattatgttttgaaggaagtgatatctcaggagttgtagttccatggctgtatgttggaatgtgcttttcctcattttgctggcatgttgaggaccatcacctctattcacttaattatctgcactggggtgacccaaaagtatggtatggaattcctggaagccatgctccaggtctggaagatgcaatgagaaagcacttgcctgatttatttgaagaacaaccaaatctactcaatgaattggtgactcagttatctccttcagttcttaaatccgagggggtgcctgtacatcgcactgtccagcattcaggggaatttgttgttacctttccaagggcataccactgtggcttcaattgtggcttcaactgtgcagaggctgtgaatgtggctcctgttgactggcttctgcatggccagaatgctgccgagctttacagttcgcagtgccgtaagacttcattgtctcatgacaagttattatttggatgtgctcaggaagccgtgcatgcccttgcagatttaactcttcatggaaaagaagatctaaaatatataaaatggagaagcgcttgtgggaaagatggagttcttaccaaagcagttaagataaggataactatggaaaaggagaggcttgactgtattccaactcatttaaagatgctgaagatggacagtaagtttgatttgtttgaggaaagagaatgctttgcttgcttctatgacttgcacctatctgccgtaggttgcaagtgctctcctgactgttattcttgtctcaaacattcaaatttgttttgctcatgtgaaatgaacaacagatttattctgtttcgttatactatggatgaactaagtacattggttgaagcattagaaggagaatcgcatgctattgaagtgtgggcaaatagaaacactgtaatggtttctgctgatgctgaggatgcttgcatttataaacaagatgtggagagtgccatttgccaaacccagagttacaaagaagggaaaaactcaacttattgtgcaggaactaatgataagtcaaattcaactatacctagcagttcttacagccaaatttcagcagaattggttcactcagagtttcaccatgaaactcttagtgcaccatctgacactaaagattgtcataaagatagtttgaatgaaaaagatttggccatggacaataaaattatggtgggcacaggaggttctgtggatttgaatattgatgttatgtctggtgaacctgaaaattattttctgcatgctgctgattaccatcataataagggtgttccatatgtggaaaaagtctgctttgcagagaccagaaaagaacaagacaacatggaacctggggctgattgtattgcttccttggagaaagaattttcatcttgttcaagggatgttcaaaattcttgtacacttgatggctataaattgtttggggtggatttgcagatgcattctgattcaggagagcaactcaacagtgtatctaaaatgggcgttgtcgaaacctccaatacaagtatatctttgacaaaccaaagctccttaatgaataactttggtatttctgttgagcctgtaaatttgggctctgttatgtgcggaaaactgtggtgcagtaagcatgcaatatatccaaaaggattcaagagtcgtgttaagttatttagcattcttgatccaccaagaatttgtaattatgtttctgaagtctatggtgctggatttcttgggcctattttcaaggttaccatggaagaacgtccaaatgaggctttcacaaacacctcagcagataagtgctgggaaacagttcttgacagactaaatcatgaaatcaagaggcgaaggagtcgaggtgaaatagaacttccacccttggaacttctgcaaagcattaacggtcacaaaatgtttggattcctttcaccatccattattcag

SEQ ID NO: 581 - DNA, 826 bp, Glycine Max
gatgatgcaattggaattgcacaagaatgtaacgttgatttttctaatctcttcattgggcgcaagttttctcaaggtgcacatagtcaaatttaccatggtgtatacaaaaaggaacatgttgctgtcaaattcgtcaaggtacgagataatgatgtaaagggaatcccaaaatcccttttggaggctcaatttttaagagaagtcatacatctacctcgtctccaccatcaaaatgttgtaaagttcataggcgcatacaaagacactgatttttattacattctcacggagtatcaacaaaaggggtctttgagggtgtatttgaacaaggtagagtccaagccaatttctctgaagagggtgatagcttttgctttggatattgctcgtggaatggagtatatacatgcacaagggatcattcatagagaccttaaaccagagaatgtccttgttgatggggaaattcgcctcaaaattgctgattttggcattgcttgtgaggcttcgaagtttgattcgttgaggggtacctaccgttggatggctccggagatgatcaaaggaaaacgctatgggagaaaggttgatgtgtacagttttggtcttattttgtgggagttgttgagtggaacagtgccatttgagggcatgaatccaatccaggttgctgttgctgtggcagataggaattcaaggccaattattccttcacattgcccacatgttttgagtgatttgataaagcagtgttgggaattgaaagctgagaagaggcctgagttctggcagattgttcgagttttggagcaattagatcaag

SEQ ID NO: 582 - DNA, 50 bp, Glycine Max
gcagagctcaaaattggagacgagtttttgaaggcaaagtgcttaatgaa

SEQ ID NO: 583 - DNA, 1665 bp, Glycine Max
gcatttgctgtcgagaacatggcaactctatcactagcagtgaactttgtgtcatacttcactggaattatgcattatgaattagcagatgcagctaacatagtaaccgattacatgggtgttagttacatgctttccattgttgtggccgttgttgctgacacttggattggcagatacaaatccgttgttatttctggattcattgaatctttgggacttgcattgcttacggtacaggcacacatgggtagcctgacaccacccatttgcaacgtgtatgtgaaagatgcacattgtgcaaagcttagtgggaagcaagaagcatttttcttcattagcctctacttgttggcctttggcagtgcaggtttgaaggcttccttgccatcacatggtgctgatcaatttgatgaaagagaccccaaagaagcaatgcaaatgtcaagcttcttcaatggtctcttgttagcagtttgcattggtggtgcagtgagcttaacgtttaatgtatatatacaagaccgctatggatgggattggggctttggaatctccacttttgctattgttttgggaaccatactctttgcctttggattgccactataccgaattcatgttgcacatacaaaaaacggcatcattgagatcatacaggtctatgttgctgcaattcgcaacagaaacctttcccttcctgaagatcctatagaactatacgagattgaacaggacaaagaagctgcaatggaaatagagcatcaacctcatagggatattttcaggtttttggacaaagcagctatccaaagaaaatctgacgtgcaaccggagaaccaagagactccaaacccatggaaactatgcagagttacccaagtagaaaatgcaaaaatcattctaagcatgctccctatattctgttgctcaatcataatgaccctttgcttagcacaactccaaaccttttctgttcagcaaggctccaccatggacaccaggatcacaaaacattttaacatccctcctgcatccctcccaatcatcccagttggcttcttaatcattatagtccctttctatgatcgcatttgtgtgccttttcttcgtaaattcactggtattcccaccggcattacacacttgcagcgcataggagtaggcctaatactctcttgcatctccatggcaattgcagcaatcatagaggttaaaagaaaaggagttgcaagagaccacaacatgctagatgccttgccagtaaaacagccattgccattgagtatattctggcttgcttttcagtattttatatttggcatagctgacatgtttacctacgtggggcttcttgagtttttctattcagaagcaccaaaaggcctaaaatccacatcaacatgcttcctttggtgctctatggcccttggctattttctaagttccatattggtgaaaattgtgaacagtgcgaccaagaatatcacttcaagtggaggttggttagcagggaacaatattaacagaaaccatctgaacctgttctacttgttcctctcaatattgagcttgatcaacttctttgtctatttgttcgtttcaaagaggtacaagtacaggcctcaacaccctgcagttaccggtggcaattcagaggagtga

SEQ ID NO: 584 - DNA, 616 bp, Glycine Max
gcggaggacgaggcggcgcggtcgtcgtctccgaacagcgccgcctcgtcgtttcaaatggatctctgcatatacaacagcagaggagggagctctaataagagggactttgagggtgaggcctatgatcaaaggacttcttcaagagctagcgatgatgatgacaataatggtagtggtggtaacaccaggaagaaactcagactctcgaaggaacagtctgcgttccttgaagagagtttcaaggagcacaacactcttaatcccaaacaaaagcttgctcttgctaaacaactcaatcttcaacctcgccaagtagaagtttggttccaaaaccgaagagcaaggactaagttgaagcaaacagaagtggattgtgagtacttgaagagatgttgtgagacactaacggaagagaatagaagacttcacaaggagcttcaagaattgagggctttgaagacttcaaacccattctacatgcaattaccagccactactttgaccatgtgcccttcttgtgaacgcgtggccacaaattccacatccacttcctcatcaatgagtgccaccatcaatgctactaattcaggagccacggcctgtgtcaaaacag

SEQ ID NO: 585 - DNA, 1560 bp, Glycine Max
ggaaaatgtggctgtggtggcttaatattctggcgtcctcctcccaacaacaacaataacaacagcaatgccaacaaatttgagaatttatcaaacgcctctgacacaaaaaaaggaacagcttcatctaataaacccacaaattcttcaactcgttctggcaccaagccaaaccatgttgttaaccaaaactaccaaaggaaccatcccaaagtaagggtccctaaagaagcaattggcatttctggtgaactggaaagcatgatcaccgatcgccaaaaggggagcagcaaccttgttcgtgcttcttctagcaacgttatgatgtttaataatttaggtaacctcaggcaaggagggaatacaaatacgtattctcagaaccctgttgccaatggaagatacacaaaccaaacggtggagaatgtaagtaaaggaaacaaggaacaaccgggttctctatgcagggtcgtgtctactagaatgaaccccgaacaattaaagataatgggcaatgaggattataagaatggaagatttcaagaagcattggctctttatgatgctgcaattgcaattgaccctaataaagcttcctataggagcaacaaaagtgcagcattaacggctcttgggaggcttctggaggctgtgtttgagtgcagagaagccattcaaattgagcctcgttatcaaagagctcattaccgattgggaaacttgaacatgagattaggagaaatggataaggctctttatcattataaacaagcaggaccagagattgacccagacgagaatgctaaagtcaaaaaaattcaggtccatttgaacaaatgcaccgaggcacgtaggctaggagattggaacaagttgattaaggagaccaataatgctatttcatctggtgcagattctgctccacagatatttgcgttgcaagccgaggcatttttgaagctccgtaggcaccaacatgcagaagaagcaatgtcaaaggggtctaattttgatgttgatcattgcaccaagttctttggacctatttgccatgcaaatacattggtgactcagtcccgggttcatttggctgctggcagatttgaagatgccctagttgcaattcagagagcatctaggcttgatccaaataataatgagatgaagaaggtgatgaggaaggctagagctgcggctgcagctcgatcaaacggaaacgagcttttcatggcatcaaaattctctgaagcatctgttgcctatggagaagggttagagcatgatccatataactcggttttgctatgcaaccgagctgcatgtagatccaaattaggccaatttgagaaggctgtggaagattgcaatgcttctcttagcttgcgtccatcttacagcaaggctaggctgagaagagcagattgtaatgccaagttgaaaagatgggaagcttcaatacaagactatgaaatattgcttaaagagacaccggaggatgaagaattaacaagggctttgttggaggccaaagagcatcttatacaacagcgaggtgaatga

SEQ ID NO: 586 - DNA, 366 bp, Glycine Max
ggagagtcaagagacgtcatgttcctgttggcaaaaccctcgtctctcatacccaggggaccaactaatgtgatggctattctaaataacatattgcttctgaaggactcaaacatcgagtgttcgaagtatcattggttgatctccaaagggatgaagaataatgttaattatacgttaaggatattctacattggttttactaagaggtatagtaaccgggtgaagaggacctcttatacacaatcgagccaaatcaaaccgaaaacacgcgcatggagagctcatgcgaacagtgcaaccggtttgttgttgattgttagttacacgcatcttccctctaactcaacatgcaacacatcttgt

SEQ ID NO: 587 - DNA, 181 bp, Glycine Max
ggccgcaatgatttcataactgatctttctcttattgttcgccagaatgctcgtcttaatgtgcgccagtggaagaaagttccacaaagtactagggatacaatagtgcaaaatattctgaacaattggagacttccagatacagatatggtacggaaggctattctgtgtgaagcaggcc

SEQ ID NO: 588 - DNA, 381 bp, Glycine Max
gggaagccggggaggtgggaggcgatagcggcggcgttcggggggaggcacagggtggagagtgtgataaaaaaagcgaaggaattgggggagaagagagtggatgattcggaatcgtatgcgcagtttttgaagaagaggaaggcgttggataagagggttgtggaggagaatgagggtgaaagtgaggggaaagcagttgataatggttggagttctgctgaggatattgcattgctgaatgctttgaaagcgtttcctaaggaagtttccatgaggtgggagaaggttgctgctgcttttcccgggagatccaagcctgcttgcatgaagagattcgccgaattgaagaaaggctttctgactgcaaaagctgcagcc

SEQ ID NO: 589 - DNA, 360 bp, Glycine Max
gtagccatggtctatcttgtcgtcgttgttgtaggatacgactcagagtgcccgataccagctcctttgacgagattaaagcgtccgtctgccatctttttccctggacatgcaggcagagttactccacagagtgtaacttatagttttgcaacccttttgcttgaccttttcagtggcaatcatattcttccaagccatgccattaaactgattagagacaagaaccttcaaatactatcaaactcttgcttagaaagagagcttataaataatgacgggactgaattagtgtctctagcctcacgatatttgcactctgaaccacgagagtgtcctaatccaaactcactactctaa

SEQ ID NO: 590 - DNA, 386 bp, Glycine Max
gtagttgactgcattccgggtatgcaaaactttcggctgaaggacctgcctactttcacaaggacaacagaccccaaggattttatagcctcggctattgttttaaatacttttaatgaactcgagagtgacatgataaatgctctctcttctatgatcccttctatttaccccattggccctttacttttattcttaaatcaagttccaatcattggaaaaaagataccaagcgtcttgaatggcttgaatccaaggaaccaaggtctgttgtttatagcaattcttggagtttgcttggggcctgaccttgtctttggtggctctgagattttgtcatctgagtttgtgaatgaaacttcaaatagaggcctaatagcaagttg

SEQ ID NO: 591 - DNA, 1119 bp, Glycine Max
gtatctggtgttggtgtcaattggggtgcaatagcatctcatcctatggaacctcacattgtggtgaatttgctaaaggagaatgtaagtgctttttctggcacagacattgaagttatggttggaattcccaatgatcaattgaagaaactatccaaagacctagaccatgcagaagattgggtcaaacaaaatgtcagcaaacatgctcatgatgaaggggtcaacatcaggtgtgtatatgtatatacaattccttcacataagactcaggttattctattttcatggaaaatgagacaaaataaaggtgaccacggggctttaaatgatgatgtttacgagtctagtttcaacaagccctcagatggaagtttccggaagaacatttatgatgttatgaaacaattagtgaagtttcttgacgaaaagaagtcgccatttattgtcaacatatattcgttccttaatctatatcaaaatgaagattttccaaaggattatgcgttctttgaaggtcacggtaaaagcaccgatgacaaaaatgcacattacaccaacatgtttgatgcaaacttagatacccttgtttggccattaaaaaagacgggtcaccctaatgtgtcaatatctgtaggtgaaattggatgccaactgatggtgacaaaaacgcgaatgataaaaatgcaaacaggttctaccaagggaactctgcttcaccctggacccgtgaactcttatttagtttctctttttgatgagaacatgaagagtgttgcaccagatgactttgagcgtcattggggtatttttcattatgacgggaagcctgagtttcctattgatttttctggcaaaggagaagataaaatgccaataggagcaaaaggggttcgttaccaagagcaaaaatggtgtgtccttaaaagtaatgccaacaggagtgaattgggtgggtatttaagttatgcttgtgctggtggtgattgcacaagcttaggaaatttggatgcatctggtaatgcttcatatgctttcaatcaatactttcaaataaacgatcaaagtgttgaggcatgtgatttcgaaggggtggccactattgcatcaaaggagaat

SEQ ID NO: 592 - DNA, 213 bp, Glycine Max
gtggcggaagcgatagcgagcctggaagagataattggttcgagccaatatgcaaaaaccaaattcatcaaaggaaagcacaaggagttgcctccaacctacacgaagcttgttctcattcgtctcaataagactgttgctgctagcaagctcattaaggtgaaaaactccttcaagcttgcaccaatcaaacctgctccggttaaagccgtt

SEQ ID NO: 593 - DNA, 205 bp, Glycine Max
gtgtgcttatctgaattccaagaaggggagaaagtgaggaatctcaattgcagacacacatttcacaaggattgtttggaccagtggttgcagcaatactgtgctacttgtccactttgcaggaacaaggtgctcccagatgatgttgcagaatatgatgggaatgatgaccaacttatctttttgttatctgcattaaggggtg

SEQ ID NO: 594 - DNA, 1005 bp, Glycine Max
gttccccaagatcttgtgacgacgggagggaagtgcatgatcttaaaatgggtaacagaggataccttgaagaccttgaaagaaaaggtgaaagagccttcagtgccagagccagaaccagagccaactactgaagtactttttctttgcagctatgatggctgtggaaagacattcatagatgctggtgcgttgaggaaacattctcacatccatggagagaggcaatatgtttgtcactacgatggatgtggaaagaaatttctggatagctcaaagttgaaaagacattttctcattcatacaggggagagggattttgtgtgtcctcatgaaggctgtggtaaggccttctccctggatttcaacttaaggtctcacatgaaaacacattctcaagagaactatcatatctgcccatatccagattgtggaaagagatatgctcatgaatacaagctaaagaatcacattgcatctcatcatgaaaagtacactactccacctccagagaagcaaacaaaaacttctaaaccatctggaggggcatacggttctgcatcatctgaccgtccctatgcatgtccctatgatgggtgtgaaaaggcatacatccatgaatacaagcttagactccatttgaagagggagcacccggggcttatggctgatgaaaatgcagagcatgctcaggctaatgttggcaatgaaatggatgaagcaagtgaccatgatgcctatgttgcgaaacggtcaaatggtaaaattcagaagcagagtaagccaaaaccaaacctcaagttgcctccttccaaaattgcaaaacgcaaagtctccactcccactttaactgtaaataaaaattcttggcccgtgaaagatgaacctttcgatgaagaagatagtgaagaaacagaagaggatcgtgacaatgttgaagatggttggagatatgcaggaggaaacaatgaagatgatgatgaagaaacagaatatgaagactga

SEQ ID NO: 595 - DNA, 1197 bp, Glycine Max
gttgatcatcatgctaaagcattttacaagcaccattggccgagtatgaaatttgggtggagaataatagtaggcgccgtagttggattcttgggatcagcatttgggaccgtgggaggtgttggtgggggtggcatctttgtgcccatgctaaccctcattgttggattcgatcaaaagtcagcaacagctatatcaaaatgcatgattacgggtggagcaacagcaaccgtgttctacaatttgaggcaaagacaccccacccttgatttgcctgtgattgattatgacttagcacttcttttccaaccaatgttgatgcttggaatcagtattggagttgctttcaatgtcatcttccctgagtggatgctaacagttttgctaataatatttttcgttggcatttcagttaaatcattctttaagggtgttgatacatggaagaaagaaaccattatgaagaagaacagaacacaaattgttgttgcttccataatacatgtccttctattctttgtaatgaaatctaaaacttacatgcaggaacttggacttctcttcgctggctggatcatgatacttgcattagagatcggaaaaaaacacacaacaacttgctcacggctatattggctatcgaacctacttcaggtccccatagctgtaggaatgagttcatatgaggctgtgcgtttatacaaagggaagagaatcatagcatccaaaggagataaacaaacacattggtgtgtgttgcagttagttctattctgcgcttgtggcacacttgctggcatgattgctggtttgctaggccttggtggaggattcatcttgggaccccttttccttggacttggaattcctcctcaggttgcaagtgctacatccactttggtgatggcattctctgcatctatggcagtggtggaatattaccttctcaaacgtttccctgttccttatgctctttacttcgtagctatagccactgctgctgcacttgttggacagcatttggtgagaaaggctattgccatactggggagagcatctgtgatcattttcatacttacactcacacttagtgttagtgcagttttactgggtggagtaggtattgcacacatgattcaaaagattgaaaataaagagtacatgggatttggagatctttgcacgtacagaaaataa

SEQ ID NO: 596 - DNA, 2547 bp, Glycine Max
gttttcttgcatggtgacttggatctgttgatagtagaagccaagtctcttccaaatttagatttatccactgaagcagttagaaaatgcatcactatgggaaacatgtgccatcctccatttataaaaggacttaagacacactcaggaaaagacaagatgataactagtgacccttatgtttctgtatgcattgctggtgctaccatagctcagactagagtcattgctaactgtgagaaccctttgtgggatgagcaattcattgtgcctgttgctcaccctgcacaaaaactagagttccttgtgaaggacaacgatcttcttggtgctgaactcattggagttgtggagatacctgttcagaagataattgctggaaacactattaatgattggtttcccattattggtcagtatggaaactgcttaaaaccttatcctgaattgcatatttctgttcagtataggcaaattggagtgaaccgttcagagagtatcagtagtggggatggaaaagctttaggagttcctaaaacatatttccctctcaggaaaggagggagtgtgactctatatcaagatgcacatttaccagatggtatgctacctgaaattccacttgagggtggaaaagtgtttcagcagaataaatgttgggaggacatatgccatgcaattttggaagctcatcacctcatatacattataggatggtcagtttatcacccagtgaggcttgtcagagaggcaacaaaaccattgccttcggggggcgagctttcgcttggagagctgttgaagtacaagtcacaagaagggctccgagtggttatgctgatttgggatgacagaacttcacatgacaagtttctgttgaaaacacagatatttccttcatggattattgtaatgatggtgtcatgcagactcatgatgaagaaactaaaaagtttttcaaacattctactgttcattgtgtgctatctccacgttatgcaagcaataagctcagtattttcaagcaacaggcacggagttgtgggaaccctctttacacatcaccagaaatgtgtgcttgtagacagtctaggttccggcaataatcgaaaaataacagctttcatgggtggtttggatctatgtgatggtagatatgatacacctgagcatcggctctttcgtgatctagatacagtctttcataatgattttcataatcctacatttcaattaaattcaaattcgtgtgcaccaaggcagccatggcatgacttacactgcaaaattgaaggtccagcagcatatgatatattgaccaattttgaacaaagatggaggaaggccaaaaaatggcgcgacttcaggctcaaaaaggtgacaaattggcatgatgatgctttgctaaggctagaccggatttcatggattgtcaaaccttctccttgttccaaaggcgataaatctgtccatgtaaccgatgaaaaagatcctgagagttggaatgtgcagatatttaggtccatagattcaggatccgtgaagggatttccaaaggatgttgacaaagctaagtctcagaatcttttgtgtggaaaaaatttgaaagtagatcaaagcatccatactgcttatgtgagagcaataagatcggctgagcgctttgtatatattgagaatcagtattttttgggctcctcctatcattggccttcatataaaaataatgcaggtgcaaaccacctggttcccatggagttggctttgaaaattgctggtaagatcggtgcaaatgaacgcttttgtgtatatatagttataccaatgtggccagagggtgttccaacaagtgctgctgttcaagaaatattttacacagatttagggatgttcattgtatcaatgtttaagactcttattgtctgtgatggacagacaatgtctatgatgtacaagattatagctgatgcccttgaaaaagcaggtctctccgataagtatcatccacaagattatctcaacttttactgtcttggaaagagagaaccacaatccacaaatatttcaccaacaccaaatccatcagaaaaccgcgctttggtatcagttaaaaaattcagacgttttatgatttatgtccatgccaaaggaatggtaattgatgacgaatacgtaattattggatcagcaaatattaaccagagatccttagatggttcgagggacacagaaatagctatgggtgcttatcaaccaaattatacatggacagaaaagaatgctcatccacgtggccaggtgtatggatacagaatgtcactgtgggctgagcaccttgctgatcttgatcattgttttactgaacctcacaacctggaatgtgtgagacatgtcaacaaaattgccaaacaaaactgggacatatatgtgtctgaggaagggaatcggatgaggggacacttgatgcaatatccagttaagatcagcaaggatggaaaagttagtgcacttgatgattatgaatcctttcctgatgttggtggcaaa

SEQ ID NO: 597 - DNA, 1179 bp, Glycine Max
tactcctccatttccgaagcacctgcatcttccacaacctccaacaacagcacttcctctctcgaaagcaacctctccatacaaaccctcccatccgttccatctctccaaagcctctctccacaaaacttcaccttctccgtctcccaccattgcgtcaccaccctcgagccacacctttctcgccccgtcacctccctcgctgtcaacaacaacctcctctacgccgcaaccgaccacgaaatcaacgtctacgaccgccacacctgcaccaccatccacgccttcaacacccagcccacctccacctccaactccaccaaaaccatcgccttctccaacaacaacaccgtcatcaccacccaccaagactgcaagatccgcgtgtggcaaaaccacaagaatattcaccaccgcatgttagccactctccccaccgtcaacgaccgtctccaccgtttcctcctcccgaagaactacgtcgcaatccgtcgtcacgagaaacggctctggattgagcatgcggacgccgttacgggactcgccgttagtaacggtgctatatactccgtttcgtgggacaggactctcaagatatggcggttatctgattttcgctgcgtggagtcgttgaaggcgcacgaggacgcggtcaacgcggtggcagtgtccaacgatgggaccgtctacacaggatccgcggacaagcgcatacgcgtgtgggcgaggcccgcgggagagaagcggcacgtgctggttgccacgttggagaagcacaagtccgcggtgaatgctttggcgttaaacgacgacgcttcggtgctgttttcgggtgcgtgtgaccgttcaatattggtgtgggagagggaggacagtgcgaaccatatggtggtgagtggagctctgagggggcaccagaaggcgatactgtgtttggtcaacgtctctgatttgcttttcagtggatccgctgatcgtacggttaggatttggaagcgcgcttatgatggacggtatggatgccttgctgtcctcgacggtcaccggaaaccggttaaatccttggcggcgattccggaggagtatgatcaaacttcacctaaatgtagcgtctcggttttcagtggctctcttgatggagagatcaaggtttggcaggtttctatcacgagtcagtaa

SEQ ID NO: 598 - DNA, 364 bp, Glycine Max
tatggtgatgctaatgacatgcgtccttctcgagatgcgaagaaatcctgccgagaccttgcttctgctttaacagcattaaatatggaattcagtgatcacctgacatacttgcctggaaaggctcctagatctgtgaattccctccccttatggttgtttatgattcatgtgaaggttatactgttgagggctgatgacctaatcaaggatatgacaattattgctgaatacattagtgatgtggattaccttgacaaccattctcaaagtgttgttatctgtgctgataatcatggaaacatcgctctctttatgagtggcataaacaatcatacacaggaaggtaggaagaagcagacct

SEQ ID NO: 599 - DNA, 561 bp, Glycine Max
tcaaatgaacaagagcttacgattatgtgggtgctattagcaactgggaagctgataaatcggatgggagaggctgttgcaagggacgatatgtgttattgtcaagtttacgtcaatttgaacatgaaagtcgatctagctaattccagttatggccaaattttgcaagtgggggcgataagttttacatcttggcaaagaacacccatcacaaagaagaaaagaaataaaatggagactgagatgttggattcagcaattaaagatcttgatgaagatgagtttaagaagagatctaaaaaagagaggattttagtttatgagtacataccaaacaaaaagcttggatttccatatattcgatttttggtttgtttaactcatatctacgtgaaagaaaaggatacaagttataaagttgcagtagaagcgaaaagaatttcttacggattattctattttcataagtactcgagactcaaaatcattcatagagacttaaaagctagtaacatccttcttgatgagaatatgaataaaaaatttcagattttgaattga

SEQ ID NO: 600 - DNA, 603 bp, Glycine Max
tcctcacctttcgacctctctcctcctcccatcgaccatgatttcctggttgataagcagcctgtaactttaggggttggaaacatcatttctgaagatggtttttcattactgatgtctccaggagctgctccatccatttggaaagctattctttctcaaggagcaatcccaatgggttctaatgcatggaataaactacggtttattcgaggtactgaattgtttagattatgtgcatatttctatgtctctgagttagtctactatagcatactaacctgtctatggaactcggtttctctaaataaggtttttcaggctcataacatgatggaatcaagcagaggttatggggatctcatctttctgctgctgcagaacctggcagcattattacagttgatgagaaaaagaaagttgatggttggaaagttaaccagctacacatctggaaggaagcaatctgaacactttggattaggttacatcaagaggcgagctgcttcggaaggagacactgtaattgtccgtgacaacatcaagggaacagtggtggaagcaccttttctttcgcagctgcgcccaccatctgctagttga

SEQ ID NO: 601 - DNA, 702 bp, Glycine Max
tctaatattaatgtgcaatgttactatgttagcataaggacctttggtagtggatgggctatttgtggtcactactcactagtgtatgactttaaagggtttgagagcgcaaagaagaggggatcaattatactttttgactgtttgatcatgatttgcactctgttaaaattgccatttccttgtacttttcatagtttccggttgcttcgttttgaggtagacttcttgtcttctgatggcaaaataatttgtagttcaaaccaatcttgcatgttaaaattcattagtgagcctatccgcctaatcacgacattcctcaagattgtgcctcttgtcactggctatatatcagaaacccagtcactgaatgtcaagatgagaggttttgttgaagaggatatacctacttcatgcttaaaactaacccttgagcagcgagcagaatattcacctggtgccggtattcctcaaatgtattatgattcatcagtagttattgaatcagaacttcccttattcaagaggattatatggcattggaagatttgcatatttgcgtggatcacaatgatggctttcatgatggagttactattcgttctagtgtgttatttgcctataataattccaagaaccacgcaaaggagtggttctgctcggggtactggtacccaaaataatcttcaggcactaagttaa

SEQ ID NO: 602 - DNA, 279 bp, Glycine Max
tctccacgacccacttgcgaccccttcttctcaccacacgacacggtttcgggagatcaccccgccaccgcgaccgaggcggccgtgaggaggctctacgctggcaacattccccgcactgtcaccaacaacgagcttgccaagattgttcaagaacatggtgttgttgagaaagctgaggctttgattgaacctgactatggaagtggatgtcaatgctctgaaaagaaggtagcagacatcgaaagaggaagcataagggcaactattctgatataa

SEQ ID NO: 603 - DNA, 962 bp, Glycine Max
tcttcagcaaccaagggcgataggaagactgcacttgatgtggcatcatggatgttcaatatagtcacatctgtcggaataatccttgtgaataaagccctcatggctacatatggtttcagctttgctacaacgttaactggtctgcattttgccacaacaaccttgctgacagtctttcttaagtggctgggatatatccaaacctcccaccttcccttacctgatcttatcaaatttgtcttatttgcaaatttctctattgtcggcatgaatgtgagtttgatgtggaactctgtcggtttctatcagattgctaagctgagtatgattccagtatcttgtttcctggaagttatcttggacaatgtgcgatattcaagggacacaaaacttagcatttctctagttctccttggcgttgctgtatgtacagtcactgatgtgagtgtcaatgctaagggttttatagctgctgcagtggcagtttggagcacctcactacagcagtattatgtgcattttcttcagaggaagtattctcttggatcgtttaacttgttgggccacactgcaccagtacaggcagcaagtttactactagtaggtccctttttggactattggctgacaaaaaaacgagttgacgcctacaactatggtttcacatccactttgttcatcattatctcctgcaccatcgcagtagggacaaacctcagccagttcatctgcattggcaggttcacagctgtatctttccaagtccttggacacatgaagactattctggtactggccttaggtttcgttttcttcagaaaagaaggtgtcaatttacaagtgattctgggcatgaccattgcaatagcgggaatgatatggtatggcaatgcatcttctaagccaggagggaaggaacgtcttagcttaccccttaaccatacccccaagacacaaga

SEQ ID NO: 604 - DNA, 1058 bp, Glycine Max
tgcctggagccagctgacttagagagacggtactcagaagtgcatctcctgagatcactaaagcacaataacatagtcaggttctacaatttctggattgatgataagcacaataacacctcaaacagtatgttgaccatcccttttatacatattaatgctaacttgaagaccattaaaggatgggcaagacacattttaatgggtttaaactatctccacagtcacaacccacccgttatgcatagggacctgaaatgtgataatatatttattaatggtcaacaaggagaagttagaattggggatttgtgcctggtaactttcttggagcgaagtaataatgccaagagtgtaattgcagtgaagttgtgccttggtgacttgttggtcatgggttcgaatccggaaatagcctctttgcatatgcaagggaacccggagtttatggcacctgagctgtgtgatgaaaattacaatgaattagttgacatatattcatttggtatgtgctggctggagttggtgacttctgaatatccttatagtgaatgcagaaactcagcccaaatatccaagaaagtttcatctagattattgggtccaacaatatttgactttgcaggtaatagatccagaaatcaaattgagaaatgtctagtcccagcatccaaaagattgccagccaaggagcttctgatggacccctttcttcaaatgaatggttcttttcccttgttagatattgttctaaccaaattgggagtctttgaaatggatcttggtgacaccagtgagcttcctgtgatcactgtatttgataaatctgctgttgatgcatcatgttctacatgtgttgagatacatgtgcaaaagagaggtgatatattctttctaaaaggggaaggacatgatgagaattatgtatcgttagttctgtggatagctaatcactgcggacgagctagaaatatccatttcatattctaccttgagagtgatactgctgtcttggtatcaagtgaaatggttgagcaacttgaacttgcgtacataat

SEQ ID NO: 605 - DNA, 333 bp, Glycine Max
ttcaaaatcaattcgattaagttacggttcgagttttttttaccgaaccgtgaagaaattcttgaattagtaataggaaaacattattgttttagtcctatttataaatcaaatgttgaatgcaatgagttaattgaaaaatttgctcaatgcaagcatactttaagttattatctcagaagttatttttggtttgatttgaaacaaatcaaggaagacgtatattacttcaaaacaaaagagtattcacatcctgccgtcaacaagtttaatgtcattcttctaatcaacatgagttatactacaacatttgataaaatgccacaaaaatta

SEQ ID NO: 606 - DNA, 124 bp, Glycine Max
ttcgacctcctccttcaccatgatcaccacatcgtcaatgagatccagttcctgttgcaccactacatccttgcgctccctgatgtctacaaggagttcctcaagtgtgtgatctcgcatccga

SEQ ID NO: 607 - DNA, 226 bp, Glycine Max
ttgcaggaagggtttgcatttgctcactgcactacttgcaaggctccataccatttgagtgttcatagtgcttatagacaatggcgtactttcaaacttcggttttttgtaaccagagacattttgtttatatttctggttgttcagcatgtagatggttacgagcagtattggcttcgtcttgttgggggttttggtagcgagctgagcttttactatatatgtg

SEQ ID NO: 608 - DNA, 374 bp, Glycine Max
ttggagaataagattgagacgagaagaaaagcatttttggaagcggcccccatcatgagaaaaagtttctcagaaagggagactagtcctgggatcgaaggcctaaatttttcaaggcttcatgcacattattgttgttgctcacatgcaatcttctttttcatggcatgccatttgcgtggaatgtgggagtcaccaagttatgacctcaacctccaagatttcttgctagtggaaggctccgcagatatatatgttttggggtacgaacatccatgcaacaaagtgaagaagaaaaaaataacgaacgaaagaagaagaagaagaaattttatacatggacgtctcgaatgctcacttatgttgtatatttt

SEQ ID NO: 609 - DNA, 1500 bp, Glycine Max
ttggagaataagattgagacgagaagaaaagcatttttggaagcggcccccatcatgagaaaaagtttctcagaaagggagagtagtcctgggatcgaaggcctgaatttgtccaattttgaacggcctatgatcactatggaaactgaacttcaaagtttcaggatctttgttgcaacgtggaatgtgggaggaaagtcaccaagttatgacctcaacctccaagatttcttgctagtggagggctccgcagatatatatgtattgggttttcaggaaatcgttcctctgagcgctgggaatgttttagtaattgaagacaatgaacctgctgcaaagtggctggcattgataagtcaagcactaaacaaaccaagaaatgaatatagtgattcttctgactcgggaactggctccaaaacccagagtagttcgaaggagtcaaagtccccagcaagtttgaatttctttcagaagccttctcttaaagttattagtaaaaacttcagggcagagggtagcagcctccttaaggcttgcaattgtcctgtggaatctccatctagggagagacggaggatgagaaaatttagtgaccctatgagtaagttagatcctgagcttcgtggtgatgacactgtagaagagttgctttcaattgcagaaataccctcttctgctagccaaagtagatactcccttatatcaactaagcagatggttgggatttttctcaccatttggactaagaaggagttagttccacacattggacatcttagagcagattctgttgggagaggaatcatgggttgcttaggtaacaaggggtgcatatcaataagcatgtcattgcatcaaacaagtttttgtttcgtctgtagtcacttggcttctggggagaaagaaggcgatgagctgaaaagaaactctgatgtagctgaaatactcaaaggcacacaattccctaggatttgcaagaacccttgccgtcgagcgccagaaaagatagttgaccatgatcgaataatatggcttggagatttgaattatcgggtggctttaagttatgaagaaacaagggttctgttggaggataacgactgggacactttgttagcgaaagatcagttaaacatggaaagagacgcaggaagggtttttaacggtttcaaagaggggagggttgtttttgctcccacttacaagtattcacataattcagactcttatgctggtgagactgtcaagtcaaagaaaaaacgccgaacgccagcatggtgtgataggatattgtggcgtggcaatggcattgaacaattatcatacatacgtggagaatcaagattttctgatcatagacctgtttgtgctgtcttctctgtggatgtggaagtaagaagcagaaacaacaggttcaggaagggctattcctacacaagcccaagacctgaatacgaagactttatacctcaaaggcatagtttctatgattattaa

SEQ ID NO: 610 - DNA, 2249 bp, Glycine Max
ttgggtagtgaggatccacctatacttaagctgcacaaatgggacctgtctgaggcccaaattgggctttcggactttcgcgaagcttttctttctcctacgagagagatactgcttttgcattcttatgagagggaagctcttttgcttcctctgagtaaaggagagttgcattctggtggtgctgaaggtggctatgattatgatgataatcacaatccaggttctgcaaatgtttcctcggaggcatccactaggcctagtgaatcagttttgatgttgatattgatactgatctttctcccatacattagtgatgtgaactcattggcctgggctcgctgtgaggacggctatgatcagcacaaagatgctttatttagagaggttctatttgtttctgggagatgtggggtaacagtccatgcttttctcaaactaacaaaaaccaagggaatggttcaacccatgttggagggtaactttaggcaaggcaggtgggttgaatgggggcccgttgctgcattatcttccgacttcagtcatggagtctctggagaccagaatagatacttagaatcatttttcacaaaagttgaaactactgtatctgatggtattcttttgaccaaattccctgagaataatgaatttccttgcttgacagaagtggtttcttttagcatatttgatggcagtctatctttggaccatctcctcaaagaaaaaacagtccaaagtaaggagaattggcaggaaccagttgattcagcaagagatgcttctgaccgctctagcttgagcttttgtggagcagatactaagcttgattgtttttccagtgtttttggtgttgtgattaatgggttctacgaatgtcgcagagtgttctcgggtgcttcgaattgcctggtaggattttttttgacattaatgcatcacgtgtctgtcaatattagtgatgaagatcaaagaggcagaagcagagatttacttcttgttgccaagttagataattggggtattcggtgggtttcaatggtgaagcttgatgaaagaataaacacagttcagtcagttgagtggatggatttccaattttctgataatcttcttgtctgtcttaattcttctggcctgattgttctctactctgcaatgtctggtgaatatgtgacacatttaaatgttttacaggcttgtggccttaaccctcattttaatttgcaagggttagaaaagttatattcacatgataatatatatgctaaacaagagtgtagcataaatgataacatgtctgatcagcagagtgattcttttaggggatcattcaagaggttagttgttgcttcacactcctccctgttagctgtggttgatgaatgtggtgtgatctatgtgatctctttgggggaatacatacctgacaaaatttactcatctgagaagttacttccgtattgtcagcaatttgtgcagggaatgctggttggctgggaagttggtggttctgatatagatcgccaagcagtatactccaatttatctggacactttcgatcaaatgatttaaacataaaacatggaaatgttgctttgtcagacaaagctgtggcaggtaatgcacttcagaaaattaatggctgcacattcaaagaaaagggggatttgtttggctcctattcaagtggtttttctgctacttctaaagtaaataatggtcacacatttcttggttatgatgtgaaattacctgttatgagaaagatattccttcccaattttagagtctgtgaggatgattctatttgtttttctcctttgggaattactattttctctaaaaagaagtgtgtaaagaatcagaatagttctcaacttatccattttaatttggaagtgaagttagaagtccatgatgacaacttcttagacagtgtatatgatgtataccactttgatggaaaagatgttattggagaagcaattggttgcacattccaaggttgtttttatattgtgagagatggtggtctatcggtatatattccctccatttcaattttatcaaattttcttcctgttgagtacattggttatcgccaatcaagtaaggatatggagatttcagttctacttaaagacaatctagaaataaaagaaccgatcaaaaggttttctccttggaaagttgaaattttggacagagttcttctgtatgaaggcactgaaatggcagatcaatt

SEQ ID NO: 611 - DNA, 918 bp, Glycine Max
ttgtcaccaacgaaggcctcgtggaggaagcatgggagattgtcaacgacatctttctcgccacagatggtcccaggacacttggcagctgaagaaggaaactattttgagcaattccattcagacaagatcatcacacgaatgctctccagcttggccgatccttatactcgctttctctcccctcgtgagttctccatgatggcaaggtatgacatgactggtgttgggataaaccttaaggaagttcctgatgaaaatggagacctcagactggaggtactgggaattatattggatggtcctgctcattctgctggtgttagacagtccacagcccctcaagcattgagcctgaagggcattcgtgtttctcacagtctgccttttctaggctggatggcccaagttgatagttgcttacatgctgaagtagtaacatctccaattgctttggcatccttttttggttttatgatttcatattcaatttctgttaactatcatgtgaattcagagttagaaattgtatatatagttgttactttattttattctactgtaggaaacacttatcttcaaaaagtctgctattttgtgatgcttattcaactattcattgaatttgttgtcgatttttttcctttaaataaaggagcagataaagattttagatttgtgcaatatgtgaagctatgttggatatgttatattttagtaaatgacaaaacagctagtgcaagtaaaatagttgcttctgcacttcatgataattgtagagctgttcttgttggaaaacgcacatatggcaagggtctaatccaatctgtatttgaccttgatgatggatctggtgtagttatcactgttgggaagtatgtaacaccaaatcacaaggaaataacggcaatggaatag

SEQ ID NO: 612 - DNA, 1149 bp, Glycine Max
tttactattaggaaaccgaatgaaagtatgaggcatatcctgttactttttgttggaggatttttcggcttaattgtaggagtatcacttccaccactgtcaatagcaaagttgaatctaccatacggcctgcttcatctctcttgtgtacaggaaaaatatatagatagcagcacctcatcccaagatcagtttccaagtgatgcaacaaagatatgggtttcaacaaatccaagaggtgcagaaagattacctcctgggattgtcaatgcagaatcagacttatttttgcgcagattgtggggtcttcccagtgaggatttaacctttaagccaaagtaccttgtgacttttactgttgggtatgagcagaaaaagaacattgatgcagctgtgaaaaagttttcaaaggacttcacaatccttctgtttcattatgatggccgaacaacagaatgggatgaatttgagtggtcaaaacaggccattcatgtcagtgttcacaaacaaaccaaatggtggtatgccaagaggtttctacatccagacattgtggcaccatatgactatattttcatgtgggatgaagacctgggggttgagaatttcaatgcagaagaatacctaaaactggtgaggaagcatggcttggagatatcacagcctgccttggaacctagtaaaagtaccaaagcggtgtgttggaatatgacaaggagaagagagcatagtgaagttcacaaagaagcagtggaaccaggaaagtgtaagtaccctcttctgcctccttgtgcagcgtttgttgagattatggctccagtgttttcacgaaatgcatggcgctgtgtgtggcatatgattcagaatgaatttgtccatggatggggtcttgattttgcttttagaaaatgtgttgagcctgcccatgagaagattggagttgttgatactcagtggattgtgcaccaaggtattccctcactagggaatcagggagaaacacaaacaactggaaaacctgcatggcgagcggtgaaggagaggtgtggcatggagtggaggatgttccagggtaggttgactaacgcggaaaagggttattacaagtccaagggaattgatttttctaatttgctcgttcataattag

SEQ ID NO: 613 - DNA, 1827 bp, Glycine Max
tttatggaagatggtatgccatttgtggatgattttttcattaccaagtatagtgagtgtgtgagaaatagtgatggagttgctcaaggggtttgtcctgattccttttatgaaggccctgatggggtgggtttagtcaacaattcaatgttgatttatggtcataggaaggatggggtgacctttgtcagataccgcaggcatttgactaaggtcgatgaaaagtatgatcatcctgttaaccattcggcgaatatgaaggttatttgggctttggggcgcattaagcctcctgattctattaatccctactatcttccccagaatcatggggctgtgaattatggtcatttggttctgaatgtctcggagcacgtgaatgaatgtacaggtcccttggatgctgaagataaagaagatcaaagtctcatcactgcagatgcaaaagttccattggtggtttcttctgctccagcaatgcattaccccaaccctccaaatcctgaaaaggttctttacatcaacaaaaaggaagctcctgtcttgagagtggaaagaggggtgcctgtcaagtttttgatccaagccgggcatgatgttgcactttatattacttcggatccgcttggtggaaatgctaccacgaggaatctgactgagactatttatgctggaggtccagaggcccacggagttcaagccagccctactgaattagtttgggctcctgacaggaacactcctgatcacgtctactatcattccttgtatgaccagaaaatgggttggaaggtcgaggtggttgatgggggtttatcggacatgtataataacagtgttattttggatgatcaacaggttaccttcttttggacattgtcaaaggattccatatctatcgctgttcgtggcgagaaaaaaagtggttatattgccgtaggatttggaagtggaatggtgaacagctatgtgtatgtgggttggattgatgatactggtataggacatgtaaacagttattggattgatggaaaggatgcttcaagcatacatcgcacaaaggaaaatttgacacatgtgagatgtaaaacagaaaatggcatcattacttttgagtttactcgtcccttggacccatcttttgtttgggcaatgggtgctaaatgggctaatgatcatcttactgacaggaatatgcattctagtacaagtaataggcctatcctcgtacacctgatgcgtgggtcagcagaagcagagcaggatctgcttcctgttttggctgtgcatggatttatgatgtttattgcatggggtatcctgcttcctggagggatattggcagccaggtacttaaaacatctcaagggtgatggatggtaccggattcatgtttacttgcaatactcagggttagtaattgttctacttgcccttctttttgccgtggctgagctccggggattttatttcagctcagcacatgttaaatgtggatttgctactatattgttggcttgtatacagccagtaaatgctttcctaaggcctcaaaaaccagcaaatggggagcaggcatcctccaagagggttatttgggaatatttccatggaattgttggtagatgtgctgttgttgttggcattgctgcactttttactgggatgaagcatctaggagacagatatgacgtggaaaatgtccatggactcaaatgggctatggcaatttggttcttaattgtctgcgagctggcagtcatctttattggttatgaggtgttgtcagaggtgaaaagggaggcacttatcaatctctttttttga

SEQ ID NO: 614 - DNA, 876 bp, Glycine Max
tttctaattaatagaagtggttttctttgtacatgtgtgcactgtttggtgtttggtggcagcaaaaggcaaagaatagtgttgagaaaatatgatactgttcatttcgtcgctacagtgagcggatttgcacggaaaggcactggctggcctattgcttgcctttttttccaacattttacactccagatttttctaggttttggtggtgaatctaatctaagttctctaagagttcttcatttctctggttgcactaaacttgaaaaaatgccagattttacaagtgcaataaatcttgagtaccttgacattgatggatgtacaagtttatcctctattcatgaatccatcggatcccttgaatctgcgactagggcaagcttcaattctttatcccatcgggaatctttggtttttcttgacatgagcttttgcaatctaattgaagtacctgatgctattgaaaacttgagtttagaaagactgaacctgcagggaaacaactttgatttaatacctaagtcgatcaaggagcaacattttttgcctgaccttccatcagatagggctacatcatggtggggaaggcttatatatctttttgattgtcccgagttggctcatatgttatccgaacatcagaattatcaaatgtcctcgtccaagatgttgaacttgaatggctacaaccctatttttttcggtgtggctttgacattgttgttgcttgaggtttggaagatttacttccacggggatgtgcagtatattctggcaagatatattgacgttgattatgtcagaaaaagcaacaacagctttgtgtctaaaatccagcttccttacaattggttgctgacagaggaagatgaa

SEQ ID NO: 615 - DNA, 1299 bp, Glycine Max
tttcttttcttaactcacacattatcaaccctttgctttcacgaagcacacaaaaaaggaggcttcagtgtgaaactcattcacagagactccccaatgtccccgttccacaaccccaccgaaacccattttaaccaactgagcaacgctattcaccgctcttttaaccgcgtcaaccatttctaccctaaaacaaaatcctcccgccaaaagacaccacagtctgtgataacctcaagccaaggagagtaccttgtgaagtactccatcggaacgccgccgtttgatgccatgggaattgcggacactgggagtgacctaatttggtctcagtgcaagccttgccagcagtgttacaaccaaaccactccattgtttgacccttccaaatccgcaacttatgaacctgtctcttgctattccagcatgtgtaattcactagggcaaagttattgctactcagatactgaaccgaattgcgagtataccgtctcatatggggatggatcacattcacaaggaaatcttgcattagacacaatcacgttgggctctactacaggttcctcggtctcatttcccaagattcccattggctgcggtctcaacaatgctggtacctttgattctaaatgttctggcatagtagggctaggaggtggtgctgtctcacttatctcccagataggtccttcaattgattctaaattttcatattgtttggtaccattgtttgaattcaatagcacaagtaaaattaattttggagaaaatgctgtggtggaaggccctgggacagtttcaactccaattattcctggttcttttgatactttctattaccttaaattggagggaatgagtgtggggtccaaaaggattgagtttgtagatgattcaacctcaaatgaagttaagggtaacattataatcgactcaggaacaacgttgaccattttgctagaaaaattttacactaaattggaggcagaagtggaagcacatatcaatttggaacgtgttaatagcactgaccaaattctaagcctttgttacaagtctccaccaaataatgcaattgaggttccaattattacagcacattttgctggcgcggacattgtgttaaattctttaaacacttttgttagtgtttctgatgatgcaatgtgctttgctttcgccccagtggcatcaggttccatctttggaaacttagcacagatgaaccacttggttggatatgatttgctgaggaagactgtgtcctttaagcccactgattgcaccaagatctaa

SEQ ID NO: 616 - DNA, 1167 bp, Glycine Max
tttgttgctcaaaaacaagagtggcaatataagtcggagatttttattcaaggtatcttggggaacatggctctgaggagtcgttccatgaaaagcaatacaaatacaatttggaatgaggatttgatgtttgtcgtagcagaatcctttgatgattccttgcttaatgtggagcagagaattgatgccactccaccaactagtgtatggcacaaccttcagaagcgaaaggaaaatgagggtgaagaagaggttgggttttctagtaaacttaatatgaggatctcttcggatggagggtaccatctaggaattctaaatgttgtggggatctctccaatgaagaagaaaaatcgcacttatgcctattgtgtagctaagtatggtcccaagtgggtgaagacgaggactattatagatagtctttctccaaagtggaatgagcaatatacttgggaagtgtatgacccttgcactgtgatcacaattgttgtgtttgataatggaaaattacactcactcttatctgcttataaacctgcacacacaaggagccaggaagatgggggaaattcaattggcttgttttgcaaacttatgcacaacctttgtttccaaggatgcactttgtcgatatttcagttggatagtttgaggaaccaagttgctgcaatcactacattgaggttcaaaagggctgaagcaccacttagtaaagaggttgtggagtacatgctagacgcgggggaaaatgtgtggagcatgaggagggggagagctcaatttcacaggattgctgttcttctaaatgttttggtctttgttgctaaacattttgacgagaaaaaaattaccacggtgcttagctacttcatgtttctctatgttgttttctgcccatggataattttgccatcaacgatcttattcctccttttggttgggatttggtgctatagaacatggccaagatatccttcccatacggatatcaaattgtctcatgttgatacaaccactgttgaggaattagaagaagaatttgataatccttttccatctaaatttagtggtgataatctgagaacaagactcacactcccccactcatctttgtgtgcatttaattctcttgcacaagttggattagtaacaaattatctataa

SEQ ID NO: 617 - DNA, 357 bp, Glycine Max
aaaatggttgctgccttggcttctggaccttggtcaggaacttatacagcttctaaagctgctcttcatgctttgacagatacattaagaccagaacttggacattttggaattgatgttgtcaatgttgtccccggagctatcaaatcaaacatcggagattcagccatagccagttacaaccgcatgccagaatggaaattattcaagccttttgaagcagcaatcagagatagagcttatttttctcagaagtccaaaacaacccctacagatgagtttgctctaaacactgtagctgctgtccttagggagaaaccacctgcatgggcattactctactgtcatggctatcat

SEQ ID NO: 618 - DNA, 366 bp, Glycine Max
aaagctcaaggcttacaatctctcctagaatatgtcaatctttcatttgtcacagaaacacctgttttgtcacctttagtcccagtttcattattgggtagttcaaaaggtgaagaccagaagcaaaaagttgttactaagcaagtaaaagttcaagcgagtccaaagaaggtcaacttggttgctgctctggttcgtggtatgcttgttaaagatgcattgatgcagttggaattgacaataaaacgagcagcaaaaactgtatatcaggttttggtaaaaaaaaataatttaactcattctttgccccctcccctagctcttttactttttgtcattgatctcaaggaccaggttttcaatgag

SEQ ID NO: 619 - DNA, 303 bp, Glycine Max
aaatgtgcctccttcgtttccacctccgtctgcgacccctccctcgtccacgtggccatcacccttgacgtggagtacctatgcggctccatcgccgccaacatcttccacttcctcgtctgcgaaaccaaccttgagtccctcgtcaaatccaccttcccgcaattgaacttcaaggtctattacttcgatccagagatcgtccgcaacctgatctctacctccgtcagacaaaccctcgaacaacccctcaactacgtcagcaattatctcactgacctcctcgaaccctacgtcgagagg

SEQ ID NO: 620 - DNA, 468 bp, Glycine Max
agaggtgttggatttacagcaaaaagaggaactgtctataaagttaggtgtttccacgcgggagagggagttgtaagtggtgtgactattaacttcaatccctttttattcaaacaaacgattttgataaacctatctttgagaataggaagtcgaagaggtggccaccgatctcggctacttcgatggttacttgtccacgccatcgccttggaagtcgccgatgcggaagccgccttcagcgccagtgtcacgaaaggagtcgagccgacatcgccaccggttctcctcgacggccgcaccgacttcgtagaggtgcgcctctacggtgacgtgatgctccgctatgtcaactacaagaacgctgggctgcaggcgccacacgtagatccgacggtacttcacataaccttcttctccaccaccacctcctcctcctccattccttcctcataccctctctcttag

SEQ ID NO: 621 - DNA, 111 bp, Glycine Max
agatacgacatattccagctaatggtgaatctgtacgctgagaggtttattcagatgctaagattgcttagcgacagggcgaatgaattaacaaacattgagatcttaaag

SEQ ID NO: 622 - DNA, 1044 bp, Glycine Max
agtgagagtttggttttatatccgttagcattggaggagggacattggaggagggacttagagaaactgaaggaggctctccaaatcttgaattctccttccccttcttccccaactggattccttaggtttcaggtggcgctccctcccagtcctaagacattcactttgttttgctcccaaccccactcctcctcggtctttcctctcatttatgtttccaagaacgacgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagattctctagaccagtacaaggatttaaggcattttcagtggcattgggaaaagggggagcctgtaattgtcagcaatgtgcttgaatgtacatctggtttaagctgggaatcgcttgtcattaactccaccttttctggattgagacttgagagttatttcagtgcatttaatattgaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcattggatcatgccaatgaattatcaaactccctgaaagaaagtgccaatattaacactgtttggggatcgcttattgttgaagaatgcacaagacttggtttgatgtatttgtgtattgctcctgatctagaccttcccctgttgctaggatctcacattccagcagtagccattacatcatcaggcactgcagtttccaaccttcttcctgctctttttacttttatttccatcaacttgatttgtagttttctcttagagtttaattcccctcaaggtttgaattgtatttgcttttag

SEQ ID NO: 623 - DNA, 939 bp, Glycine Max
ataaacactatcaatggtgaaacccaccaaagcgaagaaggtgtcgtacgatgcgaagctgtgccaacttctggaggattacacctaaattctggtggtggctgcgaacaacattggatcaaaccaacttcagaacatttgaaagggtctacgtggcaactcggtggtgctcatgagaaagaacaccatgatgaagtgcatgcatgctataaggattcattccgagaacaccggcaacaaagcattcctcaaccttattccccttctagtggtcacaattggataattgatataatgttgttaacagttgccaaatacaaggtgggagctcccgctcgtgtaggtttggttgcagctattgatgttgttgttcccccaggcaacacagggctggattcctcgcagacctctttctttcaggtgtttaacatccctaccaagattaataagggtactgtgcaaatcatcacccatgcagaacttattaagaagggagacaaggttggctcctctgaagctgcattgcttttcaagcttgggataaggcccttctgttatggccttgttgttgtttctgtttatgacaatggttcaatgaccaacgaagtttactgttggtgtctccatggtgacttcactttcgttggcttggccatctcatacccaacaattgcagcttcaccacacatgtttgtcaatgcttataagaacgtccaagctgttgcagtgcaacagcatattcattcccccaggcagacaaagttaaggataaccagtgacatttttattgctgctactgattctggcactgctccagaagctgccaccaaggaggaggaaaagaaggaagaacccgcagaagaatctaatgaccacatgggcttcagtttggattttatggattctataattctcactttttgcgaagaggagtgctag

SEQ ID NO: 624 - DNA, 180 bp, Glycine Max
ataagacgaaggtttctggaggagtacatttccaaaggtgctcttgtgagagacaaggaagaatgtaatagtggtgcccgtggtgaagcttacagcaaaagtgaagggtgtcttcctcccccatcaaaccctccaaacagaggctgctcgaaatattatcgttgtaggtctgactcttga

SEQ ID NO: 625 - DNA, 1575 bp, Glycine Max
ataatatgggatgaagttggagaagataagtttgaaagggagaaagttctgttagatttggagcaagagtgccttgaggtttacagaagaaaagttgacagagcaaatatatctagagctcatctgcatcaggaattggccgaggctgaggctgaatttacccaccttcttttgtcccttggtgaacgatctctaccagtccggccagagaaaagggcaggttcactaaaagagcagctagattcaatcactccagcacttcgggaaatgcgtctgaggaaagaagagaggttaaaccaattccgaactgtgcaaggtcaaattcaaaaaatttctgctgaaattgcaggtaactcagacaatgaaccctcatccattgttgtaaatgagaatgatctttcactaaaaaggcttgaggagtatcagaatgagttgcagagacttcacaatgagaagaatgaaagactccagcaagtggagaaatacatagacataatacacagcttgtccacgatcttgggaaaggattcttcggcaatcatcatggaagttcatccaagcttaaatgatttgtgtggaataacaaaaaatataagcgacacaatcttagataaactcaatatcacggtggagtccctttttgaagaaaagcaaaatcggctggaaaagcttcaccatttaggcaaagcactgtctaatctatggaatcttatggacacaccatacagtgagcgacaatctttttcccatgtaatcaatttgttgtcgctctcatctgcagaagtaacagatccgggaagtcttactctggaaatagtccagcagactgaagctgaagtaaagagactggatcaactaaaagcaagcaagatgaaggagctattccagaagaaacaggaggaactggagttgatatgcaagaaatcacatgtggagattccttcaagggaagagatgaataatataattaacctcataaactcaggggagattgatcattctgatctcctcctgagcatggatgaacagatatctagagcaaaagaagaggcttctagcaggaaggctatcatggagaaagtggagaagtggatgttagcatgtgatgaggagcgctggctagaagaatatagcagggatgagaatcgatactcagtcagtagaggagctcacaaaaacttgagacgtgctgaacgtgcccgtataatggtcagcagaatgccagctctggtagatttgctaataaaaatgactaggagttgggaagaagaaagaaataaagttttcttgtatgatcaggtacctctaatggccatattggaagaatataacatcctaagacgagaaagggaggaggatacaaaaagacagcagccgtgggagaaaaagaggattcaaagccaagtagttgagcgagataatacttatgtgtcaagacccggcaccagcagccggcgtcttccaagtagaagcatgaatggagctctagacagttctgcgaagactttctatgggaatacaacagctgggatccaacagcataaattcgggaaatcacggcttgtccttcattaa

SEQ ID NO: 626 - DNA, 147 bp, Glycine Max
ataattctgggctcttcttcaaaggcccgtagagagattcttgctgagatgggatatgagttcacagtaatgactgcagacattgatgagaaaggtattaggagggaaaagccagaagatttggtaatggcattagttgaggcaaag

SEQ ID NO: 627 - DNA, 363 bp, Glycine Max
atcaagcaccaaatttacaaaaaacaagatgatcgaataattactagtaggaaaattgctctttcaaattctagtctactgggacagcgtgagagtgagaccttccttcagaaagccattcaagagcaaggcaggggtagaattctggacaccagcaatgagattcaagagatagaaaagaatctcaaggagttgcaccctatgaagcaccgacaccggacacgacacggacacagacacgtgaacacatgtaatgtccaaaatatagaacgtagtacgggtgttgtgtcggtatcaaacactgacacgaacgcgtgtcagacactggacatgacaaggggttggagtgtctatgcttcataa

SEQ ID NO: 628 - DNA, 213 bp, Glycine Max
atctcgcttacgctgccccggtcaccaaaacttgggaggaaagcaagttctagttctagcacagtccaggacaaaagcttaggaaattcatggaagcctcctatcagcacctccaagcgtactacagaaaaaaataaccgaacaacacggcaatcagtaactttattatcaaataatacaagagaaaatgcttcaccaaatattcagcaatga

SEQ ID NO: 629 - DNA, 363 bp, Glycine Max
atgaaaaagcaataccatcagctttccaaagaaattgttcgccttgaagaagaatggagaaagactacttttggggcagcatctgatgccaaagaaagagaaataaggaggcttaaagctcaagttcaggatctagatcgatacatagggtcaaagatgacagaaaaacaaaagtctgtcttagatccgtattcctttttaacccctcattctcccactttctattctccatttccaaaccctccagactatttatttcccaaagctagccaatcttggtctttgcccacagcttctgcttataagaaaaaaccagaacctccaaagaaagaatctacaagattaaatatctcttcccaatag

SEQ ID NO: 630 - DNA, 480 bp, Glycine Max
atgaaacctctctccaagctcttgaacaagttttgtgggaaaatgataatgctattagcatccctgctaatagaactcataattctcattcaaaaactaagggaatcacgtccaatcagcacccgccaatacctcaaactcatcgagaagaagaaccccaccatttgctacaccaaaagattgaacttgaaggcagagcacgctgctacagctactgagtgtagggtatgtctgtccgaattcgaggaaggggagaaggtgaggaaactgaaatgccaacacacctttcatagggattgtttggacaagtggttgcaacagtattgggcaacgtgcccactttgtcggaaacaggtgctgccagatgatgttgtgttcaagcaccgtctgcatcagaatcaagcagaggctgcttctaataatgggaatgatgacaatcttctctatcttttttcagcatttcgtggtggcaacacttaa

SEQ ID NO: 631 - DNA, 1932 bp, Glycine Max
atgaaactgagtccaagggagatcgagaaactagacctgcataatgcaggctaccttgcacagaaacgccttgctcgtggtttaaggctcaattatgttgaaactgtggctctcatagcaacacagattttggaatttgttcgtgatggtgaaaagactgttgcacagctaatgtgcattgggagagaacttctgggaaggaaacaagttcttccagctgttcctcatcttgttgaaagtgttcaggttgaagccacctttcgagatggtactaagttagtcaccattcatgacctatttgcttgcgagaatggaaaccttgaactagcattatttggttcttttcttccagtaccttcacttgacaagtttacagagaacgaagaagatcatagaactccaggtgaaatcatatgtagaagtgaaaatctgattcttaaccccagaaggaatgcaataattctcagagttgtcaacaagggagacagaccaattcaggttggcagccactatcattttattgaagtaaatccttatttaacctttgatcgaaggaaagcatatggcatgcgcctcaatatagctgctgggaatgccacacgctttgagccaggggaatgtaaaagcgttgtgcttgtaagcattggaggtaacaaagtcatcagaggaggtaataacattgccgatggtccagttaatgattctaattgcagagcagccatgaaagctgtggtcacaaggggatttggacatgtggaagaggaaaatgctagggaaggtgttactggagaagactattcattaactacagtaatttctcgagaggaatatgctcacaagtatggccctacaactggtgacaaaatccgtcttggtgatactgacttgtttgctgaaattgaaaaagattttgctgtctatggtgatgaatgtgtttttggaggtgggaaagtcataagagacggaatgggtcaatcaagtggccatccacctgagggctccttggatactgttataacaaatgctgtgatcattgattatactggaattatcaaagcagatatcggtattaaagatggactgatcatctcaacaggaaaagcaggaaatccagacattatgaatgatgtatttcctaatatgataattggggctaataccgaagttattgctggagagggcttgattgtgacagctggggctatagattgtcatgtgcattttatatgtcctcaattagtatatgatgccgtaacaagtggtatcacaacattagtgggaggaggaacaggaccagctgatggaacacgtgctacaacttgtacaccagcaccaaatcagatgaaattgatgctacaatcaacagatgacatgcctttaaactttggtttcactggaaaagggaatagtgccaaacctgatgaactgcatgaaataatcagggctggagctatgggactgaagctgcatgaggactggggaactacaccggctgcaatagacagttgtttgacagttgcagaccaatatgatatccaggttaacatacatactgacaccttaaacgaatctggatttgttgaacatacaattgctgcatttaaaggaagaactattcatacttaccacagtgaaggagctggtggtggccatgctccagatatcataaaagtatgtggtgagaagaatgtcctaccctcatcaacaaatcccacacgtccttatacacataataccatagatgagcatctcgacatgttgatggtctgccatcatcttaataagaatattccagaagatgtagcttttgctgaatcaagaataagagctgaaacaattgctgctgaagatattttacatgacaagggggcaattagcattatatcatctgattcacaggctatgggtcgaattggagaggtccttccttaa

SEQ ID NO: 632 - DNA, 2514 bp, Glycine Max
atgaaactgagtccaagggagatcgagaaactagacctgcataatgcaggctaccttgcacagaaacgccttgctcgtggtttaaggctcaattatgttgaaactgtggctctcatagcaacacagattttggaatttgttcgtgatggtgaaaagactgttgcacagctaatgtgcattgggagagaacttctgggaaggaaacaagttcttccagctgttcctcatcttgttgaaagtgttcaggttgaagccacctttcgagatggtactaagttagtcaccattcatgacctatttgcttgcgagaatggaaaccttgaactagcattatttggttcttttcttccagtaccttcacttgacaagtttacagagaacgaagaagatcatagaactccaggtgaaatcatatgtagaagtgaaaatctgattcttaaccccagaaggaatgcaataattctcagagttgtcaacaagggagacagaccaattcaggttggcagccactatcattttattgaagtaaatccttatttaacctttgatcgaaggaaagcatatggcatgcgcctcaatatagctgctgggaatgccacacgctttgagccaggggaatgtaaaagcgttgtgcttgtaagcattggaggtaacaaagtcatcagaggaggtaataacattgccgatggtccagttaatgattctaattgcagagcagccatgaaagctgtggtcacaaggggatttggacatgtggaagaggaaaatgctagggaaggtgttactggagaagactattcattaactacagtaatttctcgagaggaatatgctcacaagtatggccctacaactggtgacaaaatccgtcttggtgatactgacttgtttgctgaaattgaaaaagattttgctgtctatggtgatgaatgtgtttttggaggtgggaaagtcataagagacggaatgggtcaatcaagtggccatccacctgagggctccttggatactgttataacaaatgctgtgatcattgattatactggaattatcaaagcagatatcggtattaaagatggactgatcatctcaacaggaaaagcaggaaatccagacattatgaatgatgtatttcctaatatgataattggggctaataccgaagttattgctggagagggcttgattgtgacagctggggctatagattgtcatgtgcattttatatgtcctcaattagtatatgatgccgtaacaagtggtatcacaacattagtgggaggaggaacaggaccagctgatggaacacgtgctacaacttgtacaccagcaccaaatcagatgaaattgatgctacaatcaacagatgacatgcctttaaactttggtttcactggaaaagggaatagtgccaaacctgatgaactgcatgaaataatcagggctggagctatgggactgaagctgcatgaggactggggaactacaccggctgcaatagacagttgtttgacagttgcagaccaatatgatatccaggttaacatacatactgacaccttaaacgaatctggatttgttgaacatacaattgctgcatttaaaggaagaactattcatacttaccacagtgaaggagctggtggtggccatgctccagatatcataaaagtatgtggtgagaagaatgtcctaccctcatcaacaaatcccacacgtccttatacacataataccatagatgagcatctcgacatgttgatggtctgccatcatcttaataagaatattccagaagatgtagcttttgctgaatcaagaataagagctgaaacaattgctgctgaagatattttacatgacaagggggcaattagcattatatcatctgattcacaggctatgggtcgaattggagaggtgataagcagaacctggcaaactgctgataagatgaagtcacaaagaggaccactgcagcctggtgaagacaatgacaactttcggatcaagcgttatgttgcaaagtataccataaatccagctatagcgaatggtttgtcgcaatatgttggttcagttgaggcgggtaagttggctgatcttgtattatggaagccgtcattttttggagcaaaaccagaaatggtgatcaaaggtggtgaggttgcatatgctaacatgggtgacccaaatgcaagcatcccaacacctgaaccggtgattatgaggcctatgttcggagcatttggcaaggctggtagttcacactccattgcttttgtgagcaaggcagctttggacgaaggggtgaaagcttcatatggacttaacaagagggtggaagctgtgaagaatgtgaggaagctcaccaaacgagacatgaaactgaatgacactcttccacaaatcactgtggacccagaaacatacacagttacagcagatggagaggttctcacctgcaccgcagccaagactgttcctctttcccgaaattacttcctcttttaa

SEQ ID NO: 633 - DNA, 1572 bp, Glycine Max
atgaaacttgtttttcatctgcttctctctctctgtctctatcattttcatttttcgtgcttccttttgcctcttccacctctaacatatcaatcatctttctcatccttgtatatacgtcacaaccaagttgagagaaagtctggttttatgaaatggtttggtaagattttcaacattggatccagtagaggaaggggtggtggtcgtcatctgcagcagcctgttgaggaaaacatggtttggcctgctcctgctagatccttggatgaccgtgctagatctcggaaggaggaagaggatctagatcacgcaattgcactttctttaggcgaaaattttaagagaccaactggatatagatggcgaacaggaactgatgaagattatgcaaaggctcttcaggatcgcaggttctcatctgcacatcctccatatgcccctgtacctttttatccccggggatatggaacatgtggagggtgcaaccaagagatactctatggcaattgtttaggagttggccatagttattttcatccagactgctttcggtgtcactcttgtcgttaccccattactgagcgtgagttttctttgtcagggaagcatccatatcacaagtcctgttttaaggaattgacacaccctaaatgtgaagtttgccatcaatatataccaataaatgctgctggtttgattgaatatagatgccacccctattggaaccaaaagtattgcccatctcatgaatatgataatacagctcggtgctgtagttgtgaaagattagagtcgcggggtgaaagatactatagattggaagatggaaggattttgtgttttgagtgcatggaatctgctataacagacactggtgaatgtcaacccctttatcattccatcagagactattatgaaggaatgaacatgaaaattgatcaacaagtaccaatgcttctcgttgggagagaagcacttaatgaagccattgttggggagaagaatggcttccatcacttaccagaaacaaggggcttatgcctttcagaagagcaaactgtcacaagtgtatatagatggccaagaattggaggccatcgattaataagcatgagatctcaagctcaaaggctgcctagaaaatgtgaagttacagctattcttgttctctatggtcttccaaggttactcacaggtgctatacttgcacatgagttgatgcatgcttggttacgcctcaaaggttaccaaaaccttagtcttgaagtagaggaaggtatttgtcaagttctttcttacatgtggcttgatgcagaagtcatgtcatgtgctagaaccacgccctcaacatcatcatcagcttcttcctcctcttactctaactcatcaaagaaaggtgtgaaatctcttgttgaaaataaattgggtgagtttttcatgaaccagattgccaatgattcttccccagcttatggtggtggattcagagcagccaatcaagctgtgaataaatatggtttacgttgcactttggagcatattcgtttgactggtaatttcccactgtaa

SEQ ID NO: 634 - DNA, 573 bp, Glycine Max
atgaaagtttactttgatgcttccaagcttgaacaccaggaagcgttgagagctctgtggtctgcttcgtttcctgatcaggagctccaaagcttgatttctgatcaatggaaagaaatgggatggcagggtagagatccatctactgatttcagaggagctggtttcatttcattggaaaacctactattctttgcgaagacattctcaacttcttttcagcggctactgaagaaacaaggaggaaaaggagctgtttgggagtatccctttgctgttgctggcgttaacatcacatttatgattatgcaaatgctggaccttgatgccaccaaacccaggacttttgtaagagcagtttttctacagatgctttcagaaaatgaatgggcatttgacttgctttactgcgtggcattcgtggttatggacaaactgtggctggagagaaatgctacttacatggaatttaatgatgtcttgaaatccacgcgagttcagctagagaaagagttgttgatggatgatgttctacggattgaagacatgccttcttacagtcttctttgttga

SEQ ID NO: 635 - DNA, 1569 bp, Glycine Max
atgaacacgcaccaactaactctctgccaccaaccccatcaattcctttatctcttcttgttgtttgaacgttgcattgcattgcattgcattgcttcctctcatttacctatccaacgtaagtattgcacccttgtgatttccatggccagtgtactacttaccgccaccatctccacgatcaccttcggagaccaatattccatttctcgttgtgcttttccatccctatccactcttcatctcagagccacacagaaaggaattcacgttgagatgaacaaaagggtagtggtggtaaaggcaatgacgactaagagtgattttgatgacacagacgttgatatttctttgagccacagagttaatgctgtgaagccttccaaaactgtagccataagtgatcatgccactgctcttttacaatctggagttcccgttattcgcttagctgctggagaacctgattttgacacacccgctgttatagctgaggctggaatgaatgcaattcgtgaaggttacacaagatatacccctaatgctggaacattagaattgcggcaagcaatatgtcacaagctaaaagaggagaatgaaattacatacactcctgatgagattgtggtcagtaatggagctaagcagagtgttgttcaagcagtgcttgcagtttgttccccaggagatgaggttattattccagctccattctatacgagttatccggaaatggcaagattggctgatgcaacacctgtgattcttccaagccatatatctaataattttcttttagatcccaaactgctcgaagccaatcttaccgaaagatcaagactacttattctttgttcaccgtgcaacccaacaggatctgtctactctaagaaattacttgaagagatagcccaaattgttgcaaagcaccccaggcttctggttctctctgatgaaatatatgaacacataatttacgcaccagcaactcatacaagctttgcatctttacctggaatgtgggaccgaactctaactgtgaatggattttccaagacatttgcaatgactggttggcggcttgggtacattgctggtacaaaacattttgttgcagcatgcggaaagattcaaagtcagttcacttcaggtgcaagtagtatatctcagaaagctggagttgctgcattaggactaggctatgctggtggggaagctgtttcaaccatggtgaaagccttcagggaaagaagggatttcttggttgaaagctttagagaaatggatggtgtgaaaatatctgaaccacagggagcattttatctattcattgatttcagctcctattatggaagagaagttgaagggttcggtataattgagaattctgactccctctgtcgatacctgctggacaagggcctggttgccttggtgccggggagtgcatttggagatgattcttgcatccgcatctcttatgccgaatcccttactaatttaaagacagccgtggagaggattaagaaagcacttatccctctaattagctctgctgcacttgtttaa

SEQ ID NO: 636 - DNA, 126 bp, Glycine Max
atgaactatttctcaaaaagtaattcatttttttttcaattctcttataaaaatggcgaaaagataattatttttctcatttatgataaaagaacaagcattaagccaaatacttattcgttgtga

SEQ ID NO: 637 - DNA, 405 bp, Glycine Max
atgaactcatcctcctccgccgcagagtccaccatggaagaccgccgctcgaagaagcaccaccgccgtcaccgccaccaccccgccacgacgacaacaaccttgagcacgacgaccggggagtcggacggggaggtggaggaggcggaggacggcgacccggaggcgtgggtcaccctgaacaaggggttccggcaggtgcagtcggtgctggaccggaaccggctactgattcagcaggtgaacgagaaccagcagtctcggatgcacgacaacatggtaaaaaacgtgtccctcattcaggaactcaacggcaacatctccaaggttgtctctctctactctgatctcaacaccaatttctccaacgtttgccaacaacgctccaaaaactcctccaaataa

SEQ ID NO: 638 - DNA, 1317 bp, Glycine Max
atgaagaaaaagaagcaggtgccggagtggatgaacagtgctctgtggtccaccccctccgaccatggccgctttgacccaccctctcctcctcctcctccccctgtttctgttaaagaagattcccggacaatcccaaccaatcagaattcctctcctcctcctttttcttcttcatccgtttcttctcctactgcttccgccgatgacatctcccggcaggcccaggcccaggctcaggctcaggttcagttgttggccgagttatctaggaaggtgatagacatgcgcgagttgaggagagtcgcttctcaaggaatacccgatgctgctttgcgtcccaccctctggaagcttctgcttggatatcttcctcccgatcgtgccctttggttctctgaattaaccaaaaagaggtcccagtacaaaaatttcaaagacgacctcctcatgaatccttcagaaatcacgaggaggatgtacaactccaactccaactccgctgctcatgatatcgatgatgcaaaatctgatactcagactcggctcttgctttctagatcacaaatcactcatcaggaccaccctttgagtcttggcaagaccagcatatggaatcagttcttccaggacacagagatcatagagcagattgaccgagatgtcaagcgtactcatccagatatagacttcttctctggtgattctcattttgcaaaatctaatcaggaggctttaaagaccatattaattatttttgcaaagttgaactcaggtataagatatgttcaagggatgaatgaagtattggctcctctcttctatgtgttcaaaaatgaccctgacgaggaaaatgcagcctttgctgaagcagacacattcttttgttttgttgagctattgagtgggttccaagataatttttgtcaacaacttgataatagtatttgtggaatccgttccactattacaagattgtcccagcttttaaaagaacatgatgaagaactgtggcgtcatcttgaggtcactactgaggttaatccccaattctatgcatttaggtggattactctcctcttgacacaggaatttaattttgctgacatccttcatatttgggacgtcattttaagtgatccagagggtccacaggagacacttctcagaatatgctgcgcaatgctaattctggttcgtaggcgccttctagcgggtgatttcacttctaacctcaagttgctgcaaagttatccatatacaaacattagtcatttgctccatgtagcaaataagttacgtgtacagtcagtctaa

SEQ ID NO: 639 - DNA, 855 bp, Glycine Max
atgaagaaccgttatttggtgccggagagacggtggttcgtaggtctggccgtcgtggggttgatcggcgcggtgctattcctcagcaacgcgatccgaacctcggaaacctcgtacgtgtgtccgggggcgctcgggatccgaagcaagacccgaaccgaattcagttacgacgcgtcaccgatccagctccgcgcgattatgcactacgcgacctcgcgcgtggttccgcaacaatcggtgtcggagatcaagatcagtctggacgtcattaaatcactgggccggcccatcaacttcctcgtcttcgggctgggccacgactccctcatgtgggcctcgttcaacccgggcggcaccacggtgttcctcgaagaagatccaaagtgggtccactcgatccttaaagacgcgcctggcctgcgggcccacacggtgcgttaccgcacgcagctacgcgacgccaaggggcttatcacctcgtaccgctccgaaccttcgtgttctcccacgaaggcgtacctgcgaggcaacgaagcgtgcaagctggcgctggagaatttgcccgacgaggtttacgagaccgagtgggacatgatcatgatcgacgcgccgaaggggtatttcgcggaggcgccggggaggatggcggcggtgttctccgccgcggtgatggcgaggaacaggaaggaatccggtgtgacgcacgtgtttttgcatgacgtggatcggaaggtggagaaggtgtacgccgaagagtttctctgtaaaaagaacttggtcaagggtgttggaaggctttggcacttcgagatacctccttctaacgacacacgtgcttctcgtttctgctag

SEQ ID NO: 640 - DNA, 1311 bp, Glycine Max
atgaagaagctgtgtcccaatcttgatcgtgaggatgggctcgaaaccgtgcttgaggtccctatcccagaggagattctcacacacaagagtggaaccaccaaagcttggcacaacatgaagaactggatgaagccacacgctgaatcgagatcaaattcagcatccatggcagcagtttttggagggaaaaacacagagattcagcttttgttaggtgttgttggagcgccattaatcccttcacctatcgcctctgacaaccaacccatcactcgcagcattaaagaccaacacattgaggtttcaatggctaaatacatagtgaagcagtacgtggcggcggtgggaggagagcgtgctttgaatagtgtggacagcatgtatgctatggggcaggtgaagatggcaacatcagagttttcagcaggggaagggagtgtgaatagtaagaaggtgaagaacttgcagatgaagggagaggtggggggtttcgtggtgtggcagaagaggccagagttgtggtgcctagagcttgtggtttctggctacaagatcagtgccgggagtgatggtaaagtggcatggaggcaaaccccttggcatcattctcatgcttctagaggcccaccaagacctctcagacgtttcttacagggtcttgatccaaggtccactgctaatctgttcagcaattctatatgcattggagagaagacagtgaacaacgaagactgcttcatactgaaactcgaagcggagtcatcgacactgcgagcaaggagcaacagcaacgtggagatagttcgccacacggtgtggggctacttcagccaaagaacaggtttattagttcaactagaagactcacatttgctcaaacttaagtctcacgaaagcgagagcatatactgggaaaccaacatggagtccctgatccaagactacagaaccgtggatggaatccaagtagcacacgctgggaagacatgggtgtccttgttcaggttcggtggcggccccgagacacattcgaggacgagaatggaagaggtttggcaagttgaggaagtggactttaacgttaaagggttgtccatagattgctttttgccacctagtgatttgaagagagaggaagaagagaatgatcaagaatgtggtggtggtggggttgcaataagcaataataatgccaagttgccctacaagattcgttcggcttcttttaggattagtgcttctaaagtagctgctgtgaacttggatgattcttcgtgtaccagcagcgagagtgatgaagatttgtga

SEQ ID NO: 641 - DNA, 3729 bp, Glycine Max
atgaagcacttcatgctcccaagaaaccctctcagggacgcagcagagcttccttcttctccaagccccaccccaactactagctccgccaaaccccgttcctcttctcgcaaacacaaaccctccaaagagaacgaccctccctccgatcccaatctcgttactccttcccctgccaaattgaagagccccttgcccccgagacccccttcttccaatcctctcaagcgcaagctcaccgccgccgatgccctaaccgacaattccctccccgcaccctccgattccggcgtcaagtccccattttggcttcttgctttttttgtaggttattgtcaggatgaggccgctgtctccggacaaggacaatgtagatcccacagttcagaagtcaatgctgaatactgttcttttattttattactggatattttcgaacacattggggtgcctttggtagagcattgtttggccggcttcaatagttcagtttttgcttatggacagacggggagcgggaagacttatacaatgtggggtcctgccaattgtttgtcggaggaaaatgatcagcaaggacttgccccccgtgtttttcagcgactctttgctcgcataagtgaagagcaaactaagcattctggcaaccaactcaattatcagtgccactgctcttttcttgagatatacaatgagcaaatcatggatctgttggatccgaatcagaaaaacctacagattagagaagatgtgaagtctggtgtctatgttgaaaatcttacagaggaggatgtgtcttcaattaacgatgtaactcagcttttaataaagggattatcgaacaggagaactggtgcaaccagtataaattctgaaagttcccgctcgcatactgtttttatttgtgttgttgaatctcgatgcaagagtgcagcagatggtatgagcagatttaaaacaagtaggatcaatcttgttgatctagctgggtcagaacggcaaaaatcaacaggtgctgcaggagagcgattgaaggaagctggcaatattaatagatcactctcacagcttggtaatctgataaatattcttgcggaagtctcccagacaggaaagcagcggcatataccgtatagagattctaggttgacatttttgttgcaggagtctcttggaggaaatgcaaaattagcaatgatttgtgctatttcaccagcacaaagttgtaggagtgaaacattcagtacactgagatttgcacaacgtgccaaagctatcaagaacaaggcagttgttaatgaagttatggaagataatgtgaagcacttgcgacaagtgattcggcaactaagggatgagcttcatcgaattaaagcaaatggttacaacccaacggagtcaagtggaggtcattcagcagcttggatccgacaaagcttgaacttgttacaatccagcctcaatcgaccaccaccattatcccgtctcgatgaagatggtgatgaggagatggagattgatgaggaaggtgttgaggaccatgatggagtttcctgcactgccaatatgccgagtaattgtaatattgtagacaataatgacaacgaaatgaacactgatgatcaggatttggctcaacctggtgtggagaaaaatatacctagttgctctggcagtaaaggtttgaatgaagaaccatcccgtgcaatggtccaaaacagtttctcttgtcctattggtgaatctgattctcctagtgcagcaacaaattgtgtctcgcctgccggccttagcatagttcagtgtgatttatccccaatccttaaatccccagctcctagtgtttcacctagaatcagcaccagcaggaaaagtctgaggacatcaacagggctgtctccttctgagaatgatcttcatgttgaaaaagatttggacatgaaaaccatcactaagaaaagctcaacttctgccttgtctagtcagacatctccaaatttccttagtaaaacagaaaatttagcagcaagcatacggcatggtcttgaaattatggatagttacaaacgtaattcagctttgaggcagtcaccatataggttttcattacaaccaagagagtctagattaatttttcccactaacaaagttgatgtgggcctacagacttctcttgatgatattgttggagaagattctgttctattcacctgtagtaattgtaaaaacagagctcatcttgatgccaatgagactgacaatgattcaaatctacagttgatacctgttgattgtcttgagtttgctgataagccaaagaagcaagttatcaaagcagtagagaaggttttggcaggatctataaggagagaaatggcccttgaagagttctgtgccaagcagacttctgagataatgcagcttaatcgcttggtgcaacagtacaagcatgagagggaatgcaatgccataattgcacagacaagggaagataaaattcttcgccttgagagccttatggatggtgttttacccactgaagagttcatggaggaagagctagtggctcttacccatgaacataagattttaaaggataagtacgagaatcatccagaagttttgaagatggagatagagttgaaaaaagtgcaagaggaactagagaagtatcaaaatttctacaaattgggggagagagaagtgctgatggaagagatacaaagcttaagaagccaacttcaattttatgtagactcttcatccacatcagcaaggaagcaatatccgctattgcaattgacttactcgtctgagcccagtatggcagcaaccctcactgtcattccagagtccacagaggagagagaagaaacaaatgaaactcttgcatcatccaggaatgatactgaagcacaatttgaacaagaaagaattaaatggacagaggcagaaagcaggtggatttctctttctgaagaactgagagctgagcttgagagtagcaggttgctagctgaaaagaggaagcaggaattagatgcggagagggagtgtactcaggagcttcaggaagccatgcacatggctatagaaggccatgcaagacttttagagcaatatgcagatttggaagagaaacacatccatttgcttgcaaggcatagacagatccaggatggaattgaggatgtcaagaaagcggcttccagagcaggagtacgaggtgcggagtctaagttcataaatgccctagctgctgaaatttcagctttaaaagcagaaagagaaaaagaacggcgaatcttaagagatgaaaataaagggcttcagtctcagttgaaggacactgcagaagcagtgcaagctgctggtgaactgcttttgcggcttaaagaggctgaggaagctgtcactactgcacagaaacgggctatggatgcagaacaggaagctgccaaggcctacaaacaaattgataagttgaagaataaacatgaaaaggagattatcacactaaatgagcttcttttggaagcacgtttgccaaaggaatctgtacgaccgacttatgatgacgatgttgtcatgcctagttatgacgactcaaaggagccaaagagtgttaatgatcagtttgagccatttactaataatgcagagtatggtgagctcgccaaagtaacagaatcatcgtggttctctggttacgacagatgtaatatataa

SEQ ID NO: 642 - DNA, 600 bp, Glycine Max
atgaagcagcagagagtggagtttatgggcctgggcatgggcatgggcatgggccttttggtggtgatgatggcatgtgggtcggcgagtggtgcggatgatttggcaaccaagtgttcagcggtgattcagaaggtaataccgtgtttggatttcgcgaaggggaaggaagaaacgccgaaaaagcaatgttgcgacgcagcaacgtccataaaggagagcaacccagagtgcctctgctacatcattgaagagacccacaagggtagcccacaggttaaaagcttgggcattcaagaggccaagctgcttcagctcccttctgtttgtaacgtcaaaaacgccagcatcaccaactgtcctaagcttttgggtctatctccaagttcccctgatgctgctatcttcacatcaaattcttcgaagacaactccttctgcacctgcaacctcaaactcacaaactacgaccccccagagccaaaacgcatcgtatggaagcatggttcaacccagtagtaccgttacctatgcgattgtgatggctttggccattgttctaattgctcttccaaccgaaattgtgagcatttacacatga

SEQ ID NO: 643 - DNA, 2247 bp, Glycine Max
atgaagccccacactacggcttcttctttcgccactagtctcccgcacgtgccttgcttccgcggcaccactgccgcacgtgccactccatcggagcctcatcatgactccgccggaggcctcgaattccgacgcgtctcgacatccaaacgccgcctcatcaacctctccgtccgccacgctagtcgcgtcaccgcggcgtcgaatcccggcggttccgacggcgatggtgacactcgagctcggagctgccggcgcggcgtgctgatgacgccgttcttagtcgccggcgcgtcaatcctgctctcggcggcgacggcgacggcgagagcggatgagaaggcggcggaatcggctccggctccggcggcgccggaggagccgccgaagaagaaagaagaggaggaagtgataacgtcgaggatttacgacgcgacggtgataggagaaccgttggcgatagggaaagagaaaggaaaaatatgggagaagttgatgaatgctcgagtggtatatttaggtgaagcagagcaagttccggttcgagacgatagggaattggagcttgagattgtgaagaatttgcataggcgctgtttggtgaaggaaaaacgattgtctctggctcttgaagttttccccgctaatcttcaggaaccgctcaatcagtatatggataagaagatagacggagacaccttgaagtcttacacgctacattggccgcctcaaagatggcaagagtatgaacctattctgagctactgtcacgaaaatggaattcgtcttgttgcttgtggtacaccactgaagatcttaagaactgtccaagcagaaggaattcgtgggcttacaaaggatgaacgtaaactatatgcacctccagctggttcaggcttcatatctggctttacgtctatctcacgcagatcttcagttgatagtactcaaaatttgtctattccttttggtccaagctcatacctttctgcacaagctagagtagttgatgagtattctatgtcccagattatcttgcaaaatgtgcttgatggaggggtcactggtatgttaatagttgtgactggtgcaagccatgttacatatggatctagaggaactggagtgccagcaagaatttcaggaaaaatacaaaagaaaaaccaagcagttatattacttgaccctgaaagacaattcattcgcagagaaggagaagttcctgttgctgattttttgtggtattctgctgccagaccctgtagtagaaattgctttgaccgtgctgagattgctcgggttatgaatgctgctgggcagaggagagatgccctcccacaggatcttcaaaagggaattgatcttggtttagtatcaccagaggtattgcagaacttctttgatctagagcagtatcctctgatttcagaactcactcaccgtttccagggattcagggaaagattgttggcagatcccaaattcttgcacagattagccatagaagaagctatatcgataacaactacattattggcacagtatgaaaagaggaaagaaaactttttccaagagattgactatgttattacggacaccgtcagaggatcagttgttgatttctttacagtgtggcttcctgcaccaactttgtcattcctttcatatgctgatgagatgaaagcacccgacaacattggttctctaatgggacttcttggctccatcccggacaatgcatttcaaaagaatccggcagggataaactggaatctcaatcataggattgcatcagttgtatttggtggtttaaaacttgctagtgtgggatttatttcaagcataggagctgtcgcttcatcaaattctctatatgcaattcgtaaagtctttaatccagcagttgtcactgaacaacggattatgaggtcaccaatactcaaaactgcagttatatatgcatgctttcttggaatatcagcaaatctccgttatcagataattgctggggtagtggagcatcggctttctgaacagtttgcttctcaaacattctttgtaaatatgctttcttttgtagcacggacagtaaattcgtattggggaacccagcaatggattgacctagcgcgctttactggcctacaagttagaaagacagagtcaccaacatcagatactccgaatcctgctgcaattttgtgcaatgaaacagaagaagccagcattgatgagatagaaaaataa

SEQ ID NO: 644 - DNA, 1086 bp, Glycine Max
atgaaggcactaattcttgttggagggtttggaacaaggttgaggccattgacactcagtgttcccaagcctcttgttgattttgctaacaagcccatgattcttcatcagatagaggctctcaaggccattggcgtcaatgaagtggtgctagctatcaattaccaaccagaggtcatgttgaatttcttgaaagagtttgagacaaagcttggtatcaaaatcacttgttctcaagaaactgaaccgctaggtactgcaggccccttggctcttgcgagggataagctaataagtgactctggagagccattttttgttctcaacagtgatgttatcagtgagtacccacttaaagaaatgattcaattccacaaaacacacggaggagaggctaccataatggtgacaaaggtcgatgagccatcaaaatatggtgtggttgtgatggaggagactaccgggcaggttgagagatttgtagagaaaccaaagttgtttgttggcaacaaaatcaatgctggaatctacctattgaacccctcagttttggatcgaattgaactgaggcccacttctatcgagaaagaggtgtttccaaagattgcagcagataaaaagctatatgcaatggtcctgccaggattctggatggacattggacaaccaaaggactatatttctggcctgacactttacctggactcgctgaggaaaaagtctccttctaaactggccagtggtcctcactttgtggggaatgtcattgtgcatgaaactgccactattggtgagggatgtctcattggacctgatgttgccattggtcctggctgtgttgttgactcaggtgtcaggctttcacgctgcacagttatgcgaggagttcggattaaaaagcatacttgcatatccaacagtatcattgggtggcattccactgttgggcaatgggcccgtgtggagaatatgactatccttggagaagatgttcatgtttgtgatgaagtttacagcaatggtggcgtagttttgcctcacaaggagatcaagtcaaacattctgaagccagagatagtcatgtga

SEQ ID NO: 645 - DNA, 741 bp, Glycine Max
atgaagggtggtagcaaggttgttgttcagccccatagacatgacggtattttcattgccaagggtaaagaagatgctctcgttaccaagaatcttgttcccggtgaagctgtttacaatgagaaaaggattactgttcagaatgaagatggtaccaaagaggagtacagagtttggaatcctttccgatccaagttggctgctgccatccttggtggagttgacaacatatggattaaacccggagccagagtcctttaccttggagctgcttctgggaccactgtttctcatgtgtcggacgttgttggccctactggagttgtctatgcagtagaattttcccatagaagtggacgtgacttggtcaatatggcaaagaaaagaactaacgttatacccattattgaagatgctagacatccagctaaatacaggatgttggttggaatggttgatgtcatattttctgatgttgctcaacctgatcaggctaggattttggggctgaatgcttcatattatctgaaaacaggaggtcattttgttatttcaatcaaggctaactgcatagactccacagtccctgctgaggcagtgtttgaaagcgaagtgaacaagttgaaggcagatcaattcaaaccattcgagcaagtcacccttgaaccatttgagagggaccatgcctgtgtggttggtggatacagaatgcccaagaagaaaaaagatgctgctgagtag

SEQ ID NO: 646 - DNA, 859 bp, Glycine Max
atgaatataagagcattttataattcaattttcgacggcacccctagaacttccgaatcaaggactgccagcaagaagcacggcagctacaactgcggctgttgcggcctccctaagaagggccatgactgcaccggcaagaccgctcccactcccacctccgcttcttccgccaccccttcccactcctctttctccgccgtttccgctccttcctccggctccgcctcccgctgcccgctgtctcacctccgccgcgctatctccttcgacgaggacgaagctggcaggctcgacctgtcggagcccgtcgatgtgcggtctgaagaagatgatctggattcgtctggtttgtcggggaatcttctatgggaagtattgaggaagttgccgccgacgaggctgtgtaacggcagcgatggtgagcagaggttggagggagatgacaaggagtttgtggagagcggcggaggagtgggttttgtgtcaattttgaagaagtgtccggggatcgtgaaactctcacttaaaagggaaagtatcagtggatttgttgttgctcaggtaatgcttgttgaagtgccaaatcttaaaatttcactttccttttgtctaaagcctcaattttcttcagctttctgcagtgctagtaatttagtggatccactttctgctgatgtaagcttttgctgtaatgtttttaaatgctccttctactgcatgttgggtatggatttaggatttggtcttgataatataattatccttgttgagggaacacttaatgcgattttgtggttgaattatattttcgttgatatgtttgacaatacaatcaattcatgtgatttgtgccata

SEQ ID NO: 647 - DNA, 1818 bp, Glycine Max
atgaatatgatggagggtgctgtgttgccgaatcccatagagtgtctgggtaaagggtttgatctgacaagtgattttcgattgaagtttgcaaagggatctgggagaagattggtggtggttgatgaagggaacaaaagggacattacggttcctggtactggaggaggaggagcagctaccattccaaatgtttctgaggatattcgctgtgacaagggcgatcgcctacgcttcaagtctgatgtccttcaattcaaccagatgtctgagttgcttaatcaaaaatcagctatacaaggaaaaattccttccggctatttcaatgctctttttggtttgagtggtgattggtttcgtgatgctcatgacataaaatatcttgcttttgatggttatttcatttccctgtactatttgcaccttactgcttcacacctcatactgcaagaggaagtaaagaagtctgttccagctcaatgggacccagcttcattaaccaggttcattcagacatatggtacacacataataataggtatggctgttggaggtcaagatgtaatttgtgtcaaacaaaatcattcttccaaggttccacctggtgatctaagaagacatttagagaatcttggagattttttgttttcagatttaaaaagcccttctcaacaacaaaggaacagtaccccagaaggcaaacaaaaagttcctgaggtctttaatcgtgtgatgcaatcaagtacaacgcagttcgccagtatttcagaagcatcaagcaaagatggcctcactatcatttgttcaaaaagaggaggggatgtgttcaagcaaagtcactcaaattggctccaaacagtggcttctaatcctgaagcattcctcttcaagtttgtacctatttcctcacttctcacaggaattcctggaagtggctatcttagtcatgcaatcaatttgtatttacgctataagccccctccggatgatttacaatgcttcttggagtttcaaattccaaggcaatgggcacccatgttttatgaccttcctctgaggcatcaaaggaaaaagtgttcttccccttccctgcaatttggtttcatgtttcccaagcttcgtgtcagctgtgcacaggtagtaagtgaccaaaaacctgtggtaggcctacggatgtacttggaaggcagaaaaagtgatagacttgcaatacatgtacaccatctttcaagcctcccaaacacaatgatccactcttcatcaggcatatcattgtggcgaggatctgatgataatgaatccagtgacatctttctagaaccaataaggtggaagggatttgcaaatgtgtgcactgcagtggtcaaacatgaccctaactggttgcatgaaacaagtggtgtttatattgtaagtggtgcacaactcattagtaaaggaagttggccaaagaatgtgcttcacttgcgcctcctatacactcacatacccaattgctgtataaggaagtcagaatgggatggtgcaccagaggcttcaagaaaatcatcttttctcacaaatctaagcacaacattttcattcacacaacaaagtcctcctcagaagcaggctccaacagtacttgactctggtgtgtatccagatggtccaccagtgcctgttcgttcctgcaaaatgcttaaatatgtggatacaagtgaggttgtgaggggcccgcacgatgctcctggtcattggttggtaactgctgctaagcttgtgactgagggtggtaagattggattacaggtcaagtttgcattgatagactactag

SEQ ID NO: 648 - DNA, 2475 bp, Glycine Max
atgaatcctctgtgctgcattgctccggtttccatcgatcgggaccgccccaaccacgtgctggcaaaatcgcccgctcagtgtcagttagggctcgatgcgtccatcaggacggtgaaccacgcctccaaatccagctcctccacgcaggattcctccgtcgccgtcgactctgtcaaggccacctccgccgtcgcggatctcccggaggaggaggagccacgcgattccaaggccttctccggcgggaacggcggcggagtggctgggagtgtcgccgggatcctgtacaagtgggtgaattacgggaaggggtggagatcgaggtggttcgtgttggaagatggagtgctttcgtattacaagattcacggaccggacaagatcttgatgagtccggcgaaggataggagcgtcagggtgatcggagaagagtcatcgaagtttgtgaagaaagcgaattggaatctgaatctgaatcgagcatcttctggtggaggagtaggaggaggtaatagcagtaacaacgggaagcaatgcaaaccgttcggtgagatacatttgaaggtttcttcagttcgttccagcaagtctgatgataagcggctttccatatttactgggacaaaaactcttcacttgaggtgcgtgtctagagaagacagagccatgtggattgaggccttgcagtctgcaaaagatctttttcctagagctctaacaagtagcgatcttgcaacttcagaagatatcgtagtttcaacagagaagctgcgatcacgattgtcacaggaaagcataagtgaaacaatcattaatgactgtgagtctattatgctttccgaagtctcttatcttcaaagcaagttgaagtttcttcagcagaaacatgttatgttgctggacaccttaaaacaactggagacagagaaaatagagttggaaactactgtagtggatgaaacaaaggaacgtgaatcatactgtggacaaggaaatagaaggtttagtgatttctattccgtcatgtcggagggcagtgctactgattcagtggcggataatgaaagtcaagatggagcagatgttgaaacagatgatgaggatagaacatattttgacacaaatgaatttttgtattctgatgccctaagaagtgcttcctatcgaagtagggaaggtatgggcaatgctagtatattcgatagagattatatttgttatgatggtgtgcatgggtttgacaaggagatcaaagatgtaagttatccatatgtcaaaagaagggataacctaccagagccaaaagaaaaagagaagcctgttggtttgtggtcaattattaaagacaatattgggaaggatctttctggagtttgtctccctgtttattttaacgaaccactgtcttcattgcaaaagtgttttgaagacctagagtattcatacctggttgatagagcattggagtggggaaagcaggggaatgacttgatgagaattctaaacattgcagcttttgctgtgtctagctatgcgtcaactgaaggtcgacaatgtaaaccttttaatcctttacttggggagacctacgaagctgactatccagataaaggacttaagtttttttctgaaaaggttagtcatcatccaatgattgttgcttgtcactgtgagggaaggggttggaagttttgggcagattctaatttgaaaggaaaattctgggggcgttctatccagttagatcctgtgggtgtcctcactctacagtttgaggatggtgaaacatttcagtggagcaaggtcaccacttccatatacaatatcatactaggtaaaatttattgtgaccactacggtaccatgcacatcaagggcagtggcaactattcttgcaaactgaaattcaaggagcaatccattattgacagaaatccacatcaggtccatgggtttgttcaagacaacagaactggagagaaggtagcgatgttaattgggaagtgggatgaagcaatgtactatgtacttggggatccaaccaccaagccaaaaggttatgatccgatgacagaagctgcattattgtgggaaagggacaaccatttaccgaagacaagatacaacctctctccttttgcaatttccttgaatgaaatattacctggtttatcagagaagttgcctccaactgactcaaggttgagaccagatcaaagacatttagaaaatggagaatatgagctggcaaatgcagaaaaactaagacttgaacagttgcagagacaggcaagaaagatgcaagaaagaggatggcaaccgagatggtttaagaaggaagaggatggttgttaccgatatattggtggctattgggaaacaagagaaaagaataattgggacggaatccctgatatatttggacagagttgtgatttaccttcatgctcggaagagactgcatcctactga

SEQ ID NO: 649 - DNA, 1845 bp, Glycine Max
atgaatcggagtttcagggctcaggaatcgcaaatgcacgctgcgttgaagcagagggagcagcaatttgggggtttgaggacttcggtgatgaaggagaaggaggaagagctcgcattgtttctggagatgaagaagcgcgagaaggagcgcaatgatcttcttcttaacagctccgaggagttcgatgcagctcttgtgtctaatgggggtgctaatcccatttttaatatttcgtcttctacgccggctcctgtgcggaagactggtgttgatgattttctcaattcggagaatgataagaatgactatgactggcttctaactcctcctggtactcccctttttccttctttggaaatggaaagtcgaaagactgttatgagtcggcttggtactccaaccacacgtcctgtagcattaaaatccaggttagcaaatcatcaatcagagcctgctgggaggactaatttagtatctaaacaacctacttcctctcctgggttgagctcttcaagtggtgggactaggaggccttcatcatcagggggtccaggatcacgacctgcaacacctactgggcgtcctacattaaccacttcttctaaatcatcaagatcttcgacacctacattaaccacatcttcaaaatcatcaagacctttgacacctacattaaccacatctttaaaatcatcaagaccttcgacacctactagatccatggtaacatccaagaccacaacttccaccatcaagcctgcagtttctgccactaagcatttggcttctgccactgagactccggtccctgcaactaaaccaacaattccatcaagatcctctacacctttgtcaagatctgctgcaagatcttcaactccaactagcagggctactttacctccttccaggcccacatcaagagcaactactccaacccggcgaccctcttcatcgagtgaacccagtatatatgcttcttcagttaaagcttgtttgagccccaagcccgcctctgtgacatcaaggcagccaactcatgtgacagcaagaaagcaggctcctgtgaactcaaggcaggcagcaccaccatcacgtggcacttcaccaacagtgagatcaagaccgtggaagccatctgagatgccaggtttttcacttgatgccccacctaatttgagaacaacattacctgacaggccactgtcagcaactaggggcaggcctggagctcccacttcccggtcttcatctgttgagccttcttctagtggaagacccaggcgacaatcatgctctccttcaagaggacgggcttccaatggcagcgttcatatcagtggaaactccatgccagcagttaaccgtgggcactccaaagtaaatgacaatgttagtcctgttgtaatgggcaacaaaatggtcgagagggtaataaatatgcgaaaactagcacctccaatgattgaagacaaaaactctccccatagtaatctgtctggcaggtcagcttcatctccagatagctcaggttttggaagaacactttcaaagaagtccttggatatggctattagacatatggatatacggagaaccattcctggcaatttacggcctttgatgacaaacattccagcatcttctttgtatagcgtgaggtctggatctcatcatggccgaacaattagtgtttcaggctctcctcatgccacaagcagtaatgctagttccgaactgagtgtaaaccaaaatggcatttgtttagatagcagtgaggtagatgatgatattggcagtgagagatgtggtcaatcccctgccagtgtacggggcaggtaa

SEQ ID NO: 650 - DNA, 1443 bp, Glycine Max
atgaatggcgaggggagtgaagcaatgcaagtggagatggagattgagaaggagaggttggtgtacatgtggggttaccttcccggagctctgccgcagaggacgccactgttgacgccggttctcgttagggttccgccctctggttactcttggaaggatgtttgcggtggtggttgtggattcgccatggctatctctgagcctggaaagctcataacatggggttcaacagatgatttaggccaaagctatgttacatctggcaaacatggggaaattccagagcctttccctcttccaactgaagtgactattgtaaaagctgcagctggatgggcacattgtgtttctgtgacagattgtggagaagtttacacatggggatggagggaatgtgtaccctctgggaaggtgtttggtgaatcattaactggggtaagccccgaaaaggatgtaccaggaaggcaaagttcattcttgactgagcaagtgagccctcgttctcaaggctcaaaatctactggaggaactgcctctggtaccagtggagaagaaagttcaaagagaagaagagtatcttcagcaaagcaaacagccgaaacctcatcatctagtgatgatactcagacagcattgccatgtcttgtcacactcaatccaggtgtaaggatagcaagtgtagctgctggtggtcgccataccttagcattgtcagatataggacaggtgtggggttggggctatggtggtgaagggcagcttggtttgggttctagaatacgaatggtgtcctctcctcatctagttccttgtattaattcctcttcttatggtaaagatatatcagcatcattggctcgaggaagcatgagttcagatgggcaaaatttcagagttcctggaagttatataaagggaattgcctgcggaggtcgacacagtgcagtaatcacagatgctggagctgtgcttacgtttggttggggactttatggacagtgtgggcaaggaagtacagatgatgaattaagcccgaattgcgtatcttccttattgggtattcgaatagagggagttgctgcaggactgtggcatactgtgtgtacatctgctgatggtgatgtatatgcatttggtggaaaccagtttgggcagctgggaactggtggtgatcaagctgagactataccaaggctcttggattgtccgagcttggaaaatgtgaacgtaaaaaggatatcttgtggggctcgtcacactgctctaataacagataatggaaaagtcttctgctggggatggaacaagtatggacagcttggccttggggacgtgatagaccgtaacattccttctgaagttaccatcgaaggttgtgtagctaaaaacgttgcatgtggctggtggcatactcttcttctggccgagccacccacttga

SEQ ID NO: 651 - DNA, 1305 bp, Glycine Max
atgaatggcgaggggagtgaagcaatgcaagtggagatggagattgagaaggagaggttggtgtacatgtggggttaccttcccggagctctgccgcagaggacgccactgttgacgccggttctcgttagggttccgccctctggttactcttggaaggatgtttgcggtggtggttgtggattcgccatggctatctctgagcctggaaagctcataacatggggttcaacagatgatttaggccaaagctatgttacatctggcaaacatggggaaattccagagcctttccctcttccaactgaagtgactattgtaaaagctgcagctggatgggcacattgtgtttctgtgacagattgtggagaagtttacacatggggatggagggaatgtgtaccctctgggaaggtgtttggtgaatcattaactggggtaagccccgaaaaggatgtaccaggaaggcaaagttcattcttgactgagcaagtgagccctcgttctcaaggctcaaaatctactggaggaactgcctctggtaccagtggagaagaaagttcaaagagaagaagagtatcttcagcaaagcaaacagccgaaacctcatcatctagtgatgatactcagacagcattgccatgtcttgtcacactcaatccaggtgtaaggatagcaagtgtagctgctggtggtcgccataccttagcattgtcagatataggacaggtgtggggttggggctatggtggtgaagggcagcttggtttgggttctagaatacgaatggtgtcctctcctcatctagttccttgtattaattcctcttcttatggtaaagatatatcagcatcattggctcgaggaagcatgagttcagatgggcaaaatttcagagttcctggaagttatataaagggaattgcctgcggaggtcgacacagtgcagtaatcacagatgctggagctgtgcttacgtttggttggggactttatggacagtgtgggcaaggaagtacagatgatgaattaagcccgaattgcgtatcttccttattgggtattcgaatagagggagttgctgcaggactgtggcatactgtgtgtacatctgctgatggtgatgtatatgcatttggtggaaaccagtttgggcagctgggaactggtggtgatcaagctgagactataccaaggctcttggattgtccgagcttggaaaatgtgaacgtaaaaaggatatcttgtggggctcgtcacactgctctaataacagcttggccttggggacgtgatagaccgtaa

SEQ ID NO: 652 - DNA, 1410 bp, Glycine Max
atgaatggcgttttcagcgagcagatacttgcagacaagctgtccaagcttaataacacccaacaatgcattgaaactttatcacattggtgtatatttcaccggagcaaagctgaactgtttgttgccacttggaaaaaacaatttgacaaatcagagatgattcaaaggatccctcttttgtatcttgcaaatgatattctgcagaacagtaagcataaagggaatgaatttgtgacagagttttggaaggttcttcctgcagcacttaaagatgttatcaagaaaggtgatgatcatggaacgcgtgtggtatctagattgattgaaatatgggagcaaaggagagtatttggatcccgggctaggaaccttaaagatttgatgcttggagaagatgcacctccaccattggaatttggcaaaaagcgatcacgttctgtaagaattgtgaaaagggattctcactccatcaaatcgaaactgtccataggaggtacagcggaaaaaatagtgtctgcatttcatttggtgctcagtgagcaatccgttgaagatgcagagataagtaaatgcaagtcttctgttcagcgtgtgaggaagatggaaaaagatgttgatactgcatgctctgttgccaaagatcccaagagaaaaactttggcaaaggaactagaggaggaggaaaatattttgaaacgatgcgtagaaaaacttaaattagttgaagcaagtagagtagcccttgtgtctcagttaaaagaagctttgcatgagcaggaatctgaactagagaatgttcgtacacagatgcaggttgcccaagcacaaatagaagaggcttgcaacatgcggaggatacttgataatgaagatttttctcagaaagtgtccgttgccaagtcggctgcagcaattgctgctgaggttgcagataagcttgcagcttcttcgtcatcgcagttgatcatgacttctgttctgtcaacatttgcagcagaagaggcaaaaaatgctggtctaacttctgagtccccacaacagttgattgccgcaccaaaccattcatatccttcagttttggtagcccaaccaccacccttgcaaaatgctgctccttcatcacaaggtcaatttcacatgcttagtaatccgccatcccagcagttcgtgcagtcaactggagggatcatcactccatatggttatggtagcatcccaccattaccgcccgcaccccaactgccaactcatgttggggctatggtgcctttgacacatcagaccctgcaaataactccacatcaacaaataccaataacacagcaagcccccgcacctcctactttccgaccacttcaaccaccaggaatggtgtactatactaatcatcagcattcgatacagtaa

SEQ ID NO: 653 - DNA, 1089 bp, Glycine Max
atgaattcagcatccccgcagtttgtttccccgagaagtatgagtgtgtacgatccgatccaccagattagtatgtggggagaaggcttcaaaagtaatggaaatttaagtgcagccatgcctttaattgatgaggcagacatgaagtttgatagtcagtcagaggatgcttctcatggtatactgggagaacctaataagtatgaccaagaagctagcaaacctactgataagatacaaagacgtcttgcacaaaatcgagaggctgctcgtaagagccgattgaggaaaaaggcctatgtgcagcagttagaatcaagtcgtttgaagttgatgcagttggagcaagaacttgaacgtgcaagacagcagggaatgtatataggtggtgggttggattctaatcatctgggttttgctggatcagtaaattcaggaattacaacctttgagatggagtatggacactgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgttttctatgttatgtccggtatgtggaaaacaacagctgaaagatttttcctgtggattggaggctttcacccctcggagcttctaaaggttcttggtcccctgattgaacccctgacggagcaacagcgtttgaatatctataaccttggacaatcatgtcagcaagcagaagatgccctttcacaaggtatggacaaactccgccaaacacttgctgatagtgtagcagctgggcagttcatggaaggaacgtatattccacagatgacttctgcaatggagaagttggaagatctggtgagctttgtgaaacaggctgaccatcttcggcaagaaaccttggagcaaatgtctcgaatacttacaatccgtcaggcggctcgatgcttgcttgctttgggggaatatttccaacgcctgagggctttgagctcactgtggtctaatagaccccgggaacctgcttag

SEQ ID NO: 654 - DNA, 1089 bp, Glycine Max; identical to SEQ ID NO: 653

SEQ ID NO: 655 - DNA, 657 bp, Glycine Max
atgaatttaaagatgaccgaaagtttcacactgccacctgcttcccttgtttctgttgcggcaattggtgtcttaatatctctcccaatatacgatagggtcattgttccaattctaaggaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgactggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaaggagttacacttacaagacagtacagaggagaactatggatactgatggttgtaacaagagtgatggtgtggagacagtggcaaaatga

SEQ ID NO: 656 - DNA, 825 bp, Glycine Max
atgacaaccatgtcaacctcatcctcttcccaaagcctcaaaattggcattgttggattcggcaactttggccagtttctggccaagacaatgattaaacaaggccacactctcacagcaacttctcgatctgattactctcaactttgtctccaaatggggatccattttttcagggatgtcagcgcattcctcgccgcagacatagatgttatagtgttgtgcacatcgatattatcgctatccgaggttgtagggtcaatgccactcacttccctgaagcgaccaacgctctttgttgatgttctttctgtgaaagagcacccaagagagcttctactacgagagttgccagaggattcagacatactctgcacgcacccaatgtttggtcctcagactgccaataatggatggacagatcacactttcatgtatgacaaagttcggataagagacgaagctacttgctctagtttcatccaaatctttgctactgagggttgcaagatggtacagatgtcctgtgaggaacatgacagagcggctgctaagagccaatttatcacacacacaattggcaggacattgggagaaatggatattcaatccacacctattgacactaagggctttgagacacttgttaaattgaaggagactatgatgagaaatagttttgatttgtacagtggattattcgtgtataacagattcgccagacaagagttggaaaaccttgaacatgccttttacaaagtcaaagaaacgctgatgatacaaaggtcgaatggggagcagggtcataaaagaaccgaaagttga

SEQ ID NO: 657 - DNA, 969 bp, Glycine Max
atgacagcaaagccttgttccatgatcaatactgggagcaataggaaaccatgttgtggtcgtagaagatttggaattctccgattgtcaaaacaaggagttcctcttgctatcattagtccttgtagcaagcttaagccactgtttaagcccatttttcttaatgatgcctatgaaatgtgcagaaatatttgcgcggaatatgccaagaccttttatctaggtacaaacttgcttatgacagaagaaagacagaaagctatatgtgcaatttatgtttggtgcaggaggatggatggacttgttgatgatcctaacgcggtgtatatgagctctgctattcttgataggtgggaagatagattgcacgacatttttaatggacaaccctatgatatgcttgatgctgctcttactgatatcgtctccaaggacatgatacaaaacatgagaatggatacgaggaaagcccaatacaacaattttcaagagttatatctttactgctactatgtggcgggaactgtgggcttaatgactgttccgataatgggcattgcccaggagtctgtcatcccaattcaaagtgtatatgatgttgcactatatctgggtgtaggaaatcaactcacaaacattcttagagatgtgggggaggaatttcaaggacaagattctacttcaaccgggcagaagaaggagtttctcagctccaaaaagccagtcgttggccataataatagcatagacaaattagaattggcacatgatcttcactcattagtttggtcatcattaatattgtatcgtaagatcttggatgcaattgaagacaacgattacgacaatttgactaaacgagcctgtgtgggatgtgccaagaaatttttgacattgcccctaacttacactagatctctctcaaatcccaaaatgaaacttggtccttctttaacgaggcctatctag

SEQ ID NO: 658 - DNA, 1866 bp, Glycine Max
atgacatataaacagttggaggatgcaatattggactttgctgaaggattgagagttattggagtaagacccaatgagaagcttgcgctttttgctgataattcatgtcgctggcttgtagcagatcaaggtatgatggcatgtggggcaatcaatgtggtaaggggttcgaggtcatcaattgaagaactgctgcaaatatacaaccactctgaaagtgttgcactagctgtggacaatcctgaaatgcttaatcggattgcaaaactgttttatttgaaggcttcaatgagatttattattctgctgtggggagaaaaatcaggcctggtcagtgaaggagacaaggaggtgcctgtctttactttcacagaagtcatacatttgggacaagagagtcgcagagtattgtttgattctcttgatactaggaagcactatatgtatgaagcaatcaaatctgatgacattgctactcttgtatacacaagtggaactactggaaatccgaaaggtgttatgctaacccatcagaatcttttgcatcagataaaaaacttaggggatattgtacctgctgaagttggggatagatttctaagcatgctgccttcctggcatgcatatgaaagagcttgtgagtatttcattttctcgtgcggtgttgaacaagtatacacaactgtgagaaacttgaaggaggatttgggacattatcaaccacattacttgatttctgttcctttagtttatgaaactttatatagtgggatccagaagcagatatctacaagctcccttgttagaaagcttgttgcactcacattcataagggtcagcttaaggtacatggagtgtaagcgtatttatgaggtatggtcatctgctctttctggtaaatgtctaacaaaggatcagaagccaccgtcctacctccattcaattttggactggttatgggcaagagttgttgccacaatattatttccagttcatttactggcgaagatactggtctaccataaaattcattcagctattggaatttcaaaggctggagtaagtggcggtggtagcttatcttctcatgtggatagattttttgaggctattggtgtgaatgtgcagaatggatatggtttaactgaaacttcaccagttattgctgctcgacggcttagttataacgttattgggtctgttggccatccaattaagcatacagaattcaaagtcgtagattctgagactgatgaagttcttccacctggttcaaagggaatattaaaagtcaggggcccacaattgatgaagggatactataagaatccttcagctacaaatcaggtcttagatagggatggctggctgaatactggggatattggttggattgttccccaccattcaactgggcggagtcgtaattccagcggagtaattgttgtggatggccgtgctaaggacactattgtgctttctacagaaggtgaaaatgttgaaccaggagaacttgaagaagctgccatgaggagtagcctcatacatcaaattgttgttattggccaggataagcgacgtctgggggctgtaattgttcctaacaaagaagaagtcttaaaggcggcaagggaatcgtcaattatagattcgaacagttcagatgccagtcaagaaaaagtgaccagcctaatatataaagaattgaggacatggacttcagaatctccgtttcaaattgggccagtccttctcgtaaatgaccccttcacgattgataatgggctaatgacacccactatgaaaattcgaagggataaagttgtggctcaatacggggaccaaatagagaatctatacaagtaa

SEQ ID NO: 659 - DNA, 2589 bp, Glycine Max
atgacatcaccgtggaataagattcacattcaccactctcacccttccccttccccgccaccgccactttccgactccgactccgacgactgcggcggcgattcctcctcctccgcccccctccgccactctgatctctccgactccatcttcaagccctacctcgaactctccggccactccggtgccgacctctcgaagatccaatccttcctgacctcctcctccgccggcgctctctcctgcctcatctgcctcgaacgcatcaaaccctccgaccccacctggtcctgctcctccctctgcttcgccgtcttccacctcttctgcatccagagctgggctcgccaagcctccgaccttgccgccgcccgcgccgccacgcgccttcctatttcccccgccactgcctccgcctccgccctctggaactgccccaaatgcagatccgaataccccaaatctcacattcccaaaacctatttctgcttctgcggcaaaatagagaaccctcctaacgatccatggattttacctcactcttgcggcgaggtatgtggaagaccgttgaagcacagtttgcggccaccattgtttgctactctgccaccccgggccgtgcccctcttgacccaaactaatgttcggcgatgtggcttcaaggaattttcgtgtaacaaaccctgttccaagtttttagattgtggggttcaccgttgcattgagctttgccaccctggcgcttgccctccttgccggacacgtggagtgcacgcgtgccagtgtgcgaaggttaaagaggagagggagtgctgtgatcgtgttttccagtgtgggaatccgtgtgagaagaggcttggctgtgggaagcatgtttgtgagagagggtgccattctggtaagtgtggtgagtgtccccttaaggggaagagaacgtgcccttgtgggaaaagggtttatgaaggaatgccttgtgatgctcctgtgcagctatgtggagctacctgtgataagatgttgccatgtggctaccacaggtgccctgagcggtgccaccgtggacagtgcgttgagacttgcagggttgttgtgaagaagtcatgtcgttgtggcagcctcaagaaagatgttccttgctatcaagatttggcgtgcgaaaggaagtgtcagaggatgcgtgactgcggtcggcatgcttgtaagcggcgctgctgtgatggcgattgccctccctgctctgagatatgcggcaggaagcttcgatgtaagaaccataaatgcccttctccatgccatagagggccttgtgctccttgcccaataatggtgacaatttcatgtgcatgtggagagacacgttttgaggttccttgtggtaccgaaatggacaataagccacctagatgtcctaaaccatgtcctatcactcctttatgtcggcatgcatcaaatatcaagccacataaatgccattatggagcctgccatccttgtcggctaccttgtgccaaagagtaccaatgtggtcatacatgcaaattaaggtgtcatggtgctaagcctcctcctaatccagagtttactcttaaaccaaagaaaaagaagattatacaacaaagtgaaagtgttcctggcactccatgccctccgtgcccagaacttgtgtggagatcatgtgttgggaaacacattggagctgagagaatgatggtctgctctgataaatcacagttctcctgtgaaaatttatgtggtaatcctgtaccatgtggtaatcattattgtacaaaaacctgccatgccttggagaaccagttacaaggaagccaaccttgtgaagattgttatctttcttgccaaaaggaaagagagcctgcatgtccacatcactgccctcggcgatgccatcctggagactgtcctccatgcaaggtgctcattaaacggtcatgtcactgtggtgcaatggtccatgtgtttgagtgcctatattacaacagcttgtctgcaaagggtcaagagactgtccgctcatgtggtgggccatgtcacagaaagttgccaaattgtacacatttatgcccagagacatgtcattctggtcaatgcacaaatgctgagaaatgctgtaaaaaggtcactgttcgatgcaaatgccatacattgaaaaaggagtgggtttgtcaagatgttcaagcagcatatcatcttgctggttgccatcctagggatattccaaaaaatcaatttggaattggactcattccttgcaattctgattgtaacagtaaagtgcaggttgttgagtcagaacaacaattgcgtaaaactagagttacagaggtacaagagccagatgtagaaaaatcagttcggaagcggcgaaaaaggcgggaacaagttctagaatccaaggaaacttcaaaactacagaaaattatttcaagaatgaagcggcttcttctatttgtctttattttggtcatacttcttgctgctacatattatgggtacaagggacttttatggctcaatgattggatgaatgaagtggatgaacgaagacaaagatattctagaatcaaatga

SEQ ID NO: 660 - DNA, 762 bp, Glycine Max
atgaccatatctttaaaccccatcgtcagcttcagctcaacgaagttggaaacaaagtatcaggatgcatcaagatattctgttggagcttctttaccaaaggcaacccagtttacacctttgttgatagtgtctagatcgagaaagcttgtcaaggaaagaagatttggtccttgtttttcagtggcagatagtgatcagcttgcagcagacaacagtagtagcaaggattttgacaatgctgaaaattcggcaaccaatgatcagtcagcatccgtgaattccccagatgaaaacttccaattgcaaaccgaagtaaatgcggagtcaggatctccaacattagaggcttccatttccaatggttcaattaaccaagagcaaaggtcagaagcatctcctaagtcacaatctgcaaccaaacgagcttccctgactgcaagagagaggttaaaggcagctcgatccatcaaccgatacgcgcaatcaaaagcatctaagccagacatgagcagcagggtgttggaggcttcaaaacaaagtgacaaagggtcagggaagaaaaaatctggacttccagaggcccctactaatttgtttgatgatagcaaacgagggttgtcaacaggcttcactttccaatttcctggaggttctgatctctttttcattatcttctcatttgtttttatcagcacagtgatgtttgcaacaacttacattgtgtggaaagttggtgcaatccatttcaatgagtactga

SEQ ID NO: 661 - DNA, 1611 bp, Glycine Max
atgaccggcgattttctccggacacccctcactttgaagatcgccactttcttcttcatcgccgtcacattcttctacttcggcaagcattggtccgatggctaccagcaactcgtcttcttcactcagcgatccgactcggatccgaactccaacccggtcgtttccacgtccccgaattacgccaaaccattcaacgtctccgccctaattgagaacaactcccaaccggcgccgccggaaaatgttcctccgccgccgccggaggaggggtcgatcgagaaactgggggtggtgaacgagaatggcacgatgtccgatgagttcgaggtgggggatttcgatccgggaatggtggaacagtgggtgaacgagactcaggttgatgagagcgagggttcttcttcttctccttcttctacttctgattctgatgtgggatttgggatcaagaagttcgggttgtgcccgcgcgagatgagcgagtatataccgtgtttggacaacgaggacgcgattcggaagcttccttcgacggagaaaggggagaggttcgagcggcattgccctgagcaaggtcgagggttgaattgcttggttcctgcacccaatgggtaccgtacccctattccatggcctagaagccgagatgaggtatggtacaataatgttcctcatacacgtcttgttgaagataagggaggccaaaactggatttctagagacaaggataagtttaaattcccgggaggtggtacacagtttatacatggggcaaatgaatacttggaccatatttctaagatgattcctgatattacatttggcaagcatataagggtggttcttgatgttggctgtggcgttgcaagttttggtgcgtacttactgtcacggaatgttgtcaccatgtctgttgctcccaaggatgttcatgaaaatcagattcagtttgctcttgagcgtggcgtaccagcaatggcagcagcatttgctactagacgcttgttatatccaagtcaagcttttgacttggtacattgttcacgctgtagaattaattggactagagatgatgggatactgctgcttgaagtcaataggatgctaagagcaggagggtactttgtctgggctgcccagccggtttataagcatgaagaagttttagaagaacaatgggaagagatgcttaatcttaccactcgactctgctggaattttttgaaaaaagatgggtacattgcagtatggcagaaaccttctgacaatagttgctatctagaccgtgaggaaggaactaaacctccaatgtgtgacccaagtgatgacccagacaatgtttggtatgctgatctaaaagcatgcatctctgaattgcctaagaacatgtatggagcaaatgttactgaatggcctgcacgtttgcaaagcccccctgataggcttcaaaccataaagcttgatgctttcacatccagatcagagctttttagggcagaatcaaaatactggaatgaaataatagcaagcaatgttcgtgttttgcactggaaaaaaatcagattaagaaatgttatggacatgcgagcagatttgcagcagcattga

SEQ ID NO: 662 - DNA, 1773 bp, Glycine Max
atgacggaggatcggaacgtgcggaagacacgtgtggtcgacctggtcctcgactgtgtcatcccttacatcgacgaccccaaggaccgcgacgccgtctcacaggtctgccgacgctggtacgaactcgactccctcactcggaagcacgtcaccatcgcgctctgctacaccaccacgccggcgcgcctccgccgccgcttcccgcaccttgagtcgctcaagctcaagggcaagccccgagcagcaatgttcaacttgatacccgaggattggggaggccacgtcaccccatgggtcaaggagatttctcagtacttcgattgcctcaagagtctccacttccgccgtatgattgtcaaagattccgatcttcggaatctcgctcgtgaccgcggccacgtgcttcactctctcaagcttgacaagtgctccggtttcaccaccgatggtcttttccatatcggtcgcttttgcaagagtttaagagtcttgtttttggaggaaagctcaattgttgagaaggacggagaatggttacacgagcttgctttgaataatacagttcttgagactctcaatttttacttgacagatattgctgttgtgaagattcaggaccttgaacttttagctaaaaattgccccaacttagtgtctgtgaaacttactgacagtgaaatactggatcttgtgaacttctttaagcatgcctctgcactggaagagttttgtggaggcacctacaatgaagaaccagaaaaatactctgctatatcattaccagcaaagttatgtcgattgggtttaacatatattggaaagaatgagttgcccatagtgttcatgtttgcagccgtactaaaaaaattggatctcctctatgcaatgctagacacggaggatcattgcatgttaatccaaaagtgtccaaatctggaagtccttgagacaaggaatgtaattggagacagagggttagaggttcttggtcgttgttgtaagaggctaaaaaggcttaggattgaaaggggtgatgatgatcaaggaatggaggatgaagaaggtactgtgtcccatagagggctaatcgccttgtcacagggctgttcagagcttgaatacatggctgtttatgtgtcggatattacaaatgcatctctggaacatatcggaactcacttgaagaacctctgcgattttcgccttgtgttgcttgaccacgaagagaaaataactgatttgccacttgacaatggggtgagggctctactgaggggctgtaacaagctgaggagatttgctctatatctcaggcgtggcgggttgaccgatgtaggtcttggttacattggacagtacagtccaaatgtgagatggatgctgcttggttatgtgggggagtctgatgcagggcttttggaattctctaaagggtgtcctagtcttcagaaactagaaatgagagggtgttcatttttcagtgaacgtgcacttgctgtggctgcaacacaattgacttctcttaggtacttgtgggtgcaagggtatggtgtatctccatctggacgtgatcttttggcaatggctcgccccttttggaacattgagttaattccttctagaaaggtggctatgaataccaattcagatgagacggtagttgttgagcatcctgctcatattcttgcatattattctcttgcagggcagagatcagattttccagatactgttgtgcctttggacactgccacatgcgttgacacctag

SEQ ID NO: 663 - DNA, 2421 bp, Glycine Max
atgagaatcacgttggagccgagctcggagccaagcccaagcccaagcccaagccgttcccaaactccgaaagaagaagtcgaatgggtcccacttcccaagcaccctctcttcaccgcacacggcggagccaccaccgccgccgcttcccggaacctcctggcctgggacggagcctcgcgcctctacttctgggactcaaacaaacgctgcctccaccgcctctctctccgtctcggcgaccccgatccctcttccgttctcgccgcttccccctctaaggtgttgcaatcggacgcggtgctcgatttcgatgtccgcaaaatctccatcaacaggaaaggaacagcgatactccttttcggttccgagactctctctgttatgtacctctacggacgcgcctctaagaaggacgtgaacttgatttgcaggactattactattggttctcagacatattgcactggtggcaatgatattcgtgtgttacaagcattatggcacccttacagtgatactcatttgggaatcctttcttctgactctgttttccgacttttcaacctggctgtggatcctttgcaacctgagcaagaatattatttacagcctgttgagcctggtagaactagaaaggcctcatcattgtgtccagttgatttttcttttggaggagaccacttatgggaccggttcagtgtttttattttgttcagtaatggggctatctatgtactttgcccagttgttccatttggaagtctcttcaaatgtgagtctctggtagaaatatacaatgatgctcacacatttggaaaaatatcagccaactctgttgcggcaagtaattcaaagttggccatctcctggttagaagcagcttttcctgagttacagaaccaagaaactaaaggagacagcttgtctttgctaaaagctcattcttatgctttatttgatgcatctcttgtcttgcagggacctctgcgaagagtaggtcaggatgggaatgaagattcagttggtcgtagtgcagaatgtgaaggtcgtgctgttagttttctctacaatttagtcagcaaagattctattttggtgactgcctggagtggtgggcagttacagatagatgctctagccgatgagatccaacctgtctggagtgttggtagtccacctcgtcttcgtgttgattctcatgaccaaattctcggccttgctatgatttgtgagtcaattgccagcagcagtttgtggaagcttgatcataatgcctggttgggtaatccaccccctttgctgagactggctattgttgatttggctctgccacgaaaagcagaaagtggttataatatttcattgttcattgatacgcttatgccagaaagaatatattcccttcatgacggagggattgactcaatagttttacattttcttccatttacaagtcagacaaatggcaaggatgatacgatgaaaacaccatctgtgcaccctgttctaaatacttgccagagtggattcacctcagaaccttcactttgtggctttgtgtcattatcagattcatttggatattcatggattgtaactattacactttctctagagtgtgttgtgcttgagatgaaaagctggaacctcttgcttccagtaagcattgatatggagaagaaacccatttcatcagagggggaatcaaaagggagagatataccaacaataattagcaaggaactacttagtggacccagggaggtacttgttcctcaggcctctccaagtttacgttccgttgcagctgattcaattgaaggccgatcaacattacatcagtatttcaagctgtttcatgaaacttatgtggagtatgcacataaggtgtacctggagctcaagcatcacgcacctcagttgaagaaaatcattaatgaccaacattctcgaataggtgatgcacaacagaaacttttgaaagttgacgagaaagaggctatattacagaaaaggatagatcgtgcaattcaaatgcacaattctttggaagagcgcttgcaacaattaaggaacttaccttgcgtgcacaaaaaaccactgtccagagcagagcgaaagtttaaatctgagcttgatcactttaaggaagttgagttggatgctttgcattcttctgttgatgcggtaagtgcaaggctgagaaggcacttgcaagcttcgaaagctaatcaccaacagcaaaaaacaccagggaagaaaagttatgcaggagatgatcagatgtccttgctcaaatcatcgcttgaaaaactttcacttttaaatactgaaaattcaaagaaagttgaacttgtggagtcttcattgagaaacaaagaaagaagcagtagagaaccaagcctgcctatgccatga

SEQ ID NO: 664 - DNA, 1932 bp, Glycine Max
atgagaatgttgcctgtttgctcagccaccccaagttattccacatcttcccagattcccttgtttgggggattgcacccaattcgaaaggatcttgagagcagatgtgtggctgaagaaggtgtgcatttggcttcacaatatggagctcattcactgagaaattcatttgcagtgcaagctacaaagacagtattgggcagtttttcttctacaagtgaatcaggataccttacaagcacgtggggttattcaccagtgctgacagatggacatcattcactgagtaacggggaagtcagacacatggaaagttatcatttatctactgtgccagatgaacttgcggacttcgcagaacaggcaactgaaggatctaacacattagtgacaccagcacaaccagaaacactatcggctgcagatataatgcctgagaactttacatcaagtcctagttctattaatgtggacaatgaatcattagccagtacaaaagcaagtgttggagaccttgttgctggattcaatgaatcattcaatgcctcaatcaatgagggacaaaatgctttacgaagctcactggatacagccacttcttttgtagattctattgttaaaactgctactgaatctgtagataatacttttagcaaggcattttcttctgttgatcaaacaggggagttagcaaataaaaaattaaccagcttttcaagtgagctgactggagtcacaaataaagcacctgccgtggctattgatgtgttgcgccgcacaattgtagttgtagagagttctctaacaagtggggcttcctatgttgtctacttatatggctcagccaaggagctccttcccgcaggaattagggatacagtcaatgtatatgaagataaagcaacagaaatcttgaggcctgttgggtcagcaactcaaaggatatacatggctgtctattcattggagaagagtcttggcttggatccaaatgacccaatcattccatttgttgttcttgtaggctcttcagccacattatgggccttttattggttgtggacatatggaggttactcaggaaatttgtcccctaaatcagctttcgagcttttggctgaggacgcaaatgctgcacttattgatgtccgctctgaggaaatgcgagaaaaagatggaattcctgatctccgacgggctgctaggtttcgttatgcaagtataattcctcttgaggttgatggctccatacgcaagttgttgaagagtggtagagagcttgatgattccttgattgcagctattattcgaaatttgaagattgttaaggacagttccagggttatagtgttggatgctgatggtacttgttctaaaggcattgcaagatccttgagaaaaattggggtcaagaatccatacttggttgaaggaggcttttattcttggatgaaacaaggtctccgtatcaaggaactcaaacctgagacagcactttccatcctcaatgaggaagctgaagcaattctggaggatgttagtccttctccttggcaacttttaggttatggtacagtacttattgcagggctgtatgcattattagagttggagaagacattacagttaattggtgcatttggcctcggtttgaccatctatttgcgggtttcttcatatgaaaactcagaagatctaaaacaagatgtgaggttgttgctttctcctgttagacttggagcacaagcattttcatgggctgctggaaaattagaatcaaatggattaggattacctacatcaccttcatcatcagatgttcagaaccgggtattgcaggctgctgccaaacatgaatcccaaccatctgatagtgaaggtaaccaagatccagttcctgaaccgacagttcctctcaatcagaatgtatga

SEQ ID NO: 665 - DNA, 1785 bp, Glycine Max
atgagcaaaaactggaaatctagctgctttcgggatcctgggggagttctgttccttcttgtgttgtgtttgttgtttcagaactttagtttgtgctgctctttgaatgaagaaggtaaagctcttttgaagttcaaacagggaatagtaaacgacccttttgatgctttgtccaattgggttaatgatgaagtggaagttaacccgtgtaattggtttggagttgagtgctctgatggaagagtagtggtcttgaatttgaaagacctttgtctcgaaggaaatctggtacctgagcttgcaaaccttgttcacataaagtccataattttgcggaacaattcttttcatggaatcatcccccaaggaattgcacacttgaatgaaatggaggttttggatttgggctacaacaactttagtggaccgctacctacagatcttgggaataatattccgctgacaatcctccatgctggccaaaataatggtgttcggaagctactgcaagttcgtactcgtgaaggtggaagtccttttaatcgggtttttcctgatagtcctgctccatttccttcagctccctcacctgccccagcaacgccaccagtggttcagaagccagctcccgttgaccgaaataattctgcttctccttctcccctgcctgaaccacgctctgcaccgctatctaaaagtagctcatcaaagaaccatctagttgttattttggctggagttatgggtggtgttgtatttcttctcatttcaatcattggcctatatctctgtaaaacaaacaaggtagctactgtaaaaccttgggcaacaggattaagtggacagcttcagaaggcatttgtaacaggtgtgccaaagctaaagagatcagagcttgaagcagcatgtgaagattttagtaatgtaattggcacttcatccattggtacagtttacaaagggactttatctagtggtgtcgaaattgctgtggcatctgttgcagcgacatcatccaaagattggtcaaagactctagaagcccaatttaggaacaagatagatacattatcaaaagtgaaccacaagaattttgtaaatcttcttggacattgtgaagaagatgagcctttcaccagaatggtggtttttgagtatgccccaaatggaacactctttgagcatttacacataaaagaatctgagcacttggattggggaacaagacttagagttgccatgggcatggcctactgcctacaacatatgcaccagttggagcctcctttggtccttagcaacctgaattcttcaggtgtccaactcactgatgattatgctgccaaaatctctgatttgagtttcttaaatgaaatagcttcagctgtgataaaatctcctgctagaaaaaacactgatatgacaccggcaagtaacatatacagctttggtgttatattatttgagatggtaactggcagactcccttattcagtggacaatgatggctcacttgatgactgggcttcacactatttacaaggggatcagcccctcaaagaaatggtggatccaactctagcatccttccaagaagaacagctcgaacaagtcgatgctttgattaaatcttgtgtccatcctgatcaaaagcaaagaccaacaatgaaagaagtttgtgtgagattaagagagataacaaaaataacacctgatgcagctgttccaaagctttctccactttggtgggcagagcttgagattgcttctgtagatgcaagctga

SEQ ID NO: 666 - DNA, 450 bp, Glycine Max
atgagcataccaaaggcagtggcagcgacgatccggctcacggtgccggccggaggggctcggccagctccaccggttggaccggcgctgggacagtaccggctgaacctgatggcgttctgcaaggacttcaacgcgcggacccagaagtacaaggcggacacgcccatggccgtcacgataacggcgtacaaggacaacaccttcgagttcgccgttaagtcgccgccggtgtcgtggtacctgaagaaagccgccggcgtggaatccggcagcagccggcccggtcacgtgacctcgtcctcggtgtccgtgcggcacgtgtacgagatcgcgaaggcgaaacagtcagatccgtacctccagaacatgcctctcgagtccatttctaagtccatcattggaaccgccaacagcatggggatcaagatcgtcaaggacctcgattga

SEQ ID NO: 667 - DNA, 291 bp, Glycine Max
atgagccaaaccctggtgttggtgatcaaagatctcccatttgatgctcacccacccctacccttaccccttccatggacaaacaacgccgtcacgaaggtcctccacctcatctcccattacaccctccaatccccttgctccatcggtagccaacacacctttcgccatcgcacccctctctggcagcgcaacctcaacctcaaacaccacaaattccacaacaacaccctcctcctgggccccacagcccatctcgaccctcgcaaaggcccactcaaagccctcaag

SEQ ID NO: 668 - DNA, 570 bp, Glycine Max
atgagccggcaagtggaggcacaccatttttgcgcgcaccagaacgaggagatgaggcagtgccttatctacgacagccccgagaagaaagccaggctcatagggctggaatacatcatctccgaaaacctttacttgacactccccgaccaggagaagcgtctgtggcactctcacttgtacgaggtcaagagtggcctcttcttcatgcctaaggttcctgctctcattcagcgcccagacatggagactgtctgcaccacttatggcaaagtctttcatttctggcaggtcgataagggtcactctcttccatttgggatacctcagctcatgatggctctcactagagatggccagatctatgatcacctcctccaaagttctgcagagcgcatggggatagactatgaggaagaaagaaaagcgagagaatatatgacagggccagttcatggaattcatccattggcaaatggagggggtaagggccttgaacttcggctgagggaggttgaactcaagcacgatccatctccaccatccgtcaaagccaggattttattttga

SEQ ID NO: 669 - DNA, 6723 bp, Glycine Max
atgagcggtggccggagacgtgacgggagagacagcagagcattgaagaagcggaagctgaaccgcactcccgaggaagagctcgaggcaaaatttggattcgatctcttcacagaaggcgaaaagcgtctcggatggttactgacttatgcatcctcttctgttgacgatgaagacggttacaaagtatacagttgcgttgatctctactttgttgcgcaggatggctcttcattcaagacaaaattcagatttcggccttatttctatgtagctacaaaggataaaatggagattgatgttgaagcatacctgaaaagacgttatgaaggtcagattgcagatgttgaaattatagagaaagaagacctggatcttaaaaaccatttatctgggttaagaaaatcttatttaaagctttcatttgatactgtgcaacaattgatggatgtgaagagagacctgatgcctactgttgaaagaaataaggtcaagtctgatgctgcagaagcctttttgtctatgtcaacagaaagaagagaacaaagacctcaggattttctagattgcataaccgatcttcgtgaatatgatgttccttatcatgttcgctttgccattgacaatgatatacggtgtggccagtggtatgatgttggagtgcccactaataatggggttacacttgagaagaagacagatcttctgcagcgtgctgaagttcgtatttgtgcatttgacattgagaccacaaaacttccattaaaatttcctgatgctgactatgatttaattatgatgatttcatacatggtagatggtcaagggtatttaatcataaatagagagtgtgtcggggatgatatagaggatatagagtacactccaaaaccagagtttgaagggtgttttaaggtgacaaatgttcaaaatgagattgagcttcttagattatggttttctcatatgcaagatgtgaaacctggtatctatgtgacatataacggcgatttctttgattggccattcctggaacgaagggcaacccatcatgggttcaaaatgagtgatgaattgggattcaaatgcgatacgaatcaaggggaatgtcgtgctagatatgcttgccatttagattgttttgcttgggttaaacgtgatagttatctccctcagggcagccaaggcctgaaggctgttacaaaagcaaagttgggttatgatccattggaggtgaaccctgaggacatggtttgctttgcaaaggaaaagccacagatgatggcctcctattctgtttctgacgcagtggcaacttattacttatatacaacttatgttcatccctttattttctctcttgcaaccattatacccatgtcaccagatgaggttttgcgcaaaggtagtggaaccctctgtgaaatgttgcttatggtgcaggcatacaaggctaatgttatatgtcctaacaaacaccaatctgatccagagaagttttataacaatcatcttcttgagagtgagacgtacattggtggtcatgtggagtgtcttgaaagtggtcaacttatcaacaaccttgatcgagatctacagtatgctataacagtggagggtaagatggatttggaatttgtttctaattatgatgaagtaaagaatgcaatcatggaaaagcttgtaaaattacgagaagcaccaatacgtgaagaatgtcccctcatttatcatctggatgtagctgctatgtatccaaacataattttaacaaaccgacttcagccaccgtcaattgttacggaggaagtttgcactgcatgtgattttaatcgtcccggaaagacttgcctacgcaaacttgagtgggtttggcgtggagaaacattcatggctaagaaaagtgactattatgctttaaagacacagattgaatcagagtttgttgatgattctgagaagaacaacagagccttatctcactattctgagaaatcatcaaaatcttttcttgaccttcccaaggcagagcaacaatcaagactgaaagagcgtttaaagaaatattgccagaaggcatataaacgggtacttgacaaacctgttaccgaacttcgtgaagcaggaatctgcatgcgtgaaaatccattttatgttgacactgttcgcagtttccgggatagaagatatgaatataaaggtctcaataaggtttggaagggaaaactgtcagaggccaaggctagtggaaattctataaagatccaggaagcacaggatatggttgtgctttatgattcattgcaacttgctcacaagtgtatacttaattccttttatggatacgtcatgcgcaagggtgcaagatggtactccatggaaatggctggagtagtgacatatactggtgcaaaaatcattcagaatgctcgcttgctagtagagaaaataggaaaaccacttgaactagacactgatggtatctggtgtgcactacctggatcttttccagaaaatttcacttttaaaacaagagacccaaagaagaagtttacaatctcatacccatgtgttatgcttaatgttgatgtggcaataaataactcaaatgatcaataccagacactcacagatccaatcaggaaaacgtatacaactcgcagtgaatgctctatcgaatttgaggtggacggaccgtacaaggcaatgatccttcccgcttccaaggaagaaggaattttaattaagaagcgatatgccgtttttaatgatgatggaacccttgcagagcttaaaggttttgagatcaaacgcagaggtgaactgaagctaataaaagttttccaggctgaactttttgacaagtttctccatggttcaactttagaggaatgctattcagctgttgcttcggtggcaaatggctggcttgatcttcttgattttgtggaagatattgatgattgtgacctgatacaactttctaaccagggaaaggatattgcagacagtgagttgcttgattatatatcagaatcaagtaccatgagcaaatctttcgctgattatggtctgcagaagtcttgtgctgttgccactgctagacgtctggctgactttcttggcgatacaatggtcaaagataaaggtcttcgatgtcagtacatagtagcaagtgaacccaagggcacgccagtaagtgagcgtgctgttcctgtggcaatatttgaaactgatgctgaggtaatgaagttctatgtccgaaaatggtgcaaggtctcatcagatgttgacattcgatccataattgactggtcctattacaagcagcggcttagttctgcaattcaaaaaattatcactattcctgctgcaatgcaaaaggttgcaaatcccgtccctagggtggttcatcctgattggttgcataagaaggtccgtgagaaggaggacaagtttcgccaacggaaattagttgatgcctttaaatcaatgaataggaatgagcactcaaaaaagcataatgactcaaatcgtgtccctcttgtgattgatgatgatattgttaatgagttggaggactttggaaacaaggacaggagttctacatgcaggcctagaccaattatacggcattatgaagctaataatgaacgacattcagggaagctcaatgatcaagatgtagagcaacagcataataaaccattacaacaaaaagttgacaaaaatgtagattatgaaggatggcttcaaataaagaagcaaacgtggaaagatattctggaaaggagaaagaagcgaagattggagaattcaaagaaatctgaccgtgtaaatggtgttcttcaacaaatgaatggtaaggggaatcagggcagaagtcatgtcagttcatatcttaaaaggcttgaggtagacttaacaaagcgtcactggcagataatacaactagttcccagttcactgataggccacttttttgcttgggttgttgttgatgggagtatgcataagattcctgtttctgttcctagagtcttttacctcaattcaagatcagacattactgaagaatttatgggtaaacgtgttaacaagactcttcctcatggacggcatagttataacttgtatgaggtctcaattaatgaaattcaatatggggaagcaagcaaaaaacttgcagctcttctagcagatcctgatgttgagggagtatatgaaactaaggtgccactggaatttaatgcaattgtccagcttggttgtgtatgtaaggtggacaaaactgctaataaacgtagtctacaagaaccatggaatttgagtgaattgcacatgaagaccacagttgaatgcgcttatcttgaacaatctatatccttcttttatttttaccatagcatctctgagggacgggctatatatgttggatattttcctgcattaaaagcaataactgttgtggtagttaatccctatcaaaacaaagatttatcaccgacttttcttgaaagacaatttcacgatgcttgccagtctttgtctattgattcacctccgaggaatggcattaatttcaagttggactatgttgcacatgtcaaggatgctgaagcagtgatgcaaagagcaataaatggtcacagtcatgggagggaaaatcacatgcctatggttgctgtcattgaatgcccaaatgttcaattagtaaaattgggcatccaagttctggataattttccatgcctgagtgttccttataatgcacgtgatagtcagtaccaggtaaaaatattcttggctggcaacaagttgctgctaaactggaatgcaacgttgtgctgcatcagtccaatggctaaatcaaagaattgctctctcaagatatgcccatataagaggatttatttgttaaagaaattttcagtttaccaaacaaagtggttaatcaagacaagtaaaaacatatgcaacactctttacatgtcgttaactgtggtaccgttggggaactttgaacttgactggcttatatttattgcggatatcttcttttcaagagcattgcatgataatcaacaggtactttggatatctgacgatggccttccagatttaggtggaattaatggtgaacagaactgttttgtggatgaggtccaacaacctgttcttacatatcctggagcttatagaaacgtaactgtggagctaaagatacaccacctggctgtaaatgctcttctcaagtacaacctagttaatgaaatggaaggaggcactctattgggatttggtcatgaacttgattctggagcattttccacaaatgatcaaaatggttttgatgagtctacctcatgtgcacaagcctttcgagtccttaaacagttgatccagcggtgcctagcagatgcagttacatccggaaatgtttatgctgattcaattttgcaacatctgtatagatggctttgcagccctaaatcaaaacttcatgatccagctctccaccagttactccacaaggtcatgcaaaaggtcttcgcattgttgttggcagagttccgcaagttaggtgctatgattgtatttgcaaactttacaaagattgttatagacaccgggaaatatgatctgtctagagccaaagcttactgtgatagtttgttaagaactatacaatcaagagatctatttgaatgggttgagcttgaaccactgcagttctggtgctcgttgctattcatggatcagtataactatggtggaataccaacaaaatctgatgaagctctaaatgatgaatctcaagtggacattatatctagctggaatattgctgaatacttgccgaaaaaaatccaagaccattttgttttcatcgtttctcaattcatgtatattccctggaattatgcaaaaaaacaagcacaaatcagggcctcattgcagaatggtgactcctgtaccccatcaattaacattggagctgcagaggcttttgaatcagaagtaacagaatttaccaaagaccagattagctcttatttcacacacaaactgctaggaattgttcacgatattggtcttcatatgaagggtatgaacagatcagaaaacaaccagagtacatcaggccttcctcaacttacgggtgatgtccatagaggggatgcttccttggaatttatcaagcatgtttgtgctgtcctcgcccttgaccacagtgtgcagcatgaagttttggtcttgagaaaaaatttgctcaaatatgttgatgttaaggagtttgctccagaagctaagtttcatggtccttgtcattccttcgtcttatccaatgtcatatgcagctattgtaatgactgcagagacttggatttgtgccgtgattcggctttattaactgaggagtggcgttgtgcagtgccacagtgtggccagccttatgatcgtgaggtgatggaaaatgctcttcttcaaactgtaagacaaagagaacggctataccagctgcaagatctggtgtgtaccaggtgccatcaggtgaaagctgcacatttggctgagcaatgtgtatgtgcaggctcatttaggtgcaaggaagatgcaagtgaatttcgtgaaaaaatgcaaattttcttgaacatagcttctcatcagaaattccaacttctcgaagaatgcacctcttggattttagaacttagatag

SEQ ID NO: 670 - DNA, 1335 bp, Glycine Max
atgaggaaaggaaacatggaactcgagacaaacaaggtctatgactacgaggatgcacgcgggaacgacgctgaagtcccagataccgctcatcagattagcaccgattcatggtttcaagtggcttttatcctcactaccggaatcaacagtgcctttgttcttggatatcccgggaccgtgatggttcccctgggttggttcgggggtgtgattggtctaattcttgctaccgctgtatcactttatgcaaatgctctagttgcttatctccatgaattaggaggacaaaggcacattaggtatagagatcttgctggatttatatacggtaagaaagcctataatctcacatgggttctgcagtatatcaatcttttcatgataaatactggctacatcattttggccggttcagccttgaaagctacttatgttctattcaaggatgatggtctgctgaaacttccatattgtattgccatagctggacttgtgtgtgcaatgtttgccgtctgcattcctcatctttcagctcttcgaatttggctaggattttcaacagtcttcagcctagcatatattgttatatcatttgtgttgtcgcttaaagatggattacgatcaccaccccgagattacgagattccaggagaaggtgtaagcaaaatatttacaataattggggcatctgctaacctcgtgtttgcatttaatactggcatgcttcctgagatacaagcaacgattaaacaaccagttgtcaagaacatgatgaaagccttgtactttcagtttaccgttggagttctaccattgtaccttgttgcctttacaggatactgggcttatgggtcttccacagaagtgtatttgctgaatagtgtgaatggtgcagtttgggtgaaggctttggctaatatcacagcatttcttcaatctgtcattgcattacatatttttgcaagtccaatgtacgagtttttggatactaaatatgggatcaaaggaagtgcaatgaatgttaaaaacatgtcatttcgaatggtggtaagaggaggctacctggcctttaacacatttgtggcggctttcctgccattccttggagatttcatgagcctcacgggagctataagcacatttccccttacatttattcttgcaaaccacatgtaccttaaggcaaagaaggacaaactaaacagctcacaaaagctctggcactggctcaacattggtttcttttccattatgtctcttgcagcaacaatttcggccatacggctcattgccatagactccaaaacattccatgtttttgcagatttgtga

SEQ ID NO: 671 - DNA, 795 bp, Glycine Max
atgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgtgagtagtagtccacactcaatatttcttaaactcattgcctctggtgccttcttttttattgtgcttttcttgaaattatatgttcttgttgctgttttatgcttatcacgtatgatttatgaatggttattggtgttatataaaaatctcagctactataataatagtcttcaatatcaggcgggcatggattga

SEQ ID NO: 672 - DNA, 615 bp, Glycine Max
atgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgtgagtgcttgtatctga

SEQ ID NO: 673 - DNA, 651 bp, Glycine Max
atgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgttaggtgcttgtatctgaagagtacaatggggaaatgttaccgtgtcttttga

SEQ ID NO: 674 - DNA, 651 bp, Glycine Max; identical to SEQ ID NO: 673

SEQ ID NO: 675 - DNA, 336 bp, Glycine Max
atgagtaagttcgttgggttgttcctgctggttttggtcagtgtggccgttgctgctgaattcgaccatggtcctgtgtatcctcctgaacacgacaaacagggtccatgtggaaagttcagcacccttagaattttgacgcataagctgcgtcactgtgaaaagcctgcacgaaacctgagggctcctgtttcttcacaatgctgcaatgaccttttaaatgtcagcatcccttgcctctatgctgttttctcctctgatgctttcaagaaagttggtgttgatcccaaaatcgcaatcaccattccccatcgttgccatttcatcaagccatag

SEQ ID NO: 676 - DNA, 1368 bp, Glycine Max
atgagtacacatagtatgttggatattgttgtaaatgatatacttcgagtggtcacaccattacaagaagattgggagatacggtttgcaattattaacgattttcgaagcattgttgaatctgtggaaagcctgagaggagcaactgttgagccatatggatcatttgtgtctaatctcttcacgcgatggggtgacttggatatttcaattgagctatcaaatggtttgcatatttcatctgcagggaaaaaacaaaaacagactttattgggggaggttttaaaagctttgagaatgaaaggtggagggagtaacttgcagttcatctccaatgctagagtgcccattttaaaatttaaaagctaccggcagggtgtatcttgtgacatttcaattaataaccttccaggccaaatgaaatccaagattttgctttggatcaacaagatagatggccgttttcgtcatatggttttactggtcaaggaatgggccaaagcacacaaaatcaataactcaaaagctggaactttcaactcctattcgctaagtttgcttgtgatattttattttcagacatgtattcctgcaattttcccaccgcttaaagatatataccctggcaacatgattgatgatcttataggtattagatctgatgcagagaatcttattgcagaaacttgtgatgctaacataaaccggttcatatcaaacagggcaaggtcaattaacagaaaatctgtggcggaactttttgttgatttcgtagggaagtttgctaagatggattcaatggccgtggagatgggaatctgcccctatactggaaaatgggaacagatagaggacaatatgatttggttgcccaagacttacgcaatatttgttgaggatccttttgagcagccacaaaatactgcaagatccgtcagtgcaggacaactgaagaagataacagagacatttgcaaggacgcacgacttgcttacctcaacaaatcagaatcaaatttcacttttgtccaacttagcaccagcacatgtaataagatgtatcacaaggccttacggtggaggttacattcacccaactcagccacaagtgcagaggggtgttgcttactttcacccaactcagccgcaagtgttccgcccaactcagccacaggtgcagagggccatacgcccgctgcaaccgcagtcgcaacatcattttcaaaatgccagtcaaggaacaagctccaacagttcattttcaactggacaaatacaagcgcgtaaaggagtgagctccaacagttcatcttcaaaaggacatacgccggtgcatagaggccaacagatgtggaggccaaagagttaa

SEQ ID NO: 677 - DNA, 1443 bp, Glycine Max
atgagtagcgtgttggagcatggtgttgtgggatgttgcaaatcagggccaggctatgctaccccactggaagccatgtctggtccaagagagtctcttatttatgtaactgctgtctacacagggacaggaatagagaagccggactatttggccacagtggacatagatccaaactctccaacttattccaaagtcatccataggcttcgtgttccttatttaggtgacgaattgcatcacactggttggaattcatgcagctcttgccatggagacccctcggcagaccgacgatttctcatcgcacctgcactcgtttcaggtcgcatatatgtggttgatgtgaaaacaaatccaagggctccatctttgcacaaagttgttgagcctgccgatatcatacagaagactggattagcttatccacacacatctcactgccttgcttctggtgacataatgatctcatgtcttggagataaagatggaaatgctgcaggaaatggatttcttcttcttgattcagagtttaatgtgaagggaaggtgggagaaaccgggtcacagtccactatttggatatgacttttggtaccaaccacgtcacaataccatgattagcacatcatggggtgctcctagtgcttttacaaaaggttttaacttacagcatctttctgatggattatacgggaggcatctccatgtatatagctggcctgggggcgaactgagacaaacactggaccttggtgattcagggcttttacccttagagataaggttcttgcatgatcctgctaaagatacaggttttgtcgggagtgcattgacaagtaacatgatacgattttttaagacccaagatgaatcatggagccatgaggttgccatatcagtgaaaccactgaaagtgcaaaactggattcttcctgaaatgcctgggcttataactgattttttgatttctcttgatgatcggtttctgtactttgtaaactggcttcatggggatatcagacagtataacattgagaaccttaaaaatcctaaactgaccggacaagtatgggttggtggacttatccagaaaggaagccctgtagtagctataactgatgatggtgaaacttggcaagctgaagtgcctgagattcagggcaacaagttgagagggggccctcagatgattcaattgagtttagatgggaaacggctctatgctaccaactcactatttagtacatgggacaaacagttttatccagagcttgtccagaaaggctcccacataatacagattgatgttgatactgagaaaggtggcctgaaaatcaaccccaacttctttgtggactttggagctgagcctgatggtccttctcttgcccatgagatgagatatcctggtggtgactgcacttcagatatatggatttaa

SEQ ID NO: 678 - DNA, 486 bp, Glycine Max
atgagtgaggctgcagctacgacgacttcgtcttccatgatgcgcaattaccctctcatttccgccatcgttgctttcgccatcgcacaattcatcaagtttttcaccgcctggtttaaggaaaaaagatgggatcccaagcaacttgttggatctggtggaatgccttcatcccattcggctactgtcactgctcttgccgcggcaatcgggttccatgaaggctttggaggacctctttttgctactgctttggttctagcttgtattgtgatgtatgatgctactggtgtaagattgcaagcaggacgccaagcagagcttttgaatcaaattgtatacgaacttcctgctgaacatcctctggctgaaagcagaccactccgggaacttcttgggcatactcctcctcaggtcgttgctggtggcatacttggacttataactgcaggtattggctatctaataaccatggctagtagttga

SEQ ID NO: 679 - DNA, 759 bp, Glycine Max
atgagtgctgagattgattcaacttatgctcctgaacctcacaaaatgtctggagcaactaccagtggccaaaagctctctatattttctgccaaatctggatttgtcatccctaaaaacaaattgtcagggtcgctggtccctattttccgaggggctaaacaacatggggtcactgctgctgccatcaatgaagaaagttcaaaacaaattgagaggagatcaaaatggggtcctgatctcacacaagatgcagctgtcaggaggggaaaagttttagctttgcagattcgagtggatcaaattacaaagcagttggaatcagaaaaactggaagttggggacactcagaacttgaatccagatcaaagcatatctggccctcaaattaacagcaagaaggcagaaatgctcgaacttgaaaagcgggaagcaataggtttgttttccttgaagtatatctttcctttttattcttcccctttgcttcatacaggctgtgaaatactaaaattagatcccagttacaagcctccacgtggttttaaaccattgttaaaagaagccagcattcctttgcctataaaaaaaaaaactattaattcattcgtaacccaaccatccattaataatttttttacggatgaatatccgaccaatctgtttaaaatattgccaaatggatcacatagtgatggagaagctgcaggaaaaaggaaaaatgggctttcagtagcaataggaagaaaaaccacttga

SEQ ID NO: 680 - DNA, 270 bp, Glycine Max
atgagttcatcttccaagccaaatacaggaccctggtttacccttgatgatactcccccaagggagtggaggaaaaaactcatcgagatgggagcatggctggacacaaaattcatgaaagatgccgatccttacaaagtgattgaagaattttgttgtcgaatgacgggaacactgaaggaatggtaccacaatctaggagctgtgcgtcaaaatcagttccatgaactgggatctaccacagccgttctaggaactctccatcaataa

SEQ ID NO: 681 - DNA, 2256 bp, Glycine Max
atgatagcttgtgatggttgtggagtttttggcttttgcgtgttcatgattggtttgctctttttttacagatcactctttagcctccagtcttcttgttcttggcttttaaattttagtgtcatggggtttctaaggtttataagaaggtatagtttccccttcaaggacaaaactcgaaatagagcatatgcacttcagcatatgcaaagcagaggcttctcaaaggatggagttcttaatggtaatgatgtggtgcatccagttctgatcattggcgcaggacctgtgggtcttgttctttctattcttctcacaaaattaggtattaattgcacagttttggagagaaacaaggcattttcaaaacatccacaagcacacttcatcaacaatcgatccatggagatattccgcaaaattgatggccttgttgaagagatccaaaggtctcaaccaccagtagatttatggaggaaatttatatattgtacttccctctctggttcaattcttggatcggttgatcacatacaacctcaagatcttgagcattttgtcagcccggtctctgttgcacacttctcgcagtacaagctaactatgttactactcaagcgacttgaaaacctaggcttccaaatatgtgcgcctgaaagtttggaaggaaatgaacagtcttgtgagaaaaaaataatgatgggccatgagtgtgtttccattgatgccagcaatgactttgtaacagtaactgcatcttctatcattaaagggaagcgtgtagaacagaacattcactgtaacatccttattggtacagatggtgcaggaagtactgtaagaaagcttgtaggaatagaaatgagaggtgaaaaggacttgcaaaaacttgttagtgtccatttctttagcaaagaccttggacagtttttgcttaaggagaatcctggtatgcttttttttatcttcaatgctgaagctattggggtccttgttgctcatgatctcaggcaaggggaatttgtattgcagatacccttttatccacctcagcaaacaattgaggatttcaatccaaaggcatgtgagaaattaatcagcaaacttgttggtcgggagtttggagatgtagatgtaattgatataaagccatgggttatgcatgctgaagttgctgagaggtttatatgtagtggcaaccgaatattacttgctggtgatgctgctcatcgatttcctcctgctggtggatttggaatgaatactggcattcaggacgcgcataatcttgcctggaaaattgcttctgtgattaagggtattgccccaacttcaatgctaaatacctacgaaattgaacgtaaaccgattgctttattcaatacaagattaagtctagaaaactataaagctgccatgtctgttcctgctgcacttggtcttgatccaactgttgcaaacatagtacatcaatttattgttgatgggattggttccatcttaccatctggtttgcagaaggtagctttggatggaatttttggtataggtcgtgcacaggtttcagaatttgtcctaaatgaaagtaaccctcttggatcctcaaggttggctaagctaagacatatatttgaagaaggaaaaagccttcaacttcagttccctgctgaagatcttggttttaggtacctacaaggagcacttatgccagagagtaaagatgttgaaagtcctccagaagtactaacagggcgtcggagggactacaccccttcagcacaaccaggatcaagactgcctcatatatttgtgagagtaaacccgttaagtgaggagactgtttctacacttgatcttgtgtcgggagataaagttgagttcattctcatcatagcacctgtggaggaatcttatcatctagctcgtgaagcattcaaggtggctgaggaacaagaaatttttctcaaagtttgtattttttggtctactgattctgttgaaggacttgagaaaggaagtaaagcagcattatcaccttggaagaattacctagatgttgttgaagtttggtcatcaacttcaaattggtgggatatgtgtaacatgacgaacagaggggctattttagttagacccgatgaacatattgcctggcgtacaagttcaggacttgctggggatcctagagtggaaatgcagagggttttttctgctatactgggagtacacggttcaaataaacaaatacacggatga

SEQ ID NO: 682 - DNA, 585 bp, Glycine Max
atgatcggcgtcggaaagatcaagcagtacagtaacgtcctcgacaagcccctcaccaagggcaagcaagaggttagtttgagcgcattcgcgttcttgttctcggagcttgttcagtacaaccaaacgcaggtcgacaatattggcgagcttgaacgaagactggaggatgctggatatgcggttggggctcgagttcttgagctgctttgccacagagataagggaaacagaagggagacacggctgttgggtattctttcttttgtacacagtacagtatggaaagtattatttggaaaggttgctgattcactggagaaaggaactgaacatgaagatgaatacatgatcagtgaaaaggagctcctcgtaaacaaattcatttctatcccaaaggacatgggaacgtttaactgtggagcatttgttgctggaatagtacggggcgttttggatggtgctgggtttccagctgttgtaacagctcattttgtgcccatggaaggtcaacaacgaccgcggacaacaattttgataaaatttgctgaagaggtgttacaaagagaagcaagattaggctga

SEQ ID NO: 683 - DNA, 339 bp, Glycine Max
atgatgaacaacttcgttggtttcttcctgcttcttttgatcactgtggccgttgctgaatacgatcatggtcctaaatatcctgaatctgaacacgagaaacatggtccatgcggaaagttcagcacacttagaattttgacgcataaactgcgtcactgtgaaaaggctgcacgagatgtgagggctcctgtttcttcacagtgttgcaaagaccttgtaaatgtcagcatcccttgcctctatgatgtcttctcttccgatgctttcaagaaagttggtgttgatcccaaaatcgcaatcaccattccccatcgttgccatttcgccaagccatag

SEQ ID NO: 684 - DNA, 1497 bp, Glycine Max
atgatgaaggagaggtttgcaaaattgttgcttggtgaagatatgtcaggttctggaaaaggggtttgcactgctttggccatttctaatgccattactaatctctgcgcaactgtatttgggcaattatggagactagaacctttaccttctgagaagaaagaaatgtggcagagagagatggaatggcttgttagtgttagtgattacattgtcgagttgatgccttcttggcaaacatatcctgatgggagtaagctcgaggtaatgacttgcaggcctagggcagatatttttatcaatcttccagctctccgcaaacttgacaacatgcttctcgaaattttagacagtttcactgctacagagttctggtatgtagaccaaggaattgtagccccagatgcagatggttcggcctcttttcgcagaacaattcagcggcaagaagagaagtggtggcttcccgtgcctcgtgtcccccctgcaggactcagtgaagactcaagaaaacagttgaatcactctcgagaatgtgcaaaccaaatactaaaagcagccatggctatcaacagcattgctttggctgaaatggaagttcctgagtcatatttggaagttcttcctaagaatggaagaacttgcttgggggattttgtttaccgttacataacatcagatcaattctccccagagtgccttcttgattgcttagacatatcctctgaacatgttgcactagagattgcaaaccgtgtggaagcagcaatttatgtttggcggcgaagagctcactctaggtcctcaccaaaccccaaccgttctaccacaaaatcatcatgggaaatagtcaaggacttcatgattgatggagataagagagaactactagcagatagagctgaaaacattctagtttccttgaagcagcgtttcccaggcttaagtcaaactacccttgataccagcaagatccagtgcaacaaggatgttggaaaatctgtgctagagagctactcaagagtattggagagcatggctttcaacattgtggcccgcattgatgatttgctgtatgttgatgacttgacaaaacattcagagaggtttgcattggttcctacaactacagttaacatggtttctcagcagaagaagattacacgtccaccactctcagtgtctgtctcaggcactacaccacacaaagcatcaattggcactcctagcttttcatctgcggctgtgccactaattagtcctgcaagaggggagagaactcctttcctccacaacatcaacaacagcatcaaacctcatcgtcgcggctttggggtgaggagagtgttgtcaaattatcttggtgtagagacaaagactactaagatatgcagcaactcaactgaggtgaattgttcaaacccaagtagcaagaaaaccgaactacaacaacaaccagaacaacaacgtcagaagtttaaaaacaggaccaaatga

SEQ ID NO: 685 - DNA, 384 bp, Glycine Max
atgatgaggggaagaacaagacatgaagaagatgagcaatctcgagctttgtaccagctctccgcgctcgttctcaacctccttcgctcgcctctgtcgtcgttgacgttctctgacgaggttccgccgttggcggcgtcacggcgtcccgggctgggtcagatatcgccggcgggattcgcctccttgctgttgggaatatcgctggcgttgatgctgtgtggatcggtgacgttcttcatcgggttcgtgttgatgccatgggttctgggattggtcatgctcttctacgtcgccggaatcctctccagcctctccgtcttcggccgctccattctctgctacgccaccgctccaccctcgccaccatggaagcttatgtga

SEQ ID NO: 686 - DNA, 399 bp, Glycine Max
atgatgaggggaagaacaagacatgaagaagatgagcaatctcgagctttgtaccagctctccgcgctcgttctcaacctccttcgctcgcctctgtcgtcgttgacgttctctgacgaggttccgccgttggcggcgtcacggcgtcccgggctgggtcagatatcgccggcgggattcgcctccttgctgttgggaatatcgctggcgttgatgctgtgtggatcggtgacgttcttcatcgggttcgtgttgatgccatgggttctgggattggtcatgctcttctacgtcgccggaatcctctccagcctctccgtcttcggccgctccattctctgctacgccaccgctccaccctcgccacgtaaggacattcccgcatggaagcttatgtga

SEQ ID NO: 687 - DNA, 417 bp, Glycine Max
atgatgaggggaagaacaagacatgaagaagatgagcaatctcgagctttgtaccagctctccgcgctcgttctcaacctccttcgctcgcctctgtcgtcgttgacgttctctgacgaggttccgccgttggcggcgtcacggcgtcccgggctgggtcagatatcgccggcgggattcgcctccttgctgttgggaatatcgctggcgttgatgctgtgtggatcggtgacgttcttcatcgggttcgtgttgatgccatgggttctgggattggtcatgctcttctacgtcgccggaatcctctccagcctctccgtcttcggccgctccattctctgctacgccaccgctccaccctcgccacgtaaggacattcccggccagagctggtcggtctctgcttcatcagcctag

SEQ ID NO: 688 - DNA, 1596 bp, Glycine Max
atgatggatgccacaaccagcggaaccccaactatccaataccataacatccctgaccagccaattactgccattattgccactccacttccaacatttcaaaggcagcaacgccattgctttggggactccactcctggagagtttcccttgtctgctaatccctccattgtccttcatgttctcactgcatgcaatttggaccctcaagaccttgctaaactagaggcaacatgctccttcttcaggcagccggcaaactttgctccggattcggacttgtccttatctgagctcgccgcactggacatgtgccagaagagagccatattcaagccaatgacaactgaacaacgccaggatttgaagctaaggtgtggaggttcatggaaactggtgctgaggtatttgatggctggagaggcatgttgcaggagggagaaatctcaggctatagcaggtcctggtcacagcattgctgtgacatcaaaagggattgtttattcatttggttccaacagttctggacaacttggacatggcaccactgaggaggaatggcgacctcgaccgataagaactttgcaaggcattcgaattatacaagctgccgctggggctgggaggacaatgttggtaagtgattctggtcaggtttatgcatttggggaagctgagtatggagttcaaggttctaaaactgttgcagctccacagatagtggagtctttgaaaaacatatttgttgtccaagctgcaattggtaactttttcacagctgtgttatcaagagaaggcagggtttatacattttcttggggcagtgatgaaaaacttggtcatcacactgatcaaagtgatgtggaacctcatcccttgttaggtgctcttgaaaacataccagtggtgcaaattgctgctggatattgctatctgctttgtctggcttgtcaacccagtggaatgtcagtgtattctgttgggtgtggcttggggggcaagcttggacatggctcaagaactgatgaagagtaccctcgtttgatcgaacagttcggactgctgaacctccaacccatggtcgttgcagctggtgcttggcatgctgctgtggtgggacgggatggccgtgtttgcacgtggggatgggggcgatatggttgcttggggcatgggaatgaagaatgtgaatcagtacctaaggtggtggaagcattgagcaatgtcaaagctgttcatgttgcaacaggagattacacgacctttgtagtgtctgatgatggtgatgtgtattcatttggctgtggacaatctgctagtcttgggcataatgctgctggaaatgatgagcagggcaacaggcatgcaaaagtgttagatccagagcttgtcacttcactgaaacagatcaatgaaagggtggtacagattagtctgaccaattgcaattactggaatgctcatacctttgccctcactgaatcagggaagctgtatgcatttggtgctggagacaaaggacagctaggaattgaacttgttgctaaccagactgaaaggggaaatccagaaagggttgaaattgatcttggttaa

SEQ ID NO: 689 - DNA, 2178 bp, Glycine Max
atgattccttggcttttgggagcagcctatataaatcgccaattcttaataaacgttcgaaacatcctacttttctttcttgacgcaattcagacgccgttcctattcttgatcttcatcatgtccaatcccaaatccgagtcagtagtgtctgaaccctctgattcggaaccttcaatacccatttcgtatccaataaaaactctttcggagttggagtctcgctcgtattttgagtcctttcactaccctttcaacaaagcttcttcttcggtgaacaattcttcttcttccttgcccaacaggcgcagattgctcgtgtgtcatgacatggctgggggctacttggatgacaagtgggtccaaggtggcaccaaccccgatgcttatgccatctggcattggcatttgatcgatgtatttgtttacttttcgcactccctcgttactcttcctcctccttcctggactaacactgctcatcgccatggtgtcaaggtgttggggactttcatcaccgaatgggatgagggaaaggctgtctgtgatacaatgctttcgacaaaggaaactgcacatatgtatgcagaacgtctggcagagcttgctgctgatttaggctttgatgggtggctaataaatatggaagtaaatttggatccgggtcaaatttctaatttgaaagagtttgtagcccatttatcattaacaatgcattcttctgtgccaggatcattagtgatatggtatgacagtgttacagttgatggtaaattgaattggcaagatcaactaaatgaacacaataagccattctttgatatatgtgatggaatatttgtgaactatacatggaaggaagactatccaaggctctctgctgctgttgccagtgatcgaaagtttgatgtgtacatgggaattgatatatttggaaggaacacatatggtggtggacagtggaatgtaaatgttgctcttgatgtaataaaaaagaatgatgtctctgctgcaatatttgctcctggctgggtctatgagacaaagcaaccaccagattttcagactgctcagaatagttggtggggtcttgtggaaaagtcatggggagtactacaaaaactacctggagtactaccattctacactaattttgatcagggacgtggttatcatatttcagttgatggtgataatgtatcagatgctacatggtgcaacatttcttgccaaggctttcagctttattgtaatctaactcaaatatttgtgtgcagccactccttgagtctgttgatccgacaaactctattcaacttgaaggaagcatcatacagtggagggggaaacattacattcaaaggatcccttgaagagcaaacttactatgagagcaaaatctttcaaggagagtttcttctgaacgatttgcctattcactttatttattctgtgaaatctgatggtaattcttcattgggacttaagcttgagttcacttccaccagcaacaaaagagcatctgtacttctcacatcccgggctgtgaatcgtttctcaagcaaattcagcaaaatagttatgacacgtgaacataagggattatcctctggatgggttataaatgaaggtgtggttgcaatgaatggatacactttaacagaaatccatgcagtgtgctatggatcaaatgacaatgatgaaactttggcttccccatcagattattttgcgcttcttggtcatattacaatcaagacttctgactataagtcatattttcctgtgtcttcttcctggctagttgatggaagctgcataaaatggacatcagatcctctgggttcaaagacccttgatgttaaaatttcttggaaactaaaaaatggacagaactttctatttctaaagtacaacgtatacttggtgaaattatcaaaacaagatgtaggtataacattagaggatgtgaaggagtaccttggagtagcacaagtaaactgtttttatgtttctgaccttgaagttccttctgacacttctagtctcaaatttataatacaagtctgtggggtagatgggacaattcaagaattggatgagtctccatattatcaattggagttcacgtttatgttacatttcatgctcagtatacaactaacaggaccgaaatag

SEQ ID NO: 690 - DNA, 333 bp, Glycine Max
atgattcttccaattggatatacatcacccacatcgaaaacagtggcgggtttagtccaaagaagcgcagccggaattgacgaaaaaagtaactgcacactctcttcatgcgctacagggtttttcttttttcacgaacagggtgaactaggacatattccagtttctattcattcatcctctggcttctcttgtttagatcctcatccatcgcggtgctacattagtctaaagttgattctgtttcacactcacattacttcttcattcgctggaaattgtaaaaataagaatataaccatcttaagacttcttgtgatgatatgtttttaa

SEQ ID NO: 691 - DNA, 549 bp, Glycine Max
atgatttccaatcccatgttaatgttactagttgtggtactgctggtggttggttttgcaaagtcagatttaagtaaggacagagaagaatgtgcagacaaactaattgacctagctagctgtgttccttacgttggtggtgaagccaaaacccccaccatagattgctgcactggtctcaaagcggttcttgaccggagcaagaaatgcctctgcatcctcatcaaagatcgcgacgaccccaatcttggcatcaagatcaatgctactctcgctattcagctaccctctgcttgccactcacctgctaatattactcagtgtgtagatcttttgcatttagcacctaactctcctgatgctaaggtgtttgagggattccaaaaatctgccaaaacaaacagctccaccccagtttcagtttccagtggtgctgagaagggatcaagctcaagtgctcaggaaaagagtggtgctgtctccacaattacaaaggcacaccacctgttttactctatcttaccattaccattattatttcttgtttga

SEQ ID NO: 692 - DNA, 1329 bp, Glycine Max
atgcaaaaaatgatgaagccaccttcttcttcttccttcccctctcttctcagagtcaagcctcgtctctcttcttatctcttcaccctcttagctttcattctcttcgccgccatcctatatggccatgactttgtcttcatcttccgtccacgcctccactccaacgatcacaccacacaaacactcttctccacacccgtcgatgtgagatcttcaacaacaaagaaagaaaataccgaagaaaataagacggcggggacaaaatcgaaaagggaggaagaagaagagtgtgacgtgttcaacggaaggtgggtacgcgacgagttgactcggccactgtacaaggaatcggagtgtccgtacatacagccacaattaacatgtgaagaacacggtcggcctgataaggagtatcagcggtggcgatggcagcctcacggttgcgatcttcccacattcagtgccagattaatgttggaaaagcttcgtgggaagaggatgatgtttattggagactccctcaatcgaagtcaatatgcctctttgatatgccttctccatcaacttattcctgaacatgccaaatccgaggaaaccttggattcactcactgtcttttcagctaaggaatacaatgccacaattgagttctattgggcaccttttcttcttgaatcaaactccgataatgctgtcatccatagggtaactgataggattgtgagaaaaggttcaatcaatacgcatggtcgtcattggaaagacgctgatattgttgtatttaacacttacctttggtggataactggctctaagatgaagatcttgcttggatcttttaacgatgaagtaaaggagattattgagatgtcaacagaggacgcttatcgtatggctatcaaaagtatgcttagatgggtgaggctgaacatggactccaacaagacaagagtcttctttatcagcatgtcaccatctcatgcaaaaagcatagagtggggaggtgaagcaggagggaactgctacaatgaaacaacaccaattgatgatcccacatattggggttctgattctaagaaaagcataatgcaagtaattggggaagtgtttagaaaatccaaaatacctataacttttctcaacattacccaactatccaactatcgtaaagatgcacacacatcaatttacaagaagcaatggaatcggttgactccagagcaattagctaaccctgctagctatgctgattgtacgcattggtgtttgcctggacttccagatacttggaatgagcttttgtttgccaagttattttatccttga

SEQ ID NO: 693 - DNA, 1389 bp, Glycine Max
atgcaaactaagaaaaaaacctccaggcgaaatgccagtcaagagcgtggcagtcctaaagtttcaagagcacagaggaaggtctctcaaaatggtcaagctgctgaaaagaaagtcacagacttaattacatcatctgctagaaagaataaatctcttagcacccttgagaataaaactagagagcctatccctccaacagatttgaataatggatatgagtttatggacagtgggacttctgatgcttgtttggaaaatgatgcagttgacggtgtttcattagattttatgggttgtaacaatcaagctgttcatctggagtctggaactatattttctcctgggtttcacttgtccaaaaattctggtggagttgacagagttgattttatcaaaatttttcagaatgaagaccacaagagagtttctccgtgccaagaaatagagtcaccacaggaagatgcagtagatggtcatgttagtcgagactctgacactgcaatggaggtagacataaacaattcatctttaagcacaaaaaatgtgaatggttgcaattctgattatgatggaaatggtctttccatggaagtttctgccatatatcttgccatgaaaaactcaaagcttgaatgtgttgatgagcacagtcaggatcccatgtcttctgaaatgtgcatagaggaggatgaatttgaggattttgatgactttgacccgtacttattcataaagaccttgccagacttgtcaacagtggttccaacttttagacgattgttgttaccgaagcagacacgtagttgcccttctactactcttgtcctggacttggatgaaactttggtgcattctaccctggaaccttgtgaggatgtagacttcacttttcctgttaatttcaatagtgaggagcacattgtctatgtacgctgccgccctcacctcaaagatttccttgagagagtttctggtctttttgagattattatatttacagctagtcaaagtatttatgccgagcaacttctaaatgtgcttgatccaaagcggaagatatttcgccaccgtgtataccgtgagtcctgtgtttacgtggaggggaattacctcaaagatttaacagtgcttggtcgtgatttggcacatgttatgataattgacaattccccacaggcatttggattccaagtggataacggaataccaatcgagagttggtttgatgatcgttcagatcaagaattgcttttattacttccgttcttggagagcttggttggtgttgatgatgtccggccactaattgcaaagaaattcaacctgcgggagaaaattgctgcagctgcgcatcctctaaatagaagagatttcttatcagaatga

SEQ ID NO: 694 - DNA, 1389 bp, Glycine Max; identical to SEQ ID NO: 693

SEQ ID NO: 695 - DNA, 1389 bp, Glycine Max; identical to SEQ ID NO: 693

SEQ ID NO: 696 - DNA, 1188 bp, Glycine Max
atgcaaattataaattcagccctggcaactggtgacgagcccattacatcagatgcttacaccatcaatggccaacctggtgacttctataattgctcaaaagaaaccacatatcgctttttaattgattatggaaagacatatctttttcgtataataaacgcagcaatgaacgaagaacttgtctttggggttgctaatcacaacctcacagttgtaggcattgatgctgcctacacaaagcccttaaacaccaatttcattgcgataacaccaggacaaacaatggatgtgttgatcacagcaaaccaaaaaaggggtttctattacattgctgctagtcctttctatgatggcactgcaatgtatgacaatacaaccacaacagctattcttcagtacagtggcaattacacaccaccatcatcatccattcccatgcctattcttcctgcattgaatgactcgggaatgatatttaattttactaagagcttgaggggtttggcaagtcaagatcaccctgccaaagtgccaacaaatgtgactagaaaaatttatatgacagtatccatgaatgaattaccttgtcaaaatccaaatggaagttgtttaggacctaatggaacaagactggcttcaagtctaaacaacataagttttcagatcccacagattgatatacttaaagcatactactggaacatttcaggagttttcagtgaggactttccggatcaaccacctttcttttacaacttcacaggagatacaagaagcaatactctaatcccaagcacaggaaccagggtgctaatgttcgactataatgaggttgttgaacttgtgtggcaaggaactagtgctctcactgcagagaatcatggcatgcaccttcatggttttagcttctttgtggtgggtgtggggacaggaaatttcaacaatgtgacagacccaaaatcctacaatttgattgatccaccagaagttaataccattggtcttcctaaggatggatggcttgccatgagatttgtagcaaacaatccaggggtatggttcatgcattgtcatcttgagaggcacgctagctggggtatgcatactgtgctcattgtgagagatggaggtaccatgcaaaccagtatggttccacctcctaaatacatgccaccttgttcttaa

SEQ ID NO: 697 - DNA, 1566 bp, Glycine Max
atgcagtggcggttgctgcttttgttgcttttggagctaacggctcgcgcaatgccgtatccgatcactttttccgcgcgcctcgttcaccgcttcgccgacgaaatgaaaccggttcggcctccgaccggctactggccggaccagcggagcatgcgctactaccagatgcttctcaccggcgacattctccggcgcaagatcaaagtcggaggcacacgctaccagctactgtttccttctcacggcagcaaaacgatgtcgctcggcaacgacttcggctggttacattacacgtggattgatataggaacaccgagtacttcgtttctcgtggcgttggacgcagggagtgatcttctttggattccgtgtgattgcgtacagtgcgctccattgtcatcgagctactattccaatctggatagagacctgaatgagtatagtccgtctcggtcgctatccagtaagcatctatcttgcagtcatcggttgtgtgataagggttccaattgtaaaagttcccagcagcagtgtccatacatggtcagttacttgtcggagaacacgtcgagttctggattgttagttgaggacatactgcatcttcagtcaggcggcactttatcaaactcatctgttcaggctccagttgttcttgggtgtggtatgaagcaaagtggtggttatttggatggggttgctccagatggcctattaggtttggggcctggggagagttcagttccaagttttcttgctaaatcaggattaatccactattctttttcattgtgctttaatgaagatgattctggtagaatgttttttggggaccagggaccaaccagccaacagtctacttcattcttgcctttggatggattatattcaacctacattattggagtggagtcatgttgtattgggaattcttgtcttaaaatgacaagttttaaagcacaggtggatagtgggacgtcatttacatttcttcctggccatgtgtatggagcaataactgaggagtttgatcaacaagtaaatggttcaagatctagctttgaaggatctccttgggagtattgttatgttcccagttcgcaagacttgccaaaagttcccagctttactctcatgttccaacgcaataacagttttgtggtctatgatcccgtgtttgtattctatggcaatgagggagtcattggattttgtttagccatattgccaactgaaggagatatgggaacaattggacagaacttcatgacaggataccgtttggtatttgataggggaaacaagaagctagcatggtcacgctcaaattgtcaggatctgagtctaggcaagaggatgcccctttctccaaatgagacttcatcaaacccattgcctacagatgagcaacaaagaacgaatgggcatgcagttgctccagctgttgctggaagagctccccacaaaccttcggctgcttcatctcggatgatttcatcgtgccgggtacattggcactgctatttgtttcttctacttctacttgtgtctgccctttactga

SEQ ID NO: 698 - DNA, 762 bp, Glycine Max
atgcatggtttaagaggagagaagttgcaattttcaagtgtaaggtttggtcttaagcataaaatttcctgcaaacttactgatgtgggaaatgatttaagctcatcaaaggagcttggaaagtgtcaacctttggttaagatgtgtggcattacatcagctaaagatgctgcaatggcagctgaagctggtgcaagttttattggaatggtcatgtggcctaactcaaaacgttctgtttcgctttctgttgcactggagatatcgaaagttgcaagagattatggagcagagcctgtgggtgtatttgtggatgatgattctgaaacaattctaagagcttctgatgcagcaaaccttgaatttgttcagcttcatggatatggatctcggttagcttttccgtctttaattcaggaaaatcgtgtaatatatgttctccatgtaaatgaggacggaaaccttttaaacacaatttctgatgaagagtgttctctagttgattgggtccttgtagacagtgcaaagggtggcagtggtaaagcattcaattgggaccagttgaaactgccaaacattaaaagtaagtatggttggctcttagcaggagggatccagcctgagaatgtttctaaggctctatctactctcaagcctgaaggggtcgatgtcagcagtggcatttgtgcatcagatggtatccgcaaggatcaatcaagaataacttccttcatgaatgcagtgcattctgttcaatattga

SEQ ID NO: 699 - DNA, 288 bp, Glycine Max
atgccaaacttttttggtcaactcaatgtgcctgacttgaaagcacctagcattagaagcgcgttgcgctcaacaatattaattaatagtccaatttttgcgcctaaagttatactactattaaaatgtattttcccagttgtacaaaatcgtgggtcgattcatggatcgtgcactcattcatcctcccaaatacgattcccttctttgatttgtttcctacgaaattattactcatctttttacataataataataatatatttttggcatctttttattccgtaa

SEQ ID NO: 700 - DNA, 294 bp, Glycine Max
atgcccaaaccgaaaatttcactttggccatccttcccatcaccaccgccaacacctgcttatacgcgtagaagaatctcttcatcgccgcctcaatcgcctgcatcgcctgcaacaagtgaaccttctcgaacgcgctcttcgaaacgtagagcttcatcgccgcctcttgaatcctcggtcctcccttcggatccacctccacctccaatatctccggcaccttgtgcctcagatctctgcacatcttcgtcaatatcatctgttacccacagccacactagtataccgtga

SEQ ID NO: 701 - DNA, 1152 bp, Glycine Max
atgcccatattctctgcaagcttgggctccttcacttccatctccttcctctcaacttcacaatcacaatcacaatcacacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgttcgtcaggctcggagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaagaaccagagaaatctatacaagaaattgcacaaggcttaattggttcaatcatgtcggtgaaggtaattctagcagatgaggataacaagaaattgatcttctctgaaaaggaagctgcctggtccaaattttcaaaacaggttaatgtaggggacatttttgaagtaagagttggttatgttgaggactatggtgcttttgttcatttgcgcttccctgacggtctttatcgccttactggactaatacacgtgtcagaagtgtcatgggatctaattcaggatgtcagagatatcttaaaagtgggcgatgaagtgagggtcaaagttgtcggtattgattggggaaaatcaaggattaacctatcaattagacagctagaagaagatccactcttagaaactctggacaaagtaatacctcaggatggttcagctgatcctgattccatgagcggtggtgatagcggtagcattgagcctcttccaggacttgaaacaatccttgaagagctgctacaggaagatggaatatatgacgtaagaatcagccgtcaagggtttgaaaaacgagtggtctcgcaggacttgcagctttggctttgtaatgcacctcccacgaaccaaaggtttactcttcttgctcgggctggaagacaggtgcaggagatacacctgactacatcccttgatcaggaaggtatcaagaaggcattacaacgagtactggagcgtgtcccctga

SEQ ID NO: 702 - DNA, 1860 bp, Glycine Max
atgccccccaaaacccaagaagaaatggcgagtagcagcagcaacactccgaaggaaagcgtggttgacgatcggggaaggcgtcgaacctcttgtggctattgcagatcctctcgtgacaatagcatctctcatggcatgtgggcacatagccttacagtggatgactaccaagatcttcttgattgtggctggagaaggtctggatgttttctttataaaccagagatggaaaggacatgctgcccttcttatacaattcgcttgaaagcaagtaactttgttccttctaaggagcaacttcgtgtatctatacgaatgcaaaggtttttagatggaaccttggatgtaaaaaaagtcgatgtcacggaggacccaaccaaatcaggaaacttctccagtcctatgtcagaagaatccttagctgctggcagtgaaaacaaggatgaagttgaaaaatctttgcatttatcaaaccaaattgataatgtaatacacatcctcattgagaggggggaatttgcctctggtattcaattaccaaaagcttcagtgaaaagagtttcacagggaaaaaggaagttactagtcaatggatcagaagatctcttatatagtagcaatatagcctttcaaattgcagcatctataaaacgagcacaatcatgtgacaaggttgtcaatgattccaaaccatcaagagtttgtgaaaaggagaatgattcatctcctaaaattattgcagaaaagctagtagcttctttagatccaactgtgaaaaattctggtttgtctatcagggcttgcaatggacatatcaatttttatgcttctagtaagcaagtttccttgaacagaagtgttcaaaatgctccagttcctaaaaattctagaatgaagcattacagtggaggaaattgtttgattggtcaggtaaaaaggcgaaagcttgagatccgtttaaacagatccagttttgatccagaagaatttgctttgtacagaagatatcagctcaaagtacataatgataaaccacaaaatgtcacagagaactcatatcgcagttttttggttgatactccattaatacaagtttctcctactggtggtagcacagttcctccttgtggttttggctctttccatcaacaatatctaatagatggccagttagtggcagttggtgttatagatatccttcccaaatgtttgtcaagtaaatatttgttctgggatccagactttgcctatctatcactaggcaagtactcagcttttcaagaaataggttgggtgaaagaaaaccaggtttattgtcctagtctacaatactattatcttggctattatattcactcttgcaacaagatgagatacaaagctgcatatcacccttcagagcttttatgccctcttcgctatcagtgggttccatttgacattgcaaggcctctgcttgacagaaaaccttatgttgtcttatcagattcttccattttacaaaatggagagtcatccctacctcaaattactgacgatgtaatgggaagggattttgatgatgttggccaagaagatgcaaatgatgttccaatgcttgatgaagaagaaatggttgattctgaatctgaatgctctgatgatgaacctgacctagaaaccacttcagatgatgatccagaaattgttgatgtcagcaaggttttgctagggataaagggatctcatgtgaaatacaaggatctgtgggttgtctttgatcctgagcagcggagttacttggagtcacgattgcggagatacaggaaggttgtgggtccagcgctatccgagagaatggtccattcgctcggataa

SEQ ID NO: 703 - DNA, 3144 bp, Glycine Max
atgccgacgcccgtggcagccgcgcgccaatgcctaactcccgacgccgcgcgcgccctcgacgaggccgtctccgtcgcccgccgccgcggccacgcccaaaccacgtcgctccacgccgtctccgccctcctctccctcccatcctcacccctcctccgcgacgcctgctcccgcgccagaaactgcgcgtattccccacgcctccagttcaaggccctggacctctgcctctccgtctccctcgaccgcgccccctcctcccacaaccactcctccgccgaccacgaccctcccgtctcaaactccctcatggccgccataaaacgctctcaggccaaccagcggcgccaccctgacaacttccacttctcccaagggtcttactcaccattagatcggggttgccagaagcaacagcaacagcaacagccgttttctgtttcctctgtcaaagtagagcttcagcatttgatcttgtcaatcctagacgacccggttgtcagtcgcgttttcgccgaagccggtttccggagctccgatatcaaactcgccatcctccgccctctccgcccccgcggctcgccgattttcctctgcaatttatccgagtcgccgcgccgcttcccgttcttcttcggctgtggtgacgaggacggcggcggagagaatttccggcgaatcggggaggttctggtgcggagccgggggaagaatccgctgcttctcggcgcgtgcgcgaacgacgctctgcgtggctttgccgaggcggtggagaaacggagagaaggggctttgccggtggagttgctggggctgcgcgtggtttgcattgcggaggaggtggcgggtggggatgcggaggtggtggggaggcgcgtgagggagattgggaatttggcggagcagtgtgtggggcccggtgttgtggtgagcttcggggacttgaagggttttgtgagcgatgaagaaggtgagggtctgaagagtgtggttggagaattagcgaagttgttgcaggttcattatgataagttttggttgattggtgctgcggctacttacgagagttacttgaaattcgtggggaagtttccttctatagagaaagactgggatttgcagcttctgcctattacctctgttaagcctccttctgaatcctatcaccgtcccaggtccagcttaatggattcatttgtaccgtttggtggctttttttcgtcacagaaaggttttgtgcttcttcagctgctgatccgcatcaatctagcttgcctccttggttgcagattgcagaatttggctcaacaaaaggtgcagaccaaagataatggtgttttgctcgatagtagtgaatctgggccactccataagaacttagacaagttatcccagcatctgctccatcgagatgcaaatacttttccgactgttgtggggtttcattgtggtgctgaaaagaagaaggaagacgttgacaattgccgcagcaaatcacctagtgaatacatcaatctcaactcccatgtacctgttggcatgcaaatgatgcctacatcacaatcaagtagtccttttcctgcagttttcaaggcaaagcaggagaaatataattcaaaacttgctgagatgttccagaaagtggaagatcacgattcaggtgaccgaagatcatgcaacatgtccaattcaagtgtatgtgatggcagtcaaatgtctcccacatctgtaacttctgtaaccacagatcttgggttaggaatatgctcttctcctacctgcaataaattgaagaaacctgctgttcaatatacaatggagcctccaaaggaaatcccaagtcgattttctccaaacaataatgtggctgatgggaatatgttgaagcatccatcacagtcttcatcctgcttaagttttgactattgtggacaagttgatgcaaaaaatcccaaaattctttttgaagctctttccaaggaggtatgctggcaagatgaagctttacgggctatcgtcaaaacaattgtttgcagccctacaaagagggttaaacaccgtggaccaaatcagcctggggacatctggatgaattttgttggacatgatagacttggtaaaaagaaaattgctgtttctctagctgagctattatacggtagccgggagagctttatttttgtggatctaagttctgaagaaatgaaaggatgcaatgtgaaattcagagggaagactacccttgattttattgtaggggagtgttgcaagaaacccttgtccgtggttttccttgaaaatgtagacaaggcagatattctagctcaaaatagtttgtgtcaagccatcaagacaggaaaaattacagactcgcatggacgagaagttagtgtaaacaatacaatgtttgttttttctttctcagattaccaaaacagttcgatgccaagaggggaaccttctaactattctgaggagagaatactgagggcaaaagggggaggtatcaagataaaagttgaacatgtgattggagacatcagaagccaaagcatcagtctaacaaacaattcaatagatgccattcctaatctaaatttcctaagcaaacgaaagttgattggtgacaatgaatttcatgatccgcatttactctctgatacagctaaaagggcacatacaacatcaaattggctgttagatttgaatctcccagcagaagagaatgaacagaaacaaacaaatgatggaaactctgatcatgttgtcttgactgagaatcaaaagctttggttgcaagatttgtgtgatctggttgatgaaacagttgtttttaaaccttatgattttgatgctcttgcagatagagtgttgaaagtgatcagaagtaacttcaacaaaattctcggatccaagtgtgcattgcagatccagacagaagtcatggaccaatttcttgcagctcaatatgtctcagaccgggatacggaggtggagaactgggtggaggaagttctatgtgaaggatttacagaaatacagagaaggtacaacctcactgctagttctattgtaaaacttgctacgtgtcctgagcaagctgctggtgtacaccttccctcaaggataattttagattga

SEQ ID NO: 704 - DNA, 3402 bp, Glycine Max
atgccgccttccccggcattgagatactctcctggtagagagccaagagctgatggtcacaagcgggggcgcagtcttgaaagtggattgcttttccgggagaaggacgatgatcttgctttgttcaatgaaatgcaaatcagagagaaagatagctttttgcttcagtcgtcggatgacttggaagactcattcactacaaagttgagacatatttctgatgtcaaccttggaatctccattcctggtcgaggggaatccagtgagttgcttaatgatggtgacaagaatgattacgactggttattaacacccccagacacaccactatttccttcgttagatgatgagccaccgctgagcagttttggaagcagaggaaggcctcagagtaaacccatttccatatcgagatcttctacgatggataaaagttaccaaagccgtaggggcagtgcaagtccaaatcgtttaagtccatcccctcgatcaggaactaacacattgcaatcaaggggaaggccttcgtcattgccaaattccagcccaaccccaagtgtgaggtatgccactccatccagaagaccatctccacctccaagtaagtccatggcacctgcttctaagtcaacctatactccccggaggatgagcactggctccagtggttctgtagtctcatctggagttaggggaagttccccagtcaagacaaatcgtggaaactctgcgtcaccgaagataagggcatggcaaactaatattcccggcttctcttctgaagctcctcccaatctccgtacttcattggctgatcgaccagcatcctatgtgaggggttcatctccggcatccagaaatagtagggagtctacctccaaattcagtaggcaatcaatgtctccaactgcttctaggagtagtagtcatgatcgagaccaatttagctcacgcagcaaaggttccattgcatcctctggtgatgatgatctagagtctctgcaatcaatcacagtgggtagcttggacagattgagttcaagaaggggtgggtcattttcaaccaacagaactcctgccatttccaagaaaccagccaggattgcgtccccaagttctgctcctaaaaggtcattcgattcggctatccggcaaatggatagaaaaattcctcagaacatgttcagaccacttttatctagtgttccaagtacaaccttttatgctggaaaagcaaattctgcacatcgttcccttgtatctaggaattcatctgttacaacaagcagcaatgcgagctctgatcaaggtacaacttttgcactggatactgaagggagtgaccataatcaagatgatatggcaaacgaagttgataagatattatatcctgatatacatgaagaaatgtttgcctttgataagattgatgcattaaatgcaaacattaagcaagagatgaatagggaatcagtagatatcttgcaaagtgaaaccagaaatcccaagactgtttttggtccgattgaatctgaggattctatttcccacattcgtattgacactagagttaatgaaagttcagaaatttcacatgccaaaggtgacatttctgaaactggtagttttgaaaatacagcactctgttctcattgtggttgttgttatgaggtcactaatcaacctgagaagaatattgggctttgtccagaatgtaagatcacattgttgagagtcatcatccctgagacaactttggcagtatctgaaaactcttcattgattacaacaaacatgccaaaagaagaaaaatcattacctgaaacaaatcaactaatggttgcatctgaattgcctcaagagactaatatgggtaacttgaggtttccccatggtgaacaaaatgctgaggaaaatcaaacttcttgccgtaggcagacatctggcaaccagcttgagatgaaccaatcaggagttgattacaagaagcctgatattgaatttggggatcagcatcaccgcagtgatcgccctaatttgaacatggaccccatggaaggcactggcatttctgtattgctgaaaaggtctagcagcaataaaggacctgtagttcagggcaggacttttactgccacgaccatatcttacgatgatctgtctcttgcaagagacagtgtaagcagttttagaagctcaactagacctggtagttattctgcctcatcatcaattgatctcagctcaagtaggcaaacagagtttcgtgtgcaaaggcagttgagtggaaggaaattggatgtggactgtggatatgactcaaggatcaagcctccaagcactgcttcatctttctctggagcttcaatccattctcgccaagagttaggtcttgcaactcgagagacttctggcagtacagaatgtggctctgtagaggaggttccccgagttttgcaagaaatgcaagcttcggaaaatacagtggcggacgtaattgatgcttcttcaactgatttagttgtggaggaagataaatttgaacatgatgatagtagtagagtaaataatgcttgcaactcagaacttttgagtcaggctgatgacaatttagtcacttcatttcaaaatcatgaggattgtatttcacctgaaaatgttgatgataatccaaataatgccagggatgtctcagacacagaaacttcagctaaggctccggaattatccagtcatgacaaacaagatgtgcagaattccaatgttaatgaactggatgctttggttacaactaactgctccacaattactgaatcagaaatagaaggggaaaacaattgtgagaataatattggcatggcgaatgatgatctgtcaaagagcatccttgatgactttcgggaaccttccaatgattgtcatgctgtttctgtttcagaggtcaatgtctccgagtcccatcgcattgagggatcaacagttacagttgagtgtcaaggtgcaggcaacactagaagcctgacacttgaagaggcaaccgatacaatccttttttgcagctccattgtccatgatcttgcatataaggctgcaacaatagcaacggaaaaggaatgctccaacccatttgaaggttctgaaccaactgtgaccttgttgggcaaagccaattctgatagaaaggatagtcgcaaccgacctaccagcaagcgcacgttgaaatcccagaagaccaagaccaagcagaggagggtggaaactgatgtcaaaatcccttctggcaagactgagaatgatgaaaatattgatgagtctttcacgcacaatgttgggcttcctaacaaggtagatagtatgaagccccctaagcttgaatcaaagtgcaattgcatcatcatgtga

SEQ ID NO: 705 - DNA, 1959 bp, Glycine Max
atgcctccttatttgcctcttcggtgggagagtacgggagaacaatggtggtatgcatctcccattgattgcgccgccgcgaatggccactatgatctggtggtggagcttctccatctggacgctaacctcctcatcaagctcacttccctacgcagaatccgccgcctggaaaccgtgtgggacgacgagaaacacttcgaggacgtcgcgaaatgccgctcacaggttgccaggaatctgatgctggaatgcgaggcaggaagagcacacaattctctcattcgcgccggctacggcgggtggctactctacactgctgcctcggccggtgacgtggatttcgttaaggagctgttggggaagtaccctgctctcgtgtttggtgaaggagagtatggagtcactgatatactgtatgctgctgcgaggagcaattcttgcgaggtgtttgagcttctgcttcgttctgctctctcgccgccgcaaatggaggatgtttatgagagggacatgatgaatagagcggttcatgctgctgccagaggagggaactgggagatgctgaaacggcttgtgaggaacggttctggcgttttggggtttagagatactcaaggatgcactgttcttcatactgcagctgctagaggacaggttgaggtggtgagaaatctacttgcatcatttgatgttgtaaacttaacagatgatcaagggaacacagcattacatatagcttcttacgggggtcacttaccagtggttgagattctgattcttgcgtctccctcgctagcattgtttaccaatcactacggagatacttttcttcatatggcggtggctggtttcagaagtcccggtttccgtagactggacaagcacactgagctcatgaagcgattggtaagtggaaagattgtgaacttacgggacattatcaatgttaagaacaacgatggaagaacggctcttcatgtatccgtgattgataatattcaatgtgaacaagtggaattgttgatgtctgtgtcatcaattgatttgaacatttgtgatgctgatgggatgacccctttggatcttttaaagcaaagggcgcgatcagcatcatctgatattctaatcaagcaaatgatttcctctggaggggtctctaaatgtctggatgttgtggcaggaaatgccctttgcactcatcaaaaagctcatgtcattggaggcagtcctggaacttcatttagaataccagatgcagagatattcttgtacactggcattgagaattcatcagacgccaccaattatgatcaagcaagtgtggaatcatattcctgctcaaacgaactaaacaattctgactcagccaattccccacataacaagaagtctaattctgtcaatgcaaggcgctcaaagtttcgtctccactggcctaggagaagagagacaaaagcagctgcctcagaattggaagatgatgatgattctcatgatcctttcagttcaagtagaaacctggaagagtttccaatcccgttgcggcaaagatactcacaaccatgctcccttccaaacaacaaaagaacacaacctatgaggacttctcttcctagcccatcctccaatgtgaaattcagtgcaggcttaatgcaaggtgtaattcagctaaagccacattctgctcattcaactcctagtcctttccaggaattatcagtgtcttctctttcatacatcaagaaacaaaagggtgttgaaataatgggaccctcttgctctaatcgatcaatagatgacggcacacttctattgaactacaaacagtgttccttcaataagaaattgatgaatgggtatttttcttttggagcacagggccttgctgttgaagattccaatagctgcgcaaagtcaaacagcagctacaaacgtttaagttccatagttgcctaa

SEQ ID NO: 706 - DNA, 1938 bp, Glycine Max
atgcctgcatgctacgccaccccatattgtttcagatgggttatggggaagtgccctagagactccctatatttatttcacattctacaagcttgttttatgttggaaccattggccacatacacgaggctcttgttcccgcacggtactcacgacaccattacaacaatatcatcaattggttttgtcctcttcatttttataaacgatgatgggaaagagggcatggaccattgccatatcgggattgctattacccatattttgtgccttttcaatgatttggttgttgcattggtctcccacaccgtaatttcatttgcggtcatttcttccctccttagtgaacttcaaatccaaaactccgaacttgggaaattggcattatcttcagcattgatcagtgacatattgtgcacaatcgctaccgccatcggcactgcagttatgattactgagaattctaatgtcaaagatgttataagaaacgtcttggctttgatatgtttggctatctttaatccattagtgtgtcgcccaacaatgttatggatcatcaaacataccccagaagggagagctgtgaaggatggttatgtttaccttatcatcgttatgctctttattttaggttggctttccctttcatttttgggattttctgttccagaaggacctccactgggatctgcattggttaagaagcttaatttccttggtaccaccttccttttgccaatcttcgtcactatcaatgtcttgaaagcagattttttcacttcctattcatccacatcggttatgactatcacttccgtccatgcctgccttgtaccttccctctactgcaacatgcaaccgcgtgatgctgtctctcttgccctcattttgaactgcaaaggcgttgtggaagttggcctctactgcttcttatacgacaccaacgtaatcgatgggctagctagcatttggagtaatgattttgagcataatggtggtagcatgcattgtgcaatggtctgtcaagttcttaggaacataatgaatttaaaaccgtggtctgagctgaggatattgatgtgcattcataaaccaagtcacatatcgtcaatgtatgtgcttgacctgtgttgtccaacaacagaaagtccaatcattgtggatgtattgcatctaatagagctagttgaacgcgccctacccattttcattcctcatcgcattcaaaggcaagcatcaggattgcagcacaagtcatactctgatgagcatgacaacccagatgctgtatctgcatacccttgcacagcaatagctccacccaacctcatgtatgaagatgtatgcaaccatgcctttgacaaagttgcatccatcataattcttccatttcaccaaagatggtccagtgacggggaagttcaggtcctaggattatctccatgctcggttggaatacttgtgactcgtgcctcccaccaaactagatattcaagcactcgattagcactaatttatttgagcgaacatgatgatgaagaggcattgtgtatagctaggagagcaattaggaacccggggatgaacattgttatttacaaccttgtttttaaagcagaagatgatgagtgggggcaagaggtggatgatgatgagctagaagatgtgaagcatgcacgtgaacataatataaggtatcaacaaatcatagaaacagaaggatcccagacagctgcttttcttagtgacatagtgaaagagcatgacttctttatagttgggaggcgccatgggaatgggattgagtctcctcaaactgatggacttacagactggagtgaattcccagaattaggtgccatcggtgattttcttgcttcaccagatttggagagtcgtgcttcaattttggtcgtgcaacaacaactctcaccatag

SEQ ID NO: 707 - DNA, 1158 bp, Glycine Max
atgcctggttttactgttggaaagaagagatttatccagccaaatatgtgtttcaccaatttgatcaatcaagataaatcaactctttcacaaaacaatcattgtttattccctgaggcactgaataaagattatagccccattctacctgggctgcctgatgatgtggctgagtattgtcttgcactcgtgcctcgttccaacttccctgctatgggtggtgtttgtaagatatggaggtcgtttattcaaagcaaagaatttgctactgtgcgaaaattggctgggatgcttgaggaatggctgtatttcttaacaacggactgtgaaggaaaggaaagttattgggaggttatggattgtcttggtcataaatgccgatcgcttccaccaatgcctggtccaggaaaggctgggttccaagtggtggttcttaatggaaagcttcttgtcatggctggttattcagttattgaaggaactgcctttgcctcagcagaggtttaccaatatgattcttgcctcaacagctggagcagattgtcagacatgaatgtgtctcgttatgacttcgcttgtgctgaagtcaatggtttggtttatgctgtgggaggctatggggtgaatggtgacagtctctccagtgctgaggtgtatgatccagataccgacaagtgggcactgatagagagccttcgccgcccaagatggggttgttttgcttgtggatttgagggtaagctctatgtgatgggtggaaggtcaagctttactattggaaactccaagtttgttgatatatataaccccgagagacatagctggtgtgagattaagaatggttgtgttatggtcactgctcatgcagtattaggaaagaagttgttctgcatagagtggaagaaccaacggaagctagctatattcagtccagaggacaattcatggaaaatggtaccagttccattgacaggaagctcaagtattggttttcgatttgggatactagatggtaagttgttgctattccctctggaagctgaaactgcttttcagacattgttgtatgatccaaatgcatctctggggtcagagtggcagacttgtgacataaggccatctggtttgtgcttatgttgtgtaacaatcaaggcatga

SEQ ID NO: 708 - DNA, 690 bp, Glycine Max
atgccttcttctcttcactttgataggttcaatcctatcacccacgccgccaccactgtcgccatcgccaacggcgtaaactgtccgaagcagcctcaagcgccgccctcttccacggcggcgcgtcgcctcgtggttccctctctctcttccggcagaggaatcgcggcccccgacacggtggcgctccaccacgcgcacgtggtggaccccaaccagtgctgctccatcgtgacgcagcacatcaacgcccccgtctccgccgtttgggcggtggtgcggcgcttcgacaacccgcagggatacaagaacttcgtgaggagctgccacgtcatcaccggcgacggcattcgcgtcggcgccgtccgcgaggtgcgggtggtgtcggggctccccgccgagacgagcacggagcggctggagatcctcgacgatgagcgccacgtcatcagtttcagcatggtcggcggcgaccaccgcctcaggaactaccagtcggtgacgacgctccacgccaacgggaacgggacacttgtcatcgaatcatacgtcgttgacgtaccgcagggtaacactaaggaggaaacatgcgtgttcgtcgacacaatcgtacgttgtaacttgcagtcgctggctcagatcgctgagaacagaaccaataactgtgaacacactgcacaacactgttaa

SEQ ID NO: 709 - DNA, 1089 bp, Glycine Max
atgcgaacgaggagacgcctctcttatcttccaaccatgtcttgccggaaaagacaaaagacttcgccggacaaaacctccgattgcttcgactctctccctgacgacctcgtcctctctatcctctgcaagctcagctccaccgccacctccccctccgatttcatcagtgtcttaataacgtgcaagagactaaactccttaggccttcactctcttgtcttatcaaaagcttcccacaaaacattctcagtcaaggccaaaaactggtgcgactctcttcaccgtttcctcaaacattgtgccgacgccggaaacattgaagcctgttacactctcggcctgattcggttttattgtttgcaaaacagagggagcggcgcggcgctgatggcgaaggcagcgatgaactctcacgcgccggcgctgtactcgctcgcggtgatacagttcaacggaagcggcggcacgaaaaacgacaaggaccttcgagcgggtgtggcgctttgcgcacgcgcggctttcctcggtcacatcgacgcgcttcgggagcttggtcattgccttcaagacggttacggcgttaaacaaaacgtaacggagggtcgacggtttttggtgcaagccaacgtgcgtgaactcgccgccgtgctctccgccgggaataacaagcgtccctggctgacgtggagccaccaacctgtcccccacccgaggctccggtcggaaaccgggtcgggttgtccgctgttaagtgattacggctgcaacgttccggcgccggaggttcacccggcgagtcagttcatgtcggagtggtttgatattcggggcgggtttccgagtgcgggtatgagactctgttctcaatcgggttgcgggcgacccgagacaaggaggcacgagtttcgaaggtgttcggtttgtggtgtggtgaactattgctcacgcgcgtgtcaggcgcttgattggaagtttcggcacaaggcggaatgtgctcccgttgagaggtggctcgatgacgacgacgaagatgtcgccggcgagaatgacggcggagatgacggagtaatgatggttgatagttag

SEQ ID NO: 710 - DNA, 1815 bp, Glycine Max
atgcgaacttcatgggctgatttggctgccaattcggcgcctgaaaatgcgggaacctctaactccacagctccttcgcggccggtttatgtgcctccgcatctgagaaaccgtggaccatcggaatcccctgctccaccacctacatcaaataataataataataataataataataataataataataataataataataataataatgcgggatcacggtggggtgctctgccagccagaaacggatggggtaacagaagttgtggtagttgggatcggcgcgaagtgaatcccttcggggatcaggaggaggcagcagcagcgtttggcggcgaggagcagcaggaaaacacgggaattaacttcgatgcgtatgaggacattccggtggagacgagcggtgaaaacgtgcccccggctgtgaatacttttgcggagattgacttgggcgacgcgcttagtcagaacattagacgctgcaaatatgtgaagccaacgccggttcagcggcatgccataccgatatcccttgcgggacgggatttgatggcttgtgcgcagactggttccggaaagactgcagcattctgtttcccaatcatcaatgggattatgagaggccaagcccaacccctccagaggccccctcgcggcgtccgcatagtctacccacttgcccttgttctctcaccaactagggagctatccatgcagatacatgaagaggctagaaagttttcataccagacaggggttagggtcgttgttgcttatggtggagctccaattaatcagcagctccgggaacttgagagaggggtggatatccttgttgcaactccaggaagattggtagatttactggagagagctagagtttcattgcagatgatcagatatttggccttagatgaggcagatagaatgctggatatgggttttgagccacaaataaggaagattgtagaacaaatggacatgcccccagcaggtgccagacagactatgctgttcagtgctacatttccaaaagagatacagagacttgcctctgatttcctttcaaattatatttttctggctgttggaagagtgggctcaagtactgatttaattgtccaaagagttgagtatgttcaagagtctgacaagagaagtcacctcatggatcttcttcatgcacagaaggcaaacggtgtacaaggaaagcaagctttgactttagtttttgtggagacaaagaagggagctgattctctagagcactggttgtgccgtaatagttttccagcaactactattcatggtgacaggacacaacaggaaagagaattggcattaaggtcatttaaaagtggcaacacccccatattggttgcaactgatgtggctgcacgtggtcttgatattcctcatgttgcccatgtggttaactttgaccttcctaatgatattgatgattatgtacaccgaattggaaggacagggcgagcaggaaagaaaggcctggcaactgcattctttaatgacaacaatgcatccctagcaagggctttagcagatctgatgcaagaagcaaatcaagaagtgcctgattggctctcacggtatgctgctcgctcttcctttggtggtggaaggaaccgtcgatcaggaggaagccgttttggtggccgtgactttcgaagagagggttcttttagtaggggtggttctgattactacagtgcaggaaacaacagtagtggatatggcaattctggtgtgtatggtgcaggatacggtcctggggtaaccagtgcttgggactga

SEQ ID NO: 711 - DNA, 1389 bp, Glycine Max
atgcgaacttcatgggctgatttggctgccaattcggcgcctgaaaatgcgggaacctctaactccacagctccttcgcggccggtttatgtgcctccgcatctgagaaaccgtggaccatcggaatcccctgctccaccacctacatcaaataataataataataataataataataataataataataataataataataataataatgcgggatcacggtggggtgctctgccagccagaaacggatggggtaacagaagttgtggtagttgggatcggcgcgaagtgaatcccttcggggatcaggaggaggcagcagcagcgtttggcggcgaggagcagcaggaaaacacgggaattaacttcgatgcgtatgaggacattccggtggagacgagcggtgaaaacgtgcccccggctgtgaatacttttgcggagattgacttgggcgacgcgcttagtcagaacattagacgctgcaaatatgtgaagccaacgccggttcagcggcatgccataccgatatcccttgcgggacgggatttgatggcttgtgcgcagactggttccggaaagactgcagcattctgtttcccaatcatcaatgggattatgagaggccaagcccaacccctccagaggccccctcgcggcgtccgcatagtctacccacttgcccttgttctctcaccaactagggagctatccatgcagatacatgaagaggctagaaagttttcataccagacaggggttagggtcgttgttgcttatggtggagctccaattaatcagcagctccgggaacttgagagaggggtggatatccttgttgcaactccaggaagattggtagatttactggagagagctagagtttcattgcagatgatcagatatttggccttagatgaggcagatagaatgctggatatgggttttgagccacaaataaggaagattgtagaacaaatggacatgcccccagcaggtgccagacagactatgctgttcagtgctacatttccaaaagagatacagagacttgcctctgatttcctttcaaattatatttttctggctgttggaagagtgggctcaagtactgatttaattgtccaaagagttgagtatgttcaagagtctgacaagagaagtcacctcatggatcttcttcatgcacagaaggcaaacggtgtacaaggaaagcaagctttgactttagtttttgtggagacaaagaagggagctgattctctagagcactggttgtgccgtaatagttttccagcaactactattcatggtgacaggacacaacagtgtgcgatgctttgggaaagcagtgttgaatgcttaggtattaggaaagagaattggcattaa

SEQ ID NO: 712 - DNA, 324 bp, Glycine Max
atgcgcatgctcaccggcgactccgctgccgacaactccttccgcttccttccgcagtccatcgccgccttcggctccaccgtcatcgtcgagggctgcgacaccgcccgcaacattgcctgggtccacgcctgcaccgtcacggatgggataattactcagatcagagagtacttcaacaccgccctcaccgtcacccgcatccacgattccggcgagattgttccggctagctccggcgccggccgtttgccctgtgtctgggaaagcagcgtctccggtcgggtcgggaaatccgtacccggtttggttcttgcaatataa

SEQ ID NO: 713 - DNA, 408 bp, Glycine Max
atgcgcccaagagtaaattactcgttccctgaggaggtgttggagcacgttacaagattaagcactagtgccgtcgaagaatcttcgtccaaaaactgctacaccgtctctccggccaccgtcgtcaaccgcttccccaaggttagatccatcgccatcaaggggaagtcgcacttcgccaacttcaatttggtccccgagggttggggcgcttatgtgggccattggatcacgaccatggtcgctgcctacccctggcttcaagagatcaggctcaagaggatggttatctccaacgaatgcttggaactcattgtcaaattgtttaagaacatccaggtcttggttttcacctcttgcgagggtttcaccactaatggacttgctgtcattgccgccaattgcaag

SEQ ID NO: 714 - DNA, 579 bp, Glycine Max
atgcgcgccctagcagctaagttctctaattatttatgcagaagaaaagttggggtcaatccgcgatctcgtaatttttcatcatataatagcaaagatgagctaaccattgaggaagaagctgagaggaaagtcggatggctattgaagacgatattttttgtgactgcaggggtagcaggataccatttctttccttatatgggagataatttgatgcaacagtctgtttcacttttgcgtgtcaaggatcccttgttcaaaaggatgggagcttctagattggctcgttttgcggtagatgatgaaagaaggaagaagatagttgagatgggcggagctaaggaactcttaaatatgttaagcactgctaaagatgaccgtacacggaaagaagcattgcacgctcttgatgcattgtcacaatcagatgaagctcttgcatccttgcatcatgccggggccatttcagtaattaggtctgcaccaaattcacttgaggatgcagaagttgagagattcaagttgagcttgatgaaaaggtttcaagatctcagatacgatgatgtgtcatcatga

SEQ ID NO: 715 - DNA, 1077 bp, Glycine Max
atgcgcggaagaatgaggattgaagaacaaagagacagagacagggacaaagaaagaggcattgttgttcttcaatccaaaaaacatagcggcatggttgcattctcctttttcatcctctgttccttaatcctcctcgtacaaccttcttcttcttcgacccaacaaccccccaatttagaccccgataacatctacctcctcggcgacgcccacgttgtctccgccgccgccgacaacggcgactcccacgtgcgcctcacgcgccccaccccttcctcctccggcatcctccgccgccgcgagcccctcgctttctccgaccccacatccctctccacggagttctccttctccgtctccggccacggccacggcctcctcctcgtcctcgccgccgccggcaacgtctcgaactacgtcggcgtggagttcgacacgtccaaggacgacaacgccggagacccgaatgcgaaccacgtcagcatcgatgtcggaagccacgtgtcggtggccatcgcaaatgtttcagatttgaatttggttctcaacaacggtgaaaagttgcaagcttgggttgattacgaagccagttctaaggttttggaagttaggttaagcaaatggggtgaacaaaagccttctgatcccattgtttctcatgacatcgatttttccaagatttggggtaagaatcctgtgattgcggctttaagttcttccaatggggcccactcggttcaggttgttagtgtctattcatggagggttagtttgaagaaggtttcaaatgggttgcattctctacctgcggatcctcatagtaataataataataataagtttgaggatgagcataagaagtcggtgtgtcccttgacggttctagcttgggttatttttggaactgggtgtgttgcattggtgacatttgtggtgctttttatgtgggtgattttcttccaaaagggtgaagaggagtctcttgtgaaaatacctgatcacccttcttcggatgtcaggtatgagagaattgatgtggctgttgacaaaaatgcgcatgatgatcagagttag

SEQ ID NO: 716 - DNA, 753 bp, Glycine Max
atgctaaatttcaaaaatgtttctgaggctgagttaggcctcaaaattacactttctgaagaagctgagccactcgacactacaggccccttggctcttgccaaggatctgctgttagatgcttctcgggaaccttttttggttctaaatgcatatattaccaacgactatccactgaaacaaatcattgactttcacatagaacatgatggagaggctactgagttggtgagtcaggctactgaaccatcaaaatattgtgtggctattatggatcatatcactggattggttcagagttttcaagagataccacaaaaatttgttggtaacagagttaatgctggagtgtacttgatgaacccctcagtattgaatagaattgagttgacacctacttctatggagacaaaggtgtttctaaatactgttgctgatagaaagttatatgcaatgaataaatctcttggtgaactggccaatgaccctcttattgtagggaatgtggttgtacatgcgactgcccaaattcgtgaaagattgaggctcaaatcatgcacaactatgcaaagtactcgtgttaaaaagcattctgtcatatccgagaatatcactgggtggcattccactgttggggaatgggctagtgtatatcagtgtatcattcaagaaggagcgcttgttggtgatgatattttagtccatggtgcttccatttcaaggttgcatccccagctcgtaaataactattga

SEQ ID NO: 717 - DNA, 540 bp, Glycine Max
atgctcaaaacgttggagaggtaccagaaatgcaactatggagcgcctgaggacaatgtggcaacaaatgaagccttggagttaagcagtcaacaagaatacttgaggctgaaagcgcgttatgaagctcttcagcgttctcaaaggaaccttatgggagaagatcttggtcctctaagcagcaaagagcttgagtcacttgaaaggcagctagattcgtctttgaaacaaatcagatcaataaggacccaattcatgctggatcagctttctgatctacaacgtaaggaacactttctaggtgaatcaaacagagatctcatacaaaggttggaagagtttcaaataaatccacttcaactgaatcctagtgctgaagaaatggggcatggacgctatccaggtcaaccccaaggccatgctctctttcaaccattggactgtgagccaaccttacaaattggatatcatcctgatccagtatcagtggtgtcagaaggcccaagcatgaataattacatggcaggatggttaccatga

SEQ ID NO: 718 - DNA, 93 bp, Glycine Max
atgctcaacgacaggctggcgctgtacaatttcaattgtcacattgaacacgactcctcttcctctacatctagaagtgagcctataacttaa

SEQ ID NO: 719 - DNA, 735 bp, Glycine Max
atgctccctggaaaaactgtctatgatgtgatcaaacaatacagagaattggaagaagatgtttgtgaaatagaagcagggaggattccagttcctggatatcctacctcttctttaacattggagatggttgacaaccaatgttatgatgcatgcagaaagaagcctgcaactctcaggagttctgatcaggagaggaagaaaggggttccttggacagaagaggaacatagacgttttcttatgggacttttaaagtatggtaagggggattggagaaatatctctcgcaattttgttgtgacaaaaactcccacccaagtggcaagtcatgctcaaaagtattatataaggcaaaagctttctggagggaaagacaataaaaggaggcctagtatccatgatatcaccattgttaatcttacatcagatcaagagaagcctcttttattcaatgatgagtctcacatgacttctgagcaacagaagctaactagcatgccaaaagtacaacttgaatggcggattaatcaccacaacaatggcgggtcaaattatgatatgttcgtgtcacctaattcatctggcatctcttccaagaccctcaagttgcaagggcaggatttctatgaatgtgcttttcatgagacttatgccaagcttaaaaatacgggtttcaggacagcttctagagacttcaacaaggaagctatttttggtattcatgcactgtaa

SEQ ID NO: 720 - DNA, 186 bp, Glycine Max
atgctcgtctccgtcgccggttgtggcttcctcatgctcgccctcgtcaacgtcgcgcagatcaagctcgaaaccctcgtctgcggaagctcacacacttacgccgccgtcatcccgcttctcatcttcgtcccccttgcactcctcatctacttctcgttcgttctctacgctttcactcgctag

SEQ ID NO: 721 - DNA, 519 bp, Glycine Max
atgctgctaacagaagaaagctttgtgaaggttaagaaatatggcctccccatgttgcttactgaagatgagggtgtcaaaacttttttagccaatctaactgctcagctctctgaatggcttgaagctggcaagttgcagagggttgtccttgttataatgagcaaggccaccagtgaagtgcttgaaaggtggaacttcagcattgagactgactgcgaggttgttgagaagggtgtctcgagggaaaagagtgacaaggagatcatgagagagatacaagccattatgaggcagattgcttcaagtatcacttatttgccatgcctggatgaaccttgcatttttgatgtgttagcgtatactgacaaggatgtggcagttccattcacatgggttgagagtgatccaaaactcattgcaaatccgcaaatggtgaaattgcattcctttgatactaagattcacaaggttgacacacttgtatcatacaagaatgacgaatgggatgagcagtaa

SEQ ID NO: 722 - DNA, 771 bp, Glycine Max
atgcttctcagaacagcttcatctttctctctcctcaaagccaacgccgaccatatactccctctccccaactcttcttcttctggtattattcgctactctcagtctctggggaaaaacttggttccatgcgctaccaaggacaccaacaaccgccccttaaccggcgtcgtttttgaaccctttgaagaggtcaagaaggagctcgaccttgttcccaccgtcccacaagcttccctcgctcgccagaaatacaccgatgactgcgaggctaccataaacgaacagatcaatgtggagtacaatgtttcgtatgtttatcatgcgatgtttgcctacttcgatagggacaatgtcgcgctcaagggtcttgccaagtttttcaaggagtcaagcgaggaggaaagggagcatgctgagaaattaatggaatatcaaaacaaacgaggtggaaaagtgaagttgcaatccatagtgatgcctctttctgagtttgaccatgaggaaaagggagatgccctgtatgcaatggaacttgctctgtcgttggagaagctaaccaatgaaaaattacttaacttgcacagtgttgcctcaaagaacaatgatgtgcaattggcagattttattgaaagcgagtttttgggtgaacaggtggaagccataaaaaaaatctctgagtacgttgctcagctcagaagagttggtaaaggacatggtgtgtggcactttgatcagatgctgctgcatgaggagggcgttgctgcttga

SEQ ID NO: 723 - DNA, 417 bp, Glycine Max
atgcttgtgttcattgccaccatcttccttccatccattgctatggccaagaaatttgtagtcggctttgattacgcagcttgggctgccgataaaaccttccaagttggggatgtacttgtatcaagtatgatgttggagaacactgtgttcaaagtgaatggaacagcattccagagctgcacgactcctccagcaagtgaagcattgtctaatggaaatgaccgtattgtattggcaattcctagcagaaaagtgttgttggtcactgcaatgctggccaaaagcttgttattacagttcaaccccaaacactgcctccaactctaccaccatcaccttcacctcgtcagcatcgccctcattttagtcgatgggtgcctattatttttcatcaaacttcatttgttggtttaa

SEQ ID NO: 724 - DNA, 1164 bp, Glycine Max
atgctttgcgtcaacactgccttcacctctttcttacccagaaaatcaacttgcgtcttttcctccaaatcaaccaccccaatttcctgcaccctccaaggaacagttgcagagccaaaatctacagctgctgctgaaccgcttttgctaaatgcagttcgcgggatagatgttgaaagacccccggtttggctcatgaggcaagcagggaggtacatgaagagttaccaaaccatctgtgagaaatatccttcattccgtgaaagatctgaaaatgttgatctcgtggtggaaatttctctgcaaccgtggcatgttttcaagcctgatggagtgattttattctcagacattcttaccccactttctggaatgaatataccctttgatattgtgaagggtaagggtcctgttatatttgatcctattcacacatctgcccaggttgatcaagtgaaggagtttattcctgaagaatcagttccatatgttggtgaagcactgacaattttgaggaaagaggtggataataaagctgcagtccttggttttgtcggggcaccgttcactctggcatcatatgtggttgaaggtggttcatcaaaaaacttctcaaaaataaagagattggctttctcagaatccaagatcctgcactcgttactgcagaagtttacaacatcaatggcaagatacattcaataccaagctgacaatggagctcaagctgttcagatctttgattcatgggcaacagaactcagtccagtggattttgaagaattcagtttgccttacttgaagcagatcattgatactgtgaagaaaagtcatccagacctccctttgatcctctatgcaagtgggtctgggggcttgcttgaaagactagctttgacaggtgtggatgtagttagcttggattggacggttgatatggctgacggtaggaggcgactgggaccgaatatagctgtccaggggaacgtcgaccctggtgttctttttggttcaaaagagttcatcactgatcggataactgatactgtgagaaaagcaggtagagggaaacatatcttgaatcttggacatggcattaaagtaggtacgcctgaggagaatgttgcacatttttttgaggttgctaaatcaatcagatactaa

SEQ ID NO: 725 - DNA, 1587 bp, Glycine Max
atggaaaattcagacgaacaacttcccttctctccaccaaaccctaacaatgccgaagaagacgacgaaatcgacgaaccagaagacgaagacgaagaagaggaggaagacgacgacgacgacgatgtcgtgtcgcaggagcaatccccgttgtcgcggctgcgcgagcagcgttcgaagttagaaaccctgtcccggcgattggcgtcggagctggtcccaatccgagtccacgacgtgctgattcgcggcaacacgaagacgaaggcgtggctgatcgaggcggagctcaagctcctcgaggaggccaccaccgtgcaggagctaattcgcgcctccgaaatcgccctcgccaggctccgtggcctcgagattttcgacaccgccgagcttacgctccaggccgggccgccggagcttcctcacaccgccaatgttatcgtcgacgtcgtcgagaccgccaacaaaatctccggcgatttcggcgtttacaccaaacccgcgactagttcttggtctgctgaaggtggtcttaagtacaaaaacttgttaggttatggtgatctatgggatgcctctttggcctatggtgccaaccaaacaacagaggtaagtgtaggagtgtatgcccctcgactgaaaggattgctaacccctcttgtagcacgactatccatgctttcccaagattggcaagagttttcttcatacaaagagcagttgttaggcttgtctcttggcttaatctcagcaaggcatcatgacttagtctacactcttggatggcataccttgactgatccatcacaaatgtcatccaggtctataaggaggcaacttgggcatggtttagtatcatctttgaagtatacatttaaaattgacaggagaaactcaccaattaggcctacaaagggatatgcttttctatctaccactcactttggtggccttacaccagatcctcggagcttgcgatttctgcgccaggaatttgatgttcgctgtgtcatcccctttgggttttataatacagcacttaaccttgggatttctgctggtgctgtttttccatgggggcatggcttcatgaacaagccatctccgcttcctgaaaggttttatttgggtggtgatttctctccagtttgcactctaggagggccaataacattgtggggatttaaaactaggggattaggtcctactgaaccacaaaggcgaagtagagatggaattattgatgacaatgatgattcctctagatgggacttcattggaggagatctagctgttactgcatttgcagacttgtcttttgatcttccagttaggtggttgagagatcatggaattcatggtcatgtttttgctggtgctgggaatactgctaaattaactcagaatgaatataagcacttttcacctcggaagttcttagaatcctttcgaacatcggtgggatgtggatttgttgttcctactagactttttcgcctagagggtaatttctattacatactcaagcagaatgagcatgatcgtgggaaaactggatttaggttcagcttctcagctccttcttag

SEQ ID NO: 726 - DNA, 1164 bp, Glycine Max
atggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggccttaaattactctcatttctgcaagtatgcttgctctgaagaaaatcctgagctcttggacatgggaggtccagttgaaggtggatttagtgttgcatttgatccccttgatggctccagcattgtggacacaaatttcacagtaggcaccatctttggtgtgtggcctggagataagttgaccggcatcaccggaagagatcaagttgctgcagccatgggggttcttggtcctagaacaacatatgtacttgctctaaaagacttccctggcacccatgaatttcttctgcttgatgaaggaaaatggcagcatgtcaaagagaccacagaaattggtgaaggaaaattgttctccccaggaaatttgagagccacatctgacaaccccgattatgctaagttgatcgattactatgtcaatgaaaagtacacattgagatacacgggaggaatggtgccagatgtcaaccagattattgtaaaagaaaaaggcatcttcaccaatgtgacatcaccatcagccaaagccaagctgagactgttgtttgaggtagctccgttggggttcttgattgaaaaagccggaggttacagcagtgatggtcatcagtctgtgctagacaaagtcatcactaacattgatgagagaactcaagttgcttatggatccaagaatgagatcatccggtttgaagaaaccctgtatggtaaatccaggctcaaggatggtgtagctgttggagcagctgcttaa

SEQ ID NO: 727 - DNA, 1791 bp, Glycine Max
atggaaacatacataatcaaggtgttaaatttcttgaccaaaaaaggtgaagtctacaaggcagagccacccttggaccttaaggaagccttttccaagtttgctggaggagagaatcaaatgaagaaggatcagcttcttcggttcatggtggaacaccagggagaaaataatattagcaccatggaggatttggataaaatagttgaaaagtttttgcaactaagaaattcttgttctagcaccaaaactagctccacaagaattgtagatgtttataggaaacaaggattgagtctcaatgacttcatcgattttctgattcttgatgatttcaacggtcccttgaaagacaaggtacatcatgatatgaatgctcccttgtcacattatttcatgtatacgggacacaattcctatctgactgggaatcaacttaccagtgagagcagtgacgagccaatcatagaggctttgaaacaaggcgtacgagtaattgaactagatttatggccatccaagtcttcaaataatgatggaattaaagtggttcatggaaggacttttaccactccagttccggtatccaaatgtctacaatccataaaggattatgcatttcataaatctgattatccagtaattctaactttggaagaccacctaacaccaaaacatcaggataatttgcaaaaccataaaatgctttactgtcctgagacagattatttgacagaattcccctcaccagaatcattgaaaaaacggataattatatcaaccaaacctccaaaggaatatcaacaatctgatagtatcagaaaacctatgccaaatggaagtgaaccatctgaagaagaatcatggggccctgaattgccagattcggtggctaaactgaaaactgaggataggaattcaagtgatgaagatcaggaagatataaatacaagtgataacaaatcaaaccaacaaggcgtgcgtcaatacaaacacttgattgcaatccatggagggaaatcaaaaggttctatgaagaatcggctgaaagatgatgttaaagttagacggctaagtttgagtgagaagaaactcaaaagtgcttccgagtctcatggagccgaccttattaggttcacacagagaaatatcctcagagtttttcctaaaggagaacgtgtcaaatcgacaaatttcaggccgtatatagggtggctgtatggagttcagatggttgcattcaatatgcaggggcatggcaaatcactccggttgatgcagggtatgttcagagcaaatggaggatgtggttatgttaaaaagcctgaatttctgatccgaacacttccacatgaagaggtgtttgatccaaaaaaaccgccatcaaggaagcagatattaaaagtaaaagtatacaaaggagatggctggagattagatttcagcccaacacactttgatcgattctctccacccgacttttacacaaaggtaagtattgttggagtgccagctgattgtgccaagaacaaaacaagagtaaagacggatacatggtatcctgtttgggatgaagaatttgaattcaaattgagggttccagagcttgctttgcttcggatagaagtaaaggacaaagataagggaaaagatgactttgccggacaaacttgtttgccattatcagagctaaggcatggatttcggtcagtccctctctatgacagaaagggaaagaaatataaatctgtgacgcttctaatgcggtttaagcttgaaactttaaattaa

SEQ ID NO: 728 - DNA, 6405 bp, Glycine Max
atggaaagaaatggtgatgggaaggctcaagattcagaggctctacctcctcattctgttctgaagatgggattgagagaacgtagcaacagcagcagcatggaggatccagatgggacattagcaagtgttgcccaatgcattgagcagctgcgtcagagctcatcttctatgcaagagaaagagtattctttgaagcagttattggagcttattgatatgcgagaaaacgctttcagtgctgttggctctcattctcaggcagttccagtacttgtttcccttctccggtcagggtcattgaatgtgaagatacaggcagcaactgtcttgggctcactttgtaaagaaaatgagcttagggtgaaagtcttgcttggaggttgcattcctcctttgcttggtctactcaagtccagttctgctgaaggtcaagtagctgcggcaaagactatttttgctgtctctcaaggtggtgccaaagatcatgttggatcaaaaattttttcaactgaaggagttgttccagtgctatgggagcagctgcaaaagggcctgaagactggaaatgtagttgataatttattgactggggcattgaaaaatctctccagtagcactgagagattctggaatgccacaatacaagctggaggagtggacatattaattaagttactgacaacagggcagtctagcactttagcaaatgtgtgctttttactggcttgtatgatgatggaggatgcatctgtttgttcaaagttgttgacagcagaggcaacaaaacaactcctcaaacttttaggccctggtaatgatgcccctgtcagggctgaggcagccggtgctcttaaagctctatctgcccagtgcaaagatgcaaggaaagagatagccaattccaatggcattcctgctttgattaatgctaccatagctccttccaaagagttcatgcagggtgagtatgctcaagcgttacaggagaatgctatgtgtgctttagcaaacatttctggtggtttgtcatatgtcatctccagtcttggtcaaagccttgaatcatgctcctctcctactcaagctgccgacacattgggggctttagcttcagctcttatgatatatgatgacaaggcagaatctaccagggcatcagatcctttggtagtagagcagacattacttgaacaatttaaacccggcttaccattccttgtgcaggaacggaccattgaagccctagctagtttgtatagcaatcctatactgtcaattaaacttacaaattctgatgcaaagcgtttgcttgttggtttaataacaatggctgctaatgaagtgcaagatgagcttctaaaatctctcttgacattgtgcaatactgaatgcagtctatggcttgcacttcaaggccgtgaaggagttcagctgttgatatctcttctggggctttcatcagaacagcagcaagaatgtgctgtttccctcctttgccttttatctaatgaaaatgatgaaagcaaatgggccattactgctgctggtggtatacctcctcttgttcaaattttggagtcaggatctgcaaaagcaaaggaagactcagcaacaatccttaggaacctatgcgatcacagtgaggatatacgtgcttgtgttgaaagtgctgatgccgttcctgcattgctgtggctgttgaagaatggaagcccaaatgggaaggagattgcagccaagactttgaatcacttaattcataaatctgatacagcaactatcagtcagcttacagcattattgaccagtgatttacctgaatctaaggtttatgttttagatgctttgaggagtatgctttcagttgttgctcttactgatcttctacgtgaaggtagtgctgccagtgatgcaattgttacaatgataaaacttttgagctcaaccaaggaagaaactcaggcaaagtctgcatctgctctggcgggaattttcgaaacgaggaaagatgtgcgtgaaagcagcattgctgttaaaactctttggtcagcaatgaagttgcttaatgttgaatctgaaagtatcttaatggagtcctcgcgctgcttggctgcaatatttctttccatcaaagagaacaaggatgtggctgctattgctagagatgcattactctccctagttgcactagctaactcttcagttttagaagtggcagagctggcaacatgtgctgtggcaaatcttattttggatagtgaaattgctgagaaagctgttgcagaagaggtcatcttggctgctaccagagtattacgtgaaggcacaatttctggaaaaacacatgctgctgcagcaattgctcgcctcttacattgtaagaggcaagttgattatgctgtaactgattgtgtgaatcgagctggcactgttcttgcattagtttctttcttagattttgctattgatggacatagttccacatcagaagctcttgaagcacttgccatgctgtccaggtcagatgtgaccggtgcacacagtaaacctgcttgggcagttttagctgaatttcctaaaagcataagcccgatagttttgtctattgctgattcaacgtcagtgttgcaggataaagctattgaaatattatctcgattatgtaaggatcagccttttgttctgggagacagtgttgttactgcctctggatgtatatcttctatagctaagaggataatcaattccacttctaaaaatgtaaaggtcaaaattggaggggctgctgttcttatttgtgctgctaaactaaatcatcagaggctggtggaggatctcaatagatcaaacttgtgtgctaatcttgttcagtctctggtcgatatgcttatttcttcacaggctactttggataatcagggtgatgacagcagggaagttatcagcatttgcaggcatacaaaagaagccaatgatggtaaatcaaacactggtaccgctattatttctggtgccaacttagctgtatggttactgtctgttcttgcttgccatgatgaaaaaagtaaaattgcaataatggaggcaggagcaattgaggttctcactgacaggattgcagattgtttctcacaatatagtcagattgactataaagaagatagcagcatgtggatttgtgctttgttgttggcaatattatttcaagatagggatatcatacgagcacatgcaaccatgaaatctataccagcccttgccaacttattgaagtcagaggaatcagcgaacagatattttgctgcacaatcaatagctagcctagtctgtaatggtagcaggggaacacttctgtctgtggcaaattctggggcagcaggtggacttatctccttgcttggctgtgctgattctgatatacaggatcttctggaattgtcagatgaattttctttggtgcattatcctgaccaagttgctctcgagaggttgtttagagttgatgacataagaattggtgccacttctcggaaggcaatacctgctttagttgatctgctcaaaccaattccagaacgcccaggagcaccatttttagcacttgggcttttgactcagctttctatagattgtccatcaaataagattgtaatggttgaggcaggggccctagaggctctttctaagtatctttcactaggtccacaagatgcaacggaagaagctgctacagatctgttaggaattctgtttagcagtgcagaaattcgaagacatgagtcagcagttggagctgttactcaacttgtagctgtcctgcgtttaggaggaagagctgcaagatatagggctgcaaaagctttggaaagtttattctctgctgaccatattagaaatgcagagactgctcgacaagctgttcaacccttggtggagattcttaatactggtttagagagagagcagcatgctgcaattgctgcattggttaggttactgagtgaaaacccttcaaaagcacttgctgttgcagatgttgagatgaatgcagtggatgttctttgcaggattctctcatcagattgctcaatggacctcaaaggggatgctgctgaattatgttctgttctttttggaaataccaggattcggtccacaatggctgctgcacgttgtgttgaacctctggtctctctccttgtaagtgagtttagtcctgctcaccattcagttgtccgtgcattggataggcttgttgatgatgagcaactggctgaattagttgctgcacatggtgcagttattcctcttgttggcctactttatggtaggaattatgtacttcacgaggccatttccagagctctggtcaagttaggaaaagacaggccagcttgtaaaatggaaatggtgaaagctggagttattgaaagcatacttgacatccttcatgaagcacctgattatctgtgtgcagcttttgcagaattgttgcgtatattgaccaacaatgctagcatagctaaagggccatcggctgctaaagtagttgaacccctgtttatgttgctgacaagagaagaatttgggccagatggacaacatagtgcattgcaggttttagttaatatcttagaacatccgcagtgtcgtgctgattactcattgacttctcaccaagttattgaacctcttatccctttgcttgattctccaatatcagcagtgcaacagttggctgctgagcttctctcgcatctacttttagaagaacaccttcagaaagatccggtgacgcaacaggtaattggccctcttatacgagttcttggttctggtatacatatattgcagcaaagagctataaaggccctggttagtattgcactgatatggccaaatgaaattgcaaaagaaggtggtgttattgaaatttcaaaagttatattgcaatctgatccttccattcctcatgctttatgggagtctgctgcctctgttttggctagtattctacaatttagttctgaatactacttggaagttcctgttgctgttttggttaggctgcttcgatctggcttagaaagcactgttgttggtgcattaaatgctcttcttgtgttggaaagtgatgatggaactagtgctgaagcaatggctgaaagtggtgctatagaggctctcttggagctcctgggatctcatcagtgcgaggaaactgctgcaagactgttggaagttttgctccacaatgtaaagatcagagaaacaaaagttactaagtcagccatcttaccattatcccattatctcttggacccacaaacccaagcacaacaagcaaggttgttagcaactttggctcttggtgatctatttcagaatgagggtcttgctcggacaagtgatgcagtttcagcttgtcgcgctttagtgaatgtgcttgaagaccaaccaactgaagaaatgaaagttgtagccatatgtgctctgcaaaaccttgtgatgtacagtcgatcaaataaaagagcagttgcagaggcgggtggggttcaggttatactggatctgataggttcaagtgatcctgaaacatctgttcaggctgcaatgtttattaaacttctattttcaaatcataccattcaagagtatgcttctagtgaaacagtcagagcaataactgctgctattgaaaaggacttatgggctactggatctgtgaacgatgagtatcttaaagccttaaattctctatttagcaacttcccaagactgagagcaactgaaccagcaacacttagcattccccatttggttacgtccttaaagacaggctctgaggctactcaggaagctgccttggatgcacttttcctgcttaggcaagcttggtcagcatgtccagcagaagtttcaagagctcagtcaatagcagctgcagatgctattcctttgctgcagtacttaatccagtctggcccacctcgctttcaggagaaggcagaatttttattgcagtgtttgccaggaacgttggtggtgatcatcaagtgtggtaacaatatgaagcaatctgttggaaacccaagtgttttttgcaagcttacactaggaaacactcctccaaggcaaaccaaggtggtctcaactggccctaatccggagtgggatgagagctttacatggtcgtttgagagtcctccaaaaggtcagaagcttcacatttcttgcaaaaacaagagcaaaatgggaaagagttcatttgggaaagtgacgatccagattgatcgggtagtaatgcttggagcagtatctggtgagtacactctgttgccggaaagtaaaagtggaccctcgaggaatttagaaattgaatttcagtggtctaacaagtga

SEQ ID NO: 729 - DNA, 1209 bp, Glycine Max
atggaaattccaattccgctctcatttatgttactcttactacttgtaccttcctgcatttgctcttccccacttcaagatcctgaactagtggttgaagatgtacaaaagagcattaatgcctcaaggaggaacttagcatttctttcttgtggaacggggaaccccattgatgattgttggagatgtgaccccaattgggaaaagaaccggaagcgtctagcagattgttccattgggtttggtaagcatgccgttgggggaagggatggtaaaatatatgtggtgactgaccccggtgatcaccctgtgaaccccaagccaggaacactaagatatggtgtgatccaagaggagccattgtggatcatattcaagcgtgacatggtgatcaagctcaagcaagagcttatgatgaattctttcaagacaattgacggtagaggagcaagtgtgcacattgctggtggaccttgcatcactatacagtatgtgaccaacattatcattcatgggattaacatccatgactgcaagcaaggagggaatgcctatgtgagggattcccctacacattatgggtggaggacactctcggatggtgatggagtgtcaatctttggtgggagtcatgtttgggtggaccactgctctctctccaattgccgtgatgggttaattgatgccatccatggatccacaggcatcaccatatccaacaattacttgacccaccataacaaggtcatgcttttgggccacagtgacactttcactagggacaagaacatgcaagtcaccattgccttcaaccattttggagaagggctagtgcagagaatgccaagatgcaggcatggatacttccatgtggtgaacaatgactacacccattggagaatgtatgccataggggggagtgctgccccaactatcaatagccaagggaatagatttcttgctcccaatgacaataccttcaaagaggtgacaaagagggagaattcagcacagagcaagtggaagaattggaattggaggtcaagtggagatttgatgttaaacggtgcgttttttacggcatcaggagcaggtgcatcttcaagctatgcaagagcatctagtttggcagcaaaatcatcttcacttgtgagttctataacagcatcagctggatcacttagctgcagaaagggttcacgctgctga

SEQ ID NO: 730 - DNA, 546 bp, Glycine Max
atggaagactgtagaatcagttgccctaatttccagcccttaccacatttttctcaatatgccctttccttttccccaaattttgtgaatcttttggcctatgctaaggatataccatcttattcctgcaagtatgcttgctctgaagaaaatcctgagttcctggacatgggatgtccagttgaaggtggattcattgttgcatttgatccccttgatggcttcagcattgtggacacaaatttcacattggctgtggtcactggaagagatcatgttgctgcagccatgggggttatgggtcctagaacaacaaatttgatcaattactatgctagagaaaagataataatattatatgctttcaaagtgtcatattgttgtttgaggttagctcctttgaggttcttgattgaaaaagctgaaggttacaacagtgatgttcatcagtctgtgctagataaagtcatcactaacattgatgagataactcaagttgcttatggatccaagaatgagatcatccggttaagaaaccctgtatga

SEQ ID NO: 731 - DNA, 1332 bp, Glycine Max
atggaagaggaaatcaagtccgaattcaaaagaagcggtttcggcctcgaagacgaacaagagattctaagcaaatgtgtcactttctgcatcaactacagtctcactccttctgatctcgtttcaagctgggaagtttattacctcaatagacagctgaacgaaccagtagtacaaaatgctgaaattgatggctttctgttgcatctacaaaatgagaagaaagaggatgttataaaggagaaggaggaagctggcttgcatatttactctatcggagacgtagaaatgatcttaaataatgatgatgatacaaaggacaatactcccggaactccaataaatcatcatcaagatcctttatctcctgcacctgatacaccatctttaatgtatgagaatgttttatcttctggaaaaccatcaaaatcaaaactagtaacacccttttcaaaaagaacagataagtttgcagtgaaatttagcatcaacactgtccctaatgtagagaatgatgaaaatgaagatgatgttgttagaagagttccactctttgaaaggagttcattgtccattcacggatcaggacccaaaccaggttgcagattcttgtatgatagaacagaggataggcttaatgcaatagaaaaccgacttaggaaacatacaagggcatttgtagcttctgggctccatgaagaaccaacagaccctacaactgcttcacagagaagcatttttgctgttggcatgatttgttgtgatggagaaggccgtttaaatgagaagtctgtcatgctgcagagcagtattgagcattctggaggagaatgtgttcgcctagacttgcaacggttaagccattattcaatttttcctggccagatagttggtattggagggcataatcccagtgggcattgcttcgttgcaactaaattggtggattctatacctacctccgttgctgatgaggattcaaatcctgcaaagaagcaagctgttgataaggagaatcagccaactgatctgctttgtaaacaaagaaagttatcaatgattattgctgctggcccctttactacaacagacaatttgttgtttgagcctcttatagaactgctgaaacatgcaaaactaagaccaccacagttgcttgtattgttggaagaatatgtagattcagctacacgtgtccttcttgttccatctatacgtgatgctaaccatgattttgtttttcctcagcctgcattcgacatcaaatctcagatagtcagtctcagtaatcccggaatctttgaggcaaataagcaaaaagttaagtcatag

SEQ ID NO: 732 - DNA, 1602 bp, Glycine Max
atggaagaggaaatcaagtccgaattcaaaagaagcggtttcggcctcgaagacgaacaagagattctaagcaaatgtgtcactttctgcatcaactacagtctcactccttctgatctcgtttcaagctgggaagtttattacctcaatagacagctgaacgaaccagtagtacaaaatgctgaaattgatggctttctgttgcatctacaaaatgagaagaaagaggatgttataaaggagaaggaggaagctggcttgcatatttactctatcggagacgtagaaatgatcttaaataatgatgatgatacaaaggacaatactcccggaactccaataaatcatcatcaagatcctttatctcctgcacctgatacaccatctttaatgtatgagaatgttttatcttctggaaaaccatcaaaatcaaaactagtaacacccttttcaaaaagaacagataagtttgcagtgaaatttagcatcaacactgtccctaatgtagagaatgatgaaaatgaagatgatgttgttagaagagttccactctttgaaaggagttcattgtccattcacggatcaggacccaaaccaggttgcagattcttgtatgatagaacagaggataggcttaatgcaatagaaaaccgacttaggaaacatacaagggcatttgtagcttctgggctccatgaagaaccaacagaccctacaactgcttcacagagaagcatttttgctgttggcatgatttgttgtgatggagaaggccgtttaaatgagaagtctgtcatgctgcagagcagtattgagcattctggaggagaatgtgttcgcctagacttgcaacggttaagccattattcaatttttcctggccagatagttggtattggagggcataatcccagtgggcattgcttcgttgcaactaaattggtggattctatacctacctccgttgctgatgaggattcaaatcctgcaaagaagcaagctgttgataaggagaatcagccaactgatctgctttgtaaacaaagaaagttatcaatgattattgctgctggcccctttactacaacagacaatttgttgtttgagcctcttatagaactgctgaaacatgcaaaactaagaccaccacagttgcttgtattgttggaagaatatgtagattcagctacacgtgtccttcttgttccatctatacgtgatgctaaccatgattttgtttttcctcagcctgcattcgacatcaaatctcagatagtcagtctcagtaatcccggaatctttgaggcaaataaggttaaggttggctgctgcaccgtggatattctcaagcaaatcagtggggaggagatatcacgaactgctgcagatggaaaacccattgatcgcttgagtagacttgcaaaccatattcttaaccaacaaagcttctatccactttacacaccagcagaaagtgttcccttggacttttcgcttgctccagaagcccttcaactctcgtttgttccagacatacttatcctaccttccgacatcaagtactttgtcaagaaattaattcaccgttgcacaggtgcttag

SEQ ID NO: 733 - DNA, 1725 bp, Glycine Max
atggaagaggaaatcaagtccgaattcaaaagaagcggtttcggcctcgaagacgaacaagagattctaagcaaatgtgtcactttctgcatcaactacagtctcactccttctgatctcgtttcaagctgggaagtttattacctcaatagacagctgaacgaaccagtagtacaaaatgctgaaattgatggctttctgttgcatctacaaaatgagaagaaagaggatgttataaaggagaaggaggaagctggcttgcatatttactctatcggagacgtagaaatgatcttaaataatgatgatgatacaaaggacaatactcccggaactccaataaatcatcatcaagatcctttatctcctgcacctgatacaccatctttaatgtatgagaatgttttatcttctggaaaaccatcaaaatcaaaactagtaacacccttttcaaaaagaacagataagtttgcagtgaaatttagcatcaacactgtccctaatgtagagaatgatgaaaatgaagatgatgttgttagaagagttccactctttgaaaggagttcattgtccattcacggatcaggacccaaaccaggttgcagattcttgtatgatagaacagaggataggcttaatgcaatagaaaaccgacttaggaaacatacaagggcatttgtagcttctgggctccatgaagaaccaacagaccctacaactgcttcacagagaagcatttttgctgttggcatgatttgttgtgatggagaaggccgtttaaatgagaagtctgtcatgctgcagagcagtattgagcattctggaggagaatgtgttcgcctagacttgcaacggttaagccattattcaatttttcctggccagatagttggtattggagggcataatcccagtgggcattgcttcgttgcaactaaattggtggattctatacctacctccgttgctgatgaggattcaaatcctgcaaagaagcaagctgttgataaggagaatcagccaactgatctgctttgtaaacaaagaaagttatcaatgattattgctgctggcccctttactacaacagacaatttgttgtttgagcctcttatagaactgctgaaacatgcaaaactaagaccaccacagttgcttgtattgttggaagaatatgtagattcagctacacgtgtccttcttgttccatctatacgtgatgctaaccatgattttgtttttcctcagcctgcattcgacatcaaatctcagatagtcagtctcagtaatcccggaatctttgaggcaaataaggttaaggttggctgctgcaccgtggatattctcaagcaaatcagtggggaggagatatcacgaactgctgcagatggaaaacccattgatcgcttgagtagacttgcaaaccatattcttaaccaacaaagcttctatccactttacacaccagcagaaagtgttcccttggacttttcgcttgctccagaagcccttcaactctcgtttgttccagacatacttatcctaccttccgacatcaagtactttgtcaaggtgcttagtagcgaaaatgaagggataaaccacacgaaatgcatagctatcaatccgggaagactagctaagggagaaggagggggaacttttgttgagcttgattactgtggggcttccgaccaaattaacgcttcaattgttggcatatga

SEQ ID NO: 734 - DNA, 543 bp, Glycine Max
atggaagagggcatgtcagagttttttagtagcggtgtaagtgttggtggtaacagtggcagtgctactactggcaccaagtgtgggcgttggaatcccactactgaacaggttaaggttctgactgaacttttcagttctggactacgcacccccagcactgatcagattcaaaagatctctaatcagcttagtttttatggtaagattgagagcaagaacgtgttctattggtttcagaaccataaggctagggagagacaaaagcgtcgcaaggttgataaggatgtgattcgtagtgaaaactctatctccatcaattcttttacacaaacagattttaatcagctatatcaggtttctgagcccgagagggtgattgagactcttcagctcttccccttgaattcatttggtgaatcagaatcaaagaatatgagggtccatgcaagtgatcaatgcagggatagcactatgttttcatacacagtgggggaacaaatggatcacccaccattagatcttcgcttgagttttatgtga

SEQ ID NO: 735 - DNA, 1764 bp, Glycine Max
atggaagccaaagcagattatacacaagatggcactattgatttccgtggccaacctgcagtttcatctaaaactggcaaatggaaggcttgcgcttttcttgttggctatgaagcatttgaaaggatggccttctatggagtggcttcaaacttagtgaattaccttacaagccaacttcatgaagatactgtttcatcagtgaggaatgtgaataactggtcaggatctgtgtggataacgccaattcttggggcttacatagcagattcttacttgggtcgcttctggactttcactctctcatctctcatttatgtcttgggaatgactcttctcacagtagccgtgtcactcaagagcctgaggccaacatgcaccaatggcatatgcaacaaggcttcaacctcacaaattgcatttttctacacagccctttacactatggcaattggggcaggtggaacaaagccaaacatctcaacttttggtgctgaccaatttgatgacttcaatcccaatgaaaaagagctaaaggcttccttcttcaactggtggatgtttacctcattcttgggtgctttgatagccactttaggattggtttacattcaagagaatttggggtggggactagggtatggaatccccactgctggtcttctattgtctttggtcattttctacattggcacaccaatatatcgccacaaagtaagcacaacaaaaactcctgctagcgacataattcgtgtgccaattgcagccttcaggaatagaaaactacaactccctagtaacccctcggatctctatgagcacaacctccaagattatgttaatagtgggaaacgccaagtctatcacactcccactctgaggtttttggacaaggctgcaattaaagaagacagtgctggctccacaagagtaccattgacagtgtcccaagtagaaggagcaaagcttatatttggcatggtccttgtatggctagtgacactgattccaagcaccatctgggcccaaatcaacactctttttgtgaaacaaggcaccactttggacagaaacattggccctcatttcaaaattccatcagcctctcttggaagttttgtgacactctccatgcttctctcagtgccaatgtatgactggtttttcgtgccgttcatgcgccagaaaaccggccaccctagaggaatcacattgcttcaaaggcttgggattggattttcaatccagatcatagccattgcaattgcctatgcagtagaagttagaagaatgcatgtcataggagcaaaccatgtagctggtcctaaagatattgtccctatgagtatattttggttgatgcctcagtatgtactaatagggatagcagatgtgttcaatgccataggattgctggaattcttctatgatcaatcccctgaagacatgcaaagtcttggaacaacattcttcactagtggaattggttttgggaacttcttgaacagctttttggtgacaatggttgataaaataacaggaaggggtgacaaaaaaagctggataggggacaacttgaatgattgtcacttggactactattatgggtttttgttggtcatgtcaagtgtcaatatggtggtttttctttgggtttcaagtagatacatctataagagggaatcgataagggtcaaggagggcctttgtgttcaaatggagggaaaaccaactttggatgcctctcttggtttacaagtgtga

SEQ ID NO: 736 - DNA, 1353 bp, Glycine Max
atggaagggctggccatgctgaagcagctcattgctcagcttcaacacctctttgacacttaccactctcaatcttctctcatctttcaacaacaacaccccagatggacgacctcccttgacattgaagataactctgtagatgacttctgtggccttgtaatgacagctggaaagtctggcagtttcaggatgtcggagcctggaaagcctccacctactaagaagtctcgaagagatagaagcaggggcaaatcatctggaagatcttgtacaactgaagttatggaacaagaaatttggaaagattttcctgaagatttatttgaggctgtgattgcacgtcttcccatttccacatttttccgcttccgttctgtctgccggcagtggaattccatgctgaattctcaaagtttttctcagcattgtactcaagtcacacaagaaaatccatggttttacaccattacccatgaaaatgtgaattcgggagccatgtacgacccttctttgaaaaaatggcatcatccaactatatcaacaccgcccacaaaattgattgttttacctgtggcttcttctggcggcttagtttgctttcttgacattggtcatcgaaacttctttgtttgtaacccactgactcaatccttcaaggagttgccagctcgatcagtcaaggtctggtctcgtgttgctgtagggatgatggcaaatggaaactttgctggttcaggctacaagatcgtatgggtaggttgtgatggagaatatgaagtatacgactcagtcagaaattcttggagtcgtccaggaaacatgcctgtgggcatgaagctgccattgtcgctcaactttaggtctcaagctgtctctattggcagcacactttatttcatgcgttcagacccagacgggattgtttcctatgatatggcaactggggtttggaaacaatatataatcccagcgccactgcatctgactgatcacactctggctgagtgtgatggccaggtcatgcttgtgggtttgctcacgaagaatgcagccacttgtgtatgcatatgggagttgcagaaaatgactctcttgtggaaggaggttgacagaatgccaaacatatggtgcttggacttttatgggaagcacgttagaatgacttgcctggggaacaaaggcttgctcatgttgtccttgagatcaaaacaaatgaaccgattggttacttacaacatagcaaagaaagaatggctgaaggttcctgggtgtgtcgtgccacgtgggagaaaacgacagtggatagcatgtggtactgcatttcatccatgcctgactgcggtggtgtga

SEQ ID NO: 737 - DNA, 450 bp, Glycine Max
atggaaggtgttctttattgtaagcctcactttgagcagctcttcaaggagagtgggtccttcagcaagaacttccagtcacctgcaaagctagcagataagacaacacatgagctgacaaggtctcctagtaaagctgcgagcatgttttctggcacccaagaaaagtgtgccacatgtggcaaaactgcttatccattggagaaggtaacagtggaagggcaggcctatcacaaatcatgtttcaagtgttcacatggtggatgtcccataacgccgtcgaattacgcagcccttgagggcattttgtattgcaagcaccacttctcccagctttttaaggagaaagggagctataatcatcttactaagtctgcctcagtcaaacgtgcagcagcagcagcagcaacagcaactgcaacgaccgtggcctctgttccagaatcttga

SEQ ID NO: 738 - DNA, 720 bp, Glycine Max
atggaagtaggaatgtctctgaacgcgctggttcgtcttcctctctcgaattcacgcttccacgacgatgctgctccgatgattattaggcactctctgttttcgagccgaaagcaacagcagcagcagcagagttataaggttccacagcgtcatcaagtgttcgtggttgaagccaagggcaaaaagggaatgatgtctcgtcaatttcagcgcaatgctcctcctcctttacccaagattgaagacgatggcaatcccaaattcgtcatcttcattcgcatggccaatgtatacctttggtaccctcttagtatcgtatcaggcggcaccactgctaaaataatggttgcagctaaagataattttctcggcaagtatatctacaaagacactcttgatagaaatctcgctgctgttatctacagagatgagaaggaggtacagaaatctgcattcaaacagtaccgtgtattgcgaacagctactgatttcagatacggctacaaacttgttgagaatggcaatataagagctgcactttctaccactgatgttattgagcttccaacacaagataaactaaaaaccgtgcttgacaaagtgaaagacttttttggagatgcaaaggaatcttttggaaagataacatcattgggcactactgaaacagaggagtcagaggaagacacaaaagaaaaagccaaggttaaaggatga

SEQ ID NO: 739 - DNA, 720 bp, Glycine Max; identical to SEQ ID NO: 738

SEQ ID NO: 740 - DNA, 867 bp, Glycine Max
atggaatcctccgctgccattcgatcttttcactatcccataggcactatgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagggtgatgtaatcaaagaagggcaagtcatagggtatttggatcaatttggcactggacttcctattaagtctgatgtggctggagaagtgttgaaactacttgttgaggatggagagcctgttggttatggagaccctcttattgctgtgttgccatcttttcatgacatcaagtga

SEQ ID NO: 741 - DNA, 825 bp, Glycine Max
atggaatcctccgctgccattcgatcttttcactatcccataggcactatgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgcttcttcagataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagggtgatgtaatcaaagaagggcaagtcatagggtatttggatcaatttggcactggacttcctattaaggtgatctgtctcagtttcagtaattctggttccttcctaaatatttactacttctga

SEQ ID NO: 742 - DNA, 876 bp, Glycine Max
atggaatcctccgctgccattcgatcttttcactatcccataggcactatgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgcttcttcagataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagggtgatgtaatcaaagaagggcaagtcatagggtatttggatcaatttggcactggacttcctattaagtctgatgtggctggagaagtgttgaaactacttgttgaggatggagagcctgttggttatggagaccctcttattgctgtgttgccatcttttcatgacatcaagtga

SEQ ID NO: 743 - DNA, 1086 bp, Glycine Max
atggaatcggaatcttcaatctccgattctgaaacacaccctctctcggaccaaatcgacgacgcgtgccacgacatgagctccctggaagagctcgcgagtcgcggcgcttggcgttccatcatcgacaaggtctcacgcgcccgcgctctctctctcctccacaagccccacgaccacctcacctacctcgctttcaacgccctcgccttcacaaaactacgtcgtttcaacgaagcctccgcggaactcgattccctcgaagacctccacagttcccactaccgctacgaaacctaccccaaaatctaccccaatcggattggatccatggtccctttctccctccgctgggtccacgccctaattcccatcaaattagggcaacgtcagcaaggcatggatcgcttctacattcttctcgatttcgtgcgtggaaagattaatgaaaaggagaaacagaacaacctcggtgtctcccttaatctgtggcgtaaaagagaggtttttgtcgtgaattgcatcatagggaaccatttgagtcagaaagagtttggtgtgtgcttaagcttgatgaaggagcttctctctcgcgattgttctgaccctttgctggtttcgcagcttgggtatatgcagttgcagattggggacttggagggtgcgaaaatttcgttcttgaaggtggaggaattggggaagagtaataatggttcattgagtgaggttgagttcaggaaccttgtgaataggaacaaggcgttggtgtatttggttgggaaggattatgtgtctgcggtgagggagtacgaggagtgcattgagagggacagtgcggatgttgtggcagtgaacaacaaggctctgtgtttgatgtatctgagggacttgtcggattctattaaggtgttggagagtgcgcttgagagagttcccactgtggctctcaatgagacgcttgttgtcaatttgtgtagtatgtatgagttggcgtatgttaatcactctgatgttaagagaacgcttagtagctggattgctcgtgttgcacctgatgattttgatgcatcttgtactcgtacatga

SEQ ID NO: 744 - DNA, 537 bp, Glycine Max
atggaatcttcatcctctaacaaagtgataaatgcaggttatcatgtatgcacagccataggacgtggccaaaaaatagatgttgacattattgataagaaaaatccccacactggtgtcattgttaaaatgtcgaacagtggccctaagtacaactgttctctagctgtgtctgttctttgcaatttaaatggagtgcaaggaccgcgaactctggagagattaggggcctgtgattatgttacagagctaaagcacccatctggctgtgccatcattgtaaatgttcatggaggagggttggggtggtttggcaccttactgatcattgttttgtgtctttttgctgcatatctcttggctggtatagtttaccgatttttcttcctcgggattcgtggtatagatattatccctaacctggacttctgggttagcttgcctaggagaacacagagtctgtgtgcatctttggcgaggaagtttaagggaccgtctgaaggtcaccggagcacttattctcctgtgaacttctga

SEQ ID NO: 745 - DNA, 963 bp, Glycine Max
atggaatgctgcataatctccaggctcaagacccaacccatatggttcgcgcttctctttattgtgggattgttaacgattctcaaattggcattcgttgttctcagatgggtctacgtcaatttcctcagaccaccgaagaatctcaaaaagtacggatcttgggccgtggttactggacccaccgacggcattggaaagagcttcgccttcgagctcgctcgcaagggcttgaacctcgtccttgtcggaagaaaccccgacaagctcaaagacgtgtcggattccatcgcggcgaggttcggaaaaaccgaggttaagaccgtcgtggttgatttcttcggggatctggacgagggcgtcaagaagatcagcgaagcgattcaagggttggaagttggagtgctcgttaacaatgtgggtgtttcgtacccttacgcgagattcttccatgaagtggacgaggggcttcttaacaaccttattaagcttaacgttgttggaactactaaggtaacgcaagctgttcttcccgggatgctgaagagaaagaagggtgcgattgttaacatgggttctggagctgctattgttattccttcggatcctctttatgctgtttatgctgccaccaaagcgtacatcgatcagttttcgagatgtctctatgttgaatacaagaggagtggaattgacgttcagtgtcaggttccattatatgtggcaaccaagatggcatcaatcaggaaatcttcattctttgttccatcaacagatggctatgccaaagcaggtgtgaaatggataggctatgagcctcgctgcacaccatactggccgcatactcttctttgggccgtggcgtgctcattgcctgagtttgtcgtcgatgcttggcgcctgtggttttgcttgggtattcgaaagaggggacagcgcaaggattccatgaagaaggaataa

SEQ ID NO: 746 - DNA, 900 bp, Glycine Max
atggaattcgagacttcatatccaacttgttttatgtcaaattcaagttggttttctcaagaaggccaattcacagaatggacaagagaagagaataagaaatttgaaagtgcccttgccatatatgataaggataccccagacagatggctgagggttgcagccatgctccctggaaaaactgtctatgatgtgatcaaacaatacagagaattggaagaagatgtttgtgaaatagaagcagggaggattccagttcctggatatcctacctcttctttaacattggagatggttgacaaccaatgttatgatgcatgcagaaagaagcctgcaactctcaggagttctgatcaggagaggaagaaaggggttccttggacagaagaggaacatagacgttttcttatgggacttttaaagtatggtaagggggattggagaaatatctctcgcaattttgttgtgacaaaaactcccacccaagtggcaagtcatgctcaaaagtattatataaggcaaaagctttctggagggaaagacaataaaaggaggcctagtatccatgatatcaccattgttaatcttacatcagatcaagagaagcctcttttattcaatgatgagtctcacatgacttctgagcaacagaagctaactagcatgccaaaagtacaacttgaatggcggattaatcaccacaacaatggcgggtcaaattatgatatgttcgtgtcacctaattcatctggcatctcttccaagaccctcaagttgcaagggcaggatttctatgaatgtgcttttcatgagacttatgccaagcttaaaaatacgggtttcaggacagcttctagagacttcaacaaggaagctatttttggtattcatgcactgtaa

SEQ ID NO: 747 - DNA, 900 bp, Glycine Max; identical to SEQ ID NO: 746

SEQ ID NO: 748 - DNA, 900 bp, Glycine Max; identical to SEQ ID NO: 746

SEQ ID NO: 749 - DNA, 216 bp, Glycine Max
atggaatttgccaagcccgcaacgattgggcgcaacaatgagacaccggcgattcatacggcggtgagaatggcatgcgatggccgtgaatggcgatgtcatttttgtggcctcgacagaggagaagaattgtacggtggtgaagacggaataacagaaagagagagtttgtctatggcgacgtggtgcgccggtggctcactaactacagactag

SEQ ID NO: 750 - DNA, 1425 bp, Glycine Max
atggacaagtcgtgcgtgatttctccaagttgctacgacaatcatcacctctgctttgcatttctcttctcctttctcttttgctctctgctgttatcctttcatgctcccaacctcctccgactcacatccaagaccaaaaatgtcacagattcctgcactggccgctatgtttacattcaccaactcccctcccgcttcaacgattacttgcttcagaattgccagtccctcactagaggcactgacaaacccaacatgtgtccatacatgcaaaacaatggtttaggtcctcacattacctactcccaagggcttttctccaacaacacttgctatgccaccaaccagttcttgttggaagttatttttcacaacaggatgaccaaatatggctgcttgaccaacgattcctccctcgcctctgcaattttcgtcccattctatgctggtcttgatgttagccgtttcctttggctctctaatctcacagagagagattcctctggtcgtgatcttcttcaatgggtcgcaaaaagacccgagtggaagcaaatgtggggcagagatcatttccttgtttctgggaggattgcttgggatttcaggagacaatatgatgatgcgtcctattggggtagtaagttcaggtttatacccgaatccatgaacatgtccatgttagcagttgaagcaagttcgtggaataatgactacgcaattccgtacccaacttctttccacccatcagaggacactcatgtttaccggtggcagagaaaaatcagacatcaaaagcggccatacttgttcactttcaccggagctccaaggcctgaacttgaaggttctatcaggggtaagattatagaccagtgtcgagcttcgagtgtttgcaaattcgttgactgcagctatggtgtagagagatgtgacgaccccatcaatgttataaaggtgtttgaaagttctgtgttctgtttgcagcctccgggtgactcatacaccagaaggtccatttttgattccatcttggccggttgtattcccgttttctttcatcctggtactgcttactcgcagtacaagtggcatttacccaagaataggactaagtactctgtgtatatacccgtgaaggatgtaaaacaatggaatgtcaacgtggagcaggtgttgctgggaattccagagggtgaggtgtttgcaatgagagaggaggttataaagctgcttccaaatattatctatgcagatcctaggtctaagttagattgctttgaagacgcgtttgatttagcagtaaaaggaatgcttgaaagaatagagaaggtgagggaagcaatgaggagtgggagagatcctagcattggttttgcggatgaagaccattataagtatacattttcacaaaattacagctaa

SEQ ID NO: 751 - DNA, 2325 bp, Glycine Max
atggacgccgactccagagtgaagcgcttcttccgttcccgccacgggctcgctagggttttggcgtcgctgcaattgagctccgaccaacttttcctgctcaagtgtgtggtcgcggcggggcaggagcacgtgctgtgtttgggcgaaacggaatcgttggaatcctccgcctccgccgccgccgccaccatgagtgcggtgaagagcgcgctttacgctctggcggagatgattgagaatatggattcctttaacggcaatggcggagcgggtttggggatggcgttgggggatcacgagattgcggagctgaccatgtttttacagactttggcggaaattgagcgattctatgactgtattggaggaattattggatatcagattacagtactggaacttgcacaaaaatcgtttgagatgcagaatataagctgggcccaccagaggcatgacgtgaaagaatgccaaattttgggaattaatgcacctaatgggcttaacctttctgaagacacagagtatgcatctcaagcagctctatggggtatagagggtttgccagacctaggtgaaatttatcctttgggaggttctgccgacagacttggtttggttgatcctaacacaggtgaatgcctgcctgctgcaatgctaccatattgtggaaggactttgttggaaggccttataagagatcttcaggctagggaattcttgtacttcaagttatatgggaaacaatgcatcacacctgttgcaataatgacaagttctgcaaagaacaaccacaaacatgtcacctctctgtgtgaaagactttcatggtttggaagaggtcgatcgactttccaattttttgagcagcctcttgttccagttgttggtgcagaagaatgccagtggctagtcaccaaaccattcagtcccttgagcaagcctggaggtcatggtgtcatatggaaacttgcttatgacaaaggcatcttcaaatggttttattgtcaaggaagaaaaggtgcaactgtgcgccaagtcagtaacgtggtggcagctacagatttaaccctcctagccttagcagggattggtttacgtcaaggaaagataagaacatgttataataaatggaaactgggatttgcatcttgtaagcggatctcaggtgccacagaaggagttaatgtgctgatggagaagaaaagtcttgatgggaactgggaatatggtgtgtcttgtattgaatacacagagtttgacaagtttggaattactaccggacctcttgctccaaaaggtttgcaggcagagttccctgccaatacgaacatcttatacattgatttgccttctgcggagctagttgggtcaagtaagagtgaaactagtttacctggaatggtgctaaatactagaaagccaatagtttacacagatcagtttggaagacatcatagtgtctctggtggtagacttgagtgcacaatgcaaaatatagctgacaattattccaactcatattcttctagatgttataatgatgtggaagataagctggatacttttattgtatacaatgaaagaagaagggttacctcctctgctaagaaaaaaagaagacatggagacaagtctttacaccagacacctgatggtgctctgttggatatcttacgaaatgctcatgatcttctttcacaatgtgatataagacttcctgagattgaagctaacgagaactatgctgattcaggaccaccatttctcatccttgtgcatccggctcttggtcctctttgggaagtcactaagcaaaaattttatggcggttccatatcagagggctctgagttacaaatagaggttgcagagtttttttggaggaatgttcagctcaatggaagcctgattataatagctgagaatgttatgggctcaatgaagattaatgagaacagtgaatccatactacattatggccaaaggtgtggaagatgtaaattgcaaaatgtcaaggtattgaacaagggaattgattggacttgcgatgaaaacatatactggaaacatgatgtgcagcgatctgaggtgctgcagatcatactgcatggaaatgctgaatttgaggctactgatgttgtcttacagggaaatcatgtgttcgaagttccagatggctacaaactgaaaatcatgccaggaagctcaggtttagcaatccagttggatccaattgatcaagatatgatggagagtggaagctggcactgggattacaagatagaaggttctcacattcagctagaattagtagaatcataa

SEQ ID NO: 752 - DNA, 282 bp, Glycine Max
atggactggcaagggcaaaagataacagagcagctaatgcagctaataattgttgcatttgctgtgattgcatttgcaacaggatatcttatggcttctttccaaatgatgatcctcatatatgctggtggtgtggttctcaccacattggtgactgtccctaattggcccttcttcaaccaccatcctctcaagtggttggatccaagtgagttagagaagcatccaaagcctcaaccatctccgaatgtaagctcaaagaagaagtcggttaagaagtag

SEQ ID NO: 753 - DNA, 1101 bp, Glycine Max
atggacttcaccactttcgcaaattccatatcctattctcatgcaattcctccaatacacccttatcgccttcaaccctctccttttccccttcacctcccattttcgaatttaaagcgttcgggtttggttaagaatcggctaattgctcgttgcacttctaagtccgatgaatttggttctgttaatgggttgcaattcacgcccaataagctttttgtggaggaggctattggggctgaatatggggaaggctttgagacttttagggcagatggaccactaaaagttgatgtggactatttgaatgagaaattgcaagatggttttcttcagcgcatacgctatgctatgaaaccagatgaagcttatggactgatcttctcttgggacaatgtggtggctggtacacgagctctaaaaaggaaggcatgggagcagctggcctttgaagagggaaaggatattccggaagaaggtgatatgcacaaattactgttttatgcaggtgctgattatgtgttgcataagttttttctctcagataaggcggaaaatgagctgaataggctaaagttaaggttttctcagatatattatgataatcttgtcagacttgaaaaaccaatggatggcctcaatgactggttggaagcagtttatacagctcgcatcccctgtgctgtggtttcaagtcttgatagaagaaatatgttagaggctttggagcgaatggggctcagcaagtatttccaggcaattgtgacagaagaggatggaatggagtcaatagctcatagatttctttctgctgctgtcaagttggatcggaaaccttccaagtgtgtggtttttgaagatgatcctagaggagtaactgctgcgcacaattgtacaatgatggccgtagcattaattggagctcatcctgcgtatgatttggggcaggctgatcttaccgttgctaactttagtgaactttctgtgatcaacttgcgaagactatttgctaacaagggttcttcatttatggacttacagaagcagatcatagagaaaactcctcccaaaaggaaacttacgatagacaccattttttaa

SEQ ID NO: 754 - DNA, 1335 bp, Glycine Max
atggagaaaagagggaatgtgttgatggagaagtatgagtttgggaagctattaggtcaaggaaactttgcgaaggtttaccatgcaagggacgtcagaactggtgagagtgttgccgttaaggtgattgacaaggagaaaattctaaaaattggactagtggatcagacgaagcgagagatatcgattatgagactggttaaacatcccaatgttttgcagctttatgaggtcttggccaccaagaccaagatttacttcatcatagaatatgccaaagggggcgaacttttcaacaagatagccaaaggtagactcactgaggacaaggcaaggaagtactttcaacaattggtcagtgctgttgatttttgccacagcaggggtgtttatcacagagatttgaagccggagaacttgcttttggatgagaatggagttctcaaggtagcggattttggattaagtgcacttgttgaatctcaccgtcaaaaagacatgctgcatacaatttgtggaactcctgcatatgtggctcctgaggttataagtagaaggggctatgatggaacaaaagccgatgtatggtcttgtggagtgatcttatttgttcttttggctggtcatttgccattctatgatttgaatcttatgtcactgtataacaaaataggcaaggccgattacaaatgtccaaactggtttccgtttgaagtgcgcagactgttagcgaaaatccttgaccccaacccaaataccaggatatccatggcaaaacttatggaaaattcgtggttcagaaaaggattcaaacccaaatctggtcaagtgaaaagagaggctgttaatgtggctttagttgattctgatcaagttttttgcttgtgtgagaatacaagtgctgctgttgttgaggcagagcaagcattggttaaaccttcacagtttaatgctttcaatataatttctctgtctgctgggcttgacttgtctggcctttttgctggcaatgttgaactggatgataccaaatttacatttatgagctctgcctcatccatcatgtctacaatggaggatattgctcgcgttttgagtatggagataattaagaaggatggagggttgctgaaattggagagatccagggaaggtagaaaaggaccactttccattgatgctgaaatatttgaggttgccccatctttccatttggtcgagttgaagaagtcctgcggtgatgcattagaataccagaagatattgaaggaagacttaagaccagctctaaaagatattgtcggtgtttggcaaggtgagcagcatctgcactag

SEQ ID NO: 755 - DNA, 492 bp, Glycine Max
atggagaacaacaaaaagaaagtagtaggaggaggcccttcctcatcatcattcaccaactttgatcatctttttggtcccaaggacccatccaccacttcatcttcatccaccagcatctttggctccattttcccaccccctccttccactgttggagggagagattcaacaaaacaggacatgggatgcaaaaattatggagcaccaggaaattacagttacaaaggtgaaagcagcgctagcggtgtcgtctccaacagcaagaatactactagtaccaattatcatcatcagaatgagacagtggagcccagctactacagttcatcaatctattatggtggtcaagaaaattattccccaagaaccaggaccactgaatcccaccatagttttaagaaagacaagaaggatgatgatgatccaaatggtaatgattcaaacagtgcttcaagagggaactggtggcaaggttctctttattattaa

SEQ ID NO: 756 - DNA, 705 bp, Glycine Max
atggagacccacaaaaatggagaaccaacaaccggcacctatctccgtgacactgctacatctgctatccaaaacttcgctcccatcaacaaaatccaccaacatctctgcgcgtttcacttttactcatatgacatgagccggcaagtggaggcacaccatttttgcgcgcaccagaacgaggagatgaggcagtgccttatctacgacagccccgagaagaaagccaggctcatagggctggaatacatcatctccgaaaacctttacttgacactccccgaccaggagaagcgtctgtggcactctcacttgtacgaggtcaagagtggcctcttcttcatgcctaaggttcctgctctcattcagcgcccagacatggagactgtctgcaccacttatggcaaagtctttcatttctggcaggtcgataagggtcactctcttccatttgggatacctcagctcatgatggctctcactagagatggccagatctatgatcacctcctccaaagttctgcagagcgcatggggatagactatgaggaagaaagaaaagcgagagaatatatgacagggccagttcatggaattcatccattggcaaatggagggggtaagggccttgaacttcggctgagggaggttgaactcaagcacgatccatctccaccatccgtcaaagccaggattttattttga

SEQ ID NO: 757 - DNA, 1755 bp, Glycine Max
atggagcaagaaatggagaagagaaatgaaggcagaattgaagaaagtgaagagaaatgggtgcatgatgcatctgtggattataaaggcagagttcccctccgtgcttccactggtgtatggaaagcctccctctttgtcctcacaattgaatttagtgaaagggtaagctactttagtatagccagtaatcttatctcgtacctgactaaagtgatgcatgaagacctcagtacagcaagcaagaatgtgaactactggtcaggaacaacaacccttatgcctctggttgggggatttgttgctgatgcttacactggtcgattttatatggtcctgttttcttcctttgtataccttatgggattaagcctgttgatcatgtctcaattcatcccaagtctaaagccttgcaacactaagatatgccaagagcctaggaaggttcatgaagtggttttcttccttgccctttactgcatctcctttggtactggaggatacaaaccatgcttggaaagctttggagcagatcaatttgatgatgaccacttggaagaaaggaagaagaagatgtctttctttaactggtggaactttgcactgtgctttgcattgctgcttggtgcaacggtgattgtttatgttcaagattttgtcagctggggagttgctactcttatcctcgctattcttatggctctcactgtcgtagctttctgtgtgggaaaacctttttacaggtacaggagggcagaaggaaaccctttaacaccgatttttcaggtcttaattgcagcaataaggaaaaggaatctttcttgtccttcaaatccttcattattacatgaggtccctgagttagagaggacccaaggaaggcttctgagccacactaacaggctcaggtttcttgacaaggctgcaataattgaagaaaaacgtgttgagcagaagtacaatccatggagattagcaacagtgagtagagtggaggaaacaaaacttgttctaaatataattcccatatggctaacttcattaacaattggagtatgtgtgggacaaggccagacactctttgttaaacaagcagccgctaccaacttagagataagcgacagtttcaaaatcccaccagcttccatggcctctgttgcagcagttggtaccttaatagctgtcccaatatatgataggattgttgttccaattctgaggaaagtcacgggtaatgaaagaggcatcaacatccttaggaggattggcattggcatgacattatcagtcatactcatggttgttgctgccttagtagaaaaaaagagattaagattaatggttggacatgagactatgagtgtgttgtggttgataccccaatacttgattctaggcgttggagattcgttttctctagttggcttgcaagagtatttctatgacgaagttcctgactcaatgagaagcataggaatggccttgtatcttagtgtacttggagtaggatttttcttaagtagctttttaatcatcattgtggaacatgtcacggggaaaactggcaaaagttggattggaaaggacataaattcaagccgtttggataagttttattggatgctagctgtcataaatgcttttgttctgtgtgtctttctcttggtgtccaaaaggtacacctataagactgtacagagaagagctatggaaactgattcttgtaagagtgatggggttgagatggtggcttga

SEQ ID NO: 758 - DNA, 1767 bp, Glycine Max
atggagcaggaaatggagaagagaaagggaggtagaattgaagaaagtgatgaagagaaatgggtgcatgatgcatctgtggattacaaggaaagagtccctctccgtgcttccacaggtgtatggaaagcttcactttttgtccttgcaattgcacttagtgaaaggataacctactttgggatatcaagtaatcttatcatgtatctgactcgagtgatgcatgaagacctaaaaacagcaaccaataatgtaaactgctggaaaggagcaacaaccttgttgcctctgattgggggatttcttggtgatgcctacatcggtcgatttcgtatggtcttcttttcttccctcgtatacttcaagggattaagcatgttgaccgtgtctcaattcatcccaaatctaaagccatgccacaatgatatatgcgaccgaccaagcaaggctcataaattggttttctttcttgccctttacagtatcgccttgggtactggaggattcagaccgtgcttagaaagctttggagcagatcaatttgatgatgaccactttgatgaacgaaagaagaagatgtctttcttcaactggtggagctttacactcagtgtttcttcgatgctagcgacaacagttgttgtttatgttcaggacttcgttagctggggagatgcttgtctcatcctcactatgttcatggctctcactagcattgctttctatgcggggatacctttttacaggtacagaatgaagccaaaaggaaaccctttcatgccaattctccaagtcctaattgcagccataaggaaaaggaatctatcttgtccatcaaatcctgctttattatatgaagtcccaatgtcagagaattcccaaggaaggcttctaagccatactagaaggctcaggtttcttgacaaggctgcaatagttgaagagaagtatactgaacagaaagtcagtccatggcgattagcaacagtgacaagagtggaggagacaaagcttattctaaacgtatttcccatatggctaacttcattaatgactggtgtatgcatagcaaatggctccacactctttgtcaaacaagcagctgctatgaacttaaagataaacaacaacttcaaaatcccaccagcttctatggcgtccgtttcttctatttccatcataatatctgtcccaatatatgataggattattgttccaaatctaaggaaagtcacaggtaacgaaagaggcatcagcatccttaggaggattggcattggcttagcattctcagtcatagtcatggttgttgctgccttcgtagaaaatatgagattaagaatgtctggtcatgagaatttgatgagtgtgatgtggttgataccccaatacttgatccttggcattggaaattcattttattcaattggtttgcaagagtttttctatgatcaagttcctgactcaatgagaagcttaggaatggctttgtatcttagtgtgcttggaataggattcttcttaagcagctttctaataatagttgtggaccatgtcacagcagggaagaatggcaaaagttggattgccgaggatgtaaattcaagtcgtctagataagttttattggatgttggctgtcatcaatgctttaaatttctgtctcttcctattcttgacaaagaggcacacttataagaccgtacagaggaaagctacggaaatagatgatggttgtcacagtgatggggtggatacagtggcatga

SEQ ID NO: 759 - DNA, 1392 bp, Glycine Max
atggaggaggagaaacagagaggcaaagggcacagactattgctgatgccatcaccattacaaggccacataacaccatttctccacctcggtgacatcctcttctcaaagggcttctccatcaccattctccacaccatcttcaactccccaaacccttcttcctaccctcacttcaccttccacgccatccccgacggcttatcagaaacagaagcttcaacactcgacgccgtgctcctcaccgacctcatcaacatcagatgcaagcaccctttgaaggaatggttggcttcttcggtgctgtctcatcaggaacctgtttcttgcttcatttccgatgctgcacttcacttcactcaacctgtttgtgacgagttgaagctcccgcgccttgtgctcagaactggtggagcctcgtcttttcttgtttttgcctcgtttccacttcttagagaaaagggttacctccccgtacaagaatctagattggatgagcctgtggtggatctcccaccactcaaggtgaaagatcttcctaagtttcagtcgcaggatcctgaggcattctataaactagtttgtcgctttgttgaggaatgcaaggcatcttcaggggttatttggaacacctttgaagagttggaatcatctgctttgacaaaattgcgccaagatttttccataccaatataccctataggcccttttcacaaacacttgcttacaggctctgcttcttctactagcttgttgaccccagacaaaagttgtatgtcttggttagaccaacaagatcgtaacagtgttgtttatgtgagttttgggagtattgcagcaataagtgaggctgagttcttggagattgcttgggggttagccaacagcaagcagccgttcttgtgggtgattcgacctgggctaatccatggttcagaatggtttgaaccattgccaagtgggttcctagagaatttgggaggaagaggctacattgtcaaatgggctcctcaagaacaagtgcttagccatcctgcagtgggagcattttggactcataatggttggaactcaactctagagagcatatgtgaaggggttccaatgatttgtatgccatgttttgcagaccaaaaggtcaatgccaaatatgcaagcagtgtttggagggttggggtgcaattacagaataagctagatagaggagaggtagagaagaccattaaaacactcatggttggggatgaagggaacgagattagagagaatgccttaaatttgaaggaaaaggtaaatgtttccttgaaacaaggtggttcgtcttactgtttccttgatagattggttagtgacatattgtcactgaaatctgctacatctagagttcactga

SEQ ID NO: 760 - DNA, 237 bp, Glycine Max
atggaggcacgagtggtggaggcaaagatatgcgaaaagtacagcaaaacatggtcagggtggtgtggcaactctaaccactgtgacaaccaatgcaagaaatgggaaggtgcaaaatttggatcatgtcactgggacttgggcggaaggcttcgcagcaagacatggtctggttggtgtggcagctccaacaacagtggcaagcaatgcaggactaaggaaggtgcaattcattga

SEQ ID NO: 761 - DNA, 303 bp, Glycine Max
atggaggcacttcaatcatgggtttcaaagcacaagctcgccagcattggggcactctgggcctctggaattggagcaacacttgtggcttattcatgcaaaaagtctccaatgaagccaagtctcaggcttatccatgctaggatgcatgctcaggctctaactttagcagtgctatccggtgcagctgcttatcattattatgagaaacgtgatgttcagccaaaaccagaggcagattatattattcctgctcccaatgtcacccagatggttgaatatgaacttcaatgtcctttctaa

SEQ ID NO: 762 - DNA, 870 bp, Glycine Max
atggagggaaaagaggaagatgtttccttgggagctaacaaattctcagagaggcaaccgattggaactgcggctcagagccaagacgatggaaaggactacacagagccacccccggctccacttttcgagccctccgaactcacttcttggtccttctaccgagccggaatagccgagtttgtagccacttttctctttctctacataaccatcttaaccgtcatgggtgtcaataggtccagctccaagtgtgctactgttggcattcaaggcattgcttgggccttcggtggcatgatcttcgctctcgtttactgcactgctggcatctctgggggacacataaacccggctgtgacattcggattgttcttggcgaggaaattgtcgttgaccagggcgctgttctacatggtgatgcaggttctgggtgctatcgttggtgctggcgtggtgaaaggtttcgagggaaaaaccttctacggccaacacaacggtggtgccaactttgttgcccctggttacaccaaaggtgatggacttggtgctgagattgttggcactttcattcttgtctacaccgttttctctgccaccgatgccaagcgtagcgctagagactcacacgtccctattttggcacccttgccaattgggttcgctgtgttcttggtgcacttggccacaatcccaatcactggaactggtatcaaccctgcacgaagtctcggtgctgccatcatcttcaacaaagaccttggctgggatgatcactggatcttctgggttggacctttcgttggtgcagctcttgcggctctttaccaccaagttgtaatcagagccattcccttcaaatccagttaa

SEQ ID NO: 763 - DNA, 1764 bp, Glycine Max
atggagtctgtcaagttcattaacatgaatgccaaacactcctccatcttcttattagccatgatctttgttctgatcttagcttcagcaaatgccaaaattcacgagcacgagtttgttgttgaagcaactccagtgaagaggctgtgcaaaacccacaacagcatcaccgtgaatgggcaatacccgggcccaacgttggaaatcaacaatggagacactttggttgtcaaagtcactaacaaagctcgttacaatgtgaccattcattggcacggtgttaggcaaatgagaacaggatgggcagatggaccagaatttgtgactcagtgcccgattcgtcctggaggaagttacacctaccgttttaccgttcaaggacaagaaggcacactttggtggcacgctcatagctcatggttaagggccactgtttacggtgctttaatcattcgtcctagggaaggagaaccctaccctttccccaagcctaagcacgaaacacccattcttcttggggaatggtgggacgcaaaccctattgatgttgtgaggcaggccacgcgaactgggggagctccaaacgtgtctgatgcatacactatcaatggtcaacctggtgatctttacaagtgctctagcaaagacactaccattgttccaatccattccggcgagactaaccttctacgtgttatcaatgctgcactcaatcaacctctcttcttcaccgtcgcaaaccacaaactcaccgtggttggcgccgacgcctcctacctcaaacccttcaccaccaaagtcctcatgctaggacccggtcaaaccaccgatgtattgatcaccggcgaccagccaccttccccctactacatggcggcgcgtgcgtaccaatctgcccaaaacgccgcgttcgacaacaccaccaccaccgccatactcgaatacaagtcacctcatcacagtaatcattctcaccatcattccaaaggagcactgaagaaaaaaaccaaaccgatcatgccctcactccctgcctacaacgatacaaacacagtcactgccttcagcaaaagctttagaagccctagaaaagttgaagtccccgctgaaatcgaccagagcctgttcttcactgtgggcttaggaatcaacaagtgccccaaaaactttggaccaaagaggtgtcagggacccattaatgggacgaggttcactgcgagcatgaacaacgtgtctttcgttctcccgaacaacgtgtccatcttgcaggctcaccacctcggaatccccggagtgttcaccactgattttccggggaagccgccggtgaagtttgattacaccggcaacgtgagtcgttcgctgtggcaacctgttcccgggacaaaggcacacaagttgaagtttgggtccagggtgcagattgtgttgcaggacactagcattgttactcctgagaaccaccctatccatcttcatggctacgatttctacatcgttgctgaggggttcggaaacttcgacgccaagaaagatacggccaaattcaaccttgttgatccacctttgaggaacactgtggccgtgcctgtaaatggatgggctgttattcgatttgtcgctgataaccctggtgcctggcttttgcattgtcacttggacgttcacatcggatggggtttggctacggtgttgttggtggagaacggagttgggaagttgcaatccatagagcctcctccgctggatcttcctctttgttag

SEQ ID NO: 764 - DNA, 1332 bp, Glycine Max
atggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaaccgtgctctctctcttctgtcaacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggattaa

SEQ ID NO: 765 - DNA, 1005 bp, Glycine Max
atggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccaggttactgttga

SEQ ID NO: 766 - DNA, 606 bp, Glycine Max
atggagttttctcaagatgattttgatcggttactgttattcgaacacacgcgaaagactgctgaagcaaactacgcagagaatcctcaagacgctgataatctgaccaggtgggggggagctttgatcgagttgtcgtcattccaagctcctagggatgccaaggcgatgattgatgatgccctttcgaagctggaggagtctttgctgatcaatccaactaagcatgacactctttggtgcttgggaaatgcaaacacgtcttatgcttttctaatccctgatataactgaggcaaagggttattttgacaaggcacttgagtatttccagaaagctgcggaggaggatcccgagaatgacctctatagaaagtccttgcaagttgccgtgaaggccccagaactacacatggagatccataaaaatgggcttggtctgatgagtaatgcgggatcctctgctacttcaaaagaaaaggaatctaaaaagcagaagagcaatgactttaagtatgacatatttggatggattattcttgcagtgggtatagtagcatgggtgggaatggccaaatctaacattcccccgccacctccaagataa

SEQ ID NO: 767 - DNA, 1494 bp, Glycine Max
atggataatggttgtttctcttccccaagacgtgattttcctgctggtctgagagttctagttgtggatgatgatccaacgtggctcaagatccttgagaagatgctcaaaaagtgcaattatgaagtgactacatgttgtttagcaaggcatgctctaagcttgcttcgtgaaaggaaggatggatatgatatagtgatcagcgatgtaaacatgcccgacatggatggttttaaacttcttgagcatgttgggcttgagatggatcttcctgtcattatgatgtctgtggatggggaaacaagcagggtgatgaaaggtgttcaacatggagcctgtgattatctccttaagcctataaggatgaaagaactgagaaacatatggcagcatgtcttaagaaaaaggatacatgaggccaaagaatttgaaaagctatcagatgatgggaacctgtttgcggtagaagatgttacctcaacaaagaaaagaaaagatgcagataacaaacacgatgacaaagaatgtttggatccatcatccaccaagaaagctagagtagtctggtctgtggatcttcatcagaagtttgttaaagcggtgaatcagattggatttgataaagtggggccgaagaaaatactagatctgatgaatgtcccatggctgactagagagaacgttgctagccacttgcagaaatacaggctttatttgagtaggattcagaaagaaaacgatcagagatcttcctcaagtggattgaagcattcagattttcctttaaaagatatgagaagttttggttttcagaactcagtaaacaaccagcaacaaaacgatgttgccattgacagctacaatcattcggatggatcattacaacttcagaatgtggaaactaaaagtcacgaagcggatcccaagggaattgtttcacagtccaccatagcgaaaaaaggaaggattttgactgaagaaaaccatgcagtatttgattgttccatgccaacaccatacacttggactgaagttccacacatgcaactcaaagaagaacacaagtcaattgttcatttagaagatagcttcaatcagttgccattacatggtaagcagcagcaacacatccaagtggatcaatcacaatcagttgcttcaattagttccgctcccttgataacggaggaagagaatgattatgccaattctgtgagttcaatagggaatgcagttggcacctttcctattcaaccaggaagtcttattatgaatgtagcatttctgatctggaaatttaccaaagcaaccttcttttgggaggacttgcatttctattggctacaaggtgaatgctataataatatgaacttcagtctgcagaatataggaatgtctgaatattatgatccaggacttatttcagaagctccaacacacttatatgattcagctgattactcagttatagatcaaggtctattcatagcatga

SEQ ID NO: 768 - DNA, 1131 bp, Glycine Max
atggatactgaaaccgttgagagaattgatgtgagggataacacagatgatgcaaggagttttagcatggcagtcgacagcgacataaggagtgatactgggtccatttttggagaatctcgtgtccgtagttttgcttcattagtggacagtgccataaggagtagtagtgccagtgaagcagatttgggatcatccccttccccagtgcatgcttttgctgcaccattattcaccctcgctgaacttaaagcagccaccaataatttctcatttgacaacaagattggtaccggaggctttgttgttgagtacagaggcaaactcgttgatggtcgtgaggttgcaatcaagaggggtaaaacctggtcaaactcatttggtaagtctaagtttgccttgttctcccgcttacaccacaagaatttggttgggctggttggattttgtgaagaaaaatatgaaaggctcttggtgtatgagtacatgaagaatgggacgttgtatcatcatttgcatagcaagaagggtagcagtgtgttgaattcatggaaaatgaggatcaaaattgccgtcgctgtttctgagggaatacaatatcttcataactatgcatctattattcacaaaaatatcatgtcttccaatattcttttcgatgctacttggacagcaagagtatctggttttgatttgtggctggtgaatccagaacctgaccgggattaccgaacaatgtggacagtgggaacctttggatatattgatcctgagtactatggtctaaatgtgttgacagcaaagagtgatgtgtatgggcttggagttgtattgcttgaacttttaacgggaaagagagctaaattcaagtatgaggggaaagatttcgtatgcaccccaataaaaagtgtggtggattttgcagtgcctgttattttgaccggagagttagtgaaaattttggatccaagggttggaccacccgatgtgaatgaggctgaggcggtggaactagtggcctatacagccattcattgtgtgaatttgaaagggaaagatagaccaaccatggctgacattgtggccaatttggggagggctttggctatttgtgagagtagccatatatga

SEQ ID NO: 769 - DNA, 459 bp, Glycine Max
atggatcataggcgggttgagtgtgtggtccttgtgtctgatgattctgattttgttgatgtgataaacgaagcaaagatgcgatgtctgaagacggttgtcattggggatattgatgaaggtttcttgaagaggactgctgatactgcattttcttgggaggaaattctgatggggaaagctaaaaagcaggctgtttcggttgtgaaaaactggaaggatcgtgatatcttaaaaaagttggagtggacatacaaccctgatgaggataaaagtaatttcaatctggatgataccgttactgaagcatctgaagatgataatattgaagatactacctgtgatgaagttgatgatgcctataaggatgacagaggttcttggtgggaattagattctgatgatgatgccacaaatagacagtcaggaaaattatctggtttatcggtgaataggtga

SEQ ID NO: 770 - DNA, 372 bp, Glycine Max
atggatccagacgcgttggcaaaggcattcgtggagcactactactccaccttcgacaccaaccgcaacaatctcgccaatctctaccaggaaggttccatgctctctttcgagggtcagaagatccagggctcccacaacatcgtcgccaaactcacctcccttcccttccaacagtgccagcactccatcaccaccgtcgattctcagccctcaggcgtcaacgccgccatgctcgtcttcgtcagcggcaacctccagctcgccggcgaacaacacgccctcaagttcagccaaatgttccatttgataccaacaccacagggaagctattatgtgttgaatgacatattccggttgaactatgcgtga

SEQ ID NO: 771 - DNA, 345 bp, Glycine Max
atggatccagacgcgttggcaaaggcattcgtggagcactactactccaccttcgacaccaaccgcaacaatctcgccaatctctaccaggaaggttccatgctctctttcgagggtcagaagatccagggctcccacaacatcgtcgccaaactcacctcccttcccttccaacagtgccagcactccatcaccaccgtcgattctcagccctcaggcgtcaacgccgccatgctcgtcttcgtcagcggcaacctccagctcgccggcgaacaacacgccctcaagttcagccaaggaagctattatgtgttgaatgacatattccggttgaactatgcgtga

SEQ ID NO: 772 - DNA, 351 bp, Glycine Max
atggatccagacgcgttggcaaaggcattcgtggagcactactactccaccttcgacaccaaccgcaacaatctcgccaatctctaccaggaaggttccatgctctctttcgagggtcagaagatccagggctcccacaacatcgtcgccaaactcacctcccttcccttccaacagtgccagcactccatcaccaccgtcgattctcagccctcaggcgtcaacgccgccatgctcgtcttcgtcagcggcaacctccagctcgccggcgaacaacacgccctcaagttcagccaagtatatgttccatttgataccaacaccacagggaagctattatgtgttgaatga

SEQ ID NO: 773 - DNA, 930 bp, Glycine Max
atggatgtgataaagacgcagcaaatctcatctcgaccaatcgagaaggtggtggttcaccctctcgtgcttctcagcatcgtcgacaactacaacagagtcgccaaagacactcgcaagcgcgtcgtcggcgtcttgctcggctcctccttcaaaggcaccgtcgacgtcaccaacagctacgccgtgccctttgaagaagatgacaaggatcctagcatctggtttcttgaccacaattaccatgaatctatgttttccatgtttaaaagaataaatgcaaaggagcatgttgtggggtggtatagcactggtccaaagctgcgcgaaaatgatcttgacattcacggcttatttaatgactatgttccaaatcctgtcttggttataattgatgttgaacctaaggaattgggaatcccaacaaaagcatattatgccgttgaagaggttaaagagaatgccactcaaaaaagtcaaaaagtgtttgtgcatgtgccatcagagattgctgctcatgaagttgaggaaataggagtggaacacttgcttagagatgtgaaggatacaaccattagcacccttgcaacagaggtaagtgcaaaactcacagctttgaagggtttggatgcaagacttaaagagatcaggagttaccttgaccttgttattgatggaaagcttccattaaaccatgagatcctgtaccatctgcaggatgtgtttaacctgctaccaaatcttaatgttgctgatcttatcaaggctttcgcagtgaaaaccaatgatatgatgctggtaatatacctctcgtctctcattagaagtgtaatagcactccacaacttgattaacaacaagatgcttaacaaggaacatgaacgggcagaagactcgaaaacagttacagtgccaagtgcagctgcataa

SEQ ID NO: 774 - DNA, 2295 bp, Glycine Max
atggatgttgttgaggctgaagaaagtttttttgcagcaagcgatgccaagttacatggagaaatgtgcaagtgtctttttgcaatatattgcaagatattgtcattatttccttctttagaagctgctaggcctaggagcaaatctggaattcaggcattatgttcattgcatgtagccttagaaaaggcaaagaatgttcttcagcactgctcagagtgtagtaaactttacttggctataactggggattctgttctgctaaaatttgagaaggctaaatgtgctctcgaggacagtcttaaacgggtggaagatattgttcctcaatctattggttgtcagattgaggaaattgtgaaagaacttgcaagtacggtatttgcacttgacccatcagagaagcaagttggggatgatttaattgcattgcttcagcagggaagaaagtttagtgactctaatgatagtaatgaacttgaatgttttcatctggctgctactagacttggaatcacttcttcaagaacagctcttacagaaagaagagctctaaaaaaactcatagaaagggctcgtgctgaggaagacaagcggaaagaatcaattattgcttttcttttacaccttatgaggaaatattccaagttatttagaagtgagttctctgatgataatgattctcagggttctcaaccttgttctcccactgttcagagatctcttgaggatggcattcccggtggtcattgtcatgcctttgacagacagctttcaaaacttagttcctttaattttaagccaaataataggaaatcagggcagatgctccttccgccagaagagttaaggtgcccaatatctctgcaacttatgagtgatcctgttataattgcttctgggcaaacatatgaaaggatttgtatagagaaatggttcagagatgggcacaacacctgcccaaagactcaacagaaactttcacatctttgtttgactcctaattactgtgttaagggtcttgtggctagttggtgtgaacagaatggagttcctattcctgaaggccctcctgaatctcttgattttaactactggaggttggcattatcagacactgaatccacaaattcaagatccgtaaacagtgtcagctcttgcaagttgaagggtgtcaaagttgttcctgtagaagagagtggtatctcagagcaaacagggggaaatgcaactgaaagtttttctgcacaagaggaagataatgaacggtatcttagttttcttaaagtcttgacagaaggaaacaattggaagaggaagtgtagagtggttgaacagttgaggctgttgctgcgggatgatgaggaagccaggatttttatgggcaccaatggatttgttgaagcacttatgcagtttctgcaatcagctgtgcttgaagcgaatgtgatggctcttgaaaatggagctatggctctgttcaacttggctgtgaataacaatagaaataaggaaattatgatagcaacaggaatcttgtcgttgttggaggaaatgatttcaaaaactagttcctatggttgtgcagttgccctgtatctgaatctttcttgcctcgatgaagccaagcatgtgattggcacaagtcaggctgtccagttcctaatccagattcttcaagacaagacagaagtgcagtgcaagatagattccctccatgcactctataacctttctactgtgccctccaatattccaaacctcctttcatctggcatcatttgtagcctacaatcccttcttgtaggccagggtgattgcatgtggacagaaaaatgcatagctgttttgataaatttggcggtttctcatgtgggaagagagaaattgatgttggctcctggacttataagtgccttggcttccactctagacactggtgagcccatagagcaggagcaagctgcttcttgtctcctaattttgtgtaacaggagtgaggaatgttgtgagatggtcctgcaagaaggggttatacctgcattggtgtcaatatcggtgaatgggacctcgagaggaagagagaaggctcagaagctcttgatggtcttccgagagcagcgacaacaagaccattcacctgttaagactgatcaacgtgaatccgaaagtagtgatttgtctatgcctcctcctgaaaccaaactgctatctaaatcaatatctagaagaaaggtggggaaagctttcagctttctctggaaaagcaagagctattctgtttaccagtgttaa

SEQ ID NO: 775 - DNA, 1770 bp, Glycine Max
atggattccgagttccccaacaaagcgttaacaagcgtgcgtttttccgacctgaatccgccactctctgaaccggttctccaagccctatcacactccggcttcgacttctgcacccccgtccaagccgccaccattcccttgctctgcagtttcaaggacgtcgccgtcgacgccgccaccggttccggcaaaaccctagcttttgtcattcctctcgtcgagattctacgtcgctcctcttctcatcccaagcctcacaaggtgctaggaataattatatcccctacaagggagctatcaactcaaatatatcatgttgcacagtccttcatttcaacattgatgaatgttaagtccatgctcctcgttggtggagcagaagtaaaaacagacataaagaaaatagaggaggaaggagcaaacatattgattggcacgcccggacggctatatgacataatgaatcggatggatgttttggatcttaaaaaccttgagattttgattttggatgaggctgatagactcttagatatgggattccagaagcagataacttctattatatctctcttgcctaagcttcggagaactggtctgttctctgctactcaaactgaggctattgaagagcttgctaaggcaggattgaggaaccctgtgagggttgaagttcgagcagaaacaaaatcagaaaagggtcccgcatcatcaaaacaaccagaatcttccaaaacaccttcaggacttcacattgagtacttggaatgcgaggaagataagaagccatcacagctactagatatccttattaagaatcgctcaaaaaaaattataatatatttcatgacttgtgcatgcgttgattattggggagctgtccttccttgtctttctgttttgaaaggcttctccttgattcccctacatgggaagatgaagcagtctgccagggagaaagcactagcttcatttacaaccctttcaaatggaattcttctatgtacagatgttgctgcacgtggacttgacataccgggtgtagattgtatagtgcagtatgatcctcctcaagatccaaacgttttcatacatagagtaggtcgaactgctcggctgggtaaacaaggtcatgctgttgtcttcttattaccaaaggaggaatcttatgtagaattcctgcgtataagaagagttccccttcaagagagaatatgttctgatgatgctaccgatgttgttcctcagattcgttctgccgcaaaaaaagatcgtgatgtcatggaaaagggaattaaggcttttgtttcttacatccgtgcttataaagagcatcactgttcctatatttttaggtggaaagaacttgaaattggtaaattggctacgggatttggcttattacaacttccttcaatgccggaggtaaagcaccactcactttccacggatggatttgagccagttgaagatatcaatttggtggacattaagtacagggataaatcacgggagaaacaaaggaagaagaacctgcaagcaaagaaagaagccaaagagagagagccaaaacctcaaaaaccgaagaaaaccccaattgcacccactgccacgcggaagaaaacagcccgacagagacgtgctcagcagacaatggaagacgaggaagagttgatgcaggaataccgcttattgaagaaattgaagaaagggaccatagatgagaacgaatatgccaagttgacaggtactgaggaattactgtga

SEQ ID NO: 776 - DNA, 171 bp, Glycine Max
atggattccggcatgtcctgggctgatcaatgggacaacaacccagacccttctcctgcatcagacaaagacaagaagggaaaggatggctcaggcaagaacaataaatttgggaagactatgctgagcttcaaatgggtgaaagaactccgcaagaaaactcaaaagtga

SEQ ID NO: 777 - DNA, 855 bp, Glycine Max
atggattgttgtgtgtgtacaactatgccattgatattaaggcctccgaggaatacaatatgtggggcttgttacgaaggagttaggagcataatcaacatgatgagcaatgttgaaagtgagaaagtaaaggcaatggctaatccaaatcaaaatagttctccagtttcgcggcgaaattcgattgaaaacttaatcgatttaccattaatgtttcccatgcatgacaccaagatacttgatgattgtattagatggtgttcagaacagacggagcagtttaatcaacaaaaagaagacatggttttcctcagaggctttgttgcagccttcaaagcacagattcacacggatatattggtcagtccaggcaggaacggtccacctatacctgcacataagtccgttttggcagcaagatcagaaatatttaagaacatgctagagtgcgatgaatgcaaggcagcaccaagtaacgccataactatacccgatttgaaccatgaagaactagagtctctccttgagtttctgtacagtgggacattgaatgtggaaaaattggagaaacatgtctacgctttgtcacaagcagctgataagtatgtgattccacatttgctgaaacactgcgaacgatatctgctgagttcactaagcacttccaatgctcttgagacactagaaattgcggatacttgttccaaccacaacttgaaggagacaaccttgaacttcttagttaaaaacattgagcacatggtgtcctcacctaaatttgaagcttttgtccataggagcccacatcttactgtgcaactagttacaagggcgtttgtgaatggtgccaaataa

SEQ ID NO: 778 - DNA, 711 bp, Glycine Max
atggcaaagactgagttagaggtgactgttgagagcaagaacaaagaactaaagcacctgggatttgtgaggattgctgctattcaaacttttgtgattgtgtcaaatctgtatgagtacgcaaagcagaattctgggcctttgagatccgctgttggaacggttgagaacactgtaaccaccgttcttggtcctgtctgcaacaaattcaaggacttccctgatgatgtcctggtttatgttgacaaaaaggtggatgaagcttcccacaagttcgatgagcatgctccttcctttgccaagcaccttgcggatcaagccaagggtgtgattcagaaagtgacttgtgaggcagggaaagttgcaagtgaagctcaatctggggggtcaagagctgctgttcattttgttgctacagagtcaaagcattttgtgttgataaattcggtgaagttgtggaatggactcacccactatccaccattccatgcattggcagagatagcagttcccactgctgctcactggtcagagaagtacaaccatgtgatcaaggccatgactcaaaagggttatagtttcatcgggtatctacctttgattcccgttgaagagatagccaaggcattcaaacagggagaggcgaacttaaaaggagataatgcagcctctgaggaacaaagattagaatctgcatctgattctgattaa

SEQ ID NO: 779 - DNA, 225 bp, Glycine Max
atggcaaatgttgtggaagtgaaagtcggtttgcactgtgaagattgtatcaagaaaatcctcaaggccatcaagaaaattgaagatattgaaacgtataacgtggacacacagctgaacaaggtcatggttacgggaaacgtcacaacagaacaagtgatcagagtccttcaaaagattggcaagaatgcaactgcctgggaagatgctgaaaccaataagtga

SEQ ID NO: 780 - DNA, 963 bp, Glycine Max
atggcaaggaaactgacgaaagcgcagaagaagatagcatacgatgcgaagctgtgcaagcttctggacaattacacccaaattcttgtggtggctgcggacaacgtcggatccaaccagcttcagaacattcgacacggtctacgtggcgactcggtgattctcatgggaaagaacaccatgatgaagcgcagtattaagatccacgcccagaacaccggcgacaccaccatcctcaaccttattccccttctagtcggtaacgtggggttgattttcaccaaaggtgacgtcaaggaggttaaggaagtggtttccaagtacaaggtggcagctcctgctcgtgtaggtttagttgcacctattgatgttattgttcccccaggcaacacagggctggatccctctcagacctctttctttcaggtgcttaacatccctaccaagattaataagggtactgtggaaattgtcacccctgtagaactcattatgaagggagacaaggttggctcttccgaagccgtattgctttccaagcttgcgataaggcctttctcatatgggcttgctgttgtttctgtttatgacaatggttcagtttttagccccgaggttcttgatctcactgaagatgacctcgttgtcaagtttgcagagggtgtctgtatggtgtcttcactttcattggctatctcgtacccatccattgcagctgctccacacatgtttgtcaattcctataagaacatcctggctgttgcagtggcaacagaatattcgttccccgaggcagacaaggttaaggagtacttgaaggatcctagtaaatttgctgtagcggttgttgccgcacctgctactaaatctggcgctgctccagcggctgcatccaaggtggaggaaaagaaggaagaagcagatgaatctgatgacgacatgggcttcagtttgtttgattaa

SEQ ID NO: 781 - DNA, 777 bp, Glycine Max
atggcaatgattccgtaccacctttgccgtttaccttaccaggattccctcaaagcacttgaagctgatatacagcacgccaatgctttggctgctgcaattcccagagccaagggtggaactcttcttcaaatgaaattggtttacaatcacttggctcctctcttcctgttatttctacaatggatggattgttcttgtgcaggctttctccataggtatctcaacctcttccacatacttgtatacaaggtacataatgatggtagatcaatcatgtctactcatggaaggaaggctaccattggtgacttttatgccgttatattgccatctctccaacggcttcatggtagtttggagaagttggaggttgttgaagaagaagaaggacagtcaagcatagaaggtccaagttatggcaagaaggtcattgaaggtgtgaaactaaccaccaatgttgatttgcaaagagaagatgaatgtggtatttgcttagagccttgcaccaaaatggttttacctggttgctgccatgccatgtgtattaaatgctaccgcaagtggaacagaaagtcagagtcttgtcctttttgccgtggtagcttgaggagagttaattcggaggatctatgggtattaacttgtaatgatgatgttgttgatgctgaaacagtttctaaggaggatttgttgcggttttacctctatatcagcaagcttcctaaagatcacccagatgcacttttcctaatgtattatgaatacctcatttaa

SEQ ID NO: 782 - DNA, 708 bp, Glycine Max
atggcacatactttatccactaatctggctcttaaccttcccacatcgaggtatgttcgtccctcgagaccaacccaggtgaagcccatgaaggtcatgatgggtgatgcaagagaaaagctagaacatgtccatgtgcctaaacacaacaagcaccaccagcccctccccaaaaacaaagttgctcctaccccacccgtagggttgtgggatcgatttcctacggcaaggacagtgcaagagatgatggagacgatggagagaatgatggaggacccttttgcatttagcacacttgagtggccttcatcaccccttccaagtgagggagtgggagggtatcgaagaaggggaagggcaccatgggaaattaaagagtgtgagagtgaatacaagatgaggtttgatatgcctgggatgaacaaggaggatgtgaaggtgtgggtggaggagaagatgcttgtggtcaaggctgagaaggcacaaaagaagaagcaagagaatgagattgtggaattacaacaagaaaagcagcaagaagaggaggaatggtctgctaagagttatggtaggtatagcagtaggattgctttgcctgataatgtgcagtttgagaatattaaggcagaggttaaggatggtatgctttacataaccatacccaaggctaccagctactccaacatccttgatatccaagttcaatga

SEQ ID NO: 783 - DNA, 819 bp, Glycine Max
atggcagatgcagcgaagggtacctacagagcctcaagatggtcccttaacggaatgactgctcttgtgaccggtggaactcgtggaattgggcatgccatagtggaggacttatgtgggtttggtgccactgtccacacttgttccagaaaccaagctgaattggataagtgtttgacagaatggcgtagcaaaggttttttggtttctgggtctgtgtgtgatgtctcatctcaaccccacagagagaagttcattcaggaagtcacttccatcttcaatggcaagcttaacatctatgtgaacaatgttggagtaaactataggaagcccacaattgagtacactgctgaagtatattcacaaattatggcagtcaatttagactctgcttaccatctgtgccaacttgcatatcctcttctgaaagcatctggaatgggaagcattgtgttcatttcatctattgctggagtggtcagcttaggtactggatctgtctatgcagcatgtaaagctgcaaccaatcagcttacgaaatatcttgcttgtgaatgggctaaagacaacataaggagcaattgtgttgttcctgccactaccaatacaccacttgttgaacatctgcttcgcaacaagaagtatgtagaagaaatgttatctcgaactcctcttgggcgcatcgcagaacctgaagaagtttctgccttggtggcttacctttgtctgccagctgcctcttacatcacaggacaggttgttcttgttgatggaggattatcagttaatggatttcaaaccagcatgagaataacatga

SEQ ID NO: 784 - DNA, 594 bp, Glycine Max
atggcagcaaccatagcaacaacaatggctatgatcaactcaaagtgcatcaacacaacagggtcatcacacaagttgcacaaccccaagctcccaccctcaaaacccaccctctcccttttctcccttcagaacctcccaaagggcctaacctcccacgtctcaacttccacagcaggcactgccatcgcaggcgcaatattctcctcactcgcaaactgcgacgcagccttagctgcatcgcaaattgctgaattagccgaaggtgataaccgcgggctggcattgttgttgccgttgattccagccatagcgtgggtgctgttcaacattctgcagccagcactgaaccaactgaaccgcatgcgtaacagcaagggggtcatcgttgggctcgggctagggctctgtgcatcgggcatgatgtccggcccagaagcgtcggctagtgagattgctatgattgccgatgctgctgccagtgacaacaggggacagcttctgctgtttgtggttacaccagcgattgtttgggttctgtacaacattttgcaaccggcactcaaccagcttaacagaatgagatccgagtag

SEQ ID NO: 785 - DNA, 1632 bp, Glycine Max
atggcagctctgttaccttgcgcgccgaacatagtctatggtccgttgttggggaaccggagcacgagccacctcccgcaccgacctcactcccatgctttctccggttcgaccaccagacactttcttcgcggttcgcttaccgtcgcccggttcggattcaaacccgatttcttgcccgagccggatgaagctgaaggcgttctcagagaactgttcggccgagcggagggacttctttacacgattgccgatgccgccgtttcttcgtcttcttcttcttcttccgatacggttgcggcttcctatgccgccaaacagagcaacgattggctttccggaattgccaattacatggagacggttctcaaggtactcaaggacgggctttctgctttgcatgtcccgtatgcttatggttttgcaattatactgctcacggttcttgtaaaagctgccacttttccattaaccaaaaaacaggtagaatcttccttagctatgcgaactttgcaaccacaagtaaaggccatccagcagcgttatgctggtgatcaggagagaattcaactcgaaactgctcggttgtataaactagccaacattaatcctctagcaggatgcctgcctacactcgcaacaataccagtgtggattgggctatatcgagccctttcaagtgtggcagatgaggggctccttactgaaggcttcttctggataccttcccttgctggtccaactacagttgcagctcgtcagaatggcagtggtatctcttggctttttcctttcgtggatggtcaccctcccctcggatggtcagatacattggcttacctggtcttgcctgtgttgctggtcgtctctcagtacatctctgtccaaataatgcagtcatcacagcctaatgatcccaacatgaaaagttctcaagccttgaccaatttccttccattaatgattggttactttgctctctcagttccttctggtcttagcctttactggttaacaaataatatattgagcactgcacaacaagtatggcttcaaaagttaggaggtgctaaaaatcctgtgaggcaagtcccagatgatatcatgaagaatgacctaacacaggttcagaagtcaatgtctaaactaaattccacaacagcggaagaagccagactaagtgagaaaacatcagaggggccacaacctggtgaaagatttaagctaataaaagagcaagaggcaagaagaaaacaacaaagagaagaagaagaagaaaaaaggaaagccttggaagcagcagctagagaaactaaagtagacaagacacttgaggaaacagttgaagtggagaatcaaactggaggtgatttagttgttgaaaaatctcggtctttggcttcagatactgatccctccatatctggagtagtaaatggtaatccattaagtaaagacttggagggaaatcagaattctacatctacatctgagacagaaaataatgaaggttctgctcatttcaacaatgttgagataaacgagaaaattttagacaaggaaccaagagaagtattaacaactacaaccaccacaaacaaacaacctcctgcggaagagacaaaggattga

SEQ ID NO: 786 - DNA, 1023 bp, Glycine Max
atggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgagaagcccgtcaccgtttttggattcaggaaccctgaggaaattccatggggtgaggttggtgctgattatgttgttgagtcaactggcgtattcactgacaaggacaaggctgctgctcacttgaagggtggtgccaagaaggttgtcatctctgccccaagcaaagatgcacccatgtttgttgttggtgttaacgagaaggagtacaagccagagcttgacattgtttctaatgctagctgcactaccaattgccttgctcccctcgccaaggttatcaacgaccgatttggaattgtggagggtcttatgaccactgttcacgccatcacagctactcagaagactgttgatggtccttcaaacaaggactggagaggtggaagagctgcttcgttcaatataattcctagcagcactggagctgctaaggctgtaggaaaagttcttccagcgctgaatggtaaattgactggaatgtccttccgagtccccactgttgatgtttcagttgttgacctaactgtcaggctagagaagccagcaacctatgagcaaatcaaagctgctatcaaggaggaatcagagggcaaactgaagggtattttgggatacaccgaagatgatgttgtgtctactgattttgttggtgataacaggtctagcatatttgacgccaaggccggaatttctttgaatgaaaactttgtaaaacttgtttcctggtatgacaacgaatggggttacagttcccgtgtgattgatttaattgcccacattgcatccgtggcttaa

SEQ ID NO: 787 - DNA, 1194 bp, Glycine Max
atggcatgtgtattacccttctctctctctccctctttctctgttgggtcactcacattattaaaaataaccaccctcacacttcccaacgcttccttaaccatgagccacgccggcctctggcttccgccgcagttcctcgccggagaccctgacacaaccctttcgaactccgatttcagcttcccttccgagttcccctacgagttcggattgtcttctccggagagcagcgacgacggcgaagaggacttcttcgccggcctcagtcgccgactcggtcagacctcgcttcacgaaactcgcaagcaactctcatccactgtttcggagattccaaggaaaactcagggtttggtcggttcccctcagtccacgctcgccggaataggaagctggtccggtcggagcgccgtttccggcgacggaagccccaacgggtactcgcgtgtcccttcgccctcgacgacgccgtttgacgaaaacaacgacccctgggaagtgatttacgcagccgcagttcaaatcgcaaggatgaagatgaacaacaacaacaaccgagttccagcacagtatgattttcacaataatagaaggttactcactcatcattgccctaaccggagtttcaatcaggtcgtgagagcgaagcaacagtgtggttcggattggggaaggccaaccaagcctaataactatttggttcagcagcaacaggttaaggttcagagtagagcgcgtgagtttgggcacgagagtgtgaatgcgaaatgcactcgtccatctgcgtggcccccttcgcaagttcagcagcaaaacaaccgggtacagtttggcggatccgggtctagggttggtggatcttctgtgaaaagggggtgtggtggaactggggtgttcttgcctcgccattatgaaaccccttctgagccacgtcgccagaaaactggttgtgcgcctgttttgttaccagcaaaggtggttcatgctttgaacttgaatattgatgacttgaatgggactacccaaccgcgtttctcgaatgcttttgctacggattatgaagcgattttagcgaggagaaacgcgcttctcatgcaggagcagcagcagcagcagcagaggttaataagtgttcggcgagaagaggcagccaactatgaaattcgccttcctcaagagtggacttactga

SEQ ID NO: 788 - DNA, 1125 bp, Glycine Max
atggcattttcattcacatttctgttccagttcttgcttcttgccccatctgtgatctatgcttctccagttcaagaccctgaattagtggtccaggaagtgcaaaagagcatcaatggatcaaggagaaacttggggtatctttcttgtggaacagggaaccccattgatgattgttggaggtgtgaccctaattgggaaagaaaccgcaagcgtttagctagttgtgcaattgggtttggtaagcatgccataggtggaaaagatggaaaaatatatgtggtgactgactctagtgataaccctctacacaaggatctcttagttaattcttacaaacccattgatggaagaggagcaaccatccacattgctggaggaggaccttgcattagagtgcacaagaagaccaatatcataatccatggcatacacatccatgattgcaaaaggggtggcagtggttatgtgagtgactctcctaaccatcgtagctggagtgcgagatcggatggtgatgggatcacaatctttggtgggagtcatatttgggtggaccattgctccttgtcaaactgttttgatggcctcattgatgttgttcatggctcaacggccatcaccatttccaacaattacatgatacaccataacaaggtcatgctcttgggacacagtgattcctataaagctgacaagaatatgcaagtcaccattgccttcaaccattttggagaagggcttggaggaagaatgccgagatgcaggtttggatatttccatgttgtgaacaatgattacacacattggcaacattatgcaataggtgggagttcatccccaactattttcagccaaggcaatagatttgttgctccaaatgatgatgaccacaaagaggtgaccaaacattttaaatcatcaaagagtgagtggaggaaatggaattggaggtctgaaggagatgtaatgttgaatggtgccttcttcacgccgtccggagcgggggcaactgctaggtatgataaagcgtcaagcatggcagcacgaccacctatgcttttgtcttacatgacagctggggctggagcgcttagatgcaacaagggcaatctatgccactag

SEQ ID NO: 789 - DNA, 1293 bp, Glycine Max
atggccaatgcactacataacgctgccatctccagagtcatgtttggagaccaatattccatttctcgttgcgtggttccatccctatccactcttcctctcagagccatgcacaaaggaaaacacgttgagctgaacagaacggttatggtggtaaaggcaaagactaatagtgattttgatgactcagacgttgacatttctttgagccacagagttaatgctgtgaaactttccaaaactctatccatatgtgatcatgccactgctcttttacaagctggagttcccgttattcgcctatttttcggagaatctgatttcgacacacctggtgctatagctgaggctgggatgaatgcaattcgtgaaggttacacgagatatacccccaatgctggaacattagaattgcgccaagcaatttgtcataagctaaaagaggagaatggaattacgtattctcctgatcagattgtggtcagtaatggagccaagcaaagtattgttcaagcagtgcttgcagttattattccagctccattctatgtgagttacccagaaatggcaagattggctcatgcaacacctgtgattcttccaagccacatatctagtaactttcttttggattccaaactgcttgaagccaaccttaccgaaagatccagactgcttattctttgttcaccgtgtaaccccacaggatctgtctactcgaagaaattacttgaagagatagcccaaattgtagcaaagcaccccaggcttctggttctctctgatgaaaattatgaacacataatttatgcaccggcaactcatacaagctttgcatcgttaccgggaatgtgggacagaactctaattgtgaatggactttccaagacatttgcaatgactggttggcggcttgggtatattgctggtccaaaacattttgttgctgcatgtgaaaagattcaaagccagtttacttcaggggcaagtagtatatctcagaaagctggggttgctgcattgggactaggctatgcaggtggggaagctgtttctaccatggtgaaagctttcagggaaagaagggatttcttggttgaaagctttagagaaatggatggtgtgaaaatatgtgaaccacaggggggattttatgtattccttgatttcagctcttattatggaagagaagccgaagggttcggtgtaattgagaattctgactccctctgtcgatacctgctggacaagggcctggttgccttggtgccgggggagtgcatttggagatga

SEQ ID NO: 790 - DNA, 849 bp, Glycine Max
atggccactgccaccgccgccgccgccacgtcatactttttcggcacccgtctcaacaacgttaacacgacaaccttaaacaacggaagattccacgcgctcttgaacttcggcaaaaagaagacggcgccgcagccgccgccgaagaaaaaggaagtgaaagtgaaaccctccggagaccggctggtgtggttcccgaatgcggagccgccggagtggctcgatggaagcatgatcggcgaccgcgggttcgacccgttcgggttcgcgaagcccgcggagtacctgcagttcgacctggactcgctggaccagaacctcgcgaagaacatcgccggcgatgtgatcggaaccagggtggaggtcgccgaggttaagccgacgccgtttcagccctactcggaggttttcgggattcagaggttccgtgagtgcgaactcattcatggaaggtgggcaatgctgggttctctcggtgctttggccgttgaggctctcacgggagtcgcatggcaagacgccggaaaggtagagctagtggaaggatcatcttacctgggacttcctcttccattttcattgaccacactgatctggattgaggtgatagtgatagggtacatagagtttcaaagaaatgcagaacttgacccagagaaaaggttgtacccaggtggcaggttctttgatcctctgggtttggccaacgaccctgaagaaaaagccagacttcaacttgctgagatcaagcattctcgcttagccatggtggtcttcctcatctttgcaattcaagctgctgtgacaggaaaaggcccaatcagttttcttgctaccttcaacaagtga

SEQ ID NO: 791 - DNA, 1623 bp, Glycine Max
atggccagtcacaactacaaagtcttcagctgcttcaacaggaagttcaccgtcaccgagccgggcccaccgcccgacgtagaaagagcgttttctgaattcgccgccggcgcctcctccctgtccggcgatcacatcctccggtttctggcggagcaccagggcgatgtggactgcaccgcagcggattcggagcggatgctccagcaatcgcggaaagaggatcgggaaagtggaatggatctccacgacttcttccgtttcctgctacatgacgatttcaatagccccatcaaatctcaggtacatcatgatatgaatgctccattgtcacattatttcatatatactgggcacaattcctatcttactgggaatcaactgagcagtgactgcagtgatgtaccaatcataaaggctttgcaaggaggtgtaagagtaattgaactagatttatggccaaattcagacaaagatgatatcgaagtagttcatggaaggactcttacgactcctgtctcactcatccaatgtttgaagtccataaaagagtatgcttttgttaaatctcactacccactcattataactttagaagatcaccttactccagatcttcaagctaaagctgcagagatggcaactcaagtatttggagaattgctttattatcctcagacagattctctgatggaattcccctcaccggaatcattgaaaggtcgaattcttatatcaacaaaaccaccaaaagaatttcttgaatccaaagaatgtgatgacaaggacaacgaaaaggaatcagccgacgagagtgcacctgagtacaaacgattgattacaatccatgctgggaaaccaaagggtgatattcaggatgaattaaaagctgctggtgctgttaggcgcttaagcttgagtgaacaagcacttgaaaaggcttctgaatcttatggagctgatattgttaggtttacgcagaacaatattctcagagtatatccaaagggaacacgtctcaattcctcaaattacaagccacacatagggtggacatacggagctcagatggttgcgttcaacatgcaggggtatggaaaatcacttcggtacatgcaaggaatgtttagagcaaatggagggtgcggttatgtgaaaaagcctgaatttctaattgaaaaaggtccatataatgaggtttttgatcctaaaagaacattgcccgtgaagaaaacattaaaggtaaaagtctatatggggaccggttggagcttagatttcagccaaacagacttcgatacttactcaccacccgacttttacgttaaggtttgtattgttggagttccagctgatatggccaagaagaaaacatgtgtaatttcaaataactggtttcctgtctgggatgaacagtttgatttccctttgactgttccagagctggctttgctccgcatagaagttcgagagaatgacaagagtcaaaaggatgactttggtggacagacgtgtttgcctgtctcagagctaaaatctggattccgatcagtccctctgtatgatgaaaagggtgacaaattaaagtctgtgaagcttctaatgcggtttcagtttagatga

SEQ ID NO: 792 - DNA, 972 bp, Glycine Max
atggccgatcactcagattcttctcctctcgttcctccccttcccctcaccgacccttctgagatcgacctcgaagctggtccctccgaacaaatccagtgccgaatttgtctcgaaactgacggtagagatttcatagccccttgtaagtgcaaaggtacatcaaaatatgtgcatcgagaatgtttggatcattggcgagcaattaaggaagggtttgcctttgctcactgcactacatgcaaggctccttatcatttgcgtgtccatgttgctgctgataggaaatggcgtaccctgaaatttcgattttttgtcaccagagacatgttgtttatttttctgtctgtccagcttgtcattgcttcactgtcatatttggtttatctaatagatggttaccagcagtattggcttcgtcttctctggggttttgatagtgaaatgagcttttactacatatgtggagctctattgttttttgccttgcttggcctctctgggtgcttcattacctgttatgatcgaagagttcgcaatgatttagctcagccttgtagagaattatgtctttgttgctgtcaacctggagtttgtgcagactgtcatttgccaggcactctttgtatgtggactgattgcaccacatgctttgagagttgtggaaccatggcaactgaatgtggtggttgtttggggggtgctggggaagctgggctaccactattattcattatggctttgattgttctgggactttttactgtaattgggatattctacagtgtattggttgctaccatggtaggtcaacggatatggcaacgtcattatcacatacttgcaaaaaggatgttaacaaaggagtatgtggttgaagacgctgatggagagctgactggatcggattggtctcccccggctctcccacccgaacatgttcagcagttgaaaacattgggcctactatga

SEQ ID NO: 793 - DNA, 870 bp, Glycine Max
atggccgatcagttatccaaaggagaggaattcgagaagaaagctgagaagaagctcagcggttggggcttgtttggctccaagtacgaagatgccgccgatctctttgataaagccgccaattgcttcaagctcgccaaatcatgggacaaagctggagcgacatacctgaagttggcaagttgtcatttgaagttggaaagcaagcatgaagctgcacaggcccatgttgatgctgcacatagctataaaaaaactaatataaacgagtctgtatcttgcttagaccaagccgtaaatcttttctgtgacattggaagactatctatggctgctagatatttaaaggaaattgctgaattgtatgagggtgaacagaatattgagcaggctcttgtttactatgaaaaatcagctgatttttttcaaaatgaagaagtgacaacttctgcaaaccaatgcaaacaaaaagttgcccagtttgctgctcagctagaacaatatcagaagtcgattgagatttacgaagagatagctcgccaatccctcaacaataatttgctgaagtatggagttaaaggacacctgcttaatgctggcatctgccaactctgtaaaggggatgttattgctgtaaccaatgcattagaacgatatcaggaactggatccaacattttcgggaacacgtgaatatagatttttggcggacattgctgctgcaattgatgaagaagatgttgcgaagtttactgatgttgtcaaggaatttgatagcatgacccctctggattcttggaagaccacacttcttttgagggtgaaggaaaagctgaaagccaaagaacttgaggaggatgatcttacttaa

SEQ ID NO: 794 - DNA, 270 bp, Glycine Max
atggccgccaacagatggttgaaacctgaggtatacccactcttcgcttcagttggtgtggctgttggaatctgcggtatgcaacttgttaggaatataaccaccaatcctgaagtcagggtgaccaaacagaacagaactgcaggaattcttgagaattttgcagagggagagaaatattcacaacatagcctgaggaagtatgttcgcggcaagcagcctcagattatgccatccgtcaacaacttcttctctgatccatcaaactaa

SEQ ID NO: 795 - DNA, 843 bp, Glycine Max
atggccgcgagcgatcgcacagtgttgcaattctcttcatcatcttcttcttcgcagagcttgtccgcgaaggtccaccctctggtcatcttcaacatctgtgattgctacgttcgacgccctgaccaagccgatcgtgtcatcggaaccctactcggctccgtccttcccgatggaaccgtcgatatccgcaattcctatgctgttcctcacaacgaatctatcgaacaggttgcgttggatatagagtaccaccacaatatgttaatatcccaccaaaaagtgaatccaaaggaaatcatagtaggatggtattcaaccggtcttggagtaacaggtggtagtgcattaattcacgagttttattctcgagaagtccccaatcccatacacttgacggttgatacaggatttacaaatggagcgggtactattaaagcatatgtgtctaacaatttatctcttggagaacggcaaattgctgcacagtttcaagaaattccattggatcttcgtatggtggaagctgagcgaattggatttgacaaaattccctcagatttagaagggatggaagcatcaatgcaacatctgctagtcttgattgatgacatctacaaatatgttaacgatgttgtggaagggctagttgcaccagacaacaaaatcgggagatttatatcagatgctgtaggttcccttcccaaattgtccccatcagtttttgataagcttgtgaatgacagtttgcaggatcacttgcttttgctgtatttatctagtattacaagaacgcagcttagcttggctgaaaaattgaacacagctgctcagattctgtga

SEQ ID NO: 796 - DNA, 867 bp, Glycine Max
atggccgcgagcgatcgcacagtgttgcaattctcttcatcatcttcttcttcgcagagcttgtccgcgaaggtccaccctctggtcatcttcaacatctgtgattgctacgttcgacgccctgaccaagccgatcgtgtcatcggaaccctactcggctccgtccttcccgatggaaccgtcgatatccgcaattcctatgctgttcctcacaacgaatctatcgaacaggttgcgttggatatagagtaccaccacaatatgttaatatcccaccaaaaagtgaatccaaaggaaatcatagtaggatggtattcaaccggtcttggagtaacaggtggtagtgcattaattcacgagttttattctcgagaagtccccaatcccatacacttgacggttgatacaggatttacaaatggagcgggtactattaaagcatatgtgtctaacaatttatctcttggagaacggcaaattgctgcacagtttcaagaaattccattggatcttcgtatggtggaagctgagcgaattggatttgatatgctgaaggcaaccgcagttgacaaaattccctcagatttagaagggatggaagcatcaatgcaacatctgctagtcttgattgatgacatctacaaatatgttaacgatgttgtggaagggctagttgcaccagacaacaaaatcgggagatttatatcagatgctgtaggttcccttcccaaattgtccccatcagtttttgataagcttgtgaatgacagtttgcaggatcacttgcttttgctgtatttatctagtattacaagaacgcagcttagcttggctgaaaaattgaacacagctgctcagattctgtga

SEQ ID NO: 797 - DNA, 1713 bp, Glycine Max
atggccgcgtgtggctatatatctgctgccaacttcaatcatcttgttggcgccagaaacttatccaaattcagttcttcggatgccacaatttcgttatcatttggcgggagcgattcaatgggtcttagtttgcgacccgctccaattcgtgctcctaagaggaaccatttctctcccttgcgtgtcgtttgcgtcgattatcctcgaccggagctcgaaaacactgttaatttcgtcgaagctgcttacttgtcttccaccttccgtgcttctccgcgtccactaaaacccttgaacatcgttattgctggcgcaggattggctggtttatcaactgcaaaatatttggctgatgctgggcataaacctatattgctggaagcaagagacgttctaggtggaaaggttgctgcatggaaagacaaggatggagactggtatgagacaggtctacacatcttctttggggcttaccctaatgtacagaacttatttggagaacttggcattaatgatcggttacaatggaaggagcattctatgatttttgctatgccaaataagcctggagagtttagtcgatttgattttcccgatgtccttcccgccccattaaatggaatatgggcaatattgaggaacaatgagatgctgacctggccagagaaagtcaaatttgcaattgggcttctaccagctatgcttggtggacagccatatgttgaggctcaagatggtctttcagttcaagaatggatgaaaaagcagggcgtacctgagcgagtaaccgatgaggtgttcatagcaatgtcgaaggcactaaacttcatcaatcctgatgaactttcaatgcaatgtatattgattgctttaaaccgatttcttcaggagaaacatggttctaagatggcctttttggatggcaatccccctgaaagactttgtatgccgatagttgatcatattcagtccttgggtggtgaagttcatctaaattcgcgcattcaaaaaattgagctaaatgatgatggaacggtgaagagcttcttactaaataatgggaaagtgatggaaggagatgcttatgtgtttgcaacacctgtggatattctgaagcttcttctaccagacaactggaaagggattccgtatttccagagactggataaattagttggagtcccagtcataaatgttcacatatggtttgacagaaaactgaagaacacatatgatcaccttctctttagcagaagtccccttctaagtgtatatgctgatatgtcagtaacttgcaaggagtattatagcccaaaccagtctatgttagagttggtttttgcaccagccgaagaatggatttcacgtagtgatgaagatattattcaagccacgatggctgagcttgccaaactcttccctaatgaaatatctgcagaccaaagcaaagcaaagattctcaagtaccatgttgttaaaacaccaaggtcagtttacaaaactgttccaaattgtgaaccttgtcgtcccttacaaagatctcctttagaaggtttctatttagctggagattacacaaaacaaaaatatttagcttcaatggaaggcgctgttctttctgggaagctttgtgcacaggctattgtacaggattctgagctactagctactcggggccagaaaagaatggctaaagcaagtgttgtgtaa

SEQ ID NO: 798 - DNA, 624 bp, Glycine Max
atggcctcaagaacagttgcaaaagacataatcactcttcgcggttccgctgcaattgttagcgagttcttcggatatgctgctaacagcattctttacaaccgtggagtttatccagaagaaagctttgtgaaggttaagaaatatggcctccccatgttgcttactgaagatgagggtgtcaaaacttttttagccaatctaactgctcagctctctgaatggcttgaagctggcaagttgcagagggttgtccttgttataatgagcaaggccaccagtgaagtgcttgaaaggtggaacttcagcattgagactgactgcgaggttgttgagaagggtgtctcgagggaaaagagtgacaaggagatcatgagagagatacaagccattatgaggcagattgcttcaagtatcacttatttgccatgcctggatgaaccttgcatttttgatgtgttagcgtatactgacaaggatgtggcagttccattcacatgggttgagagtgatccaaaactcattgcaaatccgcaaatggtgaaattgcattcctttgatactaagattcacaaggttgacacacttgtatcatacaagaatgacgaatgggatgagcagtaa

SEQ ID NO: 799 - DNA, 471 bp, Glycine Max
atggcctcaagaacagttgcaaaagacataatcactcttcgcggttccgctgcaattgttagcgagttcttcggatatgctgctaacagcattctttacaaccgtggagtttatccagaagaaagctttgtgaaggttaagaaatatggcctccccatgttgcttactgaagatgagggtgtcaaaacttttttagccaatctaactgctcagctctctgaatggcttgaagctggcaagttgcagagggttgtccttgttataatgagcaaggccaccagtgaagtgcttgaaaggtggaacttcagcattgagactgactgcgaggttgttgagaagggtgtctcgagggaaaagagtgacaaggagatcatgagagagatacaagccattatgaggcagattgcttcaagtatcacttatttgccatgcctggatgaaccttgtaagaaccacgtgctttgcctatga

SEQ ID NO: 800 - DNA, 234 bp, Glycine Max
atggcctcgtacgatgagaaacaaggaaagcctttacccaagtttggggaatgggatgtgaatgatcctgcgtcagctgaaggattcactgttatattcaacaaggccagagatgaaaagaaaattgcctcagcatcaggacgattcccttctcagcgaagatatgattctcgaaagcacaaggatcaacaaaagtgcaagagttcctcctccacctcaaaggtaagtacctaa

SEQ ID NO: 801 - DNA, 717 bp, Glycine Max
atggcctctagaggaactggaacgctgattttggtttgtctcttatggcttttcttcctatgcgccaccatagctttcttgcagctcaacttcgtagacaaaggaaccaccaacaacaacccttcctctcgcagtagtaacttcatcgcaactcaacagcatagcgctgatacccctttggaacaggatttggagggtgtcacccacaaggtgtattttgatattcagatccatggcaaattagcgggtcgcatagtcatgggcctttatgggaacacagtaccgaaaactgcagaaaactttcgagcgctttgtacaggagagaaaggagtgggaagaagtgggaagtctcttcattataaagggagcacattccataggattataccgagctttatggtccaagggggtgatttcacccgtggtgatggaagaggtggagaatcaatctatggtgataagtttgctgatgaaaactttaagctgaagcataccggaccgggatacttatccatggcaaattctggggaagacaccaatggctcccagttcttcattacaacagttaaaaccagctggctggatggacgccatgtcgtatttggcaaggtactttccggtatggatgttttgtacaagattgaagcagaaggaagtgaaagcggctcgccaaagaacaaggttgtcatattagacagtggagaattaacttcatga

SEQ ID NO: 802 - DNA, 438 bp, Glycine Max
atggccttctgtaataaggttggaaatgtcttgaggcagggtgctgctcgcagcacacaagcacctgtttcatccatgcttaattacattcgctgcatgtcttcaagcaagctttttattggaggcctttcatatggagttgacgatcagtctcttaaggatgcattttctggctttggagatgtggttgatgcaaaagttataactgacagagactctggaagatcaaggggatttggatttgtcaacttctccaatgatgagtctgcaagttcggcactctctgcaatggatgggaagatgggcgaagcattagggtatcctatgcaaatgatagaccttctggacctcaatctggcggcggcggcggtggtggttatcgcagtgggggttttggcggcgggtggtgattttgcttctcgcaatggtggttggtga

SEQ ID NO: 803 - DNA, 1404 bp, Glycine Max
atggcgaacgtggatgaactcttatcttccttaatctcagacatccatacctacaccggcaaggaccctcttcttccctggcttcgcgcgatccgaaaggtgaaggacacgcttccacccaaaaccctaaaggaaaaactacccgcgttcttgcagaaatgcgcacataccttcgagctcgatcgacgttacagaaacgacatgcgctatcttcggatttggctccatctgatggatttcgtggatgatccaaaaacgcttttgagaaccatggaggttaatcacattgggacaaaacgttgtgaattctaccaagcgtatgcgctttactacgagaagagcaagaagtacgatgaggcagagaaaatgtaccatctgggagtgaagaaccttgcagagcctgtagataaattgcagaaatcatatgaacaatttcttcaacggatggagcgaaaaaacaataagagaattcagaccaagaaggatgagcgcaagagatttcatggagacgatacagttgtagtcaagtttgttgacactgccatggttggaaagtctgaagcagaagacgcatgccatcatggattagtggatcctacaataaatatgaaggaggccatgaatgccattaacagcatgttccgggaaccgttagagactgttccattaggcaggaaatcacataaaaaccatccaaaagaagatcctagtacgaagaacgaatttgaggtttttgttgatgaaaacatggatcatggaatcaaaccatcaggttccttgtcacttcaaaacaggactgaagctagccaacctcacccagaaccgctccagatatacgttgatgatgaagaaaattccgagaccagtgatgtgaatgtgaatctgtttgaaggtagtagtacttcatcggcttcacaaccaaatggttttgtttttctacgccccaaggatattccttctgaaaaatctagtgatatggatgctgacatcggtcgtaattcaaagttcagagaggatacagtcgtttgcagatttgttggttctgccattttggatgaaccagaggtggaaaatgtttgccaccacggtttagtagaccccaccatcaacttgaaggaagctatggatgacataaataacatgtttgggaagccaatagattttgttaggagaagaagaaccaccaccaagcaagagaaagccccccagagcaataggggaaatgactttggtgggttttcaatccttgttgatgatgagcacccggtgcaacaagttccacaaccaccaccaccaaaattgcaagaaaaatccaaggaatctgatttgtttgagccaactatgctcacaaaggaagccatagacgatataaacaagatgtttaacatgcctctggatttttag

SEQ ID NO: 804 - DNA, 3099 bp, Glycine Max
atggcgacttcgactcctaaaaccaacgtcgttttcatagacaccaacctcgatacccacttggccctcgtcgtttccgacctcgacactgtctccaacctcaaaaagagtattctgtcggaacatcccttatgctttccgaaaattgggaaaattcagattcatgggataaaggttgagcgcaaggggtacttttaccaccttacagattccatgcctgtgagaagtgccttcagtggtgtcaaagagagctggtttctcactgttgatgtttctgtgttgagggagtgtgctcagaatgaccaattattttctcttggcattgcaaataatgctttgactgttggttctccatccaagagggggtgcacctttgacaatttcaagttgcctcagttggacaatagaccagttgaaaatgaagaaattcctgttgctagtccacatgttttgaaacatactggcaaaggagttaagtcatctggccaccacgacactggaaccccattacctggttctattcctgagacggaggaccattgctttgtaaatcgcaaactgccaagtttgaatactgagtgtgaagtagatggatctggtaaaggcattaaggatgatcgtaatgtatgtgaagaggctcctgtatcaagtgcaaagaaaatacgaaagagtaacaggaaaaaacaagacatggtgcaagatgataattcaaaagatgctgctgctgtagacaatgctcttagttttccatccaaaagggcatccagtgcaaataatgaacttccaggttcacgtattgaatgcgaggtagatggaaccaatgaaggcattaaggatgcttgtattgtacatgaggagggaaattgtaaatctgtatcaagtgtgaagaaaaaacagaaaggtaaaaggaaaaaagaagatgcggtgcagcatgacacttcaaaagtaaatgattcttctgttgttggatctggtgattatacaattcagcaggatattcaggtagtagcaaatccttcagaggatgcagataaagaagtaattaaggaaactgaaattttaaaggagcatcagcacgctgatggcagcaataataacactaagaatgacattgatgttgctgcatctgcaaataagaagcataagaaaaggaagaggtctttgactgttgattctaaagaaatgttcaaggtagagacagcaattcagaaggatgaaatgcataagtctgatgaagcacataaggaaaggaaagaatcaaaagagcagtttgaacttaaaaatgaaaaatctagggatgatgttgaatataagcaagatcaggtaactgaagacattttaaatactggacctcctgcaaagaaaaagaggaatggcaaagagaaaagtggagaagaaaatcttggtatgagcaaagctactattaacaacatggagactggaacagatgcatgcaaagaaggctttcaatctacggaaagaacaacagcaaattataaaaaccattctgacattggaataaaagcacacactgctgatgtggatgagcctatggagctgactgagaataatgagaatgttgtccttgatcaatgtcataaaaatgaagctgatcagattgagggagctgaggaaggaagagaagtatcaccacataatgatcctaagttagtgcagttggaaaagtccacatcatccagccaggataaaacagatgcaaacatcggagaattaaatgtgacttcaaaaggtgtggatgtcaatggaatgactgaacctataaaatcagtgaaggaaaaaaggacgagaaaagctaagaattcaggtggagggtctgcacttagagaaggtattggccttgtggatgcttctgagcatgaaactgttattatgaaatctcttagtgcaaaaaattgtgatcctaagtcaggaaatacagagacagaggagaaccctttaaatcaaacagaaggggggaaaaatcagcaggagaaagtgcaagggacttctgataaggaagatgattctggtgttgataatgctgattccttggaacaaattaaaactaaatctaatgctgaacacatggacaagagacagagaaagaaatcaaacagcaaacagacttcaacctcaaagagcatatcaagtatgctaacaaaagatcaagttcttgatagcaagaagccatcaccatcttctggcagtggaacacatggcaaaccttcagttgcagtgacaaagaagagtaaatctacaagcacgaagtccactaacaaatcaagcaaaacaaatttggaactggtggaagactctgttagacttgaactttctgattctcggtttaattctgggggtaaagatgctgcccagcattcaacatgctctcctggagagaaagatgatgataacttggaagcaataaatggacatactcatgctgaggatttaagctcctcacagcaattatcatcaaaggaaaagcttgatgtaaggagtgaccttggtaagaaggttccaaatgtacacaggactggacaagattcaaaattgtctggtagatctgacagggctgtgtccttaattggagaaaacagaaaggctcatgtcaatgcttttgggaaaagtatggatttggagaaacaaagaaaacgtgctcctgtatcaaacttaaagctggaaggttccataaaaatggttcaaaataaagcaggaaaagcttctgggaacaacgttcgtggagttgcaagtaaaacacaacaagagaagagcttgttatcaggagcaattttcaaggatgacagtagcagcacctctgaagatgaagttgataattctgatgccagcactagaactccatcatataatccactgatgtctgatttttctgatggggatagcagttcagtttcatatggtgggagaagtcaggaaaatggtgcaagaagttccgtaaaagcaagcttttcaggcacaaaagggatgtcaatcgatgatgttcttagaagctcaagcaggtttaagaaggccagaacagcctctcttttggaagagactcaaagccagcccgaatttgttccagacagcctggccgagtaa

SEQ ID NO: 805 - DNA, 579 bp, Glycine Max
atggcgatgagaaatatgatagtgataacagttacgacgacaatggtgatggtgatgataagcatagtgggaggatcagcgagttggtgcgtggcgaagattggcgcgagcgaggaagcactgcagacggcattggactctgcatgtgaagccggtggtggagctgattgtgcacccattcagcctgatggcctctgctacgttcccaacactcttcaagctcatgcttcttatgctttcaacagcttctaccagcgcaacactagagctccccatgcatgcctcttccacggtgcttccaccatcgcacaaaccgatcccagctatggatcttgcgtgtacccatcctccgcaaccccaagtactgctggagttacaaatacaaatacaacagtgacaacacctgcagcgatgccgaatgtggcagcacctaccacaacaactccaatccatggcggggatggtgtaggaatgaaccctctaatccctgaaaattctacatcagcacccaattcgaacacaatattaaccactacctcatttttagttttccttctcattatgtcccttatcccttaa

SEQ ID NO: 806 - DNA, 545 bp, Glycine Max
atggcgatggtgaagagaagcattggtgtttgtaagaggcttcctggttcttcttcttgtttgagcacttcaactgcaacaagtgataatgatattgctcggaggcttcagcttccaccatttgattacaaaccacggccatacaaaggacctttggctgatgaagtttttgccaaacggaaaaagttccttggtcttccttgttccacttctatcaaaaacctaatttttttatattttactttccatattttaagtggattccatcattgctgcatatatataaaaacacatattattaaggccacacgaattgctccttggctgaaagccaagtatttgcagattcataagttgaggatagcagaatatggaacttatcttaaaaacaggaatttaactgtaaataatacagcatcacaagagtttattttgtctttcctcaacttaaaatataagttccatattctgctatcctcaacttatgaatctgcaaatacttggctttcagccaaggagcaatattcgtgtggccttaataatat

SEQ ID NO: 807 - DNA, 1422 bp, Glycine Max
atggcgatggtgaagagaagcattggtgtttgtaagaggctttctggttcttcttcttgtttgagcacttcaactgcaacaagtgataatgatattgctcggaggcttcagcttccaccatttgattacaaaccacggccatacaaaggacctttggctgatgaagtttttgccaaacggaaaaagttccttggtccttccttgttccacttctatcaaaaacctctcaacattgtggagggcaagatgcaatatctattcgatgagaatggtaggcgttatcttgatgcttttgctggaatagttactatctcctgtggacattgccatcctgaagttttgaatgctataatggagcaaagtaaactcttgcagcatacaacaaccatatatctacaccatgcaatagctgattttgcagaggccttggcatccaaagtgcctggaaaccttaaggttgtttattttgtaaattctggttcagaggcaaatgacttggcgatgctgatggcccgtttatacactggtaatatgggtatgatttccttaaggaatgcatatcatggaggaagttctagtacaattggactcaccgcgatgaacacatggaaatacccaataccagagggagaagttcatcatatcatgaatccagatccataccgtggaatctttggctcagatgccaataggtacgccagagaattgcaagatcatattgactatggcacatcaggaaaagttgctggatttatagctgaaacaattcaggcatctggaggagcagttgaactggcacctgggtacctaaaactggtctatgacattgtacacaaagctggtggtgtctgcattgctgatgaagtgcaatgtgggtttgcgcgcacaggaagccatttttggggatttgagacacagggtgtcattcctgatatagttactatggcaaagggtattggcaatggtttgccattagcagctgtagttacaactccagaaatagcgagtgtgatggctcaaaagcttcaatttaatacttttggagggaaccctgtatgttctgccgggggacttgctgtgctcagagttcttgacaaggagaagcgtcaatctcattgtgctgatgttggttctcacttgattcagcgtttaagatccctgatgcaaatacatgacatcattggagatgtaagaggaagaggcttaatggtggggatagaatttgtcaccgatagaaaagagaagacacctgcaaaggctgaaacaacagcattgcacgaaagattcagagagctcggtattctagttggaaaaggagggctgcatggaaatgtttttaggatcaagccaccaatgtgtttcaccaaagatgatgcagattttgttgtggatgccttggactatgctatatctaagttgtga

SEQ ID NO: 808 - DNA, 1422 bp, Glycine Max
atggcgatggtgaagagaagcattggtgtttgtaagaggctttctggttcttcttcttgtttgagcacttcaactgcaacaagtgataatgatattgctcggaggcttcagcttccaccatttgattacaaaccacggccatacaaaggacctttggctgatgaagtttttgccaaacggaaaaagttccttggtccttccttgttccacttctatcaaaaacctctcaacattgtggagggcaagatgcaatatctattcgatgagaatggtaggcgttatcttgatgcttttgctggaatagttactatctcctgtggacattgccatcctgaagttttgaatgctataatggagcaaagtaaactcttgcagcatacaacaaccatatatctacaccatgcaatagctgattttgcagaggccttggcatccaaagtgcctggaaaccttaaggttgtttattttgtaaattctggttcagaggcaaatgacttggcgatgctgatggcccgtttatacactggtaatatgggtatgatttccttaaggaatgcatatcatggaggaagttctagtacaattggactcaccgcgatgaacacatggaaatacccaataccagagggagaagttcatcatatcatgaatccagatccataccgtggaatctttggctcagatgccaataggtacgccagagaattgcaagatcatattgactatggcacatcaggaaaagttgctggatttatagctgaaacaattcagggagctggaggagcagttgaactggcacctgggtacctaaaactggtctatgacattgtacacaaagctggtggtgtctgcattgctgatgaagtgcaatgtgggtttgcgcgcacaggaagccatttttggggatttgagacacagggtgtcattcctgatatagttactatggcaaagggtattggcaatggtttgccattagcagctgtagttacaactccagaaatagcgagtgtgatggctcaaaagcttcaatttaatacttttggagggaaccctgtatgttctgccgggggacttgctgtgctcagagttcttgacaaggagaagcgtcaatctcattgtgctgatgttggttctcacttgattcagcgtttaagatccctgatgcaaatacatgacatcattggagatgtaagaggaagaggcttaatggtggggatagaatttgtcaccgatagaaaagagaagacacctgcaaaggctgaaacaacagcattgcacgaaagattcagagagctcggtattctagttggaaaaggagggctgcatggaaatgtttttaggatcaagccaccaatgtgtttcaccaaagatgatgcagattttgttgtggatgccttggactatgctatatctaagttgtga

SEQ ID NO: 809 - DNA, 1386 bp, Glycine Max
atggcgatggtgaagagaagcattggtgtttgtaagaggctttctggttcttcttcttgtttgagcacttcaactgcaacaagtgataatgatattgctcggaggcttcagcttccaccatttgattacaaaccacggccatacaaaggacctttggctgatgaagtttttgccaaacggaaaaagttccttggtccttccttgttccacttctatcaaaaacctctcaacattgtggagggcaagatgcaatatctattcgatgagaatggtaggcgttatcttgatgcttttgctggaatagttactatctcctgtggacattgccatcctgaagttttgaatgctataatggagcaaagtaaactcttgcagcatacaacaaccatatatctacaccatgcaatagctgattttgcagaggccttggcatccaaagtgcctggaaaccttaaggttgtttattttgtaaattctggttcagaggcaaatgacttggcgatgctgatggcccgtttatacactggtaatatgggtatgatttccttaaggaatgcatatcatggaggaagttctagtacaattggactcaccgcgatgaacacatggaaatacccaataccagagggagaagttcatcatatcatgaatccagatccataccgtggaatctttggctcagatgccaataggtacgccagagaattgcaagatcatattgactatggcacatcaggaaaagttgctggatttatagctgaaacaattcagggagctggaggagcagttgaactggcacctgggtacctaaaactggtctatgacattgtacacaaagctggtggtgtctgcattgctgatgaagtgcaatgtgggtttgcgcgcacaggaagccatttttggggatttgagacacagggtgtcattcctgatatagttactatggcaaagggtattggcaatggtttgccattagcagctgtagttacaactccagaaatagcgagtgtgatggctcaaaagcttcaatttaatacttttggagggaaccctgtatgttctgccgggggacttgctgtgctcagagttcttgacaaggagaagcgtcaatctcattgtgctgatgttggttctcacttgattcagcgtttaagatccctgatgcaaatacatgacatcattggagatgtaagaggaagaggcttaatggtggggatagaatttgtcaccgatagaaaagagaagacacctgcaaaggctgaaacaacagcattgcacgaaagattcagagagctcggtattctagttggaaaaggagggctgcatggaaatgtttttaggatcaagccaccaatgtgtttcaccaaagatgatgcaggtatataa

SEQ ID NO: 810 - DNA, 2592 bp, Glycine Max
atggcgcctcccattcccaaagttctcatggtcgcagagaagcccagcatcgctctctctattgcttctgttctctctcacgctcagatgtttacgagaaggggaagcactgaagttcatgaatttgatggcaagtttcttggatcgcctgcacattttagagtaacatcagttattgggcatgtattcagtgtagattttcctggtaaatatcaagattgggcagccacagatccgttagatctttttcaagctcaggttataaagaatgaatcaaacccaaaggcacatatatgtagacatttaagtcaagaagctcgtggatgtcgttatttggtattgtggttagattgtgatcgtgaaggagaaaatatatgttttgaggttataaagtctactggtttccatataaatgatacttaccgtgcacggttctcttctgttactgagaaagatgttgtgaaggctctagacaaccttgtcagacccaacagagatgaggcgctggctgtagatgctaggcaagagatagatttgaaagttggagttgcctttactcgatttcaaacgagttatttccagggaaaatatgggaacctagattccagagtcatctcctatggaccgtgtcaaactcctaccttaggattttgtgtgcagcggtatttacaaataaacactttcaagccggaaaagttttggagtttgcacccttacataattcaaaatggctatgagattcagctagaatggcaacgtggcaaattgtttgacataaatgttgctatgatgtttcaaaagctggtttctgaagatggacttttggaagttacagaaatatcagaaaaacaggaaaccaaaagtcgccctgttggtctaaacacagtgaatcttctgaaggttgcttcaagtgctcttggatttgggcctcagatggctatgcaactagctgaacggttgtatactcaaggttttatcagctatccacgcacggaaagcacagcataccctccttcatttgactttcgtggtgtactctctgcacaaacaaataatccaacttggggtaattatgtacaagggctacttaccaatggttatcaaaaacctcgattgggaacagatgtaggtgaccatcctcccattactccaatgagatcagcagcagaagatatgctgggcaatgatgcttggaagctgtaccaatatatctgtcaacacttcatagggacagtgtctccggactgcaagtatataaggagaaaggttgaattttccattggcggagagtcctttcattgtacagggcagcatgttgtcaccaaaggatttactgctattatgccttggttggccataaatgataaaaatatcccatcatttataaaagggcagaaaatagaagtatcaaaattggagctctatgaggggagcaccagtcctccagatttccttactgaaagtgagctgatatccctgatggagaagaatggaataggaacagatgcatcgattcctgttcatattaacaacatatgtgagcggaattatgtgcaggtacaagcaggcagaaagcttgtcccaaccacattaggcataacattagtaagaggttatcaaacaatagatccagatctctgcctgcctgatattcgtagcttcattgagcaacaaattactcttattgccaagggtcaggtggatcatcgtcatgtggtgcagcatgtaatccaacagttcacgcagaagtttagttactttgtcaaaaagattgaagacatggatgcattatttgaagcgcagttttctacgctaactgattcagggcgtattctgagcaaatgtggtaaatgcttgagatatatgaagttcatttctactcagccatcacgattgtattgtggtacatgtgaggaggtttactatcttcctcagaagggcacaataaagctgtacaaagaattgtcttgtcctctagacaattttgagcttttgatctgctccatgcctggcccagatggtaaatcgtttccactatgcccatactgctacatcaatcccccatttgaaggtattgaaacactcatcaacacggctaaaactggaacttctggcaagattggcaagggagctggcatgccctgcaacctatgccctcatcccacttgcccaaattctctggtttcccagggtgtatgtgcttgtccagagtgcagtggaacacttgtcttagacccagtaagtgctcccagatggaaactttgttgcaatatgtgcaattgcctagtttttcttgcacaaggtgctcatagaatctccacaactaaagatcggtgccctgaatgcgactcctcaatcatagaagtggacttcaacaagaaaacaactcctctggaagacggagctaccttgcaccatggttgcattctatgtgatgagttgctacattcccttgtggaaatgaagcatggtagaagtttcaggcatatgagttcacgaggaagaggtagaggagcaagaaaaggtggaaggggcagaggacgcgggggtggaaaaatgatggatccaaaaatgagcttccgagatttctga

SEQ ID NO: 811 - DNA, 1248 bp, Glycine Max
atggcggaattggaggaggagcggatgggaggggatttcaagcccttctcggagggctcttcgtgctcgcgttcgatcagcgaaaccgtgaacggctcgcaccaattcacaataaagggttactctttggccaaagggatgggcgcgggaaagtacatcatgagcgacactttcaccgttggtggttacgattgggctatttacttctaccctgatgggaagaaccctgaggacaattccatgtacgtttcggtctttattgcgctcgctagcgacggaaccgatgttagggctctcttcaagttgacgctggtggaccagagtgagaaggggaatgataaagttcatagccatttcgatcgccctctagagagtggaccttataccttgaagtataaaggcagcatgtggggttacaaacgcttcttcagaagatcactactggaaaattcactgtatctaaaaaatgattgccttgtcatgcattgcactgttggggtcgttaaaactcgttttgagggatctaaacagggtgttatcgtgccacagtcagacatgggccgagattttaaggacttgttggaatctgaggttggttgtgacatagttttcaaggtcaaaagtgaaagcttcaaagctcataagttgatacttgcagcccgatctcctgtgtttagagcgcagttttttgggcttgttggggatcctaccttagaggaagtagtggtagaggatattgagccctttatcttcaaggcaatgcttctcttcatctactctgacaaacttcctggcatatatgaggttatggactcgatgcccctgtgctcatacactgtcatggtgcagcatctcttggctgctgctgatctctataatcttgatcggctcaaactgctttgtgaatcaaaattatgtgaagaaatcaatactgacaatgtggccacaacacttgcgctggcagagcaacaccactgtccacagcttaaggcaatctgtttaaaatttattgcaaatcctgcaaacttgggagctgtaatgcagtcggaagcttttgtgcatttgaaagagagctgcccctcaatgctgttggaattgctggagacatttgcatcagtggatgataactcaggccagacattaagcagaaagagaagtggcagtagcatatatggtcaagatttagcagatggggcagctgctgaatcagttaatccgaatggcaggcgagtaaggaggcggacataa

SEQ ID NO: 812 - DNA, 1149 bp, Glycine Max
atggcggaattggaggaggagcggatgggaggggatttcaagcccttctcggagggctcttcgtgctcgcgttcgatcagcgaaaccgtgaacggctcgcaccaattcacaataaagggttactctttggccaaagggatgggcgcgggaaagtacatcatgagcgacactttcaccgttggtggttacgattgggctatttacttctaccctgatgggaagaaccctgaggacaattccatgtacgtttcggtctttattgcgctcgctagcgacggaaccgatgttagggctctcttcaagttgacgctggtggaccagagtgagaaggggaatgataaagttcatagccatttcgatcgccctctagagagtggaccttataccttgaagtataaaggcagcatgtggggttacaaacgcttcttcagaagatcactactggaaaattcactgtatctaaaaaatgattgccttgtcatgcattgcactgttggggtcgttaaaactcgttttgagggatctaaacagggtgttatcgtgccacagtcagacatgggccgagattttaaggacttgttggaatctgaggttggttgtgacatagttttcaaggtcaaaagtgaaagcttcaaagctcataagttgatacttgcagcccgatctcctgtgtttagagcgcagttttttgggcttgttggggatcctaccttagaggaagtagtggtagaggatattgagccctttatcttcaaggcaatgcttctcttcatctactctgacaaacttcctggcatatatgaggttatggactcgatgcccctgtgctcatacactgtcatggtgcagcatctcttggctgctgctgatctctataatcttgatcggctcaaactgctttgtgaatcaaaattatgtgaagaaatcaatactgacaatgtggccacaacacttgcgctggcagagcaacaccactgtccacagcttaaggcaatctgtttaaaatttattgcaaatcctgcaaacttgggagtgatatattattacaccttgtgcagctgtaatgcagtcggaagcttttgtgcatttgaaagagagctgcccctcaatgctgttggaattgctggagacatttgcatcagtggatga

SEQ ID NO: 813 - DNA, 456 bp, Glycine Max
atggcggatggtggtacgttgggattggagggttcatcgtgggatgtgtgtgttttagatttggtgaaggaggcattgcagaaaggtgttggcttctactccactttcttgcacaacaaccatgacgaaaaactcagaaggggaaccaaaatcaccctcttcctcaaggacgatcagttggagtacttggaagagacgaggatcaaggatcttgtgaagaaacactcccaattcattacccatcccatttacctgtggactgagaagacaacagagaaggaaattagtgatgatgagcctaagaaggaaggaaatgttgaggatgatgatgtggctatggagaaagattctaagaagaagatcaaggatgtttctcatgagtggcaactcattaatatttggttgcgtaagcccgaggagactaccaaggaggaggaatctgcttccttctgctct

SEQ ID NO: 814 - DNA, 210 bp, Glycine Max
atggcggattggggtccagtggtgatagcagtggtgctgtttgtgttgctaagccctggtcttgtgtttcaattgccagggaagagcagagtggtggagtttgggaacatgcaaaccagtgcagtgtctatcttggtccacacaatcatcttctttggtctcattaccatctttcttgttgctattggtgtgcatatctacactggctag

SEQ ID NO: 815 - DNA, 5103 bp, Glycine Max
atggcggccgccaacgctccgatcgccatgagagaaactctcaccttgccgaccattggcattaatccgcagttcatcacgttcacgcatgtgacaatggagtccgataagtatatttgcgttcgagaaacggctccgcagaatagtgtggttatcattgatatgaacatgccgaatcagcctttgaggaggcctattaccgcagattccgctcttatgaatccgaattccagaatccttgctttgaaagctcaactccaaggaacaactcaagatcacctacaaatttttaacattgaaatgaaagcaaagatgaaatcttatcagatgcctgagcaggtggtcttttggaagtggattacccccaagttgttgggtattgtaacacagacctctgtataccattggtcaattgaaggtgactctgaacctgtaaagatgtttgagagaacagcgaatttggcaaacaaccaaataattaattatagatgtgatccttctgaaaaatggttggtcttgattggtattgttccaggttcccctgagaggccacaattggttaaaggaaacatgcaactcttctctgtggaacaacagcggagccaggctcttgaagcacatgctgcatcatttgctcaattcaaagttcctgggaatgaaaatccatctactttgatttcttttgccactaaaacacttaatgctggtcaaattatatccaagttgcatgttattgagctgggtgcacagccagggaagccatcattttccaagaaacaagcagatcttttctttcctccagattttgctgatgattttccagttgccatgcagatatcccacaaatacagtttgatttatgtgattaccaaacttggtctcctatttgtctacgatttggagacagctacagctgtatataggaacagaattagtccagatcctatatttttgacatcagaagctacgtcagttggaggcttttatgccattaataggagaggccaggtgttattggctactgttaatgagcaaacaatcgtgaattttgtcagtggtcagctaaacaatttggagctagcagttaatctcgccaagagaggaaatcttcctggtgctgagaaactggtggtagaacgtttccatgaactgtttgcccaaaccaagtataaagaagcagctgagcttgctgctgagtctccacaaggaatccttcgcacacctgatacagttgccaaatttcagagtgttcctgtgcaagctgggcaaactcctccactattgcagtattttggaacacttctaacaagaggaaagctgaatgcctttgagtcattggaattgtcacggctggttgtgaaccagaacaagaaaaatcttttggagaattggttggcagaggacaagcttgaatgcagtgaggagctaggagatcttgtaaagactgtggataatgatcttgccttaaaaatatacatcaaagccagagctactccaaaagttgttgctgcttttgctgagagaagggagtttgacaagattctgatatactctaagcaggttgggtacacgcctgactatctcttccttttgcaaacaattctccggacagatcctcagggtgctgttaattttgcattaatgatgtcgcaaatggagggaggttgcccagttgattacaacaccataactgatctgtttcttcagagaaatctgatccgtgaggcaacagcttttctgctagatgttctgaaaccaaatctaccagaacatgggtaccttcaaactaaggtgttggagataaatctagttactttcccaaatgttgctgatgcaattttggctaatggaatgttcagccattatgaccgtcctcgtattgctcaactttgtgaaaaagctggtctttatgtgcgatctttgcaacattacacagagttgccagatataaaacgtgtaattgtaaatacacatgcaattgagccacagtcactcgttgaattttttggtactctgtcacgagaatgggcattagagtgcatgaaagatctattgctggtcaatcttagaggcaacctacagattattgtgcaggttgctaaagaatattgtgaacaattgggcgttgatgcttgcataaagctttttgagcagttcaggtcatatgaagggctgtattttttcctgggatcatatttgagctccagtgaggatcctgacattcactttaagtacattgaagcagctgcaaagactggacaaatcaaagaggttgagcgtgtgactagagaatcaagtttctatgatcctgagaaaacaaagaactttctaatggaagctaagcttccagacgcacgacctctaattaatgtttgtgaccggtttggatttgttccggatctaacacactatctatacacaagcaacatgcttcgttacattgaaggttatgttcagaaggtgaacccagggaatgctcctttagtcgttgggcagcttttagatgatgaatgcccagaagattttatcaaaggcttgattctctctgttcgttccttactgccagtggagcctcttgtggaggagtgtgaaaagaggaatcggcttcgtttgctcacacagtttttggaacatcttgtaagtgagggaagccaggatgtacatgttcacaatgcactgggtaaaatcatcattgatagcaacaacaatccagaacattttctcactaccaacccatactatgattctcgagttgtgggcaaatattgtgagaaacgtgatcccaccttggcagttgtagcttataggcggggacaatgtgacgacgaacttatcaatgtgacaaacaaaaattctttgttcaaactacaagcaagatatgttgttgagaggatggatggtgatctttgggagaaagttcttaaccctgataatacctacagaaggcaacttattgatcaggttgtatctacagctcttcctgaaagcaagagccccgaacaagtatctgcagctgttaaggctttcatgactgctgatctacctcacgaattgattgagcttcttgagaagattgtgcttcagaattctgcattcagtgggaactttaatctgcagaatctgcttattttaacggcaataaaggctgatccgtccagagttatggattatattaatagactagataattttgatgggcctgcagttggagaaatggctgttgaggctcagttatatgaggaagcatttgcaattttcaagaagttcaacttaaatgtccaagcagtcaatgtcttgctagataatattcatagcattgatagagctgtggagtttgctttccgagttgaagaagatgctgtttggagtcaggtggccaaggctcaactaagggaagggctagtaagtgatgccattgagtcctttatacgagctgatgatgccacacaatttttagatgttatccgtgctgctgaagatggcaatgtttaccatgacttggtgagatacttgctgatggtaaggcagaagacaaaagaacccaaggtggacagtgagctcatttatgcatatgcaaagattgataggctaagtgacattgaggagttcattcttatgccaaatgtagccaatcttcaaaatgttggtgaccaattgtatgatgaagaactatatgaggctgccaaaatcatatttgcctttatatctaactgggccaagttagcagttacacttgtgaagttgaaacagttccaaggtgcagttgatgcagcaaggaaagctaacagtgcaaaaacatggaaggaagtttgctttgcatgtgttgacgcagaggagttccgtttggcccagatatgtgggcttaacattattattcaggtggatgacttggaagaggtcagtgaatattaccaaaatagaggttgcttcaatgagctaatatccctcatggagagtggtttaggattagaacgggcacatatgggtatctttacagagttaggagttctgtatgctagatatcgttatgagaagctcatggagcatatcaaactatttgcgacccgactcaatattccaaaactcataagagcttgtgatgaacaacaacattggaaggagctgacctatttgtacatccaatatgatgagtttgataatgctgcaacaaccatcatgaaccattcacctgaagcatgggatcacatgcaattcaaagatgttgttgtcaaagttgctaatgtagagttgtattacaaggctgttcacttctatttacaagagcatccagatcttatcaatgatgttttgaatgtccttgcacttcgtgttgatcatgcacgtgttgttgacatcatgcgaaaggctggtcatctccgtcttgtcaagccttacatggttgcagttcagagtaacaacgtgtctgctgttaatgaagccctgaatgaaatatatgttgaggaggaagactatgatagattgcgcgagtcaattgatttgcatgataactttgaccaaataggccttgcacagaagattgaaaagcatgagcttcttgagatgagacgtgtcgctgcttatatttacaagaaggcaggtagatggaaacagtccattgccttgtcaaagaaagataacctttacaaagatgccatggagacagcctcacaatctggtgaccgtgaacttgctgaggagttgcttgtttatttcattgatcagggaaagaaagaatgctttgcctcgtgtctatttgtttgctatgatttgatccgggcagacattgctcttgagttggcctggatgaacaatatgattgactttgccttcccatatctcctgcagtttatccgtgagtacactggcaaagttgatgaactggtgaaggataaaatagaagcgcagaaccaagtgaaagctaaagagcaagaagagaaggaagtaattgctcaacagaatatgtatgctcagttgttgcctcttgctttgcctgcaccgccaatgcctggaatgggaggaggctttgcccctccccctccaatgggtggattggggatgcctccaatgccaccttttggtatgccacccatgggtagttactga

SEQ ID NO: 816 - DNA, 1110 bp, Glycine Max
atggcggcctctgttgtagtgtctacctctctgtctgtgtgtttcaactatggctatcatcgtcgtccatccatttccgctctctcttgtcattcgaattccatcaccaaaacaaacctaaaactcagttcgcaatgtttctccaactcgaattcggtagccccgatttattgccgcaagtttgttgctcgcacttcaattggagaaaacgagagcgagagcgagaaggagttagggttcgtgggggaggactctgcggtgtttgaattgggcaaacagaaagtatcttcgtggatttatttcaccgctattttgggagtcgttctctatgttcttaacgtcgcatggattgataattcaactggctacggcaaagcttttattgacgccgtttcaacgctttccgattctagcgaggtggtaatgttgatcctaattctcatatttgctggtgtccatagtggcttagctagcttccggaacactggtgagaaactcattggagaaagacctttccgtgtactttttgcagggatatcactacctttggctgtcagtactgttgtgtattttattaaccacagatatgatggacttcaactctggcagctccaggatgcccctgggcttcatcaacttctgtggctttcaaatttcatttctttctttttcctatatccttcaactttcaatcttttagaggttgcagctgttgacaagcctaaattgcatctatgggaaactgggatcataagaataaccaggcatccacagatggttgggcaggttatctggtgtcttgctcatacgatttggatcggaaattccgtggctgttgcagcttcaattggcttgattgcacatcatctatttggtgtctggaatggagacaggcgactggccataagatatggggaggattttgaattagttaagagtcgaacaagtgttgtcccttttgcagcaatcctcgatggccgacaagagttaccaaaagatttctacaaggagtttattcgactgccatacttgacagttactgcaataacgttaggtgcttactttgcacacccgcttatgcaggctgctagtttcaaccttcattggtag

SEQ ID NO: 817 - DNA, 261 bp, Glycine Max
atggcggcggcgaactctgagggtaatggtcagaaaccgagattggaaacgtttcagttattctcttcctccgcttccgccttcggaatcttcgacgatgctgcgcaacaagttcctcatatacctcctcctccctgcgttgaagtccttgcttctgaggttccttcatccatcaaacacaacgtggactctgtaaatttggatggagttactttgttaaagagatactcaactatcgtcattcaactccacaatttgtga

SEQ ID NO: 818 - DNA, 1980 bp, Glycine Max
atggcggctagtagacatggaggttatcgtgacaacgagtttagggaccgtgagtccaattttgatgtttcaaggcggggtttcaataataattctaaacaagagtatgataagattacgaatggtggccgcgatgttgtgagggttgggagcaaggatgcaagagataggcttagtctgaaacaaaaagatattagggacagggaagctccaaatggtagttaccggtcatcttcgagtaagagcgactctggcagtagtggcgggtgtagtagtgggcttggtcccagaagatgtgagttttctgttaagactatggatagagagcctggtgagctttctagtgaaagtgggtctgatgatgatggtattgaatcaggatcacaggaaaaatactgtgaggttgcaacaggtgaaggaaaccgtgcacgatctccactagagaggaaaagaaaattttctccaatagtatggaatcaggatgacagcgaagtcaataatttatcaaaacttagggttgtcacagcagtgactactctgcctccacttccaatagtccgtctgtcacctaatgttcccgatagaggagttgaaactcatcctgtcaaaaacacagaagctgagattcttgagttaccaactgtaactaaccctcctttgctgtctgagtctcctgtaggtttgcattcattgttgccagagcagagatggggtaatgagcaggaagccaagcaacctgaaggtgaagattttattccaactcataatatatcatcttcaagatgggcatctggtgataactctcctggtgatgaaggtgaaatcaatgatgacaaggaaatccttaagaggaggaagctatctcctgagctgggtatgagagtaagaaacaagatgttgagactagaggaatctaacatagaagattttgtagaagctagagccaaatcatctgaatctgaagaaagaagtagccgtgggagatcatccagtggagattatcatcctggtaatttgtcagggaaggatgattatatggagattgatggtcaaggtagcagaagtgaaactagtggttatcattcggatacagatttggaagatgattgcagagaaacttctgaacctccggttccaccacaaagagttgtcaacatgcttcagggttgtagaagtgttgatgagtttgagagactgaacaagatagatgaaggaacatatggtgttgtatttagggcaaaagataagaagactggtgaaattgtggcattgaaaaaggtgaagatggagaaggaaaaagaaggttttccattgacttctctcagggaaataaacattcttctttcctttcaccacccatccatagttgatgttaaagaagttgtggtagggagtaaccttgatagtattttcatggttatggaatacatggaacatgatcttaaaggactaatggagggaatgaagcagccctttagccagagtgaagtaaaatgcttaatgctccagcttttagaaggtgtgaagtatcttcatgacaactgggtgcttcatagggatttgaagacttctaacctgcttctgaataataggggcgagttaaaaatttgtgattttggattggctcgtcagtatgggagcccattgaaaccatatacccaccttgtggttactctttggtacagggctcctgaacttcttctggggacaaaacaatattcaacagccattgacatgtggtctctgggttgtataatggctgagctattgtccaaggaacctctatttaatgggaagactgaatttgaacaacttgacaagattttcagaattcttggcacaccaaatgaaacaatttggcctgggttctcagaattaccccaagtcaaggtcaattttgtcaagaataagcttccaactctgggtggttctggctggctatctggcctctcttggttacttcttcacaactttttctag

SEQ ID NO: 819 - DNA, 216 bp, Glycine Max
atggcggctggcaaaaatctgctatgccattccgccatggcgccgctatataataacaatgcttgtcacacagttgtgattcgcatacaactgtatgatttcataagtggatttaccagcagaaaacaaggacagtgttgtatatcctcaaacaagtttttggacaaactacatatcaatattctctctcttttcttctcctttttaacaccatag

SEQ ID NO: 820 - DNA, 402 bp, Glycine Max
atggcggtgcctctactctcgaagaagatcgtgaagaagagggtgaagaagttcaagaggcctcagagtgacaggaaaatttctgtcaagacaaactggcgcagaccaaagggtatcgattcccgtgttaggagaaagttcaagggatgcactttgatgccaaacattggttatggttcagacaagaagacccgccactatctccctaatggttttaagaaatttgttgttcacaatgtgaaggacttggaactgctcatgatgcacaacaggacttactgtgctgagattgcccacaatatatccacaagaaagaggaaagatatagttgagagagccgcgcagcttgatgttgttgtgacaaacaaaacagccagattacgcagccaggaggatgaatag

SEQ ID NO: 821 - DNA, 2358 bp, Glycine Max
atggcgtcgggtcggagttcggagaagctgagccttccatcactccaatccaaaatgaagtgcgatcccgaaggctacgaatcggagctactccttctctacaaccaattcaattcctcgctcgaactctttcagaaacaagccgccatgaacttcacctccatctccggcatcggcagcgaccccaccgtcgccaaggacctcggcgacagggccatgttcctcgcccacgtcactcctttctaccccaaacacctcgccgatttccccaaaaaactcgccgatttgctccgctgcgccgcccgcacgctgccttccggccttcgctgccacctcgcacacgcgctcattctcttatccaatcgaaagattgttgacattggagaaacgctgtcgttgttcatggagcttcaaaccctaggtgacagaacgctcaagaagttggcgtttgatcatgttgttcatagtataaggcgtatgaaccaaaagcataagaacgaagctaagaacagagcgcttcagaatgtcttgtttgacttgcttcagaaagaggctgaagagccagccaagagggcactcgtgactctatgtgagcttcacaggagaaaagtgtgcctaatggttgtgagtttttatctgtctctcaggattatgatagcaactttatcatttctgcttgattatgagaagattcaagatgatgatgatgacagtgataattcagacagtgatgatgaaaagacagaatcacctcaagttgtccttagcagggagacagtttataaggcaagccaccaaggtacagcagcaagcaaaaagaaaaagaaagcaaaactacaacgtgcaatacgcagcatgaaaaggcatcagcgtgtgtcatctgataggagcaaaaacagttattattcaccacttaaccatctgaaagatgctcagggttttgctgagaagctgttctcacgtcttaggagttgtaatgaacgatttgaggtaaagatgatgatcttgaaattaattgctcgaacagttggacttcaccagttaattttgctagagttctattcttttcttcagaaatatattcagccacatcaacgagacattacaaatttgcttgcagcagtggttcaggcttgccatgatatggttcctcctgatgcagttgaacccttgttcaaacaaatagtaaatcaatttgtacatgaccgttcacgtccagaggctattactgttggaataaatgcagtcagggagatatgcatgcgcatgccattgttaatgaatgaagacttgctacaagaccttgcgctatataagaagtcacgtgagaaggcagtttcaatagcagctcgatctctgattgggttattcagagaggtttgcccctcactgctagttaagaaggaccgtgggcggcctattgaccctaaggcaagaccaaaggcctatggagagcagaatgttgcgactgacgttcctgatgttgagttattgcagacggctattgacaatgatgatgagcaggagagtgatcattctgatggttctgcatgcagtgtctctgacaatgaccaggaaaatgatttgatgagtataaatgatgacgatgacaatgatgatgagaaccagttatgcagtgatgatcctgaaagtgatgatgaagccaaagatagtgatgttatatcagacgatgacgacgagagaagttctgatgacgaagctgatgatagtgatgtttcagaacatgaagaagatggtgatctgcattctttaagtgatgatggacttgtgacaaaaagtacaatgaaagactcagcaaaaaagaggaagtttactgattttaatggtcaactgatagctgctgatacaagtctccgggctctgaagaaattagctgggagacaaatgggggatgtcataccagaatctaacgacggaattctttctaacgaagacttcaagaggatcaaagaactgaaggcaaaaagtgaggcaaaaaatgcgttggctcagcaagggctagcgaagtcagctgcaactaaggttccaagctctggtcaactaaatctaaagcgagtggatggtaccatgcttgaagctcacataaggaaaaagttgaacaaggatgaaaggttggcattggttagagcaggaagggaggaaagaggaaaataccaagctcgaactgctgtgaaacagaataagacgggtgggttaagcaacagacaaaaggaacacaagaagaaaatgcccttggctgcaaagagagataaggtatcaagaactcggatagagaaaaagaggaaaaatcagcgatctggcaaacagttccgtggaaagaaagcgtggaagcaataa

SEQ ID NO: 822 - DNA, 561 bp, Glycine Max
atggcgtgcaggagcatgcttcgttcctcgattctggtggaacccttccaattgcaacctcttcattttagtaacagacccgttagggcttgtccgtttcgccgtggcaaaggagtgaccctccgttgctccagcaatgagacgccgtcgtttcaggacgatcaaggtccacctcaagaagccgtgttgaaggccatttccgaggtatctaaggcagaagggagggttggccaaactacgaacatggttattggaggcaccgtgtcggatgattctactaatgaatggctcactttggaccagaaggtgaactcatacccaactgttcggggattcactgcaataggaactggaggggaggacttcgttcaagccatggttgttgctgtggaatccgtaatccagcagcccattcctcagggacgtgtgaagcagaagttatcagcaaggggcaaatatgtatccgtaaacattggccctgtccaagttgtttccagtgaacaggtccaagctgtatataatgccatgaggagggatgacaggatgaaatattttttgtag

SEQ ID NO: 823 - DNA, 1608 bp, Glycine Max
atggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactga

SEQ ID NO: 824 - DNA, 1584 bp, Glycine Max
atggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtctccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactga

SEQ ID NO: 825 - DNA, 1458 bp, Glycine Max
atggcgttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctccacatgaccatccaaaccgccgtcctcatcgagaccctcaccgccctcggcgccgaggtccgctggtgctcctgcaacatcttctccacccaggaccatgccgccgccgccatcgcccgcgacagcgcctccgtcttcgcctggaagggtgagaccctccaggaatactggtggtgcaccgagcgcgccctcgactggggccccggcggcggccccgatctcatcgtcgacgacggcggcgacaccactcttctcattcacgagggcgtcaaggccgaggagatctttgagaagaccggccagttccccgacccggcttcctccgacaatgcggagttccagatcgtgctgagcatcatcagggatggcttgaagaccgatcccaagaggtaccacaagatgaaggacagaatcgtcggtgtctccgaagaaaccaccaccggtgtcaagaggctctaccagatgcaggccaatggctccctcttgttccctgccatcaacgtcaatgactcggtcaccaagagcaagtttgataacttgtatggatgccgtcactcgcttcccgatggactgatgagagccactgatgtgatgattgccggaaaggtagctgttgtgtgtggctacggagacgttggcaagggttgtgcttcggccatgaagcaagccggggctcgtgtcattgtcaccgagattgatcccatttgtgcccttcaggctctaatggagggtcttcaggttctcaccctggaagatgttgtctccgaggccgacatcttcgtcaccaccacagggaacaaggacattatcatgcttgaccacatgaagaagatgaagaacaatgccatcgtgtgcaacattggccacttcgacaacgaaatcgacatgctggggcttgagacctgccctggtgtgaagcgcatcaacatcaagcctcaaacagacagatgggttttccccgataccaagagggggatcatcgtgttggcagagggtcgtttgatgaacttggggtgtgccacgggacaccccagctttgtgatgtcgtgctccttcaccaaccaggtcattgctcagcttgaattgtggaaagagaagggttctgggaagtatgagaagaaggtgtatgtgttgcccaagcaccttgacgagaaagtggcttctctccaccttggccagcttggagctaggctcaccaagctttccaaagaccaagctgattacatcagtgtgcctgttgagggtccatacaagcctgctcactacaggtactga

SEQ ID NO: 826 - DNA, 555 bp, Glycine Max
atggctaagtactatgatattgatgatattatcattgaggaagagactgtgtcagttatatttcagagggctgcatctggagtgggaatagatcccagttcttcaatccttattgaaacaggttcaaaagttgaactgccgttttggcttgctcatgagttacagttgagacaagcagtatcagtcaatgttcctccttgtttcaatcaaaaaacaaggcaggagctccatgctgattctgcaggtgtggatctgaggtccagatgtccatttttctatgaatttggttgcaagatagcacccatagttggcgaccgaaccattgggtttctgttgttgactgcatttaagagtaggtacaaggaaattctcaccaaggcacatactgtagcatttgcacctggttccaaattttggactattctaacaaaagaagagatctacttgtatgagacagctcaatctgcaatggcatctttcaagaagtggcgaatggggggacccagatttcagatagcttctgttctgggaagaaagagaaaatctaaggaatag

SEQ ID NO: 827 - DNA, 555 bp, Glycine Max; identical to SEQ ID NO: 826

SEQ ID NO: 828 - DNA, 2784 bp, Glycine Max
atggctacctccaaattaaaacccaaaaccctactttctccttctaagctctttcttctctcgctgtgtctcgcgtgcaccgccattgccgacgatggcgagttcatgtccaagctcgccaaggcgctgagcccgacgccgtctggttggtctgggagcagcttctgcgcctggaatggcgtcaagtgcagcgcccaccgagtgacctcaatcaacatcgcttcgcagtccctcggcggaatgcttcctccggatctcaactcactctcccaactcacctcgctctctctccagaacaacgcgctctccggcgcgtttccttcactcgccaacctctccatgctcgaaagcgttttccttagcagcaacaacttcacctccatccccgttggttgcttccagggactccccagtttgcaaaccctcagcatgaccgatagcatcaacctcgctccatggacgattcccgccgagttgactgatagcatcaacctcgtcaaactagaactcggaaacgcaaacctcattggtaccttgcctgatgtattcgacaagtttgtgagtttggtggagcttcgtctctcttacaacaacctcaccggtgtcttacccaaatccttcgctggatctgcgattcagaatatgtggctcaacaatcagaacggcttcgggttttcgggtaccattgaggtgcttgcttccatgacccacttgtctcaagtgtggcttcagaagaaccagttcacgggtcccattccggatttgtcaaattgcaccactttgtttgatctgcagctgagagacaaccagttaaccggtgtggttccaccttctctcatgtccctttctggcttgcagaacgttactttagccaacaatgcgcttcagggtcccgttccttcgtttgggaaaggtgtgaagttcactctcgatgggatcaatagtttttgtttgaaagatgttggaccctgcgattctcgcgtcaccactttgcttgatattgctgcgggtttcgggtatccctttcagttggcgcgttcctggactgggaacgatccttgtgatgattggagttttgttgtgtgtgcaggggggaagattattacggtgaatttggcaaagcagaatttgactggaaccatttcacctgcgtttgctaatttaactgatttgaggaacttgtttctcaatgataacaatttgggtggttcaataccggggagtttgacaaatttggctcagcttgaggttctgaatgtgtctaataacaagctatctggcgatgttcccaagttctcaagcaaggtgaaattcacgactgcaggtaatgatttacttgggcgttctgatggtggtggtggcagtggaactactccgtccaagggttccggtgatgcaccgagtggaagtccgagtgcagggacaagtggatcttcactttcacctgcttggatcgcaggtattgttgttattgctgtgttttttgttgcagtcgtggtgtttgtgttttgcaagtgtcatgctaaaaaccggcatgggaagtttggaagggttaataatccggaaaatgggaaaggagaggttaagattgatatgatgagcgttaccaattccaatggatatggtggtgttccgagtgagttgcagagccagggcagtgagcgtagtgaccttcatgtttttgagggtgggaatgctactatttcaatccaggttcttcgacaagtaactgataatttcagtgagaagaacattttgggtaggggaggatttggggttgtttataaaggggaattgcatgatggaacacaaattgccgtgaagagaatggaatctgttgcaacggggagtaagggattgaatgagttccaagcagagattgcagttctaagtaaagtcaggcacaggcatttggtggctcttttagggtattgcattaacggcaacgaaagacttttggtgtacgagtatatgcctcaagggacattaacgcaacacctgtttgattggggtgaaaatggttgtgctcctttgacttggaaacaaagggtagcaatagctttggatgtagctcggggagtggaatacttgcacagcttggctcagcaaagcttcattcacagggacttaaagccctcgaacatattgctgggtgatgacatgagagccaaggttgcagattttggcttggttaaaaatgcgccagatgggaaatattctgttgagacacgcttggctggaacatttggatatctagcaccggaatatgcagctaccggaagagtgacgaccaaagtagacgtgtacgcatttggagtagttttgatggaactgattactggtagaagggcattggatgatactgtgcctgatgaaagatctcacttggtttcctggttccgtagggtactaattaacaaggagaacatcccaaaggcaattgatcaaactctcgatcccgatgaggaaaccatggagagcatatataaagtggctgagctagctggccattgcactgctcgtgaaccataccaaaggcctgatatggggcatgcagtgaatgtcctgggtcctctggtagagcaatggaagcccaccacccatgaagaagaagaaggttatggcattgaccttcacatgagccttcctcaagctctgcgaagatggcaagccaatgaaggcacttccacaatgtttgacatgtccatctcacaaactcaatcaagcattcctgcaaaaccttcaggatttacagactcctttgattcaatggattgccgctga

SEQ ID NO: 829 - DNA, 1722 bp, Glycine Max
atggctagtattggctactggactagcatagcagtgatggaaatggccgaaactcgagacgccgccgccgatggggtgcccggaactcccgccataagggaaatgagacccgagaccgcgacccatgcgggaatcgggtcgggtgggattcggagggtgaatttccgagcggagattgatacgtcaccgccgtttgggtcggtgaaagaggccgtgacccgttttggaggtagcgggccttggataccgttttttaacaacattgaagattttgacctaaagaaagtggaggaacaagcagcagagttggagaaggatttgattgtcaaggaacttgaaacgcttgacgtgctcgaagaactgggagctaccaagaggattgtggaggacttgaagcagcaattacagaaggaggctatgaaatgtttagcaactcaagatgtaaattcatatgaacaagttggaactactgttattaaggagatggataaggaaaattgtggaagtaatgtcaatgatcaagaacaggtgatgcaaattccaagcccatgctctatgtcatcatcacctgatatgatcttaatagagttgaaacaagccaaattgaatctaggcaaaactataaatgaacttggggtgatacagtcctctgttgaatctttgaataagaagatgaagaaggagaaactttttctggagaggacacgcgaaaagctagcaacaaagtttgcagcagtatctgctcaagagagggtccaagagcaaacaagattaaatccaccagcacctcatgtagagttcaattttggtaacactgcaaataatttcaattctgattctaggcagtgcaatagaatggccgagacaagaagacctgaaccttcaaagcccttgaatgtgtatgaagaatatggatttagtgttaagactgctgagatgaggtggcttgcggctaaaaagatggaagaagctgcaagggctgcagaagctattgctcttgctgaaatcaaggctctatctaataatgctgagagatcttcaggattagttctgccagaaccggagaaagtcacttttgcttttggagagtgctctcccctaaacctcaaggctcagatacccgaggaatcaaccttgaagaaggtaatagattccaactttcaagttgatgaaacaaaaatttccaaactgactattctgaagaagttggaggaagcagctgaagaagttctacacagcaaacaagtcttgacagatgctttaaacagagttgaaaccgcaaacagaaagcagcatgctgctaaggaggctctaaggagatggattcctgaggatgatatgaaggagtataataacactattaactgcaacaagtttcatcaagctggaatttatcaagattctctgcaggatgtaaccaggtcaacaacatcaaacaatgatccaaagcctgctttaaggaccacaatttcaatgagagatgtacttagcagaaagcaggttcctgaaggatatgctacaagaaaggagatggaagagcacactgaacgacaaaaggtagcattgagtcaaatgcttcaggcattgagggaagatctaactcttccaccgaagaccgagaaagatgggagcaatcagaagccgttcgtagcacagaggaagaaatttggattcattcaaatatcactccccttggcaaagccaaataagaaaaggggatga

SEQ ID NO: 830 - DNA, 774 bp, Glycine Max
atggctcaaattgcgcttattgctcctgcagcaactgttatacctattattactggcatgtactacttactatactataaatcttgtagggggaaacaacaaaaactatcatatgctgcaagaagaaacaaagtgagtttagcatcactggttcctagttggaggcttgaaagggttccaaggttagccttatcaaataataataattcaggcgatgatagaaagacaagtgtcgtggtgaaggtatctgaaggaggagctatctctctccctcatggttggtcagcacaaaagggggaaccgagttttcatctgtttggatttattatatgtgttgcggctacggctgcaagggctcttaaatcagtgctacaagggattttgcttgcttccgaaggagagaagctgaattctatgaaccttctgctttacatggctccaatggctgtggttttccttcttcctgcaacacttataatggaagagaatgtggttggcatcacgttggctcttgccagagatgattccaagatcatttggtatctgctgtttaattcgtcacttgcatattttgtcaacctgaccaactttttggtcactaaacataccagtgctctgacccttcaggtactaggaaatgccaaaggggcagtagcagtagtagtttcaattctaatattcagaaacccagtgtcagtcactggaatgatgggttactcactcacagtctttggagttatactctacagtgaagccaaaaagagaagcaagtga

SEQ ID NO: 831 - DNA, 1023 bp, Glycine Max
atggctccgaatcttgaatgtcgcatgtacgaagcgaagtacccggaggtggacatggcggtgatgatacaggtgaagaacatagcggacatgggggcctacgtgtcgctgctggagtacaacaacatcgagggaatgatcttgttctccgagctctcccgccgtcggattcggagcgtgagcagcctcatcaaggttggacgaatcgagccggtgatggtgctccgtgtcgacaaggaaaagggttacatcgatctcagcaagcgcagggtctccgaagaagacatccaggcctgcgaggagaggtacaacaagagcaagctcgtccactccatcatgcgccacgtcgccgaaaccctcaacatcgatttggaggaactttatattcacattggatggcctttgtatcgcaaatatggtcatgcttttgaggctttcaaaataattgtgactgatcctgatactgttttaagtactctcactcgtgaagttaaggaagttggccctgacgggcaagaggtgactaaggtggtgccagctgtatcagaagaagtgaaggattctcttgtgaagaatattagaagacgaatgaccccccaacccttgaaaattagggcagatattgaaatgaaatgttttcaatttgatggagttcttcacattaaggaggcaatgcataaggctgaagctgcaggaaatgatgactgccccgtcaaaattaaacttgttgctcccccactttatgttcttaccacccagacactggacaaggagcaaggaatattggttctcaacaatgccatagcttcttgcactgaagcaatagaacaacacaagggtaaacttgtggttaaggaggcagctagagcagtgagtgaacgtgatgataaattgcttgctgagcacatggctaagctacgccaagataatgaagaggtcagtggtgatgaagacagtgaggaggaagaagatacaggaatgggcgaggttgatgtggataatggtgccgggataacggactga

SEQ ID NO: 832 - DNA, 726 bp, Glycine Max
atggctgaatcatcggcgtgtcttgttcgatccttctcctctcccgcagaaactacttgttacgagggtaaccccattcttgcgcttggagaatctatctcgtttgggaggtttatgacagagagcctggattgggagaaatggtcaacattttcacacaatcgctacgtagaagaagccgagaaatattccaagccgggttctgttgccgctaagaaagcctactttgaggctcattacaaaagaaaggctgcagagcgagcagctgctctttatcttgttgaggacaatacagatattgctgtccctgcagaagagatgacactagatcatgaagttttggctttgcctgtcaagggaagagaagtaaactcttctccaaaattatcaaccaaaactggggttgccaatcattctcgttcttttgatgaaaggaaggctgctgtgccacccagaagtggaataaacagtggtccgatgggtaagaagtctgttggaggcttagttgagaagaagagactaactgcacagtcagtccacatgtcaatcaatcttccatctggtaccggtgaaacacgcaaaagaactgctgcagcttcacagtccagaaatggcttaaacaatttttcaacaaaagaaaagaataactgcaccatcactttacatgtcaatcaatctcccatctggtgccggtatcacaagcaaaacagctactgtagttactaa

SEQ ID NO: 833 - DNA, 507 bp, Glycine Max
atggctgacgaagaagaaaacggagtatcgatccaactggaattcccgaagggtcgagtgaagaagattatggcgctggacaaagacgtgaagagagtgagctcagaagcgttgttcctggtgtcgcgctccaccgaattattcctccaatttctggctgaaaaatcggctcaggttgcaattgagaagaaacggaagaccgtgaatctcgaacacataagagtggcggtgaagaggcaccagccaaccagggattttctcctcgatgagcttccgccgccgtctcaggccgccaagcccgataagcccactcagcctgcgggtcggcccaaattggatcctgctccccgtggtactcgctgcatcgatcaattcttccggaaaccagaacctgaaaacacagcccaagccccaggccaaccacctgaaaatccagctcaagctcaatcgcctgaaaatccagaccaagaccaagcccaatcaccggtacctgtagatgagtcttag

SEQ ID NO: 834 - DNA, 771 bp, Glycine Max
atggctgcacctgcgaggcctctgttcgttctcttcggatcctccattgtccaactcagtttcagccatggtggttggggttctcatctttctgacatctactctcgtaaggccgacatattgttgcgaggatactatggatggaactcgcgacgtgccctccaagtccttaatcaagtttttccaaaggatgctgcaatacaaccttctcttgtgatagtttattttggaggtaatgattccatgggtcctcattcgtctggcttaggccctcatgtgcctcttcatgaatatattgaaaacatgagaaagattctgattcatattcagggtctctctgaaaagatacgtatcattgttctcagttgtcctccagtcaatgaggaaaaagtgcgtggaaacactagtggaatttttagtgagctggtaagaacaaatgaattgtgccaaagctactcagaagcttgtattaagctatgcaaggaactggatgtcaaagttgttgatctttttaatgcactgcagaagagagatgactggatgaatgcttgtttcactgatggtatccatttagcagctgagggaagcaaaattgtggttaaggagatattgagagtgcttaaggaagcagaatgggagccatgcctccactggaaatccatgcctactgaatttgcagaagactcaccatatgatcttgttgctgctgatgggaaaactacactgaatccttctgagtggactttttacagagagattcagtgggattag

SEQ ID NO: 835 - DNA, 771 bp, Glycine Max; identical to SEQ ID NO: 834

SEQ ID NO: 836 - DNA, 1206 bp, Glycine Max
atggctggaatttgctgtggtgttgtcggagaaggtgacactccggctccactcgagccaactactcgcccctccaggcgccggagtttggacatcttacccttaaaatacatcgctgacatggcggtgccgccgtcggatggttcacggaaacgtcccaagctggatctcagggaccgcgataacgtagttcaaaattgcgacgaatccactggacacaaggtggtgaaaaaagaagccaaagtggaaatccacgacaatatttccgaaacgaaaaacgtaactgttgcggatgcttcggaagttgaagattctcctaagttcggcgtgacgtcagtttgcggcaggagaagagacatggaagattccgtttcggtgcggccttccttcacccaaggcttccactactttggcgttttcgacggtcacggttgctctcatgtcgcgactatgtgcaaggagcggttacacgagatcgtgaatgaagagattgacagcgcgcgcgagaatttggagtggaagctgacgatggagaacggattcgctcgcatggacgacgaggttaatcgcaggagccagagcaaccagaccttcacctgcaggtgcgagctccagactccccactgcgacgccgtcggatccaccgccgtcgtcgccatcgtcacgccggacaaactcgtcgtttccaactgcggcgactcccgcgccgtcctctgccggaaaggcgtagccatccctctctcctccgatcacaagccggatcgacccgacgaactgctccgagtccaatccaagggagggcgcgtgatttactgggacggtcccagagtgcttggtgtgttagccatgtctcgagccataggtgacaattatctgaagccgtacgtgatttctgaaccggaggtgacggtgacggagcggacggaggaggacgagtgtttgatactggcgagtgatgggttgtgggatgtggtgtcgaatgaaaccgcatgtggtgtggtgaggatgtgcctcaaggcgcagaagccgccgtcgccgccgggatctccggggagtgacgtggcggcggacggttccgaccgggcttgctccgatgcgtcgattttgttaaccaagttagcgttggcgaggcatagttcggataatgtgagcgtggtggtggttgatttgaggagagatcaacgacaatcatcaaactccaattaa

SEQ ID NO: 837 - DNA, 525 bp, Glycine Max
atggctggtaggtacttcagtatcctttctctgttgcttcttctggtggcattctcttgcacagaagccaatgcagatgttccaaaaacaacagagaagaaaatagaggtggtggtggaagccactgtctactgccagagctgtgaccactttggaacatggtctttgattggagccaagcctattccttcagccaaagtgagtgttacctgcaaaagccacaatggtcatgtgagctactataaggtctttgagacagacaaagatggttacctttatgcaccacttgaagggttcaagatgcagcattatatacttgatcaccccctccactcttgctacgtgaagcctgtttggtctcctcttgaaagttgcagccttctctccaatgtcaattatggtctcaatggtgctccacttcgttatgagaacaagaaattgcatggaagcaagtatgaggctgtcatatatgctgctggtcccttggctttccgtccctctgaatgctcacagactcaccactaa

SEQ ID NO: 838 - DNA, 381 bp, Glycine Max
atggctgtggctttgacgattgtgttgagcttgctctcggttctctcttctgcatcttgtgcacgaatggtgggggggaagacggaggtccccgacgtgagaacaaacagggaagtgcaagagcttggaaggttcgcggtggaggagtacaaccgcggtttgaaacagtggaagaacaatgggagtgaacagttgaacttttcggaggtggtggaggcgcagcaacaagtggtgtcaggaatgaagtactacttgaagatctcagctactcataaaggggttcacaaaatgttcacctctgttgtggtggtcaagccatggcttcattccaagcaactccttcattttgcgcctgcagcaccatccagtaaagatttttga

SEQ ID NO: 839 - DNA, 1506 bp, Glycine Max
atggcttacaacttccctgatgtgttttgctggattcagagtcttccaccaatctcagaatgggaaacaagttccatgtccttaaacatatgttcttcttcaagctcatcatgccaaccacgtcttaatctcaccgtatccaaaaacaatagcaataatcattcctcatcaaacctctattttgttattattgcagactgcaacattcccatccatctttggacctctaaacctttcaagccaagcagcaccactattactaataaaacccacaataataataagttaatagatgatgaagaaaccatttccaatctctttgttaatttcattcaagccatccttctttatggctccaacaaaaacagcactcccttcctcagatttccaaaccttgactccatcacttccaacaacttttcagatgttttcaatctttctttcttcaccctcttgttcctagtttgcatatatgaagctcctgctgcagattttcgttctgggtttcagtcaagacaagcatcacataagattatgaaactcctagggtctaacttggaagagcattggatgcgttcattgaacctcgcagttactaactgggttggggaacttgaagcacataacaaccccttcagaacaccgtgccctttgttttcttatgcattttcaacaattgggttgtggaaggtgcagctttattgtcccctcttggtcatggatgttgagaattcaaaaagcaatccagctagcgagaggcttcaattctccctcagatatcaccatgtggaaggtgttcttcagttcaatcacaaagtcttgatcaaagaggagtgggctgaaatcatggtggacattgacaacataaggtgtgatgttataaaattggtgaatgagtcccttatgagccaacgaggggtaggtgcagctgaaaaacattttccttcgagaatatcattgcaacttacaccaacactccaagaccaagtgttgagcctatcagttggcaagtcctcagagaaccctcgaaaagaaattggtgttgacaaaagcgtggaagcttcatttgaaccatccaatcccttggcacttaaggtgtcagctggagaatcctcaaccgttagtttgaagccttggaaattcgaggaatctgtttatggatacagtgcaaatttgaattggtttcttcatgatagtgttgatggcaaagaagttttctcatcaaagccttcaaagtttgcaatgcttaacccaaagtcatggttcaaaaaccgatactctagtgcttaccgacctttcaacaaggaaggaggggttatatttgctggtgatgaatatggagaaaaagtgtggtggaaagtggacaaaggagccatagggaaaacaatggagtgggagataaggggttggatatggttaacatattggcctaacaaacgtgtaacattctacaatgaaactaggaggttggagtttcgagaaatagtccatctcgacgttgcttag

SEQ ID NO: 840 - DNA, 963 bp, Glycine Max
atggcttccattgccggatccagctgcgtcgctctccgaaccgccaatttcgcctcctccgataaccggaaaatcggtcagatccggcaatggtctccaattctcactaatctccgtcctgtttccggtcttcgccaccgatcaaatactccgtttagctcctccggtgtaagagcacaggttgctactctggaggaagcaggaaccggagcaactcaaaaagtggaatcgccggttgtagtggtgaccggagcttccagaggcattggaaaagcgattgcactgtcgttaggtaaagcaggttgcaaggttctggtcaactatgcaaggtcatccaaggaagctgaggaggtttccaaggagattgaggagtttggtgggcaagctcttacatttggtggagatgtttctaatgaggatgacgtggagtctatgattaaaactgcagttgatgcttggggaacagttgatgtattaataaacaatgcaggaataactagagatggtttattaatgagaatgaagaaatctcaatggcaggatgttattgatctaaatctcactggtgtttttctttgcacccaggctgctgctaagattatgatgaagaaaagaaagggaagaattgtcaatattgcatcagttgttggtttggttggcaatgttggacaagccaattatagtgctgcgaaagcaggagtaattggcctgacaaaaactgttgcaaaggaatatgctagcagaaacatcactgttaatgcagttgctccagggtttattgcatccgacatgactgccaagctaggacaagacattgagaaaaagattttggagacgatcccattaggaagatatggccaaccagaagaagttgccggactggttgaattcttggctcttaatcaagctgccagttacatcactgggcaggttttcaccattgatggaggtatggtgatgtaa

SEQ ID NO: 841 - DNA, 1293 bp, Glycine Max
atggcttcgacttttggtgctcaacctggacctgttgctggatttcagtcgattattccaaatcaacatgtttctgtgcaaacaccaccaccaagacagattttacagtattcgcatatgactcagacaagtcctttgggtcacattgggcccctaagaaatcctgtacaaaatttgtcaactccaaattcttcattttcatttcctgttactttaagccaagcaatgccaataggacaacatcagacatctgtgtcttcaatgcatctacctatatctggtatatcatcaccaccgatacctaaccagccattgacccatcttggtgtctcttctggcctgaacgaagcccctgtcactgttaaaatgtctgttggtcccagcaatatggggccagtggttccacctgcaagacctgtttctctacatcaacagccagatgttgcatttaagccaccgcagtcaaatatgtcaatgattacacgatctgccacctttcttccacatcaagtaggaatttcccctggacaaccatcttctttgagatcaatgcctgtaccaatacgtgcacctacacatttatctgcaaaccatttatcaggacctgtttcatttccttcacgtggaatatccccttcacttccattgcctcagcaagcaggaatacctaatcttgcttctggagttgctccttatcacacccatgtaaaaccaccagtcttggggacatcaaaatctggaaattttacttttcaatcacatctgcccaatgcagactatggtcaagtgttttctggaccaaacagtcaatcaggtgctacacaagagccaccttctggtccacgacctccaccatttgggtttgctgtgcctgatcagcctcgtcaaatctttccaaggacacaattccctggtcaagtggatcaagccgttccctttggggtaagattaggttccatctcgaactcaattccaccacccagacatgctgtatttccatatgctggtcaacctgcacctagatcgtcagtcccacaaatgggtatgaagaacttcatttctgcccctcaaatgccaaatttgaccaatgctggtgctcaaagaggcatgcctattcggcaaagctatcctcctcagatggcacggccagatatcccaatgcctctgaatcaaaagtttgtcaacaatccccccatggcttctggtaagatagcatatgctgcggaccaaatttatgatcccttttcacccacttctgcacctccacaacagaaaggtaatcctggaaaatga

SEQ ID NO: 842 - DNA, 1962 bp, Glycine Max
atggcttcttcagctatggaaacctgcatatccgaggatttgcacatgcaggttgacattgagaagaaggcgcaggacataaggtctcagtgggtgcttaacgctcctgagcccccgagtccatggcgtgtggttgcagattctgtgagcaaaaccatctcccactataaacataagctttcctctctcacagatcaaccttgcaccacactcctcctttcagttctgcgggtcatttttcctattcttgcttggggcagaaactacactgctactaagttcaggaaagatcttcttgcaggcctcactattgctagtctttgtattccccagagcatcggatatgccaccttagcacatcttgatcctcaatatggcctttatacaagtgtggtaccaccacttatctatgctgtaatgggaacttctagagagatagcaattggtcctgtggcagtggtttctctgctgttatcatcaatgatggtgaaattagtagaccctgctactgatccagtgggttatacaaagctgattttgcttgctactctctttgctggtatctttcagacttcctttggactcttcaggcttgggttccttgtggatttcctatcccatgctgcaatagtaggatttgtagcaggagcagccattgtgattgggcttcaacagttaaagggactcttaggaatcacccattttacgaccaaaaccgacatagtctctgtcatgaaagctgtttgggaagcagttcataatccatggagccctcgaaattttatcctgggatgctccttcttggtcttcatcctaacgacgagatttttgggtaaaaggaagaagaagctgttctggttggcatcaatctctcctcttgtatccgttgttctgtcaactctaattgtgtttctcacaagagctgataaaaatggagttaaaattgtgaaacatgtcaaaggggggttgaatccaagctccctccatcagttagacttcaataacccctacattggagaagtggccaaaattggactagtggttgctgtcgttgcccttactgagtctattgctgttgggcgatcctttgcatccatcaaaggataccaacttgatggaaacaaggagatgatgtcaataggtttgacaaacatcataggatctttcacctcctgctacgttgcaaccggttcattctcccgtacggctgttaattatgcagctgggtgtgaaactttggtgtcaaacattgtgatggccataacagtcttgatatcattgcagtttttgacaaagctattgtattatactccaacagctattcttgcttctgtgatcctctctgccctcccaggactcattgacgttagtgaagcttacaaaatttggaaggtggataagatagactttcttgcttgcgctggggcattctttggagtactgtttgcttctgtggagattggtctacttgttgcggtgttaatatcattttcaaagatcattctgatctcaattcgaccagggacagaaactctaggaaaaattcccggaactgatttgttctgcgatgtctatcagtatcctatggcagttaagattcccggggttatgataatacgagtcaagtctgcgttgctttgctttgcaaatgccaatttcgttagagaaaggatcatcaaatgggtcactgaggaagaatcagaagatgacaagggaaattcaagaagcaccattcaactcgtaattcttgacacctccaatttggtgaacattgacacctctggaattactgctctagaggaactgcataagagtttgtcttcacaaggaaaacagttagccattgcgaaccctaggtggcaagtgatacacaagctaaaggtgtccaactttgtcggcaaaatcggtggcagagtctttctgactgttgaagaagctgttggctgcaagagccgctgctaa

SEQ ID NO: 843 - DNA, 831 bp, Glycine Max
atggcttcttctcgaaatgagttttatgcacttatggtagtggtggtggttggctccatagtggcttcctgtggtgctaacttcaaccaagactttgatctaacttggggtgatcagcgtgctaagatattcaatggtggacagcttctatctctttccctggacaaagtctctggctctggcttccaatccaagaaagagtacttatttggaaggatcgatatgcagctcaagctcgttgctggcaactctgccggcactgtcactgcttactacttgtcgtctcaagggccaactcatgacgagattgattttgaattcttgggaaacgtgagcggtgacccttacattctccacacaaacgtgtttacccaaggccaagggaacagagagcaacaattctacctctggttcgaccccaccagaaacttccacacttactccatcatctggaagccccaacacatcatattcttggtggataacattcccataagggtgttcaagaatggtgagactattggcgttcctttcccaaagaagcaacccatgagaatctattctagcctgtggaacgctgatgactgggccaccagaggtggtttggtgaaaactgattggtccaaggcaccctttacagcctactaccgcaatttcaaagccacagagttctccaccaattccttctctgatgctgcatggcagagcaacgagcttgatgcctatggcagaagaaaactgagatgggttcagaagtacttcatgatctataactactgcaacgatcttaagcgattcccacaaggcattcctgttgagtgcaggcgctga

SEQ ID NO: 844 - DNA, 1419 bp, Glycine Max
atggcttctttgccaacacttctctcgttcgccgtcatcttcttcaccgtcgccctcttatacctccgccgcgtgttccgccgccgtcagttccgcctcccgccggggagccacggcctgccgttgatcggcgagacgctgcagctgatatcggcgtacaagagcgacaatccggagcctttcatcgacgagcgcgtggagcggtacggttcgatcttcacgacgcacgtgttcggcgagccgacggtgttctcggcggacccggaggtgaaccggttcattctgcagaacgaagggaagctgttggattgcagttatcccggttcgatatcgaacctgctcggaaaacactctcttctgttgatgaaaggtgctctccacaagagaatgcactctctcacaatgagcttcgccaactcctccatcatcaaggatcatcttcttcaccacatcgaccgcctcatctgcctcaacctcgatgcctggtccgacactgtctttctcatggatcaggcaaaaaagataacatttgagttaacggtgaagcagttgatgagctttgacccagatgaatggactgagaatctaaggaaagagtatgttcttgtgattgaaggattcttcactctcccttttcctctcttctccaccacataccgcagagccatcaaggcaagaacaaaggtggcagaggcactagcgttggtagtgaggcagaggagaaaagagtatggtgaaaacaaagagaaaaagagtgacatgcttggggcactgttggcctccggcgaccacctttccgacgaggaaatagtggattttttgttggctttgctcgtcgccggttacgaaaccacctctaccataatgactcttgcgatcaagttcctcactgagactcctctggccttggcacagctcaaggaagagcatgaccaaatcagagcaaagagtcacccaggggcaccactggaatggacggattacaagtcaatggcatttactcaatgtgttgtgaatgagaccttgagagtggcaaacataattggtgggatatttaggagagcaacgacagacatcaacataaaaggttacactattcctaagggatggaaagtctttgcatcatttcgtgctgtacatctgaatcctgaacattacaaagatgcccggtccttcaatccctggagatggcagagtaactcatcagaaacagcaaatcctgggaatgtttatacaccatttggaggagggccaaggttgtgccctggctatgagctagccagagttgtactgtctgtcttccttcaccgcattgttacccgcttcagttgggttcctgctgaggaagataagttggtgttttttccaactactaggacgcagaagaggtatcctattattgtgcagcgtagacattag

SEQ ID NO: 845 - DNA, 1698 bp, Glycine Max
atggcttggttatggcgcgcaggagccaagctctctcttgttgcctccgccgtgggcggtggcgccacggcggcgctcattgcaacctccgacgaccccgaaacggcgctcaagctttgcgccaccgtcccccatcgcctcttccgtgacgccgccaccgccgccaacattgctttcgattatgaatattcactgtggggactcctggaagggagtagtgagagggagagaatcaaacatgaagttcacctccggtcagcacaaaaacttcaagatctgtgtttcaagaatggaggggtttatataaagcttgggcaacatcttgggcagttggaatatttggttcctgaggaatatgttcggacaatgagggagtctatgctaaatagatgtcctgtatcttcttatgagcaagtatgcaacgtattcaagaaagagcttggagacacaccagataaaatattctccgagttcgacccagtccctatagcaagtgcttccctggctcaagttcatgtagctcgcacgcatgatggccaaaaagttgctgtgaaggttcagcatactcacatgactgatacagcagctgccgatcatgccactgtggaattggttgtgaacacattgcatagattttttcccagttttgattataggtggttgattgatgagattagtgaaagtttgcccaaggcaaatgttggattttggaattttatgtttctcattcatcattcttggattctgttttattttctccttcatgaattagattttttaactgaggcaaagaatagtgagaggtgtttggagaacttccacaagttgtctcctcatattgcgaattatgtatatgcaccaaaagtatattggaatctgagtacctcgaagctgctgacaatggaattcatggagggtgcttatgtaaatgatgtaaagaccattcaaaaacttgggatcaacctgcatgaactttcaacattggttagtcaaacttttgctgaaatgatgttcaagcatgggtttgtgcattgtgatccgcatgctgctaacttattggtccgcccattaccttccagcaaagctagtatttggggcaggagaaaaccacagttgattcttttagaccatggactctataaagagcttgacttccaaacaagaactaattatgcttcactatggaaggcattggtatttgctgatgctaatgcaatcaaggaatacagtacaaagttgggagctggggaggatttatatgcactttttgcgggagttctaactatgaggccatgggatagagttgttgacccatctatggatcatttagttatacagggaaatgagagtgatcgattagaactgcagatgtatgcttctcagtatttccatcaaatctcggagcttctaaggagattaccacgagtgattcttctaatgctaaagacaaatgactgtttacgagcagtcaataattctctgttacagggatcatctttggagacattttttgtaattggaaaggtttcttcggaggctgtcattgaggcaaagatgttgcaaagcaaatcacttttaacttggctaaacgttaaattggataagattttgctggaagtacgactttggggaatgcaggtggccttgtggcttttacaactaagaaaatctttgtcttggtctaaccaagcattatag

SEQ ID NO: 846 - DNA, 435 bp, Glycine Max
atgggaaaatatcttgaatctgcggcgaggttggaagagctatcgcggattgtgtcatctgctgcgaagcccaataggtcaaagggaacgctacccagatcgcccaaccgtgttgccactcctcgaattgcgaacccaattggtgttaaggtcgaacctgcgaaaaagatggaacctttggaatgtcggacacccctcgccaaggttgtcgcagattgctccaagcgctggttccaggacaccctcaaggaggccaaggctggggactctgccatgcaggttttggttggccaaatgtattactctggatatggtgttccaagggatcctcaaaaggggcatgtttggattagtaaagcatcaagaaatcgaaattcagtttggaaagtgtgcggtaaacggccaggatacagagcaagcgattctgattcatga

SEQ ID NO: 847 - DNA, 435 bp, Glycine Max; identical to SEQ ID NO: 846

SEQ ID NO: 848 - DNA, 7506 bp, Glycine Max
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcgcattcggggacttccaattagtaccaaccattgaagaatttgaggaaattctaggatgtcctctcgggggaaggaaaccatatctttcctccgggtgtctcccctctttgagcagaattgcaactgtggtcaaggattcagccagaggtttggaccgcataaaacagactcggaacggcatagcgggcctgccacagaagtacctagaagacaaggcgatgggtatggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacctttgaccgaaggtgcgaaaagagtagcgcacggatcatctgttgcttacccgccctctgtgtttggttggtttcacacttgttccaacaagacacaagacatccatgtccgctcctgagccatcgctcatgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactataccaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaagttggctgctacacacgttcggaaggagtgcgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacaggtgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcctcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaagtataaagggacgacttgtcccaaaaaccatctcaaaatgtactgccgtaagatgggcgctcattctaaagatgaaaagctgttgatacacttctttcaggatagcttggccggagctgcggtagtgtggtacactaatttggaagcttcccgtatccgtacttggaaggatctgattaccgccttcctaaggcagtatcagtacaattctgatatggctccggaccgtactcaactgcagaatatgttcaagaaagagggtgaaacctttaaagaatatgcgcagcgatggagggatttggcggcacaagtagctcctcccatggttgagagagagatgatcaccatgatggtagacactctgccagtgttctactatgagaagctagtgggttacatgccgtccagctttgcggatctggtgtttgccggggaaagaatcgaggttggattgaagagaggaaagtttgattacgtttcctccacaaacgtgaacaccaaaagaatcggggcaacaggggcaaaaaggaaggaaggagatgcccatgccgtctcttcaacacccgcatgggtcaaaccccagcaaacacctcatggtacccatcagtacgcgcaacatcacccaagcttctcggctcatgctgggaacgcctctagttcaacacccgtgcagcctaaggcacccacccagagggaagctccccaagttccaactccgaacacggctcgaccggccggtaattccaacacgacaaggaacttccctccaaggccattgccggaattcaccccgctcccaatgacgtacgaagatcttctaccatccctcatcgccaatcatttggccgtggtaactcccggaagggtcctcgaaccccctttcccgaagtggtatgaccctaatgcaacttgcaagtaccatgggggtgccccggggcattccatcgaaaaatgcttggcccttaaatacaaggtccaacatctaatggatgccggatggctgactttccaagaggatcggcccaatgtgaggaccaacccgctcgccaatcatggagggggggcagttaatgcagttgaatccgataggccccacaggtccaaacctttaagggatgtggcaacccctaggaggtttatctttgaggccctacaaaagggaggtgtaattccccatagtgggtgtaaggaggattcctgtctgctacatcccgacgagatgcatgacatggagacgtgtttggaagtagaggaattgttacaacggatgatagaccaaggtcgactagaagtcggcattgaaggaaaagaagagcagcatatatgcatgcaatctacggaggggagtggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacacctccggggaagaaggaagaagaagtcactgacgtcagctcgctgtcagctaaagtaacaaatatcacggggctgagcggtgtgacccgtagtggtcgtgtgttcgcacctccgggcctaccagtccaacccgccgacgtcaaaggaaaagaaaaagtggtggaggaacaagatggcgaagcaccccacgcttcgaataaagatatgccagcaaaggggcccccagagaaaagggatggtagaaaggaggtgtcgctagaggaagccagcgagttccttcggataattcagcagagcgaattcaaggttatcgaacagctcaacaaaaccccggctagggtctcgctgttggagttacttatgagttccgagcctcatcgggctctgctagtaaaagtgctgaacgaagctcacgtggcccaagatatttcggtagaaggtttcggagggctggtcaacaatatcactgccaacaactatcttgccttcgccgaagaagaaatccccgccgaggggagagggcataataaggctttacacgtatcagtcaagtgtatggaccatatcgtggccaaggtgctcatcgataatggttccagtttaaacgtgatgcctaagagcactttggacaagttaccattcaatgcttcccatttaaaaccaagttcaatggtggttcgggccttcgacggcactcgccgagaggttaggggagagatcgatctcccagtacaaataggccctcacacctgtcaagtcaccttccaaataatggatattaaccccccctacagctgcctgttggggcgcccttggatccactcagtgggagttgtgccttctacactccaccaaaagctgaaattcgtagtggaggggcacttggtcatcgtgtcaggcgaggaagatatcttggtaagctgcccatcctccatgccttatgtggaagccgcagaagaatcgttagaaaccgctttccagtcttttgaggtggtcagcatttcctccgtggactccctctttgggcaaccttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcggacatgaaaagaagcatcgcgggaaggaaggacagtggtcagagctcgcgttggagacaagaaagtgaaggaagcccgccctgccacataagtagaagctttataagtgcgggtctgggagacgaaggtcaagtgttcgcgatatgtgaaagtgatgttccaagtacttcggatttggtccgaccatgccctcctgatttccagctgggaaattggcgagtggaggaacgccccggcatttacgcaacgagcataatattcgatgacgagtcccccgaaggtactaatacctgggacccgtctatcaacttcgagcaagaaatgaaccaaacggaagatgaaggagatgaggatgtgggatttccttcggaactagaaagaatggtcgcccatgaggaccaagaaatggggcctcatcaagaagaaacagagctagtagacttaggaattggcagtggaaagagggaagtaaagataggtacaggcattacagcacctatccgtgaagaattaataatcctgctaaaagactaccaagacatctttgcttggtcataccaagatatgcccggtttgagttctgacattgtgcagcaccgattgcctctaaatcccgggtgttccccagtaaaacagaaattgaggaggatgaaacccgaaacgtccttgaagataaaagaagaagtgaagaagcagtttgacgttggatttctggccgtcgctcggtatccagaatgggttgccaacatcgtaccagttcctaaaaaaggtgggaaagtacgaatgtgtgtagattaccgggacctgaatcgggccagtcccaaggacaattttccgttaccacacatcgatatcctcgtagataacacggccaatttcgctttattttccttcatggatggtttctctggttacaatcagataaagatggcgcccgaggatatggaaaagactactttcgtcaccctgtggggaacgttctgttacaaggtaatgtcctttggactcaagaacgccggggcaacttatcaacgggccatggtagctttgttccatgatatgatgcatcaagagatcgaggtctacgtggacgacataattgctaaatctaaatctgaggaagaacaccttgtcaacctgcggaagttgttcgaaaggcttaagaaatatcaattaaggttgaaccccgctaagtgtacctttggggtcaaatcagggaaattgcttggtttcgttgtaagccagaaagggatagaggtagaccccgaaaaagtgaaggctatccttgagatgccagaaccccgtacggagaggcaagtccgaggtttcctggggcgcttgaattatattgccagattcatatcgcagctcacagccatttaggcttttggaaggatcaaaaagtgcctaatgaatcctcctgtgcttatgccaccagtacctggaaggcctctcattttgtacatgacaatcttggacgagtcaatggggtgtatgctggggcaacatgacgactccgggaagaaagagcgcactgtttactacctaagtaagaagttcacgacctgtgagatgaattactccttgctcgaaagaacgtgttgtgctttagtatgggcatcccatcgcctaaggcagtacatgctgagccatactacctggttgatatccaaaatggacccggttaagtacatctttgaaaagccagctctcacgggacgaatcgcccggtggcaagtcttgctatctgagtttgatatagtctacgtcacccaaaaggcgataaaaggaagcgctttggcagattatttggctcaacagcctcttaacgactaccagcccatgcatccggaattcccggatgaggacatcatggccttgttcgaggaaaggttggacgaagatcgggacaaatggactgtatggtttgacggagcgtcaaacattctaggtcatggcgttggggcagtgttgatctctccggacaatcaatgtgtacctttcacagccaggctaggattcgactgcaccaacaacatggccgaatatgaagcatgtgccctagccgtccaggcagcaattgactccgatgtcaaactactcaaggtgtacggcgactcagcgttggtaatccatcagctgagaggggaatgggaaactagagatcccaagctgataccctacaaagcctacatcaaggagttggctgagactttcgatgagatctccttccatcatgcacgaattgatcatttggtgttcccatggcaacaacgttaa

SEQ ID NO: 849 - DNA, 726 bp, Glycine Max
atgggaaggggaagagtggagttgaagaggattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgttggagaggtaccagaaatgcaactatggagcgcctgaggacaatgtggcaacaaatgaagccttggagttaagcagtcaacaagaatacttgaggctgaaagcgcgttatgaagctcttcagcgttctcaaaggaaccttatgggagaagatcttggtcctctaagcagcaaagagcttgagtcacttgaaaggcagctagattcgtctttgaaacaaatcagatcaataaggacccaattcatgctggatcagctttctgatctacaacgtaaggaacactttctaggtgaatcaaacagagatctcatacaaaggttggaagagtttcaaataaatccacttcaactgaatcctagtgctgaagaaatggggcatggacgctatccaggtcaaccccaaggccatgctctctttcaaccattggactgtgagccaaccttacaaattggatatcatcctgatccagtatcagtggtgtcagaaggcccaagcatgaataattacatggcaggatggttaccatga

SEQ ID NO: 850 - DNA, 522 bp, Glycine Max
atgggaaggggaagagtggagttgaagaggattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgttggagaggtaccagaaatgcaactatggagcgcctgaggacaatgtggcaacaaatgaagccttggagttaagcagtcaacaagaatacttgaggctgaaagcgcgttatgaagctcttcagcgttctcaaaggaaccttatgggagaagatcttggtcctctaagcagcaaagagcttgagtcacttgaaaggcagctagattcgtctttgaaacaaatcagatcaataaggacccaattcatgctggatcagctttctgatctacaacgtaaggtgaatcaaacagagatctcatacaaaggttggaagagtttcaaataa

SEQ ID NO: 851 - DNA, 732 bp, Glycine Max
atgggaaggggaagagtggagttgaagaggattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgttggagaggtaccagaaatgcaactatggagcgcctgaggacaatgtggcaacaaatgaagccttggtattggagttaagcagtcaacaagaatacttgaggctgaaagcgcgttatgaagctcttcagcgttctcaaaggaaccttatgggagaagatcttggtcctctaagcagcaaagagcttgagtcacttgaaaggcagctagattcgtctttgaaacaaatcagatcaataaggacccaattcatgctggatcagctttctgatctacaacgtaaggaacactttctaggtgaatcaaacagagatctcatacaaaggttggaagagtttcaaataaatccacttcaactgaatcctagtgctgaagaaatggggcatggacgctatccaggtcaaccccaaggccatgctctctttcaaccattggactgtgagccaaccttacaaattggatatcatcctgatccagtatcagtggtgtcagaaggcccaagcatgaataattacatggcaggatggttaccatga

SEQ ID NO: 852 - DNA, 1101 bp, Glycine Max
atgggagaaatagaaagagaggagatgtcgtcgacaaggtgggagaaggaggaggaagaagaagaagaagaggcccaaatggatatctggaagtacatatttgggtttgtggaactggcagtgataaaatgtgcgattgagcttggcatagctgaagccatagagaagcatggaagtcccatgacactatcggagatatcatcaagtttagggtgtgatacttcacatctgaagcgcatcatgaggttcctggtgcaaagaaagatattcaaaggcgacgggtgcagcaggggctattctcaatcagctctgtctcgtcgattgatgagaaacggcgaacacagcatggctagttttctcttgctggagagtagtcctgtaatgctggcaccttggcacagtctgagtgctcgcgtcatggccaatggcaacccctcatttgcaaaggctcacggtgaagacgtgtggcgctatgctgccgcaaatctcgatcacagcaacctcatcaacgaagcaatggcatgtgatgctaagcttgttatgcctatcatcattcaaagttgcagcgaggcatttcatggcctcaagtccttggtggatgtcggtgggggcaacggcaccgccatgcgcatcctggctaaggcttgcccttccattcgacccatcaattttgatcttcctcatgtcattgccctctgcgatggcgatggcgatggcgtccaacacgtgtcaggcgacatgtttctaagtgttcctaaagctgatgctgcttttcttatgtgggttttgcacgattggtcagacgaagagtgcatccaaatcttaaagaagtgtagggaagccatatcaaattcaaaggaaaacggaagggttattattgtggaggcggtgattgaaggagaaggagaaggagaaggagggaagcatgacggattgaaggatgtgggattgatgctggacatggtaatgatggcgcacactaacttcggcaaagagcgcacactcaaagagtgggaatatgtcatcaaaatggcaggatttagctcatacactgtcaaacccattcatgctgtgcagtccgtcattatggctttctactaa

SEQ ID NO: 853 - DNA, 840 bp, Glycine Max
atgggagataaaaggctcagaaatcatggaagaaactttagaatggtttccattgtgactatggaaaattactatgattctggctggcacatgggcaccagcaactgggctcaatgcagtgatcattcttcttcttcttcctttgcagtgcctacacaacaaatactccctcatcatgtcactgacgctgcctctcttcaatttggtgagtttcactcatggtcacttcccattgaaggggctgcagaagagagagcaataagtgcttccaagagtcacaggcaagctgagaaaaggcgcagagacaggatcaatgcacagcttgcaactcttagaaaacttattcccaagtctgataagatggacaaggcagctttactagggagtgtgatagaccaagtgaaagatctaaagcgaaaagccatggatgttagcagagccttcacagttccaactgaaatcgatgaagtatcaattcatcatgaccatgttcttcaagatgaaagctgcactgaaaaagtgaacaaattgaaggacaatattgtgatcaaggcttctgtttgctgcgatgatcgaccagaacttttccctgaactcatccaagtcctcaaaggcttgagactcacagcagttaaagctgacatagccagtgttggtggcagaatcaaaagcatattggtgctttgttctaaggatagtgaaagtgtttgccttgccactctcaaacagtccctcaaatctgctatcaccaaaattgcttcatcatcatccatggcttctagttgtccctctagaagtaagaggcagagattcttcttgccttctcactgcctacagtaa

SEQ ID NO: 854 - DNA, 2088 bp, Glycine Max
atgggcaaagagaagagacgtggaatcatcctcgccttcaccggagctgcggcggtgctcgcaattgcggcgaacctagccatcaccgcaatcaagtaccagaaggcaaaaaatgctaagaagaaaggttctatggtgcgcgttaatctatctgcatctgagattcttaagctagcagagcaaatcattgctaactcaaacaaggtccataattctgttgcgtcggtgcctctcgacaagaaacgtcggcattctctctttcactggagaaataatcttcgagctattgaagcattttgctcgttatctaattttgcaattggatcaaggttacgcatgcaaatgttatatcacctctggcagaactgcaagcgcagcaattcccactggtccagtgtgtttccgaagatggtatctactcgggaggatgtacgcaaagcaagtgcagaagcagtgcgaagactagatgctcattttgatacgtgcagcaaacgtgaagatgtgtatcttgtcattaaagcatttgcagtaactaagaaccaaggagttctctggaatgtgagagactttgagcgaaatggattgaacctcacagcaagcaaaagagaagagttgcagcgtctaagggatcagattgatgaattaagctttaaatatatccaaaatctcaatgatgatagcaggtttattctcttcaccaaggcagagttagctggattgcctccagagtttctcaagggtttagataaatcggacaatggaaaatttaaaatttccctgagaagtcatcatgttgcagctgtacttgaattttgcaaggttggaaccaccaggcaggtggtatcaggggcatatgggaatcggtgtggagaaatcaatgtctctatcttagaaagactggtgcaacagcgccataaatatgctcgtttacttggctattcatgctatgcagagtatgtcatcgatgttagaatggcgaagacaccaaaaaaggtgtttgagttcctgaaagacatatcgacaagtttaactggcttggccttgaaagaacttaatatcttgaaagatgtgaagaagaaagaggaaggggagtttccatttggaattgaggacctactgtattatgtaaaacgggttgaagagcaggattatgatttggactttggagagatcaagcaatacttgccaattagtgtggttttatcggggatcttcaaaattatccaagatctatttgtgctggacttgggttctggtgaactcttaggttattgctaccttgatttgttctcaagggagggaaaatatggtcatacttgtgtgttggctctccagaacagtgcattaacaagcagtggggcacatcagataccagttgcattgctaatatctcagtgtcagaaggatgctgatggtagttctggattattacggttttctgaagtggtcagtcttttccatgagtttggccatgtggttcaacaaatttgcaaccgtgcatcatttaccagaatttctggattatgtgttgatgctgactttgtggaaatacctgctcaactgttagaaaactggtgttatgaaagctattctctcaagttgatttcgggatttcatcaggatattacaaaaccgttaacggatgacatatgcaaatcaattaaaagatggaggacttctttttctgcacttaaattgaagcaagatattctatgctgtctttttgaccaaatcatacattctgcggataacatagacattcaggaattattcaagtatcttcatcccatggagatgttaggcttgccgatattagaaggaaccaatccagcgtcatattttccttctactgtcgttggttatgaggcagcttgctacagtcgtatatggagtgaggtttttgctgctgatatattcacctcaaagttctgcaacgatgtttcaaaccagcaagccggcatgcaattcaggaacaaggtattggcctcggcaggagtgaaagatcctattgatgtgttattagacttcctaggaagagaaccatcaatccaagcttacattgagaacaaagtcaagtatgttttgtaa

SEQ ID NO: 855 - DNA, 195 bp, Glycine Max
atgggcagagtacaccttgggcatttgaaaaattcagaatctggtgtctgtaatcatattcttcttttcctatacatgttgacatcaattagttttaattttgccagttgtagacagtgtatgaggagctggtttgaccagagtgtggcctctccaccaagtgaaagaatgcccttgcttgctttgcctgagtag

SEQ ID NO: 856 - DNA, 789 bp, Glycine Max
atgggcctcgttaggaacaatgccaccttcgttcccatttgcgcttcctcaacttctcacgcctcagatcatgcaacaacgtgtggctcccccgcatcagcatggattggtaaaggactcacctgtgtttgcttcaagcgtaagggaaactgtcaacgaatctgcattagtttgacccctttacaggaggaaagactgagaagactaaagcgccggatgaaagtttactttgatgcttccaagcttgaacaccaggaagcgttgagagctctgtggtctgcttcgtttcctgatcaggagctccaaagcttgatttctgatcaatggaaagaaatgggatggcagggtagagatccatctactgatttcagaggagctggtttcatttcattggaaaacctactattctttgcgaagacattctcaacttcttttcagcggctactgaagaaacaaggaggaaaaggagctgtttgggagtatccctttgctgttgctggcgttaacatcacatttatgattatgcaaatgctggaccttgatgccaccaaacccaggacttttgtaagagcagtttttctacagatgctttcagaaaatgaatgggcatttgacttgctttactgcgtggcattcgtggttatggacaaactgtggctggagagaaatgctacttacatggaatttaatgatgtcttgaaatccacgcgagttcagctagagaaagagttgttgatggatgatgttctacggattgaagacatgccttcttacagtcttctttgttga

SEQ ID NO: 857 - DNA, 981 bp, Glycine Max
atggggaaaacacacgacaacgtagttgggcttatattggccatctcttccactgttttcatcggttctagctttataattaaaaaaatgggtcttaaaaaagctgccgaccacggcaacagagcagccacgggagggcattcgtatctgtatgagccgtggtggtgggctggaatgatttcaatgatcgctggggaaatagccaattttgcagcttatgcgttcgctcctgcaatccttgtaactcctttgggagctttgagcatcattttcagttcagtgttggctcacttcatattaaaagagaaattgcacatttttggcgtgcttgggtgtgctctgtgtgtggtgggatctacgtctattgttttgcatgcaccgaaagagaaagacattcattctgtcaaggaagtgtgggaacttgctacaggaccaggttttattgtctacatttgcgctatagtgatattagtttgcgtccttcatttccgttttgtgcgaagccatgggcagactcatatgatggtgtatctcggaatatgttctcccaccggctccattacggttatgggtgtcaaagcagtgggaatcgctttgaagcttacatttgaagggacgaatcaatttgtttactttgagacctggatatttacagtggttgtgataggatgttgccttttgcagattaactacttgaacaaggctttggacgcctttagcactgctgtggtgtcaccagtttactacgtgatgttcacatcatttacaatcgtggccagcattatcacgtttaaggaatgggcgaagcaggattcaacgcagattgctactgagttgtgtggttttgtgacaatattatctgggaccttcctccttcacagaactaaggatatgggaaataaaccctccgacgcctccgttcattcaagtcctgaagataacaatagtaatactaagacacctctaagcaaccaaatttga

SEQ ID NO: 858 - DNA, 2646 bp, Glycine Max
atggggaagaaagtcagaaagaagactcgaggttctgccaaggagaagggggttgctacccatttgcctatcaaggttattgagtcatccaacccgactgttgagtctgttgatgaggttgcaaaagagactaattcttgccctcatcttgtaaaaggtgttaattttgacagattgtccactaagattggttcttctggatccgttaggtgtgaagattgtagggaaggtgcgaatgatagaaggagtggtaaaggaaaaggtaaacatgagaagaagaaaggtggcgcatcattagattcaaaatctgagtcaaaatctatatgggtttgtttggagtgtggtcgatatacctgtggaggcgtggggctaccaataacccctcactgccatgtggtagggcatgcgaggaaaaatcggcaccctttggtagttcattttgataagccccaattgtgttggtgttttccttgcaacatgcttgttcaagttgataaatttgaaaaaactgatgaatcgtgtcatcttctatctgatgttgtgaaattgttgaaaggacgatcacaagaaaaatcttcagtggatattgaggatgtctccgttggggatgacagtattacttcagaaattaagtcaagagctctgtttgcaaatgattcatatggacaagctggttatgtagttagaggtatgattaatcttgggaatacttgcttcttcaattcaattatgcaaaatctgctagctatgaatagattgcgggacgactttctaaagttagatgctcctgttgggccacttattagttccttgaagaagcttttcactgaaacaaaccccgaatcaggattgaaaaatgttataaatcctagatctttttttggctgtgtatgttctaagtctccccaatttcgaggatatcagcagcatgacagtcacgaattgctccgttgtttactggatgggttaagtactgaagaactagctggaaggaaacagagtggttctcccaagggagatgggacctcttccaatactttagttgatgctttattcgggggtcagatatctagtactgtatgttgcatagagtgtgggcatttctcaacagtgtatgaacctttcttagatctttcagtgccagttcctactaagaaacctccaccttgcaaggcccaacaagtaccacggaccaaaaaagctaaacttccaccaaaaaaaggtggaaaaactcgagtcagagttaacagggacacttatcccttaccggttcaaactcaatcaaaccaattatccagctcagaatcatcttgccctgatcatgtagctgataaagaggacttgtcttcacctaatttggttactcctggagagtctcaacatatgcaagtgcttgacaatggtgcaatcaaaacatcagacggattttcatggttggattatgaggatgccccagaggtacagggtactgagagcaaagatgaatgtttaaatgaattgcatggacaggccatctgtgaatctagtggtcttgtttgtttccttaaggaggatgaaaacctaagtcccaaattttcttcagcaaatgggtgggaagacaaggttccattacaagttcaaggttcagaagtgctgttacttccatacaaagaagaaagttcctctgctgctgagatcattggaggggatggtgaggcctcctcatctgttttgggtggtggtcaagaagaagtggagtttgatggctttggtgacttattcaatgagcctgaagttgttgctgggcctgctcctagaccatcttcatgtagagaggttatggaagctggttttatcataagcaacagtgagtctgatccagatgaagtagatgatacagattctcctgtctctgtagagagttgcttggcacattttataaaacccgagcttctcttggatgaaaatgcttggcattgtgagaactgttcaaaatttctccaacatcaaaagatggaagagaaaaagcatgcaagagctttaactcttgttctgttaaaggatagcggatcatctgaaatggaagacacacatattgatgaattacagtcttcaagttttcgtaatacttgcaatgaagaaagctgtagtcatttagctgctgattcttgtgttattgaaaatgtccaaagaagagattctccgatgataggtaatgataacaatgactcagaagaagaggctggctccaaaagcgtgaaagtgaagagggatgcaactaagagggtcctcatttataaagctcctcctgtcttgaccattcatttgaagagattcagccaagatgcccgtggtcgcttaagtaaattaaatggccatgtcaatttcagagaaacgatggatattagaccctatattgatcccaggtgcataaatgaagagaagtatgaataccacttggttggcttagtggagcactccggaactatgagagggggtcactatgttgcgtatgtgagagggggccagaggaacagtgggaagggtggtgataaagagaatgagggttccacatggtatcaggcaagtgatgcatatgtgcgtgaagtttcccttgatgaagttcttcgctgtgaggcatacattttattctacgaaaaaatttga

SEQ ID NO: 859 - DNA, 582 bp, Glycine Max
atggggaagtctcctgattggttgtatacagatcatgcaacaacgtgtggctcccccgcatcagcatggattggtaaaggactcacctgtgtttgcttcaagcgtaagggaaactgtcaacgaatctgcattagtttgacccctttacaggaggaaagactgagaagactaaagcgccggatgaaagtttactttgatgcttccaagcttgaacaccagacttcttttcagcggctactgaagaaacaaggaggaaaaggagctgtttgggagtatccctttgctgttgctggcgttaacatcacatttatgattatgcaaatgctggaccttgatgccaccaaacccaggacttttgtaagagcagtttttctacagatgctttcagaaaatgaatgggcatttgacttgctttactgcgtggcattcgtggttatggacaaactgtggctggagagaaatgctacttacatggaatttaatgatgtcttgaaatccacgcgagttcagctagagaaagagttgttgatggatgatgttctacggattgaagacatgccttcttacagtcttctttgttga

SEQ ID NO: 860 - DNA, 753 bp, Glycine Max
atggggaagtctcctgattggttgtatacagatcatgcaacaacgtgtggctcccccgcatcagcatggattggtaaaggactcacctgtgtttgcttcaagcgtaagggaaactgtcaacgaatctgcattagtttgacccctttacaggaggaaagactgagaagactaaagcgccggatgaaagtttactttgatgcttccaagcttgaacaccaggaagcgttgagagctctgtggtctgcttcgtttcctgatcaggagctccaaagcttgatttctgatcaatggaaagaaatgggatggcagggtagagatccatctactgatttcagaggagctggtttcatttcattggaaaacctactattctttgcgaagacattctcaacttcttttcagcggctactgaagaaacaaggaggaaaaggagctgtttgggagtatccctttgctgttgctggcgttaacatcacatttatgattatgcaaatgctggaccttgatgccaccaaacccaggacttttgtaagagcagtttttctacagatgctttcagaaaatgaatgggcatttgacttgctttactgcgtggcattcgtggttatggacaaactgtggctggagagaaatgctacttacatggaatttaatgatgtcttgaaatccacgcgagttcagctagagaaagagttgttgatggatgatgttctacggattgaagacatgccttcttacagtcttctttgttga

SEQ ID NO: 861 - DNA, 108 bp, Glycine Max
atggggaccaataacactaaaatgtgcagagagaataatctaataattaaaggttccacacacaaaaagaaaaaagtgtatgtgtttcggagtgttagtgcacaatga

SEQ ID NO: 862 - DNA, 390 bp, Glycine Max
atggggaggttgtttgtggtgaatctggaaggaaagatctatagctgcaaacactgtcatacccatcttgcgctttacgatgacatctactccaggacattccattgcagacatgggaaagcttatctcttcaataatgttgtgaatgtttctgttggcgaaatggaggacagaccgatgatgaccgggttacatacggtggctgacattttctgtgtgggttgtggatcgattgtgggttggaaatatgaaactgcatatgaaaaaaaccagaagtacaaggaaggaaaatcggtgcttgaacggtacaaagtgtcaggtcctgatggaagcaattatttgatcagcaatgaggcacatgttggtggaagtgatgcagatgatgcttag

SEQ ID NO: 863 - DNA, 390 bp, Glycine Max; identical to SEQ ID NO: 862

SEQ ID NO: 864 - DNA, 1290 bp, Glycine Max
atggggcactctaaggaaaatagtgatgttgctgccaagcagaaggcaattgatgattggcttccagtcactggttcccgaactgccaaatggtggtcttcagctttccacaatctcacagcaatggttggtgcaggtgtcctcagccttccctttgccatgtcaaatatgggctggggtgccggttccaccgtgcttatcttgtcatgggtaatcaccctctacaccctgtggcaaatggttgagatgcacgaaatggtgcccggaaaaagatttgataggtaccatgagttgggacaacatgccttcggagaaaaactaggtctctggattgtggttccccaacaagttgttgttgaagttggcacgtgcattgtctatatggttactgggggcaagtcattgaagaaagttcatgataccctttgtcccgattgcaaagatattaagacctcatattggattgttatcttcgcttctgtgaacttcgctcttgcgcaatgccccaacttaaacgacatctctgctatctcttttgctgcagctgtcatgtctttgatatactcaaccatcgcttggtgtgcttctataaacaaggggattgacgcaaatgtggattatggctccagagccactagcactgctgatgctgtattcaacttcttttctgccttgggtgatgtagcatttgcctatgcaggtcataatgtggttttggaaattcaagcaaccatgccttcatctgaagatacaccttccaagaaacccatgtggagaggagttattttggcatacataggagttgcattctgctacttacctgttgccttcattggatactatatgtttggaaactcagttgatgataacatcctcatcacactagaacgccccgcttggctcattgccgctgctaacctttttgtctttgtccacgttgttggaggctaccaggaaactagccaatgttctcattgtgttttctttattgttggcttggacaattggtcaatacttgttgttttttcagcggtgacaatgttaattggcatatgtgttccgttctttggctctcttcttggatttcttggaggctttgcgtttgccccgacatcatattttttgccctgtatcatatggcttaagcttaaaaagcccaagaaatttggcttgtcttggacaattaactggatctgcattattcttggggtagtgttgatgatattatctccaattggtgctctaaggaatatcatactatcggccaagaactacaagttcttctcgtag

SEQ ID NO: 865 - DNA, 468 bp, Glycine Max
atgggggttggagattatttgtctcatttaattggaagtggcaatggaaaccaccaacacaagaacaagaacaagaagcaattacagaccgtagagctgaaggtgatgatggattgtgacggctgtgtgctcaaggttaagaaagctctctcttcattagatggagtaaaatcggtggagataaacaggaagcagcagaaagtgacagtaaccggttatgtggaaccaaacaaggtcttaaagaaggccaattcaacagggaagaaggctgagatttggccttacgtgccattcaacatggtggctaatccatatgctgttcaagcttatgacaagaaagctcctccgggatatgtgaggagagtggacaactcttctgtcaccattggaacagtgacaacagcatatgcagatccatacaccaccatgttcagtgatgaaaacccaaatgcatgttctatcatgtag

SEQ ID NO: 866 - DNA, 468 bp, Glycine Max; identical to SEQ ID NO: 865

SEQ ID NO: 867 - DNA, 297 bp, Glycine Max
atgggtccgatgctgctgagccaactcgccaccggtctaagcgttctcgccggagcggttcttgtgaaatcggttatggaccagaagcccatggcaggcccattcactcgctgccccacgtgcaacggaaccggtcgagtcacgtgcctctgttcgcgttggtccgacggcgatgtcggatgctccacatgctccgggtcgggtcggatggcctgcagcagttgcggcggctccgggaccggtcgtcccttgccggccaaaatcgcgattcgcccaccgaaccgcccaattaattag

SEQ ID NO: 868 - DNA, 234 bp, Glycine Max
atgggtctgtggactttacttgaggggtttcttcttcttgcaaatgcgctagcgatattaaatgaggaccgctttcttgcacctagaggatggggcttccaagatttctctggtggaaggactaagtcgttcaaaggccagcttataggcctcatttatgcaactcagtacctcagagttcctctcatacttctcaattccatctgcatttttgtgaagttggtgtccggatga

SEQ ID NO: 869 - DNA, 234 bp, Glycine Max; identical to SEQ ID NO: 868

SEQ ID NO: 870 - DNA, 2337 bp, Glycine Max
atgggtttatgttctctttttttggttacacttcttctgctaacatcatttgcggtatgccaacttgaagaatttatcagcattgactgtggagggacaagtaactacaccgataaaagcacagggcttgcatggatatcagactctgggatcatgaaacatggcaagccagtggaggtacaaaatccaagtggaaacaagtttcagtatcagagacgccgagagtttcctatagacagcagaaaatactgctatacacttgtcactgaggagagaagaaggtatctggtgcgagcaacgtttaaatatggtaacttggatgatggagacacataccctcagtttcagctctatttggatgcaaccaaatgggctactgtgtcaatctatgatgcctcaagaatctatgcgaaggaaatgatcttcagggcaccctcaaactctattgatgtttgcatgtgttgtgctaccactggttctcccttcatatctaccctcgagctaaggcccttgaatctttctatgtatgccacagattttgaaggcagttttttcttgaaagtggctgcaagaattaactttggtgctccaagtgaggatgttgtcaggtatccagatgacccatatgatagaatttgggagtctgatcttattaaaagacaaaattatcttgttggggtggccccaggcactgaaagaattaacacaacaaagaaaatagaaatagagacaagagaaaacccacctgttaaagtgatgcaaactgcagttgttggcaccaaaggaatacttagctatagactaaacctggaagacttccctggcaatgctagagcttacgcatatttcgcggagattgaagatctgcctaagaatgagactagaaaattcaaattggagcaaccttacatagctgactatagcaatgcagtggtgaacatagctgagaatgccaatgggagctacactctctatgaaccaagttacatgaatgtgagtctggagtttgtgctttcgttctcctttgttaagacccgggattccactcaaggacctcttctaaatgcaatggaaattagcaaatacatgccgattgcttcaaagactgacaggcaagactcaaattttgtaaatgcatttcgtttcttatctgctgaaagtgtcctgaagaatgaaggtgatccctgtgttccaactccctgggagtgggtaaattgtagcacaactacacctccaagaattacaaagataaacctgtcaagaaggaatctcaagggtgaaatcccagggaagctcaacaacatggaagcattgacagaactgtggttagatggcaacatgctcaccggacaacttcctgacatgagcaatcttatcaatgtaaagattatgcatctagagaacaacaaattgactggtccattgccatcttacttgggtagcttgccaagtttacaagcactgttcatacagaataactcatttagtggggtaataccatcaggattactgtctggaaaaatcattttcaactttgatgataatcctgaactacataaagggaacaagaagcattttcaattgatgctaggaatttctattggagtactagtgattctattaatattgttcttaacaagtttggtgctattgcttattctgcggagaaagacatctcaacagaaacgtgacgaaaagggtgtttctggacgcagcagcactaaacctttaactggatactcatttggtcgggatgggaatataatggatgaaggtactgcttactatattacactctcagagctgaaagaagctactaataatttttcaaagaatattggcaagggaagctttggatctgtttactatgggaaaatgaaagacggaaaagaggtggcagttaagactatgactgatccatccagctatgggaaccagcaatttgtaaatgaggtagccctcttatcaagaattcatcacagaaacttggttcctctgattggatattgtgaagaagaatatcagcatattctagtttatgaatatatgcacaatggcactttaagggagtacattcatgaatgttcgagtcagaagcaattagattggttagctcgccttcgaattgcagaagatgcagctaaaggtcttgaatacttacacacaggatgtaatcctagtatcattcaccgcgatgtgaagacaagcaatattcttcttgacatcaatatgagagcaaaagtgtctgactttggactctcaaggctagctgaagaagatttaactcacatatcaagtgttgcaaggggaactgtaggttacctggatcctgagtaa

SEQ ID NO: 871 - DNA, 2793 bp, Glycine Max
atgggtttatgttctctttttttggttacacttcttctgctaacatcatttgcggtatgccaacttgaagaatttatcagcattgactgtggagggacaagtaactacaccgataaaagcacagggcttgcatggatatcagactctgggatcatgaaacatggcaagccagtggaggtacaaaatccaagtggaaacaagtttcagtatcagagacgccgagagtttcctatagacagcagaaaatactgctatacacttgtcactgaggagagaagaaggtatctggtgcgagcaacgtttaaatatggtaacttggatgatggagacacataccctcagtttcagctctatttggatgcaaccaaatgggctactgtgtcaatctatgatgcctcaagaatctatgcgaaggaaatgatcttcagggcaccctcaaactctattgatgtttgcatgtgttgtgctaccactggttctcccttcatatctaccctcgagctaaggcccttgaatctttctatgtatgccacagattttgaaggcagttttttcttgaaagtggctgcaagaattaactttggtgctccaagtgaggatgttgtcaggtatccagatgacccatatgatagaatttgggagtctgatcttattaaaagacaaaattatcttgttggggtggccccaggcactgaaagaattaacacaacaaagaaaatagaaatagagacaagagaaaacccacctgttaaagtgatgcaaactgcagttgttggcaccaaaggaatacttagctatagactaaacctggaagacttccctggcaatgctagagcttacgcatatttcgcggagattgaagatctgcctaagaatgagactagaaaattcaaattggagcaaccttacatagctgactatagcaatgcagtggtgaacatagctgagaatgccaatgggagctacactctctatgaaccaagttacatgaatgtgagtctggagtttgtgctttcgttctcctttgttaagacccgggattccactcaaggacctcttctaaatgcaatggaaattagcaaatacatgccgattgcttcaaagactgacaggcaagactcaaattttgtaaatgcatttcgtttcttatctgctgaaagtgtcctgaagaatgaaggtgatccctgtgttccaactccctgggagtgggtaaattgtagcacaactacacctccaagaattacaaagataaacctgtcaagaaggaatctcaagggtgaaatcccagggaagctcaacaacatggaagcattgacagaactgtggttagatggcaacatgctcaccggacaacttcctgacatgagcaatcttatcaatgtaaagattatgcatctagagaacaacaaattgactggtccattgccatcttacttgggtagcttgccaagtttacaagcactgttcatacagaataactcatttagtggggtaataccatcaggattactgtctggaaaaatcattttcaactttgatgataatcctgaactacataaagggaacaagaagcattttcaattgatgctaggaatttctattggagtactagtgattctattaatattgttcttaacaagtttggtgctattgcttattctgcggagaaagacatctcaacagaaacgtgacgaaaagggtgtttctggacgcagcagcactaaacctttaactggatactcatttggtcgggatgggaatataatggatgaaggtactgcttactatattacactctcagagctgaaagaagctactaataatttttcaaagaatattggcaagggaagctttggatctgtttactatgggaaaatgaaagacggaaaagaggtggcagttaagactatgactgatccatccagctatgggaaccagcaatttgtaaatgaggtagccctcttatcaagaattcatcacagaaacttggttcctctgattggatattgtgaagaagaatatcagcatattctagtttatgaatatatgcacaatggcactttaagggagtacattcatgaatgttcgagtcagaagcaattagattggttagctcgccttcgaattgcagaagatgcagctaaaggtcttgaatacttacacacaggatgtaatcctagtatcattcaccgcgatgtgaagacaagcaatattcttcttgacatcaatatgagagcaaaagtgtctgactttggactctcaaggctagctgaagaagatttaactcacatatcaagtgttgcaaggggaactgtaggttacctggatcctgagtactatgcaaatcaacaattgactgaaaagagtgacgtgtacagttttggagttgttctgctggaattgctatcaggaaaaaaggctgtatcatcagaagactatggtcctgaaatgaatatcgttcactgggctagatctttaattcgtaaaggagatgtgataagcatcatggatccttcccttgtggggaatctgaaaactgagtcagtttggagggttgcagaaattgccatgcaatgtgtagaacaacatggtgcatgcaggccaaggatgcaagaggtaattttggctatacaagatgcttctaacattgaaaaggggacagaaagtcaactgaagctatcttcttcaggtggtaattcaaagccacagtcttcacgtaagactttacttgcaagctttcttgaaattgagagccctgacttgtcaaatagttgcctcccctcagccagataa

SEQ ID NO: 872 - DNA, 2151 bp, Glycine Max
atgggtttatgttctctttttttggttacacttcttctgctaacatcatttgcggtatgccaacttgaagaatttatcagcattgactgtggagggacaagtaactacaccgataaaagcacagggcttgcatggatatcagactctgggatcatgaaacatggcaagccagtggaggtacaaaatccaagtggaaacaagtttcagtatcagagacgccgagagtttcctatagacagcagaaaatactgctatacacttgtcactgaggagagaagaaggtatctggtgcgagcaacgtttaaatatggtaacttggatgatggagacacataccctcagtttcagctctatttggatgcaaccaaatgggctactgtgtcaatctatgatgcctcaagaatctatgcgaaggaaatgatcttcagggcaccctcaaactctattgatgtttgcatgtgttgtgctaccactggttctcccttcatatctaccctcgagctaaggcccttgaatctttctatgtatgccacagattttgaaggcagttttttcttgaaagtggctgcaagaattaactttggtgctccaagtgaggatgttgtcaggtatccagatgacccatatgatagaatttgggagtctgatcttattaaaagacaaaattatcttgttggggtggccccaggcactgaaagaattaacacaacaaagaaaatagaaatagagacaagagaaaacccacctgttaaagtgatgcaaactgcagttgttggcaccaaaggaatacttagctatagactaaacctggaagacttccctggcaatgctagagcttacgcatatttcgcggagattgaagatctgcctaagaatgagactagaaaattcaaattggagcaaccttacatagctgactatagcaatgcagtggtgaacatagctgagaatgccaatgggagctacactctctatgaaccaagttacatgaatgtgagtctggagtttgtgctttcgttctcctttgttaagacccgggattccactcaaggacctcttctaaatgcaatggaaattagcaaatacatgccgattgcttcaaagactgacaggcaagactcaaattttgtaaatgcatttcgtttcttatctgctgaaagtgtcctgaagaatgaaggtgatccctgtgttccaactccctgggagtgggtaaattgtagcacaactacacctccaagaattacaaagataaacctgtcaagaaggaatctcaagggtgaaatcccagggaagctcaacaacatggaagcattgacagaactgtggttagatggcaacatgctcaccggacaacttcctgacatgagcaatcttatcaatgtaaagattatgcatctagagaacaacaaattgactggtccattgccatcttacttgggtagcttgccaagtttacaagcactgttcatacagaataactcatttagtggggtaataccatcaggattactgtctggaaaaatcattttcaactttgatgataatcctgaactacataaagggaacaagaagcattttcaattgatgctaggaatttctattggagtactagtgattctattaatattgttcttaacaagtttggtgctattgcttattctgcggagaaagacatctcaacagaaacgtgacgaaaagggtgtttctggacgcagcagcactaaacctttaactggatactcatttggtcgggatgggaatataatggatgaaggtactgcttactatattacactctcagagctgaaagaagctactaataatttttcaaagaatattggcaagggaagctttggatctgtttactatgggaaaatgaaagacggaaaagaggtggcagttaagactatgactgatccatccagctatgggaaccagcaatttgtaaatgaggtagccctcttatcaagaattcatcacagaaacttggttcctctgattggatattgtgaagaagaatatcagcatattctagtttatgaatatatgcacaatggcactttaagggagtacattcatgaatgttcgagtcagaagcaattagattggttagctcgccttcgaattgcagaagatgcagctaaaggttga

SEQ ID NO: 873 - DNA, 618 bp, Glycine Max
atgggtttttcctcaaaagaagagaagtccaaaagaatattgaggggcttgaagactctcttcttcttgatcactatggttatatcgcttcttcttttctccgccccggttctccttgttattgccgatgcacttgttccttctgctctgctctcctcgctttctcaatcttctttctccatggaaactctcgcttcccatttccacaactacgattttcgatactctctcattgatattccccttgtgtcaataatacgatccttcatcatcttctgtgtttatagtttgtgtgatggaccaaggctttcgcatggaccttatttggggatcacgaccatgtgctctgttttgtctctgatgtttgtgtcgttcaaagcagtttacatcttcagtgtttcgggtattgatcgaagtgggtatgttcgtgccaccgaaatagctctgttcgtgtgttcttgtgcgttggccgtggggcatgttgtggtggcctacagaacaagttgcagggaaagaagaaagcttttggtctacaaaattgatattgaagctatttcagcttgcaaaaatgggtatcctaggtatctgaagattcctcaagaagaaagaatcaaatga

SEQ ID NO: 874 - DNA, 1161 bp, Glycine Max
atggtagaatctggcgagctccgcagtcgaattgcagagattcagaagctttgcaatgctaatgacgacgaattggacaatgactctgctcttcttcattttaagaccgcactgcagcagattgattccgacttctcttctatggaaattcaagatgcttacctacaccatttgaaagaggagcttaacaacctccaccttgaaaccgcccaagtaacaaatcagattcaccttctttccaaaactcacaacgatgattgtattctcttggaggccaaacttggagaaatcgattgttctttagattataatgtcacatctaagaacacagctgaaggcattgattcccctatgctggcagatgattgtctaaatttgaccgttgcaaatctagacaagaatttagagcaattcgaacttgataataagattgatgaaatgaagtcggttctaaactctctccagaatcttcagtttacagtcaaatggtttgaagttgtagagcagattgaggatgcattcacggggctaaaagtgcttgcattcgatgagaattgcattcgtttgtcattgaagacttatatgccaacatttgagggtatttcctacctaccgagaattgaagctaccgttgatgcagctgaactcaattatgagttattaattgaagtttttgaggggactatgaggttaaagaatgttcaggtttttccaaatgatatatatgtgaacgacattgttgatactgcaaaattagtcagcaagtcctcgttgcagtggtttatacagaaagttcaagatagaattatactaagcacacttaggcatcttgtagtaaaggatgctaataaatcaagatattcgcttgaatacttggacaaagataagactattgtggctcatatggctggaggaattgatgcgtacataaagttgtcacatggttggcctatatttggttctccattgaagctgatatgtataaagggatcagatgatttgaagagaacttctttaagttttcattgcaaagttgagaaattggccaattctttagatacccatattcggcagaatatatcaagcttcgtcgatgcagttgaaaaagtacttatggaacaattgcagcttgatcttcgggtcggtgataattcaggttaa

SEQ ID NO: 875 - DNA, 1170 bp, Glycine Max
atggtagaatctggcgagctccgcagtcgaattgcagagattcagaagctttgcaatgctaatgacgacgaattggacaatgactctgctcttcttcattttaagaccgcactgcagcagattgattccgacttctcttctatggaaattcaagatgcttacctacaccatttgaaagaggagcttaacaacctccaccttgaaaccgcccaagtaacaaatcagattcaccttctttccaaaactcacaacgatgattgtattctcttggaggccaaacttggagaaatcgattgttctttagattataatgtcacatctaagtatcagaagaacacagctgaaggcattgattcccctatgctggcagatgattgtctaaatttgaccgttgcaaatctagacaagaatttagagcaattcgaacttgataataagattgatgaaatgaagtcggttctaaactctctccagaatcttcagtttacagtcaaatggtttgaagttgtagagcagattgaggatgcattcacggggctaaaagtgcttgcattcgatgagaattgcattcgtttgtcattgaagacttatatgccaacatttgagggtatttcctacctaccgagaattgaagctaccgttgatgcagctgaactcaattatgagttattaattgaagtttttgaggggactatgaggttaaagaatgttcaggtttttccaaatgatatatatgtgaacgacattgttgatactgcaaaattagtcagcaagtcctcgttgcagtggtttatacagaaagttcaagatagaattatactaagcacacttaggcatcttgtagtaaaggatgctaataaatcaagatattcgcttgaatacttggacaaagataagactattgtggctcatatggctggaggaattgatgcgtacataaagttgtcacatggttggcctatatttggttctccattgaagctgatatgtataaagggatcagatgatttgaagagaacttctttaagttttcattgcaaagttgagaaattggccaattctttagatacccatattcggcagaatatatcaagcttcgtcgatgcagttgaaaaagtacttatggaacaattgcagcttgatcttcgggtcggtgataattcaggttaa

SEQ ID NO: 876 - DNA, 546 bp, Glycine Max
atggtgaagtactccagagaacccgacaatcccaccaagtcctgcaaggccagaggcgctgaccttagagtgcatttcaagaacactagggagactgcctttgccatcaggaagttgcccctggttaaagctaaaagatacctggaggatgttttggcccacaaacaggccatccctttccgacgcttctgtggtggtgttgggaggacagcccaggctaagagcagacactccaatggtcaaggacgctggcccgtcaaatcagctaagttcatcctagatttgctgaagaacgctgagagtaatgctgaggtaaaaggtttggatgtcgatgctctgtacatttcccatgtccaggttaatcaagcacagaagcaaaggcgtcgtacctacagagctcatggaagaatcaacccttacatgtcatctccatgccacattgagctgatattgtctgagaaggaagagcctgtgaagaaagaggctgagacccaattggcaacaagcaagaagaagggtgctcttcgaagtggtgcttcatcttaa

SEQ ID NO: 877 - DNA, 1521 bp, Glycine Max
atggtgaatgcactcactcacagtcagagtcagtttgtgttggtgctattgaactccaattgcagagggagcaagagtagtagcaacaccgtcttccgaaaaccctttgcgaaattttcatccctcaccactaaaatttgccacgcctcttaccaccgtttcgctgacacaaagcacacaacccttctggttgagacttaccatctccatcacagcctcagagccttacttgcaaagcttgagaacgaatattccaaccctcttcacatgctcgcagaagacgctgattggtccaaagaccatttttgggctgttgtcaggttccttaaaagttcctcaaacttcacccatatccttcaggtgtttgatatgtggaagaacattgagaaatcacggattagtgagttcaactataacaagatcataggcttgttatgtgaaggaggaaagatgaaagatgcattatctgcattgcaagatatgaaagttcaaggtatcaagccttctttggacacttacaatccaatcattcatggattatccagagaaggtaagttcagtgatgctttacgttttattgatgagatgaaagaatctggcttagagctggattctgaaacctatgatggtttgattggagcctatgggaaatttcaaatgtatgatgagatgggtgagtgtgtgaagaagatggagttggaaggatgttctcctgatcctatcacttacaatatacttatccaagagtatgctggtggcgggctactccagagaatggaaaagctttatcaaagaatgctttcaaaaagaatgcatgtcaaatcttctactctagttgcaatgctggaggcttataccacatttgggatggttgaaaagatggaaaaattttatagaaaaatcttgaactcaaaaacatgtatagaggatgatttgattagaaaagtggctgaagtatatatcaataacttcatgttttctagattagaggacctggcactagatttatgtccagcttttggtgagagcaacctcgaatggtgtttccggcttctttcttatgcatgtcttttgagtaaaaaaggtatggatatagttgttcaagaaatgcaagatgccaaggttagttggaatgttactgttgcaaatattatcatgttggcttatgtgaagatgaaagaattcaggcatttgagaattttgctatctcagttgccaatctaccgggtgcagcctgatataatcactattggaattctatttgatgcaactagaattggttttgatggtagtggagctttagaaacatggaggagaatgggctatctatatagagtagtagaaatgaaaacagattctctggtccttactgcatttgggaaaggccattttcttaaaagctgtgaagaagtgtactcctcccttcaccctgaggacagaaaaaggaaaacatgcacttaccatgatctcattcctttattgtcaaaacatactggtaccatccactgtataaaaacctag

SEQ ID NO: 878 - DNA, 1395 bp, Glycine Max
atggtgacctgtgccgtgaaaggaggctgccccagtgactacatagccattgccctatccattctttccatcactgtgcttctcttatggtcaatttttcccttcctagttcacaaggttcctcgtaccaaaggcagtggcttttggttacctgtaattcaagttgttgccagcttcaaccttcttctatcaattgtgatgtcaaataatttcttgaaaatgggaaagagacattggttgcggtcatgctacctatggggagtctgggttgaaggtccactagggtttggtttgctgttgagctgtcgcataacacaagcttcacaattatattttatctttgtcaagaggcgcttaccattgataagatcatatatttttcttccacttattctacttccctggattgctgctggtggtgttatccattcaatgaagcctctaagcagtcgctgtcacatgaaagctcaatggaccatcccagttgtatgcctccattcattgtatattgccattttggttggggttacagctgcagttcatcacatagagttcaggtttgatgaactcaaagacctctggcggggaatacttgtatcagttgtgtccattgctgtgtgggttactgcttacatactaaatgaaatttatgacaatatctcatggattgaagttgcctccagatttctgcttttagttgtggctagcatacttgtggtggctttcttttcaatatcaagttcacaaccacttctctcacaaatcagcttgaggagaagagaatccagagaatttcgcacaatgagtcaggctctgggcatacctgatagtggggtactagcagaaagtgaacccatttcaaggatagatcctaatgaaccattggataagcttctcctgaataagagattccggcagtcttttatggcgtttgctgatagttgcttggctggggagagtgtgcacttctttgatgaagtatatgagcttagtaaaatacctgaagatgactgtgttaaaaggatctacatggcacgacatattattgagaaatacatagttgcaggtgcggctatggaggtgaacatctctcatagaagcagacaagaaattttatcaacttccaacctcacacgccctgatctcttccataatgcacttaatgagatcattcagctgatgagaacaaatctggcccgagattactggtcttcgatgttcttcctgaagttccaggaagactccaatgtaagatctaatgagtacgagctggagcaaataacagggtggaacttttctccaaggttgagttctgtgcatggtacagacgatccttttcaccaggaccatcttctcaagagctcaggctgtagcaatgatacaactaatttatga

SEQ ID NO: 879 - DNA, 1284 bp, Glycine Max
atggtgcgtgtcaaagaagctctcgttgtcaccccttccgagcccacaccgaataccgttctctcactctcagctcttgactcccaactcttcttgcgcttcaccatcgagtatctttttatttacaggcccggcccgggcctggacccaacttccaccgcggctcgtttaaaagctgcattagccaaagcgcttgttccttattatccattcgccggaagggttcgctccaggcccgacggcccgggcctcgaggtcgtttgtcgggcccagggcgctgtcttcatcgaagcctcttctgaacgttacactgcccatgatttccaaaaggcccccaagacagtggcacaatggaggaaactattatctctctacgtcaccgacgttctcaaaggctctccaattcttgttattcagttgacgtggcttgccgacggcgctgcagctgtcggcgtcggtataaaccactgcatctgcgatggcatcggcagtgccgagtttctcaattatttctcggacttagcatcccataataataacgtgagtgtcgatcccaaacctaaacccgtctgggatcgacagctcatgaacccggacggcagaactcgggcgaacctggctatgcacgccgagtttgtccgggttccggatttgtgcgggttcatgaaccgtgtcacgagcgggctgagaccaacttgcattgtgttcgacgagaggcggatcaacgcgctgaagggcgcgtgcggaatgtcgtcgtacacgtcgttcgaggttctggcggcgcacgtgtggaggagttgggcgagggcgatggggtttcctaaaaaccagacgctgaagcttttgtttagcgtgaacgtgcggaagcgcgtgaagccgggactgccggaggggtattatgggaatgcgtttgtgttgggatgcgcgcagacaagcgcgtgggagttgggggagagaggggtcaggtacgggtcgggtctggtgaagcgtgcgaaggagagggtggacagcgagcacgtgcggagggtggttgagttggtctccgagtcgagggcgagtcctgactcggtgggggtgctgattctgtcgcagtggtcgaggctggggcttgagagggttgaactcgggatggggaagcctctgcatgtggggcccatatgctgtgataggtactgtttgtttcttccggtgaccggtgaacgggcgagtgtgaaggtcatggtggctgtccccaccaccgccgttgacaactttcaccgtttcctccgggaatcgaatttatga

SEQ ID NO: 880 - DNA, 735 bp, Glycine Max
atggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattgggatcacgatatcatttgcgaagataattataacctcaattcaacctgctacagcggttattggaaggcttccaggaacggatgcattcggcgatgttgaacaatatccaatggcggttaacattcctggggttttgatagtctctttaaaatcttcttggctttgttttgcaaatgcaaatcttgtggaggaaaggattgagagatgggtgaacaatgcaaaagctaaggaaggaagagaaagcaccttcacatacgtcattattgatgcctcaagtcttacgaatattgacaccgcgggaatagcttctctggtggagctcaacaaaaatctgatttcacggggagtaaagttagctatcgctaaccctaggtggcatgtaattcacaagctaagattagctaacttcgtgagcaaaattggaggaaggattttcctttctgtgggagaagcagtagatgcatgtgttggcactaaaataatggttgttgtataa

SEQ ID NO: 881 - DNA, 1533 bp, Glycine Max
atggttatcaccctctcttcttactcattgtctttcatctctctttttctctccacgtcactcgcccttcttgctatttccctcaactattggcttgtccccggaggttttgcatggaggaaatatcacagtcgttacaaaggccatgcaaaagtctctggcccaatgggctggcccatattgggaactttacctgcgatgggccctctagcccacaggaaacttgctgccatggccacttcaccaaaagcaaaaaagctcatgacattgagtctaggaacaaatccagttgttatcagcagtcacccagaaaccgcaagagaaattctttgtgggtcgaacttcgctgaccgacccgttaaagaatcggcccgaatgctcatgtttgagcgtgccattggatttgctccatatgggacttattggcgccacctacgtaaagtggcaatcacccacatgttctctccaaggaggatttctgacttggagagtctccgacaacatgtggttggtgaaatggtgatgaggatatggaaggagatgggggacaaaggggtggtagaggttcgaggcatattgtatgaagggtctttgagccacatgttggagtgtgtgtttggtattaataattctctaggatcacaaacaaaggaggcgttgggtgatatggttgaggaagggtatgacttgattgccaagtttaattgggcagactattttcctttcgggtttttggactttcacggggtcaagagaaggtgtcacaaattggcaactaaggtcaatagtgtggtgggtaaaattgtggaagaaagaaaaaattcagggaagtacgttggacaaaatgattttcttagtgccttgttattgttgcctaaagaggaaagcataggtgattcagatgtagtggctatcttatgggaaatgatatttcggggaacagacacaattgctatacttttagaatggatcatggccatgatggttttacaccaagacgtacaaatgaaagctcgtcaagagatcgactcatgcatcaagcaaaacggttacatgcgagactcagacattccaaacctcccttacctccaggccatagtgaaggaggttctccgattgcacccaccaggcccattactttcctgggctcgcctcgcaatccatgatgtccacgtggacaaggtcatcgtgccagctggcacaactgcaatggttaacatgtgggctatatcacatgactcatccatttgggaggacccgtgggcctttaagcccgaaagattcatgaaagaagatgtgtcgatcatggggtcggacatgagacttgcaccatttggtgcaggacgtagggtgtgcccaggaaaaacattaggcttagccacagttcatctatggcttgcacaacttcttcaccatttcatatggattccagtgcaacccgtggatctttcagaatgcctaaagctctcgctcgaaatgaaaaagcctttacgatgccaagtgattcgcaggttcaacaccataagctcttga

SEQ ID NO: 882 - DNA, 1368 bp, Glycine Max
atggttgatttacattggaaatcaaagatgccaagttccgacatgccttccaaaactctcaaactctctctctccgacaacaagtccttaccctctttgcaactacccttccgcaccacagatatctctcacgccgcaccttctgtttgcgccacttacgactactatctccgtcttcctcaactcagaaagctttggaactcctcagattttcctaattggaacaacgaaccaatcttaaaacctatcttgcaagctctcgaaatcaccttccgctttctctccattgttctctccgatccaagaccttactccaaccacagagaatggactcgcaggatagagtctcttatcacacatcaaattgaaatcattgccatactttgtgaagatgaggaacaaaattccgacacacgtggcactgcaccaaccgctgatctcagcaggaacaatagcagcgagagcagaagctacagcgaggcaagcctgcttccgcggcttgccacgtggtacaaatccaaggacgtagcgcagaggatccttctctcagttgaatgccaaatgaggaggtgttcctacacgctgggtttgggtgagccgaacctagcgggcaaaccgagcctgctctacgacctcgtgtgcaagccgaacgagatccacgcgctgaagacgacgccgtacgatgagcgcgtagagaatcacgagaaccacgcgttgcacgcgacgcaccagatcgccgagtcgtggatccacgcgtcgcggaaggttctagagaggatcgcagacgcggtcctctccagaaccttcgagaaggcggctgaggactgctacgccgtggaaaggatctggaagcttctcgcggaggtggaggacctccacctgatgatggatccggacgatttcttgagactgaagaatcagctctcggtgaaatcctccggcggcgaaacggcttcgttctgcttcaggtcgaaggagttggttgaactgacgaagatgtgcagagatctgaggcacaaggtgccggagatattggaggtggaggtggatccgaagggaggaccgaggattcaagaggcggcgatgaagctctacgtttcgaagagcgcgttcgagaaggttcacttgttgcaggcgatgcaggcgattgaggcggcgatgaagagattcttctacgcgtataagcaggtgttggcggtggtgatgggaagctccgaggctaacggtaaccgagttgggttgagttgcgactcggctgactcgttgactcagattttccttgaaccgacgtattttccaagcttggatgccgccaagacttttcttggatacttgtgggataataacgataataacaaatggatatga

SEQ ID NO: 883 - DNA, 1698 bp, Glycine Max
atggtttcggttgataatgggattgggaattccaaagatgaaattgaggaatctaatgggaataaagtgaatgagtttacatctatagatatttcaactactcataaaacatttgtgaacagtgaagatcctcagagaaggcttcagggcacgttaggttcttctgttcctaataggataaactttcttaaatttgattctgcatctgccaaattcagaaggcttgctactgagagagaccaggtttcactatctgtgccttctcctcgtccaaagagcttaagatcacgtttcagtggcatgtttgctcagaaacttgactggggttcagtcaagaaaatgttcattgaatggattagaagtccaatgaacatggccctttttgtgtggattgtttgtgtcgcggtttcgggagcaattctgttccttgtcatgacaggtatgttgaatggtctactacctagaaagtctcagagaaatacatggtttgaaataaacaaccaaatactcaatgcattgtttacactcatgtgtttgtaccaacaccctaagagattctaccaccttgttcttctgatcagatggagaccaactgacatctctaggcttagaaaggtatattgcaagaatggcacttacaagcctcacgagtggacacatatgatggtagttgtgattctccttcatgttaactgttttgctcaatatgcactttgtggtctaaacttagggtataaaaggtctgagaggcctgccattggagttggaatatgtatatcttttgcaattgctgctcctgcaattgctggtttgtacaccattcttagcccacttgggaaggactatgattgtgagatggatgaagaagcacaggttcaagttacggcttctcaagggcaagagcagctgagagagaaaccatttgagaagaattattcatttgcatccaaagatgatcgacaaaggtttgttgaaaatagacctaagtggagtggaggaatacttgacatttggaacgatatttccttggcatatctctcacttttctgcactttttgtgtgtttgggtggaatatggagagacttggctttggaaacatgtatgttcatattgccacttttatgctgttttgtatggcacccttctggattttttttttggcttctgttaacatagatgatgacaatgttaggcaggctctagcagctgttggaatcattctttgttttcttggtttactgtatggtggattttggaggatccaaatgagaaagaggttcaatttacctgcctatgacttctgttttggcaagcattcagtttctgattgcatactttggctatgctgttgctggtgcactcttgctcaagaagcaaggacggggaataactatgatcttgtagaagataaattctcaaggaaagaaactgatactagagatgaaaaaccatcaatttcacctttggctcgtgaagatgtagtatcaaccaaatctggcacaagttctcctcttggtagtactagcaattcttccccttatgtgatgaaaacatctagtcctccaaattcaagcaatgtcttaaagggatattacacttcagataggatgctatctaatttgaaccaagagaattgtgaaagaggtaaagatggaacaatgaacccgccggctccttcattgatacaaagagaatga

SEQ ID NO: 884 - DNA, 474 bp, Glycine Max
atggtttctagagagcaaaaaagagcagcactgcatgagaagctgcaacttcttcgttctataaccaactctcatgctctaaacaaaacctcgatcataatagatgcatcaaagtatatcgaagagttaaagcaaaaagtagaaagactgaatcaacacgtagccaatgcacaaacttcaagtgaccaaaatactttgcctatggttacagtagaaaccttagagaaggggtttcttataaatgtttattcagcaaagacctgccctggtttacttgtttccatattggagtcatttgaagagattggtcttaatgtgcttgaagctagggttacttgtacggacacctttcgatttcatgctgttggaggaaaaaatgaagaacaaggtgatgagggtattgatgcacaaactgtgaaacaggaattgggacaagcaataaagaactggagccaaaatgctgaccaaaagtaa

SEQ ID NO: 885 - DNA, 1077 bp, Glycine Max
atgtacggaaccgagaataaccgagatgattcggagcgaacggcgttcagaagagcagagaagaagtacaagctctactacgactacaatgcttcttccaagaacaaaaagaaaaaacaacctaaacccgtggacttagcggaggtccttgactttagatctattctagaatgctatcaccaaaacgctgtgcttccttcgggtgttatcgttcttcacgacaagttcacctctccggtttttgctttacaaaatcgcccaggcttttattttattcctggggcattaagcatagagaaacaatgtagtttgataagggagagtttgactgattttccgcagccacctaacagaacaaatcacaatgccttgtatggtcctattcaggacctgttcgttgcagctaaggaagggaaacttttggttgaagacaactctccaattacttcttctgaaacttatgctgatattgatcatagagatgataaggaatggaagtttactactgaaaaggacatgtcgttgagaaagtgcagaacagtttctgcttctgtgttacttagaaagttgcgatggagcacccttggcctacaatttgattggtccaagcggaattatgatgtatctctcccacataacaaaatccctgaagcattatgtgagctttccaaacaattggcaaaacctgctttgcctggtggtgttgagttcagacctgatgctgcaatagtgaattacttcggcctaggggacacattgggtggccaccttgatgacatggaagcagattggagcaagcctattgttagtctaagtctgggctgcaaagctatatttcttttgggaggaaaatccagagaggatactcccttggcaatgttccttcgaagcggtgatgctgtacttatggctggagatgcaagggaatgctttcatggggttcctcggatcttcacagataaagaaaatgctgaaataggccatcttgagacacggctgacgcatgaagatgatatttgtttcttaaaatacattcaaacatctagaatcaacatcaatatcagacaagttttttga

SEQ ID NO: 886 - DNA, 1125 bp, Glycine Max
atgtatttatcggagaagcctcgtcccatcgatttctacaaggaggaaggcgcgcgcgacatgatgatcgaggtcgtctccaacggcgacctccctcctccgccgccgccgccgccgatgattctcggcgagagcagcggcgaggaccccgaggtcgagatcaaggccccgaagaagcgcgccgagacctgggtccaggacgagacgcgctctctcattggccttcgccgcgagatggacgcgctcttcaacacctccaagtccaacaagcacctgtgggagcagatatcggcgaagatgagggagaaaggtttcgatcgttctccaaccatgtgcaccgataagtggcgcaacctcttgaaggagttcaagaaggccaagcaccaggaccgagggagtggttccgccaagatgtcgtattacaaggagattgacgagatcctcagagagaggagcaagaatgtgcagtataaaagccctactcctccgcccaaggttgattcctttatgcagtttgctgataaaggtattgacgataccagtatctcttttgggcctgttgaagctactggaagaccaacactgaatcttgagagaagtttggatcatgatggacatcctcttgccattaccacagctgatgctgttgcagcaagtggagtccctccttggaattggagagagactcctggaaacggtggagaaagtcagtcatgttgtggaagggttatatcagttaaatggggtgattatacaaggcgaataggtattgatggcaccccagaagccattaaagaagcaattagggctgcttttaggttgagaactaaacgtacattttggttggaggatgaagatcagattatcagaagtattgaccgtgaaatgcctttaggaaattacactcttcacattgatgaaggaatggccattaaattacctctctatgatgagcctgaccatatacctgtgcatactgaagataagatattttacactgaagacgatttccgtgattttctgacccgccggggttggatatgtctaagagaatttgacagctacagaaatattgacaacatggatgatcttcgacctggtgccatatatcgtggtgtgagttga

SEQ ID NO: 887 - DNA, 1311 bp, Glycine Max
atgtcaccggtcgccggagtcagtgcccccctcctgggggaatccaaagcagcgacgccgccggcttccgtccccggcgcggtgttcaacgtggcgacaagcatagtcggcgccggaatcatgtcgattccggcgatcatgaaggttctcggcgtggtgccagcattcgcgatgattctcgtggtggccgttctcgcggaactgtcggtggacttcctgatgcggttcacgcactccggcgaaacgatgacgtacgccggcgttatgagggaagcgttcggatcggccggagcgttggccgcgcaagtttgcgtcatcatcaccaacgtcgggggcttaattctctaccttatcatcatcggggatgtgctatctggaaagcaaaatggaggtgaagtgcatttgggcattttgcaacagtggtttggaattcactggtggaattcccgggaatttgctttgcttttcaccttggtcttcgttatgcttccattggtattgtacaaacgtgtagagtccttgaagtacagttctgcagtgtcaactcttcttgcagtggcatttgttggcatatgttgtggtttggctatcacagctctggtgcaaggaaaaacacaaactcctagattgtttcctcggttagactaccaaacgtcattctttgatctgttcactgcagttcctgttgttgtcacagccttcacatttcattttaatgtgcatcccattgggtttgagcttgccaaggcatcccaaatgacaacagcagttcgattagcattattgctttgtgctgtgatctaccttgcaataggtctatttgggtacatgctatttggggattcaacccagtcagacattctcatcaattttgaccagaatgctggttctgcaattggttcctttctcaatagtttggtccgtgtaagctatgcactccacatcatgctggtgtttcctctattgaacttctctttgagagccaacatagatgaagttctcttccctaagaagcctatgctagccacagacaacaaaagatttatgatcctcactctggtgctgcttgtattctcctaccttgcagctatagcaatcccagatatttggtacttctttcagttcctgggatcatcatccgcagtgtgccttgccttcattttccccggctctattgttttaagagatgtccacggtatatcaacaagaagagacaaaattattgcactggtaatgattatactagccgtggttacaagtgtgcttgccatttccaccaacatatttaatgcttttagtagcaagtcataa

SEQ ID NO: 888 - DNA, 213 bp, Glycine Max
atgtcagcgcttttcaatttccattcatttctaaccgtgatacttctgggaatatgtgcctgcacttatttcaagatgcagtttccggctatccttgaccagaaaactgggtttcgtggtttcttctggaaggcagcaagaataggtgaacgcttaagcccatgggtagcagcaggttgctttatgatgggtgtttcaataatcttcttctaa

SEQ ID NO: 889 - DNA, 213 bp, Glycine Max; identical to SEQ ID NO: 888

SEQ ID NO: 890 - DNA, 213 bp, Glycine Max; identical to SEQ ID NO: 888

SEQ ID NO: 891 - DNA, 555 bp, Glycine Max
atgtcattaccttttgtctatcttgggatactgattggggcaagcctcagaagagaaaatatgtggggtcctatcctagaaaaatgtaggattaggttaagcaagtggaaacaaaaaacactttcttctgtgggcagggttatcttaattaatttgggacttcctatgggggtggagagaaagggaggagaaaagtgccatggggaagtaggtcgtttgggcataaaaaacattttccaaaaaaatgtcaagtgtaaatttgccatagatgtttggaatgcttgctatagatggttgggattattttctgctatgcataagaaaccgattcagcacttcatgatccatgattgcagttggctgggaacgacggtgtgggcattgtggtgtcatagaaacaatcttattttcggtgaacaatctttagacttggactctgttgttgaaactattaaattcaagtcatggctttggttggaatcttatgtaaaagcgtttcatttctctttcttcgaatggttctctaacccaatgtcaagcctgcaatctctatga

SEQ ID NO: 892 - DNA, 1950 bp, Glycine Max
atgtccactgcaactctctcccaccaaatggagtccatgacgaccagactcttcctcttcgcagggactcttctactgcttctactctcacgcgccacgcacgtgtcatccgccaccttatgtccgccgtgcggcaacacgacggtgccgtttcccctgagcacaaccccaacatgcggcgacccgtcgtacaaaatccgatgcagcagctccaacaccctcgtcttcgacacgcttaacaactcctacccgatcgagtccatcgacccgaactcccagcgcttcgtgatccgacccgctccgctgttaacgaacacgtgcgtgtccaccgataaagtgcaccaggggatccagctcaacaccaccctccccttcaacatcacaagctccaacaccatcgtgtatctcaactgcaccaccacgctcctccagtccccgctcaactgctccgccgccagcgcctgccattcctacatcaaggccaccgcctccgccgccgcatgccagggcgctgggccactctgctgcacctatcgcaccggcggctccagcaactcctacatgcttcgtgttagagactctggctgtagcgcatactctagtttcgttaacctcaacccggctctcccagtgaaccgctggcccgaaccgggtttggagattcagtggctttcgcccaaagaaaccgtgtgtgggtcccagcaggattgcgactccgccacgtcgacttgcgggcctgatgcttcttctgcgctcgggatcaggaggtgcttttgtaacgatgggctcgtctgggaccctatccaaggggtgtgcgctaaaaaaattacttgccagaaccctggtggttgtgacgactcaacaagcagaacggccataatagcaggttcagtatgtggggttggagctgcactcattcttgccgtcattgcctttctactctacaaacgccacaggcgcatcaaagaagcacaagcacgcctagccaaagagcgtgaagggattctgaatgccagtaatggtggcagagccgctaaacttttcagtggcaaagagttaaagaaagccacaaacgacttctccagtgaccggcttctaggtgttggaggctatggtgaagtctacaagggcattcttcaagatggcactgttgtggctgtcaagtgtgccaagcttggcaaccccaaaggcactgaccaagtcctcaatgaggttcgcatattatgccaagttaaccaccgcaaccttgttggtttacttggttgctgcgtggaactggagcagcctattatggtttatgagttcatagaaaatgggacacttcttgatcacttgcaaggtcaaatgcctaagagccgtggcttgcttacatggactcatcgccttcaaattgcacgtcacaccgctgagggtctcgcttaccttcacttcatggctgtgcctcctatctaccatagagatgtcaagtccagcaacattctgctagatatcaagatgaatgccaaagtttcagattttggattgtctaggttggctcagacagatatgagtcatatctctacttgtgctcaggggacccttggttaccttgatcctgagtattataggaactaccaattgactgataagagtgatgtttacagttttggggtggtgctacttgagcttttgacagctcagaaggcaatagattttaacagggctgccgatgatgtgaacttggcgatttacgtgcatcggatggtggctgaggaaaagttgatggatgtcattgatccagtgttgaagaatggagctaccactatagagctagagacgatgaaggcagtggcgtttttggcattgggttgcttggaggaaaagagacagaatcgaccttcaatgaaagaggtggcagaagagattgagtatatcattagtattgcctcggcaaaggtagtggagaactag

SEQ ID NO: 893 - DNA, 2151 bp, Glycine Max
atgtccagcaactccaatctgctttgctggaacacaaactcttccttcgaaatgagaaggctttacaacaaaagttctgttccattggagaatctcgccgtcggggacacccacgtttgcgccaccgcggtgggtgatggcacggtgcggtgctggagaaccggtgacacgtttcgaaatccatctgggtctgatcaattcgcttcaatttcatctgggtcgggcttctcttgcggaattttgaagaatggttctaaggttcggtgttggggagacaccaacgttgcgcaacagattgaaaattcgtttgggaacatgtccatgttgagtctcgtcgcaggtggttcgaatatttgtgggttgaactcaacggggtttttggtgtgttctgggcaacttgattttcctcgaggtggggcttttgagtattcaggattggcacttggtgctgagcatggttgtgctattagagggtcgaatggttgggttgtgtgttggggtggcaatggacaattctctgtaaataatgttacagaaggagtttcctttgaggtaattgtttctggttctaactttgtttgtggattgacaacgaacaatttgaaagtggtgtgttggggtcctggttggtctaattactctaatagttcgaggtttgagcttccattgcctcgtgttcttccagggccttgtgtttcattttcttgtgcagagtgtggttcatatgttgattctcaaactctatgttctggttctggtaacatttgtaagccaatgacatgtaggcctcaaacaacagctccgcctcccctgctgccaacaccaccaccaccatctcagtctccgccgccaccgccatcaacacccccaccatcatcaactcgatcgaaaaccttgacaagggggttattggcttttgctattattggttcagtgggagcttttgctggaatatgcacaatagttcattgcttgtggagtggagtttgttttgggaagaagaaagtacacaattctgtgcagcctacaatcacaagaggaagcagtggctcaagtggtgggggtgcttctaataatagcaattcttcgatatcatctatgattatgcgtcagacttcaataataatgaggcggcagaggagtggaacctcatcaacaaagcatccagacagggctgaggagttcactctagctgagcttgtggctgccaccaacaatttctcacttgaaaacaagattggttctggaagctttggtgttgtgtacaaaggcaagctcgcggagggtcgtgaggtggcaatcaagaggggtgaaaccgggtccaagatgaagaagtttcaagagaaagagagtgcatttgagtctgaattggccttcttgtcgcgcctgcaccataagcaccttgttgggctagttgggttctgtgaagagaaagatgagaggctcttggtgtatgagtacatgaagaatggggctttgtatgatcatttgcatgcaaagaacaatgtggagaaggaaagcagtgtattgaataattggaaaatgaggatcaaaattgctttggatgcttcccggggaatagaatatcttcacaattatgcagttccgtctattattcacagagatataaagtcttccaacattcttcttgatgctacttggacggcaagagtatctgattttggattgtctttgatgagtccagaacctgaccgtgatcaccgaccaatgaaggcagcgggaacagttggatatattgatcctgagtactatggtctaaatgtgttgacagcaaagagtgatgtgtatgggcttggagttgtattgcttgaacttttaacgggaaagagagctatattcaagtatggagaagatggaggcaccccattgagtgtggtggactttgcagtgcctgctattttggccggagaattagtgaaaattttggatccaagggttggaccacccgatgtgaatgaggccgaggcagtggaattagtggcctatacagccattcattgtgtcaatttggaagggaaagatagaccaaccatggctgacattgtggccaatttggagagggctttggctatttgtgagagtagccatgacagcacttccagcggtactatctctgttgtttcagaatga

SEQ ID NO: 894 - DNA, 1350 bp, Glycine Max
atgtccatacaaacagagcaacctcttcctactcacactcccttcctaaattcaaactcaaaccaaagccaccaacaccaaccacaagaaaacaacaacgattatgaaacacaaacacctcttgatgatgtccttgcaagtttagaagtgcttctcacgctacttagcttcaaccagtcttcattgttgagcttcactgtgtcttggacaacgtttgcggtggttggtgtggttgcgccactcctggctcttcaggtgtatgacaccgacaaaaatcagataaaaggttttgaaattggcattgttgcatttcagacttgtctagctgccgtgtccttgatttgcctctctcacaatcttcaaaaatatggcctcaacaggttcctcttggttgaccatcacgctgctcacatgccatgctttcaccatgatttcgaaattagtcggaatcatatacacgtgttgttggtcttggaccatggatctatacggttaatcattctgtgggttttgtcatgtttccttttgaagacagcccgagaaatcactcaccttgccttcgtagaacacgggtccctttggccctccattgctgttttgttggctctgatagtatcatggacttatgtgagtgcaatctctttatcagcctgtgttctatttcacttggtctgcagtttgcaactcgttcactttgatgattataggaaactcttgcaaagggaatatgatgccttggtttttatggaggagcacattcggttgcgattccaactgtccaagataagccataggttcagaatttaccttcttctacagttcttggtggtcacagctagccaatttgtgactctattaccggtctctggatttggtggagcactgactttcataagtggtggagattttgctgttttcacacttgttaaggtggttgggattattattgttctgcatgcagcaacaaagatttcacttagagcacagggcattgtttcccttgcaagcaggtggcatgcgcttgtaacatgcacttctgatccatctaaactgagatattgtgctagtacagggagcttggaagctgcaaaacatttaaactcaatatttttggattactcagaaagtgatctagactcatcagattacattgttgtgccttcaaatacccagttagcttcttatatgtcctcacatcacaagagacaagcctttgtgatgtatctgcagacaaatgctggaggaatcagtatatttggatggacagttgatcggtctctagtgagcacaatatttttctttgaattgactctggttacttttgttcttagtaagacaatactttattga

SEQ ID NO: 895 - DNA, 369 bp, Glycine Max
atgtcccaacccagattcatttccatgatctccctctgtctggcccttgttctgttctacacctgcaatggcctaccatttgtggacctcaatttccatgaagtagatgtgatgaccaaaagggtttgcaccaagagcattggggagtgcctgagcttgacagagccggagatggattcggagaccaacagaagagttctggcaatgcagaaaaagtacattagctatgacacactcaagagagacatggttccctgtgatagggctggagcttcttactacaattgtcatgcaatacgagcaaatccttataatagaggttgtgaggtaattactgcttgtgcaagaggtcaagacatcaaaacttga

SEQ ID NO: 896 - DNA, 828 bp, Glycine Max
atgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgcttcttcagataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagggtgatgtaatcaaagaagggcaagtcatagggtatttggatcaatttggcactggacttcctattaagtctgatgtggctggagaagtgttgaaactacttgttgaggatggagagcctgttggttatggagaccctcttattgctgtgttgccatcttttcatgacatcaagtga

SEQ ID NO: 897 - DNA, 150 bp, Glycine Max
atgtccttttcaacttttgaccagaatttagagtgcaaccgtgagttgcttatattgaaccaaacaaaatgtattagtttctcctcctttgtctcaattttttctcgaatcaaaacaataattcaacataatatgatatttttacagtaa

SEQ ID NO: 898 - DNA, 528 bp, Glycine Max
atgtcgaacccagacactcgatcattcaattggcactacacggaactcgatgacagagacctagagatccgaggtaggacactgtttttcgtcatcgtactcttctccattattcttcttgtcaccgttctcttcatctacacgcgctgggtttgccgctaccagggacgactccccaccaccgcgttctccgccgcagccgtccacgcgccgccgctagcgccgcctcagggactggaccccgcctccattaagaaacttcccataatcctccaccacgcgcctgcagaccgcgacgaaagcgcgtgggacgaaacggagtgctgcatctgtctcggcgagttcagagacggtgagaaagttaaggttttgccggcgtgtgaccattattttcactgtgattgtgttgataagtggctcactcatcactctagttgccctctctgcagagcttctctcaaggttgaatcttccttccctaagattttgattcaggaaccaccccttagaattgacttccagttctag

SEQ ID NO: 899 - DNA, 2049 bp, Glycine Max
atgtcgccaaaatatcagattctccacaatcgccccatcaatcagtggaaggttacagagctgaaagatgagctgaagaggaggaagataagtaccaagggtttgaaggatgatttggtcaaacgtttggacgaagtccttcgtctggaaagggaggttgatgaggcttctgagaaggatgaggccaatggtttcgatggtcatgcagatgggaaaaaagttccggaagcagttactgtggatgctgaaatggttgattcaactgacagggccagtgccaaaacatttgatactgctgaaaagggcaagggtggttttgttgatccaattgaaacgggaaatgtggaaaagattcaggagattgtggatcatgacagcgataagaatgacaagcaggacagtgtttccaaccaagttaacattaataatagtgtgtcagctatggatcaagaggttgaacctaagggcttgccagctggtggagattatgcaaatgtgggacatgaggcaattgcccatgcttctactgtggagactatcattacggtcactgagacagcacagctggagaatgaggtgtcaaaggcgcagctggatggtgaggactcaaagccccaactggattatgacaccaagcccttgcatgaggatcctgttcccgactctgctgttccagaaaaccaggtatctgaggtcaaccctagtttagggtctcaagtaaaatctgattctatttctactgattctctgtcaattaatcaaaagaatgaactaaaggatactataattactgataatgtcaaattagaacaagatattgttaagccggagatggtggaagaaccatcatccagaaatgatgttcctgtttcttatgatgaatcacattcaatggatgttggagggctgcatgagaaaaaggcatctgttgaagaaaatatcaataatgtttcaagtccagacttgaacaagaccaatagcagtgatgatgtagggtattcagaaaagttgaacttggacagaagttctggtgatgattctatggaagaggatttgcctgagactaagcaaattgattctaagtttaatgttgatgaacttaaagacaaagtagagattgaaaagcctattgtgaaggaggaaagtagtactatagctgttggagatagtctatctgcaggaaaagatgatacccaccaagatattgacattagtcctgctgccctgactgagaaacggaaatttaatgaagttgggaacagtgagcctgccaaaaggcaacgcaggtggaacactgaaacagttaaaggtccagatgcacaaagcactactcccaggcctgctactacacctagagatgagccaattactttgaaacgcagcttctctaggtctgattcctctgcaactgatgatacacctaaagaacacattgttccaccatcacaaaggtccccaactaattccctcagaattgaccgtttcctccgtccatttaccctaaaagcagtgcaagaacttcttggtaagactgggaatgtcagcagcttctggatggaccaaataaagacccattgctatgttacttactcatctgtggaagaagctattgagacacggaatgctgtatataatttgcaatggccaccaaatggtgggcgtctcttagttgcagagtatgttgatcctgaagaagtgaaaatgaagttagaacctcctcctactcaggctgcatcggacagcactgatcgagcagttcctcctgctccccccttctcacagccagagccttccccccatctgcacagggagcagcatccagttccagtcattctcccacctccaccaccattgtcaaaacccccaccagtagcaagagaacggcttccatctccaccacccctccctgagaaagttgacccacctattgtcactctggatgatctcttccgcaaaaccacagcaactcctcggatctactatctacctttgtctgaagagcaagttgccgcaaaactttcaacacagggtaaaagcgggaggcagtag

SEQ ID NO: 900 - DNA, 1017 bp, Glycine Max
atgtcggacgctttgatcaatggattggccggagctggaggagggatcattgctcagctcatcacttacccacttcaaactgtaaatactcgtcaacaaaccgagcgtgatccgaagaaagacacgaggagtcaagggacccttgaacgaatgtgccaggttgtaaaagaagaggggtgggaacggttgtatggaggcttgatgccatcggtagtgggtacagctgcgtctcagggtgtttactattatctctatcaaatattcaggaacaaagctgaagcagctgcactacaacaaaagaaaatgggcgtcggcgatggatcagttgggatgctctcctcacttgttgttgctgttttatctgggtctgttaccgtgctgttgacaaatcccatatgggtagttgctacgcgtatgcagacacatagaaaagagttgaacagaactccagctgatcagggtttgttagtttccactgagcagccaattctttctgcagttgagcatcttccttatggaactagtcaggtgattcaagatatctacagtgaagctggaattttgggtttctggaaaggtgtattaccaacattaatcatggtaagcaatccttccatacagttcatgctgtatgaagccatgttggtgaagttaagaaaaagacgtgcttggagtaagaagggtagcaatggggtaactgctttagagatatttcttattggagctttagctaagcttggagctactgttgtaacctatccgatcctagttgtgaaggcaaggctccaagctagacaggacaaaactggagacaagaggcaccattacaaaggtacatgggatgctattataaaaatgatccgttatgaagggtttaatgggttttacaatggtatgggcacaaaaattgtacaaagtgtgctggctgctgctgttttgttcatgatgaaggaagaactagttaggggggttcgtttcttgcttgccaatgatgctgtaaagccaaagcatccgtga

SEQ ID NO: 901 - DNA, 1017 bp, Glycine Max; identical to SEQ ID NO: 900

SEQ ID NO: 902 - DNA, 2304 bp, Glycine Max
atgtcggagatggcgagcccagatcccgagggactcgacggagtccgcatgacgtggaacgtgtggccccgtacgaaggttgaatcgagcaagtgcgtgatccctctggcggcgacggtggctctgatccgtccccaccctgacatcccccgcctccagtacgcccctctccgctgcaagacctgctcctccgccctcaaccctttctcccgcgtcgacttcaccgccaagatctggatctgccccttctgctaccagcgcaaccacttcccccctcactaccacgccatctccgaaaccaacttccccggcgaactctacccccaatacaccaccgtcgagtacctcctccctctctccaattccctcaacccttcccccgtcttcctcttcctcctcgacacctgcctcatcgacgaggagatccacttcctcaaatccgcgcttcgtcgcgccattggtcttttacccgataacgccctcgtaggcttcgtttcattcgggactcaggtccaggtttatgaattgggcttctccgacatgtccaaggtttatgtcttccgcggctccaaggagattcccgcagaacagattctcgatcagcttggtctttctgcttccggaaggagacctcacaagggtgctgctcccggtgtcgccggtgccggtggattccccaattcaggcatcacgcgcttccttttgcctgcttctgagtgtgaatatactctcaatgcgctgctggatgaattgcagacggatcaatggccggttccgcctgggcgccgccctgcacgctgcaccggggttgcattgagtgttgccgcggggttgctgagtgcttgcaatcctgggactggtgctagaatcatagctttggttggtgggccatgcacggaaggacctggcgcgattgtgtcaaaagatctatctgacccggtgcgttctcataaagatcttgataaagatgcagcaccattcttcaagaaagcagtcaaattttatgagggtctcgcaaaacagctggttagccagggtcacgttttagatatttttgcatcagcacttgatcaggttggagttgcagaaattaaagttgcggttgaaagaaccggtggtcttgttgtcctgtctgaaagttttggtcattcagtcttcaaggactcttttaagcgagtttttgaggatggggagcaatctcttggtctttgtttcaatggaaccctagagataaattgctccaaggaaatcaaaattcagggaattattggaccttgcacttcgttggaaaagaaagggccttctgtttctgatactgttataggagagggaaacacaacagcatggaagatgtgtggccttgacaagagtacatgcttgactgtgatgtttgatctttcatcaagtgatcgttcaaacacccctggtgctatcaacccacaattgtacctacagttccttacaagttaccaggacccaagtggtcaatcagtgcttcgtgtcacaacagtaactagaagatgggtagatagttctgttagctctgaggaattggttcaaggatttgaccaagaaactgctgcagttgtaatggctagatttgcttctctgaaaatggagagtgaggaaacatttgatgctacacggtggttggatcggtttctcattcgcctctgttcaaagtttggtgactaccgcaaggatgatccatcatcttttacattaaacccatcattttcacttttccctcagtttatgttcaatctgcgacgctcgcagtttgtacaggtttttaacaacagtccagacgagactgcatatttccgtatgttgttaaacagggaaaatattagtaatgctgctgttatgattcagccgtcattgatatcatattcatttaatgcgctgcctgcaccagcattgttagatgtggcttccattgctgcagacaagattttgttgctagattcatattttagtgtggttatttttcatgggatgacaatagctcaatggcgcaacttgggataccagaatcaacaagaacaccaggcatttgcacaactattgcgagctccacatgatgatgcccaaatgataattagagaacgttttccggttcctagattggtagtgtgtgaccaacatggttcccaggctagattcttgttagcaaaactgaatccttcagcaacgtataacaatgcacatgagatggctgctggttcagatgtaatctttactgatgatgtgagccttcaagttttctttgagcatctgcaaaggttggctgtccaatcttga

SEQ ID NO: 903 - DNA, 462 bp, Glycine Max
atgtcggttgcagaggataagtctcagtctgaatatgagattatggtgaagaggaattgcaggatttgctacctcagcatggacatggacatgacaaaccataacaatgaatcagctgggaatgccatgactcccattgagctgggttgttcttgtaaagaggatttggctgctgctcacaaacactgtgctgaggcttggttcaaggtcaagggtaacaaagtttgtgaaatctgtggatccattgcacgcaatgtaactgttgtagctgaagtccaaacgaatgaacagtggaatgaagcaaataataatgcctcaatggtaccaccaccaactggacctgccccccaagcagaaactcgacatctctggcagagccaacggttcctgaatttcattctttcgtgtttggtcttggcttttgtcatatcctggctttttcacttcaatatgccctcatga

SEQ ID NO: 904 - DNA, 1428 bp, Glycine Max
atgtcgttcgcatcatcattctcgatgctccgccaccgcgcggtggcggcatacgcgcccactctcctcctccgccgcttccgctgtctcccaacgatcgccgccagacaccaacaacaacaacaaaaccctaacaaacaagctgctgccccgagccgcaacctcctgaaggcgaaacaaacactgaaagagtattcctgtcttgcccctgtcctctccctcgaagacagccctcctctgacggaatcccaggccatcggcgtggtggcggcgtcgcaggccaacttcatgcgcgtcatcgtccccgaaaatgacgaaccttctggaagcttccgcggggtggagattctctgcgtggtgagggcgctgctgaagaagattaagcggagggtgatggtcggggacaaggttcttgtggggtccatcgattgggttgaccgcaggggcatgatcgagaatgtcttccagcgaacctccgagattctcgaccctcccgttgctaacgtcgaccaacttctcgtgcttttctcgctcgaacaccccaagcctgaacccttcaccctcacgcgctttcttgtcgaagctgaatccaccggaatccctctcatgctcgcactcaacaagacggagcttgtggataatgagatcattagttcatggaaggctaggttgcgcagctgggggtatgagccggttttttgcagtgttgaatctggacatggacttgatcttcttggttacaagttgagggatcaaacgacagtgattgtggggcctagtggagttgggaagtctagtttgatcaatgcccttagaagcaatccttccgatgctgcggaaggggataattggtttgagcctattttgggaagcaagtggcttgaggatcagcgagttggggaggtttcgaccagaagtggtagagggaagcatactactcgtcatgtctctctacttccattgtctgaagggggttttcttgctgatactcctggatttaaccagcctagtttattgaaagtgacaaagcagtctcttgcacagacttttcctgaaatcaggaaaatgcttagtgccaatgagactgagaaatgttcatttaacaattgcttgcatctgggtgaacctgggtgcattgtgaagggagattgggaaagatattcctactattttcaacttcttgatgaaatcagaatcagggaggagttccagctcaggacatttggaactaaaagagaaggggatgtaaggttgaaaatgggagacatgggtgttcagcaagcagaaccacgcttggaacctaagaagcataggagacaatctcggaaaagcattaaccagtcaattttagatgaattggatgatgatgacgacgacaatttgcttgatgaggagaatgatcctattttaagggcgctatttcgttaa

SEQ ID NO: 905 - DNA, 1779 bp, Glycine Max
atgtctagcaaacagacttatagcttctgcttctgcttccgccggcgtttcaggatccccgtgtcggaggccccgccggagataaggacccttttcgacggttactccgatgagaatggcgtcatgacagccactcacctccgaagttttctggctgaggtgcagagggaggacaatgccactgaggaggaagcacaagccatcatcgatggtcacaagcatctcagtatcttccaccgaagtggtctcaatctcgagagtttcttcaactatctttttagtcaccataataacccacctctcttaccttctcttggggtgcaccaagatatgtcttcaccgttgtctcattacttcatttataccggtcataattcctatctaactgggaaccagcttagcagtgactgcagtgacgtccccatcatcaatgcactggagaagggtgtaagggtgattgaattagatatatggcctaatgaatcaaaggataatgtagatgttcttcatggaaggactttgacttctcctgtggcactcatcaaatgtctgaggtctattaagcagcatgcctttgttgcctcagaatatccagttgtaataaccttagaagaccatctaactcccgaccttcaggccaaagtggctgagatgattactcaaacatttggagacatactatttgctcctacctcagaaagcttgaaggaatttccttctcctgaatcacttaaagggaggattattatatcaaccaaaccacctaaggagtaccttgaggcaaaagaagtacaggaaaaggaggaggaatcacaacaggaaaagcctgcagatgatgaagaagcatgggggaaggaagtccctagtttgagaggtggcactatctctgattacaagaacattgaggatgatgatgttcttgatgatgaggaagatattgatgaagcagaaaagtcacgtcaggatgcagcggacgaatacagacgtttaattgccattcatgctgggaagcctaaaggcggattaacggaatgtctcaaagtggatcctgataaagtgagacgtctaagtttaagtgagctacagcttgaaaaggctgctgaaactcatggaaaagaaattgtcaggttcactcagcggaatatactgagagtgtatccaaaaggtactcgcattacttcgacaaattataacccattgattgggtggatgcatggagctcagatggttgcatttaacatgcaggggtatggtagatctctttggttgatgcagggaatgttcaaagccaatggcggatgcggttatgttaaaaaaccagatcttctattaaaggttggtccaaataatgaggtctttgatcctagatctcatttgcctgtgaagacaaccctgaaggtgactatatatatgggggaaggatggtttcttgatttcaaacatacacactttgataaattctcacctccggacttctacgcaagagtggggattgctggagtccctaatgatactgttatgaagaaaaccgagaaagtagaggataattggtcaccttcatggaatcaagtattcaagttcccacttgctgttccggaacttgctctgcttcgtgtagaagttcacgagtatgacatgtctgagaaggatgattttggtggccaaacgtgcttacctgtgtgggaactaagaagtggaatccgagcagttccactgtattcccgcaaaggagataagtatgccaatgtgaagcttctcatgcactttgaattcatttga

SEQ ID NO: 906 - DNA, 1743 bp, Glycine Max
atgtctatcgtgttaaacattatatactacctaactcagtccactttcaccgtcactgcatctccatcccatgatttcaaccccattggcttctaccccgatgtcaaaccgcaaccactcgctcatttttcttcgccgagtcctaagcgccaaagattgccactcaagggagaacctttcttggttgatgcaaccattgattggaagccttgtaagggtccattggcgatggattatataccatgtttggataactttaaggccattaaggctctcaagaaaaggaggcacatggagcacagggaaaggcactgtcctcattctagtcctcactgtttggtgcctctccccaaaggatataaagtcccccttccttggcctaagagcagggacatgatttggtatgataatgtccctcatacaaagcttgttgaatacaagaaggagcaaaactgggtggttaagtctggcgattatcttgtctttcccggaggtggtactcaattcaaagaaggagttaaccattatattaaattcatagagaagacactaccagaaatccaatggggaaagaatatcagggttgttcttgatgctggttgtggagttgctagctttggcggctatcttctggacaaaaatgttattaccatgtcatttgcaccaaaggatgagcacgaagctcagatacagttcgctttggaacgaggaattcctgcaactctttctgtcattggaacccaaaagttgacatttgctgacaacggatttgatttgattcattgtgcaagatgcagggtgcattgggatgcagatggtggcaaaccgttgtttgagctcaataggattcttagacctggtggtttctttgcatggtctgccacaccagtttatcgcgatgatgaaagagatcagaaagtatggaatgccatggtgaccgtaacaaaagcaatgtgctggactgttgtggctaagactcttgattcatctggaattgggcttgttatataccaaaagcctacctcaactttctgttatcaggaacgcaaagagagaactcctcctttatgtgaaactagcgataggaaaagtatctcatcatggtataccaaactcagtagctgccttatacctcttccagttgatgctgagggtaatctgcagagctggccaatgccttggcccgagaggcttaccagtatacctccgagcttatccattgaatccgatgccagcgagatgttcttgaaggacaccaaacactggtcagaattagtttcagacgtttatagggatggtctttctatgaactggtcaagtgttcgaaatataatggacatgaatgctggttatgcaggatttgctgcagcactcattgatctaccagtctgggtgatgaatgtagtacccattgacatgccagatactcttactactatatttgacagagggctaataggaatgtaccatgattggtgcgagtccttaaacacatatcctcggacttatgatcttgttcatgctagctttctcttcaaacatcttatgcaaagatgtgacattgtagttgtggctgtggagatagatcgaataatgagaccagatgggtatctcctggttcaggactctatggaaataattaacaagctcggtccggtcctgcgttcacttcattggtctgtaacgttatatcaaaatcagtttcttgttggtaggaagagtttttggcgtccaaggccctag

SEQ ID NO: 907 - DNA, 1788 bp, Glycine Max
atgtctcggcttcataagtcaacaacaggtcagcagcaacagtttcattccctacaccaaatcctgtccccatacatgtcaagtgttgttgtatccgttttattatggcatgccattgctgtgcttttgctttcaaatttggcctctgctgagggcattgaggccacaaatggaggcacaaaacacagaggtaaggtgatctatgtccacaatggggctgttgccactgatgacggtagatgctcaaggattgggaaggatgttctgagagaaggagggcatgcagtggatgcagcatcctgcttcaagtggccttggtggtggtgcctttatgcttctcaggcttttgatatgagagaaactgctcctgctctttcttgcaaggatatgtatgctggaaatactactttgaaggccaaaggtggcctatctgtagcagttcctggagaacttgctggccttcatgaggcgtggaaacaacatgggaagcttccatggaaaagacttataaagccagctgagtttctagcacgtagagggtttaaagtatcaccattcctccacatgcagatggaagcatcagagtcagatatattggaagacaagggtcttcgtagcatatttgcaccaaatggaaaactcttgaatataggtgacatttgctacaataacaaactagctgagactctcagaacaatatccgagtctggtccacaagccttctatgatggattgattggtcttaatttagttaaagatgttcagaatgctggagggatattgagcatgaaagacctcaaaagttacactgttaaacagaaggaacccatatctaatgatgttcttggactaacgctccttggcatgcctcccccttcaggtgggcatccaatgatgctactgctgaacattctagatcaatataagctcccttctggcctttctggtgcccttggcttccatcgagaaattgaagctttgaagcatgtatttgccgtgagaatgaatcttggtgaccctgattttgtaaatataactgaggttctttctgatatgctttctcatagttttgctaaagtgttgaaaaatgacatcaatgataataagacttttggccccagtcattacggcggcaggtggaatccgataaatgatcatggtacaagtcatttaagtataatagatcccgagagaaacgccattgccatgacatgcactgtaaattcatattttggttcaaagatcctttcaccaagtacaggaatagtactgaacaatgaaatggatgatttttccatccctagaaatgttaccaaggatgttccaccaccagctcctgccaatttcatcatgccaggaaagcggccactatcatccatgtcacccactattgtccttaaggatgggaagctaaaagctgtagtaggtgcaagtggaggtggtttcatcattggtggaactgcagaagtacttttgaatcacttcgttaaaggactgaatcctttttcttctgtaacggctccaagggtctatcatcagctactacctaacgtggttaattatgagaattggacaactgtgttcggtgaccactttgaagttccagctgatatcaggaaagcccttaaaagtaagggtcatgtcctaaagggccttgccggtgggactatttgccaattcattgttttagacactattgtgccctacgaacaaaataaagggattgaaaacgaaacgcttgtggcagtgagtgatccaagaaagggtggttttcctgcaggcttttga

SEQ ID NO: 908 - DNA, 1842 bp, Glycine Max
atgtctcggcttcataagtcaacaacaggtcagcagcaacagtttcattccctacaccaaatcctgtccccatacatgtcaagtgttgttgtatccgttttattatggcatgccattgctgtgcttttgctttcaaatttggcctctgctgagggcattgaggccacaaatggaggcacaaaacacagaggtgaggtgatctatgcccacaatggcgctgttgccactgatgacggtagatgctcaaggattgggaaggatgttctgagagaaggagggcatgcagtggatgcagcagtggcttctgccctttgtttgggggttgtgagtcctgcttcaagtggccttggtggtggtgcctttatgcttctcaggttgaataatggggtggcaaaggcttttgatatgagagaaactgctcctgctctttcttgcaaggatatgtatgctggaaatactactttgaaggccaaaggtggcctatctgtagcagttcctggagaacttgctggccttcatgaggcgtggaaacaacatgggaagcttccatggaaaagacttgtaaagccagctgagtttctagcacgtagagggtttaaagtatcaccatacctccacatgcagatggaagcatcagagtcagatatattggaagacaagggtcttcgtagcatatttgcaccaaatggaaaactcttgaatataggtgacatttgctacaataacaaactagctgagactctcagaacaatatccgagtctggtccacaagccttctatgatggattgattggtcttaatttagttaaagatgttcagaatgctggagggatattgagcatgaaagacctcaaaagttacactgttaaacagaaggaacccatatctaatgatgttcttggactaacgctccttggcatgcctcccccttcaggtgggcatccaatgatgctactgctgaacattctagatcaatataagctcccttctggcctttctggtgcccttggcttccatcgagaaattgaagctttgaagcatgtatttgccgtgagaatgaatcttggtgaccctgattttgtaaatataactggggttctttctgatatgctttctcatagttttgctaaagtgttgaaaaatgacatcaatgataataagacttttggccccagtcattacggcagcaggtggaatccgataaatgatcatggtacaagtcatttaagtataatagatcccgagagaaacgccatttccatgactagcactgtaaattcatattttggttcaaagatcctttcaccaagtacaggaatagtactgaacaatgaaatggatgatttttccatccctagaaatgttaccaaggatgttccaccaccagctcctgccaatttcatcaagccaggaaagcggccactatcatccatgtcacccactattgtccttaaggatgggaagctaaaagctgtagtaggtgcaagtggaggtggtttcatcattggtggaactgcagaagtacttttgaatcacttcgttaaaggactgaatcctttttcttctgtaacggctccaagggtctatcatcagctactacctaacgtggttaattatgagaattggacaactgtgttcggtgaccactttgaagttccagctgatatcaggaaagcccttaaaagtaagggtcatgtcctaaagggtcttgccggtgggactatttgccaattcattgttttagacactattgtgccctccaaacaaaataaagggattgaaaacgaaacgcttgtggcagtgagtgatccaagaaagggtggttttcctgcaggcttttga

SEQ ID NO: 909 - DNA, 852 bp, Glycine Max
atgtctcgggttgataacagaaattcctcagccaccaagcgtgctaggactgatggtagtcgtagggaagatgattggacatgccccagctgtggcaatgtcaatttctctttcaggacaacttgtaacatgcgtaattgcactcaaccaaggccggctgatcataattcgaaatctgctgccaagcctctacaagctccgcagggttattcatcctcagctccttatttaggttctaataccccctcttcaatatatcttggtgttccaccatatggatcttctctgttcaatggatcatctgttcctccctatgatgttccattttctggaggatcagcatatcactacaattatggtagtcgcctttctgctggcagtccttatagaccattgcatttatctggaccaacaccctacacaggtggaccagtgattggaaatggtgggatatatggaatgccccaactgttggatcggtatggcctgggcatccctatcggacctgggacaatgggtgctaggcctggattttttcacgatgacaagtcacagaaaaaagatgcaactcgtgacaatgactggacatgtccaaaatgtggcaatgtcaatttttcattcagaactgtctgcaacatgagaaagtgcaacacacccaaacctggatcacaggcctcaaagtcggacaaaaattctaagcaaaagatgcctgagggaagctggaagtgcgaaaagtgtaacaacataaactatcctttcagaaccaagtgcaacagacagaattgtggtgctgacaagccggctgagtctgaagaatctccttcatcagctgcagatcaaaatgatcagtga

SEQ ID NO: 910 - DNA, 705 bp, Glycine Max
atgtctcgggttgataacagaaattcctcagccaccaagcgtgctaggactgatggtagtcgtagggaagatgattggacatgccccagctgtggcaatgtcaatttctctttcaggacaacttgtaacatgcgtaattgcactcaaccaaggccggctgatcataattcgaaatctgctgccaagcctctacaagctccgcagggttattcatcctcagctccttatttaggttctaataccccctcttcaatatatcttggtgttccaccatatggatcttctctgttcaatggatcatctgttcctccctatgatgttccattttctggaggatcagcatatcactacaattatggtagtcgcctttctgctggcagtccttatagaccattgcatttatctggaccaacaccctacacaggtggaccagtgattggaaatggtgggatatatggaatgccccaactgttggatcggtatggcctgggcatccctatcggacctgggacaatgggtgctaggcctggattttttcacgatgacaagtcacagaaaaaagatgcaactcgtgacaatgactggacatgtccaaaatgtggcaatgtcaatttttcattcagaactgtctgcaacatgagaaagtgcaacacacccaaacctggatcacaggcctcaaagtcggacaaaaattctagtaagtag

SEQ ID NO: 911 - DNA, 858 bp, Glycine Max
atgtctcgggttgataacagaaattcctcagccaccaagcgtgctaggactgatggtagtcgtagggaagatgattggacatgccccagctgtggcaatgtcaatttctctttcaggacaacttgtaacatgcgtaattgcactcaaccaaggccggctgatcataattcgaaatctgctgccaagcctctacaagctccgcagggttattcatcctcagctccttatttaggttctaataccccctcttcaatatatcttggtgttccaccatatggatcttctctgttcaatggatcatctgttcctccctatgatgttccattttctggaggatcagcatatcactacaattatggtagtcgcctttctgctggcagtccttatagaccattgcatttatctggaccaacaccctacacaggtggaccagtgattggaaatggtgggatatatggaatgccccaactgttggatcggtatggcctgggcatccctatcggacctgggacaatgggtgctaggcctggattttttcacgatgacaagtcacagaaaaaaggtacagatgcaactcgtgacaatgactggacatgtccaaaatgtggcaatgtcaatttttcattcagaactgtctgcaacatgagaaagtgcaacacacccaaacctggatcacaggcctcaaagtcggacaaaaattctaagcaaaagatgcctgagggaagctggaagtgcgaaaagtgtaacaacataaactatcctttcagaaccaagtgcaacagacagaattgtggtgctgacaagccggctgagtctgaagaatctccttcatcagctgcagatcaaaatgatcagtga

SEQ ID NO: 912 - DNA, 1824 bp, Glycine Max
atgtctctccagtctcaactgtgctccgcggcacggcagagtccattgctggcgaagaagcttcacgcacaaatcataaaagctggtctcaaccaacacgaacccatccccaacactctcttaaacgcatacggcaaatgcggtcttatccaagacgcactccaactgttcgacgcattgccccgccgagaccccgtcgcatgggcctccctcctcaccgcctgcaacctctccaaccgccctcaccgcgccctctccatctcccgctcccttctctccaccggcttccaccccgaccacttcgtcttcgcctccctcgtcaaggcttgtgctaacttgggtgttcttcacgtcaaacaagggaaacaagtccatgctcgcttcttcctatcacccttctccgatgacgacgttgtcaagtcttctttgattgatatgtacgcgaaattcgggttgcccgattacggacgtgccgttttcgactccatttcttccttgaattcaatttcttggactaccatgatatccgggtatgcgcgaagtgggcgaaagtttgaggcttttcggctgtttcgtcaaacgccgtatcggaatttgtttgcgtggactgctttgatttctgggttggtgcagagtgggaatggagttgatgcgttccacttgtttgttgaaatgcggcatgaagggattagtgtaacagacccgttggttctttctagtgtggttggtgcttgtgctaatttagctctctgggagctagggaaacagatgcacggtgtggttataactcttggctatgagtcttgcttgtttataagcaatgcgcttatagatatgtatgccaaatgcagtgaccttgttgctgcgaagtatatcttctgtgaaatgtgcagaaaggatgtggtttcttggacttcaataattgttggcactgcccagcatgggcaggctgaggaggcattggctttgtatgatgaaatggttttggctggggttaagccaaatgaagtgacctttgttgggttgattcatgcttgtagtcatgctggcctagttagcaaggggcgtactttgttcaggactatggttgaagatcatgggatttcgccctctctgcagcactacacttgtttgctggatctttttagtagatcagggcacctcgatgaggctgagaatctcattagaacaatgccagtcaaccctgatgaacctacttgggctgctttgctcagttcttgtaagcgccatggtaacacccagatggcagttaggattgctgatcatctgttaaatttaaaaccagaagatccttcttcttatatattgttatctaacatatatgctggagctggtatgtgggaagatgtttcaaaagtgagaaagttgatgatgaccttggaagctaaaaaggcaccaggttatagctgcattgacttgggaaagggaagccatgtgttttatgctggagagacttctcacccaatgagggatgagattataggtttaatgagggagttagatgaagagatgaggaaaaggggttatgctcctgatactagctcagttttacatgacatggatcaacaagagaaggaaagacaacttttctggcatagtgagaggttggctgtggcctatgggcttcttaaggctgttccagggactgttatacgtatagtgaaaaatcttcgtgtttgtggagactgtcatactgttctgaaactcatcagcgctataacaaatagggaaatttatgtccgagatgccaaaagatatcaccattttaaggatgggaattgttcttgcaatgacttctggtga

SEQ ID NO: 913 - DNA, 234 bp, Glycine Max
atgtctgatattgccatgttggtagccgaagaatatgagagaaggacaaagcattataggaagggtggtgctggcgctgtacaagagaggaatttgaacgtggtttcttgtgctaattcttttttggttctgaaggagaagattgaggtgcagaagaaggagcttgtcaagtgggttttggaacccaaaacccaatttgcaattgctgcttctaacagtttattctctgcttga

SEQ ID NO: 914 - DNA, 912 bp, Glycine Max
atgtctgcatatgctcatcaaatggagcagcagtactctgcacctagtctctcagatgattctgagacaggaagccattatgaattagaatcaggattcttcatgaaatcgtttaccgcaacaatattcgttgcttcacttgtcactcttggagttcttctaattactttggtgatttccttggtgattatgctgcaatcctgtcaaagtaaaagtgctggagttatcgagcttctgaatataaatgattattacagttattgcagggtgtattctctgcatgctgagctcaataacttagaaggttataatcttcctggaatctgcagacacctggctgtacactatatcaaagtaggtcaatatgctagagacttggatttgactatgtctgtgattgatgattacttcaagagtgttagaccttctgaggatggtttggatgtggttttgatggacatagatgacatttttcctcggaactctgactcttccaatttgtttcacaggttttataatgacagcactagcaactgtattaaagaggcaaagaatgtaaagctcatgtttgttactagactatacatgtaccttcaaactggtggatggtctataattttgttatcgagagagcctagaacacaccgaaatgtcaccattaatcatcttgactcagcgggacttagaagttggtctgccttgatgatgagagcagaagattcagatcctaccaaagggtacgagtacttttctaggcaaaggaatttgataaggaagaagagcttccgaataaaaagtatcataagcagccatatggatgccgtgacagttccggagaccggagtgcggaattttttgcttccagaccctctatgttacaagtgtgagaagcagatagagcatagatactga

SEQ ID NO: 915 - DNA, 900 bp, Glycine Max
atgtctgcatatgctcatcaaatggagcagcagtactctgcacctagtctctcagatgattctgagacaggaagccattatgaattagaatcaggattcttcatgaaatcgtttaccgcaacaatattcgttgcttcacttgtcactcttggagttcttctaattactttggtgatttccttggtgattatgctgcaatcctgtcaaagtaaaagtgctggagttatcgagcttctgaatataaatgattattacagttattgcagggtgtattctctgcatgctgagctcaataacttagaaggttataatcttcctggaatctgcagacacctggctgtacactatatcaaagtaggtcaatatgctagagacttggatttgactatgtctgtgattgatgattacttcaagagtgttagaccttctgaggatggtttggatgtggttttgatggacatagatgacatttttcctcggaactctgactcttccaatttgtttcacaggttttataatgacagcactagcaactgtattaaagaggcaaagaatgtaaagctcatgtttgttactagactatacatgtaccttcaaactggtggatggtctataattttgttatcgagagagcctagaacacaccgaaatgtcaccattaatcatcttgactcagcgggacttagaagttggtctgccttgatgatgaggtatggtgatcatgttccttttatatatccaagatcaagccttgttatttttaacatgtttggattagatttaactttccccaaatcacgtggaaagtcaaagcaacaaatagttgcttccacttttttaatttttcaccatgatttttgggtcccaaaatcaattctagtagctatccaaacatgctag

SEQ ID NO: 916 - DNA, 732 bp, Glycine Max
atgtctgctgctgtgtcctccacaacctctcatttagaggaagagcttaaaaacaacaacaacaacaacaacaacgttggtggagaatcagaccagcccccttacaatgagggtgccaactctgatgttgctgaagaaactgagccagaggaagatgatgactccaagttggaatctaacaaagaactggatcttggccctcaattcaccctcaaggaacagcttgagaaagataaagatgatgtaagtttgagaaaatggaaggagcaacttctgggaagtgttgacatgtctgtcgttggaagtgaaagcaaagaccctgaagtaaagatattgagcctcattattacaagcccagacaagcctgacctcacccttccaattccatttactactgatgctaagaagagtcttttcatccttaaggaaggaagcaaatgccaaatgaaattcaccttcactgtctccaacaacatcgtttctggtctcaaatacacaaatgttgtttggaaaactggcgttagagtggacagcagaaaaaagatgttgggaacttttagtcccaagcaggaaccatatacatttgaattggaagaagaaactatcccttctggcatgttcgtcaggggaacctatgcagcaagaaccaagtttgtagatgacgatcgaaaatgctacttggatgtcagttactactttgaaattcagaagaacagaccaacacctcaatga

SEQ ID NO: 917 - DNA, 207 bp, Glycine Max
atgtcttccattggggcacgttcagctgaaatttatgttatggagaagaggcagaaagagaagttgaagagaatggaagaggaaagagtacgaagaggtgaggtgagtactgaagagagaaaggagattagttctagtgtgggaaagaacaaggtgcatccaggtagtgaacaaggagtcacatccgataatgtctttagggcgtaa

SEQ ID NO: 918 - DNA, 603 bp, Glycine Max
atgtcttttatcggtacccagcaaaagtgcaaggcttgtgagaaaacggtttatccagttgatcagctttctgctgatggcactgcttatcacaaagcttgcttcagatgttctcactgcaaaggaacattaaagctgagcaactattcctcaatggaaggtgttctttattgtaagcctcactttgagcagctcttcaaggagagtgggtccttcagcaagaacttccagtcacctgcaaagctagcagataagacaacacatgagctgacaaggtctcctagtaaagctgcgagcatgttttctggcacccaagaaaagtgtgccacatgtggcaaaactgcttatccattggagaaggtaacagtggaagggcaggcctatcacaaatcatgtttcaagtgttcacatggtggatgtcccataacgccgtcgaattacgcagcccttgagggcattttgtattgcaagcaccacttctcccagctttttaaggagaaagggagctataatcatcttactaagtctgcctcagtcaaacgtgcagcagcagcagcagcaacagcaactgcaacgaccgtggcctctgttccagaatcttga

SEQ ID NO: 919 - DNA, 603 bp, Glycine Max; identical to SEQ ID NO: 918

SEQ ID NO: 920 - DNA, 603 bp, Glycine Max; identical to SEQ ID NO: 918

SEQ ID NO: 921 - DNA, 603 bp, Glycine Max; identical to SEQ ID NO: 918

SEQ ID NO: 922 - DNA, 2004 bp, Glycine Max
atgtgcacggtggtttcaagttcagtccttgtgggatggctttcttcttcttgttctaaaacgaaagggagcgttggcaatggcataagccatttaagccctgccactcgtgctatatccgtactagccacggctatggctaaagatgtgtggacccgaacatcatcttccaacaccagtaggcaacgtagtagtagtagtagtagaaggcagcagcagtacttggaccgcagcgtggacatggaagtgctattagcggcaattggacagacccagaacgaggatgaactgtatgcggttatgtctccctacaacgggaggcagttatccatgcgcttcatggtttccctgctatcccgcgagcctgattggcaacgcgctcttgcccttctcgattggatcaacgacaaggccctctatcgtccctccctcttcgcctacaacgtccttctccgcaacgtccttcgggccaagcagtggcacctcgcacacggcctgttcgatgaaatgcgccaaaagggcctctcccccgataggtacacttactccaccctaattacttgtttcggcaaacacggcttgtttgattcttccctcttttggctccagcagatggagcaagacaacgtctccggcgacctcgttctctacagtaacttgattgaccttgcccgcaagttgtccgattattccaaggccatttctatcttctccagattgaaagcctccactattacccccgaccttattgcttataactccatgatcaatgtctttggaaaagccaagctcttccgtgaggctcgccttcttcttcaagagatgagagacaatgccgttcaacccgacaccgtcagctattccacccttcttgccatctacgttgacaaccaaaagtttgttgaagcactttctctattttccgaaatgaatgaagctaaatgccctcttgatctcaccacttgtaacatcatgattgatgtttatggccagcttcacatgcccaaggaagccgaccgcctcttctggagcatgaggaaaatggggattcaacccaacgtcattagctataatacgctcttgagggtttatggagaggctgacctatttggggaagccatccatctattccgtttgatgcaaagtaaggatgtacaacaaaatgttgtcacctacaacactatgattaatatttatggcaagactctcgagcacgagaaggctacaaatctcattcaagaaatgaataaaaggggtattgaacccaatgccatcacttattcaaccataatatctatatgggagaaggcagggaaactggaccgtgctgccatcttgtttcagaaattaaggagttctggagttcgaattgatgaggttctttaccagacaatgattgtagcctacgagaggacgggtttagttgctcatgcaaagcgtctacttcatgagctcaagcgaccggacaacattcccagggacactgcaattgcaattcttgccagagctggtagaattgaagaggctacctgggttttccggcaggcttttgatgctcgagaggtcaaagatatatctgtgtttggttgcatgattaatcttttctctaagaacaaaaagtatgccaatgtagttgaagtgtttgagaagatgagagaggtgggatattttcctgattctgatgttattgctctcgtgctgaatgcttttggaaagctgcgtgaatttgataaagcggatgctttatatagacagatgcatgaagaagggtgtgtttttccagatgaagttcatttccagatgctgagtctatatggtgcaagaaaagatttcgtgatggtagaatcattgtttgagaagctggattccaatcctaatatcaacaagaaagagttgcatcttgttgttgctagcatttatgagagagcagatagacttaatgatgcatcccgaatcatgaataggatgaataaaaaagcaaacagaattcatgatcatgcttag

SEQ ID NO: 923 - DNA, 861 bp, Glycine Max
atgtggcccatttgcttgctattcaacaagattctcaaggcaggggatgaaggagaattaaaaggggataatttgaatgcgatagatccgtacctgtttcagcaaccatcaattaacatagattcccatcctccctccttgcgctgttcacacttcattgaagtaccacacataaaccaaatatatacatgggattgtggccttgcttgtgtcttgatggttttgaaaactattggcgtcaacaactgtgatattcaaacactggctgaactatgctgcacaactagcatttggactgttgatttggcatatttattacagagatttgctgttgctttttcctacttcacagttacatttggggcaaacccaaactatagcattgaatcattctacaaggaggaactgcctaatgatctagtgagagtggatttgctatttcaaaaagcagtggaggctggcattgatatacagtgcaggtcaattagtgaagaagagatttctattctcatattgtctgggaaatatattgcaattgtattagttgatcacaacaaattgaggttctgtttcagtcatgttttgcaagaagatgttcccatgcctggtcttttcagcaacaaccctggctacacaggtcactatgtgttgatatgtggctatgatgctggagcagatatgtttgagattagagatcctgccagctctaagaaacataagaggatttcttcaaagtctttagaagaagctcgcaacacctttggaactgatgaggatcttctgttgatatctttggagaaaagcagtaaccatcatcaaccttttctgcaactttccaatgatgtcaataccgattcttga

SEQ ID NO: 924 - DNA, 861 bp, Glycine Max; identical to SEQ ID NO: 923

SEQ ID NO: 925 - DNA, 672 bp, Glycine Max
atgtggctaccatggcgtatccgaaccacagcttcgcgttcaaaccgatcccaatcctgcaccatctcctgctcttccttcaaagacatccaatccatactcgaatccgaacctgaacctccctctctattccgccgcctaatcgtctctccctccctcatccgctcctttagcagcccccgcgccgcctcctccgccgtccaaccgcctccggactccgaccgtaccgccgtcgtcgtctactacactagcctccgcgtcgtccgccgcaccttcgacgactgccgcgccgtccgatctatcctccgcggcttcgccgtcgcgatcgacgagcgcgacgtcagcgtcgacgagcgcttccgcgaggaactgcagcggatcctcgtccgccgcagcgtgccgctgccgagcgtcttcgtcgccggcgtgtacatcggcggtgccgacgaggtgaggaagctctacgagaacggcgagttgcacgagttgatcagacggttgccgaagtcacagaggaacatgtgtgatttgtgcggagggctgagattcgtggtctgcgacgagtgcgatggaagccacaaagtgttcggagagaagagtggcggattcaggagctgttcgtcttgcaattccaacggtttgattaggtgtcctgcatatatattcctttaa

SEQ ID NO: 926 - DNA, 750 bp, Glycine Max
atgtggttttctgggtggaccccgagcggcgcctggccacgaaatccgacgactccggcaacacctcccccgtctggaacgagcgtttcgccctccctctccctctccccctccacgactccttcctcacgctcgagatcttccactccaaaccctccgacacccccaaacccctcgtcgccaacctccgcctccccctcaaagacctccacgactcaactcgctcccgcaagttccccctctcccgcccctccggccgccctcacggcaaagatccccctcaaactcggcctcctcggccgcccccaattcgattacgcctccctcaacactaaccctaaccctaatttcgtctgctacagaggatacaccccttcccattccccttctccaccagcctctccttacacatcatacacctcttacactgactcctattctaattactaccccgcttactattctggcgctcctccccctcccccccctagacccttcttcgaccgttacgctgggcccagtgggccttctgctccgcttgattactcctccacttatgaccccatgcccaagcctcccaaaatgggcctcggcgctggcctcgccattggcgctgttgctggggctctcggcgggcttgctctcgacgagggccttaactacgaagaggacaagatcgccgagagggtcgagaacgacgtcgctgctgctgcgcgcgacgattacagcgattaccgagtggattattga

SEQ ID NO: 927 - DNA, 861 bp, Glycine Max
atgtgtatggagaagcacggccatgatgaggaggagcaacccaaacctgtggttctaatcacaggatgttccacgggagggataggccacgcgcttgcacgatccttcgcagcgaacaggtgcagggtggtggccaccagcaggtcgcggtggagcatggcggatctggaacacgaccacaggttcttcttgcaagaattggatgttcagtccgatgagagcgtgcgtaaggtggtcgatgctgttgtcaacaagttcggtcgcatcgacgtgcttgttaacaacgctggtgttcagtgtgtgggcccccttgccgaggttcctctctctgccattcaaaacactttcgataccaatgtcttcggttcgttgagaatgattcaggccgttgttcctcatatggctgttaggaaagagggggagatagtcaacgttggtagcgtgggtgccttggcctctggaccttggtcaggcacttacaatgcttccaaagctgctcttcatgctttcactgatacattaagattggaacttggacactttggaatcgacgttgtgaatgtagttcctggagccatcacttccaatattgcaaataatgcccttgccaattacaatcgaatgcctgaatggaagttattcaagccttttgaagcagcaatccgagacagagcttctttgtctcaggggtccaagtcgaccccttcggaggagtttgctaaaaacacagtagcagctgttcttaagaagaatccacctgcatggttctcctatggccattactctaccttcatggctatcatgtatcatttaccactctttcttagagacttttttttgaagaaattgatgaaatgctga

SEQ ID NO: 928 - DNA, 1179 bp, Glycine Max
atgtgtatggagaagcacggccatgatgaggaggagcaacccaaacctgtggttctaatcacaggatgttccacgggagggataggccacgcgcttgcacgatccttcgcagcgaacaggtgcagggtggtggccaccagcaggtcgcggtggagcatggcggatctggaacacgaccacaggttcttcttgcaagaattggatgttcagtccgatgagagcgtgcgtaaggtggtcgatgctgttgtcaacaagttcggtcgcatcgacgtgcttgttaacaacgctggtgttcagtgtgtgggcccccttgccgaggttcctctctctgccattcaaaacactttcgataccaatgtcttcggttcgttgagaatgattcaggccgttgttcctcatatggctgttaggaaagagggggagatagtcaacgttggtagcgtgggtgccttggcctctggaccttggtcaggcacttacaatgcttccaaagctgctcttcatgctttcactgatacattaagattggaacttggacactttggaatcgacgttgtgaatgtagttcctggagccatcacttccaatattgcaaataatgcccttgccaattacaatcgaatgcctgaatggaagttattcaagccttttgaagcagcaatccgagacagagcttctttgtctcaggggtccaagtcgaccccttcggaggagtttgctaaaaacacagtagcagctgttcttaagaagaatccacctgcatggttctcctatggccattactctaccttcatggctatcatttccattttaccatattcagtggcgaacaaattttcgaataagattaacgtttctcgtgcgagagggacaatcgttgctcacttgctcggtggtgtttcagcttgtgacatctgtgaaatcagcattaattggatactgagacgtgccatgagaatgattcggcttgttgttccccatatggcaacttggaaacagggaaagattctcaacattggtggtgttagtgccttggcctctggactttggtcaggcacttacaatgcttctaaagctgctcttcatgctttcacagatacattaagggggttttcttcttcttcttcttcttcttctaacttaccctacagtacttgtacccttcatgaatcatgttaa

SEQ ID NO: 929 - DNA, 1389 bp, Glycine Max
atgtgtgtatttcctttgggcttgaaactcaaaactataataatgggttcttcttctcctccggacactagcaagagcataaagctagagcgatacaacagctacatcaggagactcaacagcaccaaactcctcaacgcctcctccaaactcctcttccgtgccactatcttagtcgcactcatcctcgtcttcctcttcaccttcaactaccctcccctcgccccagacttcacctcccaccgccacctccactcccactcccacttcctctcctcctcctcctccttcgcctcctgggagaagcaggtccgccactcctccacccctcgccgccccaacggcctcaccgtcctcgtcaccggcgccgctggcttcgtcggcagccactgctcccttgccctcaaaaaacgcggcgacggcgttctcgggctcgacaacttcaacagctactacgatccctccctgaaacgctcccgtcaggcaatgctctggaaacaccaggttttcatcgtggaaggtgaccttaacgacacccccttgcttgagaagctcttcgacgttgtccccttcacccacatcctccacctcgccgctcaggctggcgtccgctacgccatgcagaacccccaatcctacgtcaccgccaacattgctggcttcgtcaacctcctcgaggctgccaaatccgccaatccccaacccgccatagtctgggcttcatccagctccgtctacggcctcaacacccaaaaccctttctccgagctccaccgcaccgaccaacccgccagcctctacgccgccaccaagaaagccggcgaggagatcgcccacacctacaaccacatctacggcctctccctcaccggactccgcttcttcaccgtctacggcccctgggggagacccgacatggcttactttttcttcaccaaggacatcctccaagggaaaaccatcgacgtgtaccagacgcaggaggggaagcaggtggcccgtgacttcacctacatcgacgacatcgttaaaggctgcctgggagccctggacaccgcccagaagagcaccgggagcggcggcaagaagaagggccccgcccagctcagagtatacaatctggggaacacttcaccggtgccggttgggaccttggtgtccattctggaaggtctgctaagcaccaaggccaagaagcacgtcattaagatgccatcaaacggcgacgttcccttcacacacgccaatgtcagcttggcctacagggatttctcttacaatcccaccaccgatctcgccaccggtctcaggaagttcgtcaagtggtacctcggttattacggcctccagcaaaggctaaaaaaggaatatcaccttgacaatgaataa

SEQ ID NO: 930 - DNA, 1086 bp, Glycine Max
atgttaaaaaaccaaccacaaccagattggcctgagcccattgtccgggttcagtccttatccgaaaactgcgaagattcaatccctgaaaggtacatcaagccttctactgatagaccatccataaaaagttgtaattttgatgatgccaatattccaatcatcgaccttgggggactatttggtgctgaccaacatgtctcagcctcaattcttaagcaaatctcagatgcttgcaaagaatggggcttcttccaagtcactaatcatggtgtcaaccctgatttgatggacaaggtcagggaaacttggcgtgaattctttcacatgcccatggaggtgaagcagcaatatgcaaactcgccaaaaacctatgaaggctacggaagcagacttggaattgagaaaggtgctattcttgattggagtgattactactttcttcactatcttcccttttcactcaaggactataacaaatggcccgcctcgcctccctcttgcagggaagtgcttgatgggtatgggagagagttagtgaggctatgtgggaggttgatgaaggctttctcaataaaccttggattagatgaaaaaatccttcaaaatgattttggaggggaagacataggggcatgtctaagagtgaatttttaccctaaatgtccacggccagagttgacgttgggtttgtcatcacactcagaccctggaggaatgactatgttgcttccagatgatcaagttcctggtcttcaagttcgaaaatgtgatgattgggttactgtgaagcctgcaaaacatgctttcattgtcaatatcggagaccaaatccaggttctaagcaatgcaatttacaagagtgtggagcacagagtgatagtaaattcagataaagagagagtctctcttgcatttttctacaaccccaaaagtgacatacccatagaaccaataaaagagcttgtaacaccgaaaaggccctcactctacccagcaatgaccttcgatgaatacagactcttcattagaatgagaggacctcgaggcaaatctcaaattgaatctttaaagtctcccagatga

SEQ ID NO: 931 - DNA, 1440 bp, Glycine Max
atgttacctcagaagcaagctgaagaagccatgatgtcaagcctcactcaaacgatggagcgggaggagggagaggaagtgataggggagacctcaaattttagctttaaaaatgctctctggcatggtggttctgcctacgatgcttggttcagctgtgcctcaaatcaggttgctcaggttctgttgactctgccttactcattctctcagctgggaatggtttcaggcatcatattccaagtgttctatggcttgcttgggagttatactgcttatttaattagcattctgtacattgagtacagaagccggaaagagaaagagaatgtcagcttcaaaaaccatgtcatccagtggtttgaagtgttggaaggcttactgggtccatactggaaagctattgggttggccttcaactgcacttttctcctctttggatctgtcatccagctcatagcttgtgcaagtaatatatactacataaatgaccacttggacaagaggacttggacctacatatttggagcttgctgtgccaccacagtgttcatcccatcattccacaactacaggatatggtccttccttggtcttggcatgaccacctacactgcttggtatttgaccattgcagccattgctcatggccaggttgaaaatgtgaagcattcggccccaaacaagatggttttgtatttcacaggcgccaccaacatactctacactttcggcgggcacgccgtcacagtggaaatcatgcatgcaatgtggaagcctcagaagttcaaatacatatatctttatgcaacagtttatgtgttcaccctcactctaccatctgctattgccgtttactgggcctttggtgaccaacttttggatcattccaatgccttctcgctcctccctcgctctggctggcgtgacatcggtgtcatcctaatgctcattcaccagttcatcacattcgggtttgcttgtacgccattgtatttcgtgtgggagaaagtgataggaatgcatgacacaaagagcatattttttagggcactagcgaggttacctgtggtgataccaatatggtttttggccattattttccctttctttgggcccattaattcagctgtgggggcccttttggtcagcttcaccgtttacatcatccctgcttctgctcatatgctcacatacagatctgcctcagcaagacagaatgccgcggagaaattgcccttctttatccctaactggacggtgatgtacgtggtgaatgcatttgtggtggtgtgggttctggtagtgggctttgggtttggagggtgggccagcatgacaaatttcatcaagcaggttgacacattcgggctatttgccaagtgctaccaatgcccacccaaaggccccccctcctccaaccacaccttgcataactga

SEQ ID NO: 932 - DNA, 570 bp, Glycine Max
atgttagtgagaggcatgaagggttatgagccccgttcaagctcttcatgtgcagcttgcaagttattgaagagaagatgcataccaaattgtatttttgcaccttactttaggtctgatgagtgcaagaagtttgcaaaggtgcacaaggtgtttggagcaagcaatgtgagcaagattctgattgaagtgccggaagagcagagagaggacacagtgaattctcttgcttatgaggctgaggcaaggctgagagacccggtttatggatgcattggtgccatagctctgttgcaaaggaagatggtggagcttcaacatgatctggtcatcgcaaaggatcgtctcgcgcgttgtcacgctgctgctactgctgctgccaccaccaccaccactactagtatcccttctcctgatatcttgcatgccaatgttagccttcccccattccctgacttttacacttcttcaagtgacttcaatgatatcttctgccacagttcttcgtctcaattattgagccgacatgaaacggtggatgatttcaatcaaatcccatatatattttaa

SEQ ID NO: 933 - DNA, 1410 bp, Glycine Max
atgttatgtgtaaaaatgtcttcttcttcttcttctcctgctgttctctcaaaatgcaccgttttccctcaccggaactccactctgggggacctcaagctctctatctccgaccttaacatgtttttatctcactacatccaaaaaggctgtctcttcaccactccttcacttccctctcactctcacactctcatccctcacctcaaaaacgcgctttcccaaaccctctctctcttccctcccctcgccggccgtctcaaaaccgacaccgacggcttcgtttacatcacatgcaacgacgccggcgtcgacttcatccacgccaccgccgccgatatctccgtcgcagacctcctctccccgtcgtcttcgtctgatgtccctccaatctccaagcaactcttccccttccaccacaaaatcagttacactgctcattcttcccctatcatggccttccaggtcaccgatctcgccgacgccgtcttccttggctgcgccgtctgccactccgtcaccgacggcgcctccttctggaacttcttcaacaccttcgccggaatctcaagaggagccaccatctctccctccagcctccccgatttccgccgcgagtccatcctcagctccaacgtcgtgctccgcctgccagaagatatcaaggtgacctttaatgtggaggaaccttttcgcgagagaatcttcagcttcagccgcgaatcaattcagaaactgaaagctactgtgaacaaaagcttgacattgtttcctccgccagagaacggtgacgcggttgagttgatggcgaagatgagcagcgacacgcaactgagaacggttacagagatttcgtcgtttcagtcgctgtgcgcgctggtgtggcgctgcgtgacgaaggcgcgaaatctcgaggggtcgaaaacgacgacgtttcgaatggcagttaatgttcgccaacgcttggagcccaagttgggggacagttacttcgggaacgcgattcagagcattgccacgtgcgcagaagctggtgatgtggcgtctaaggagcttcgctggtgcgcggagcagctgaacaaaagcgtgaaggccttcgatggtgctacggtgcgccgtaacttggagaattgggagcgcgagcctaagtgcttcgagttgggaaaccacgacggcgccaccgtgcagatgggaagctcgccgaggtttccgatgtacgacaatgattttggatgggggcggcccttagccgtgcgcagcggcggagcgaacaagtttgacggcaagatgtcggcgtttcccgggaggaatggcggcggcgccatcgatttggaggtggttttggcgccggaaaccatggcgcgactcgagtctgattctgagttcatgttttacgtgtctggttggtag

SEQ ID NO: 934 - DNA, 1599 bp, Glycine Max
atgttcaaacagatattcagtaaactccctcggaagtcatcgaaaggttccgaacacggtggaagtgggagaacacatcatggtgttaccacttcttcgaagagcagtgattccgttagtgttacccctggtggcaccaaacccgggaattcttcctctgcgggacagaatcatggtaacagagttccgttaccgaatgttgtgaatgagaacaacattcacaacaaccccaacaatgggaattttggttcctatgaggcattgcctgcttttagggatgttccctcttctgagaagccaactttgttcatcaagaaacttaggatgtgttgtgtggtgtttgacttcactgaccccgccaagcacctcaaggagaaggagattaagcggcagacgttggtggagctcgtggattatgtgtctaacgcgaatgccaagttcgtggagaatatgatgcaggaggttgtgaaaatggtgtctgcaaatatattcaggacgctcagtcctcagccgcgcgagagtaagattgttgatggtgttgacatggacgaggaggagccttctatggatcctgcctggcctcatttgcagattgtgtatgagctttttctgaggtttgtggcgtctcccgagctggatgcgaagttggccaagagatacattgatcagtcattcattttgaggctgctggatttgttcgactctgaggatccgagggagcgcgagtacttgaagatgacgctgcaccgcatctatgggaaattcatggcacatcgccctttcatcaggaaggccatcaataatgtgttctttaattttatttttgagactgagaagcacaatgggattgctgagttcctggagattcttgggagcatcattaatggttttgcactgccattgaaggaagagcacaaactgtttcttgttcgtatactgattccgttgcacaagccaaagtgcttagcaatgtatcatcaacagttatcttattgcattacccaatttgtagagaaagactgcaagcttgctgatacaattattaggggattgttgaagtactggcctataacaaatagtccaaaggaggttatgttcctgggtgagttggaagaagtcttggaagcaactcaacccccagaatttcagcgttgtatggtgccattgtttcgtcgcattgcacgttgtttgaatagccctcattttcaggtggcagagagagccttgttcttgtggaacaatgatcacatcatgagcttgatcaaacaaaaccgaaaagtgatactgcccatcatattccctgcattggagagaaatgctagaagtcattggaaccaagctgtccatggtttgaccttgaatgtgcggaaggtttttaatgatgtcgatcccgacctatctaaagaatgtttacaaaagtttgaggaagatgagtcaaagaaaagtgaagtcatagcagggcgtgaagccacgtggaaacgcttggaggagcttgctgcaaagaaagctgcaagtggtgaagcagtgcttattgaagcacatttgggcacttccccttttaatgaatttccaatgaacatttcatttcaagaccagtag

SEQ ID NO: 935 - DNA, 336 bp, Glycine Max
atgttgaaaggagaagagatacttgagcaattcgaggcttctagttcttctgagcctgtggcttctttaactcaggaaacagaaagtgaaaaggagaatggaagggaaggtaagggaagtaagaatgatgagataatcaaagagctgaagaaggtgaagaggcagaactttgtgactcattgtcttctttcggtgatgattgtcctcaatgtggcttggcaactatcagaggtttctcttattttgaaagtcaaagatggactaagccactcttttagatccaagaacctgatgacaaagaacacccatctgaatctccatcccttccttccatga

SEQ ID NO: 936 - DNA, 210 bp, Glycine Max
atgttggactgtgggcctgtggttgtggctgtggtgctattcgtgttgttaatgcctggcttgctttttcaagtacctggacgctcaaggtgccttgagtttggcaactttcagaccagtggtgcttccattctagttcactccctcctctactttggcctcatttgtcttttcttgtttgccattaaggtccacttttacatcggctag

SEQ ID NO: 937 - DNA, 534 bp, Glycine Max
atgttgggagttatcggagctggaacgtggttgcgatattcaaaggcccttcttcaaccatggaaggtagggttctcctctttgtccgctgtcgacggccggaaacaccaccttctggatttgcaggagatcgagacggttctcaccgacgttaaagctgacaacgttaaggttataccagttcccaagcactgcgattgggctgatttcatggtactcgccactggcaggtccacctggcacgtcaagaacatcgcccaagccctaatttacaaggctaagcagaaacagagaggagttgaacgaatgatgctaccaagtgtggaaggtcaagcaggaggaaagtggatcgtcattgactctggtaaagtgatagttcatgcacttgatgaaaaggctagagcttactacaatttggagggtctttggaccccagggacaattcaaaatgaacgtgaagaggatttacaaaaagctttggtgaaggttcgtcggaaaaacaattcaaagaaacctgcacaaaagaatgcttaa

SEQ ID NO: 938 - DNA, 1576 bp, Glycine Max
atgttgtcacaggcaattccagaagctgcccagtttcagtctaaggaaatccagtttaaagacaaactggatatcatctttgatggagggaatcgaattgaggaagtgaaaaggtgggccagtgtcaagtggcagaatgatgcttcagctacatctcccttgtgtggaagagagcgagagaagaaacacaagaattttgatagggattgtgaatcagatagtaccattatggttgactattcaccaacaccaaaagcttcttggtcacctgcataccataaaatgtttgttgacttatgcattgaagaaacattgaaggggaacaagtctgcgacgcattttaccaaggagggctggaggaatattgttggatcctttaatgcaaagactggtatgagatacgacaaaaaacaaattaagaatcactatgattcaacccggaaactatggaaaatctgggctaagttgactggtgaggacaacatgaaatgggacccccaaaccaaaacgtttggtgcttctgaggaagactggcacaattgtctaaaggcattcccagaagctgtacaatttcggtttaaggaactccagttttctgacaaattaaacgtcatctttgatggagctatgccaactgaggaaatgataacaaggcttaagaggcagaatgatgcttcagctacattgcatggaagagagcatgagaagaaacgtaggaatgttggtcgggattgtggattaaagagtgccatcatggttaatgccattccaatccgcacaattccaagtgagcagagcatgtccagttcatcatataccaaggtcaaagccgcatggactcctacactgcacaaggtctttgttaatctatgtatgcaagagacattaaaggggaataagcctggcacacattttacaaaggaaggttggaagaacattatggaatcattttatgcaaaaactggtttgaattatggtagattacaacttaagaatcactgggattctaccaaggaacaatggagaacttggtgtaagcttattggcaccagttacatgaaatgggatccatctgaccagaagtttgaggctggtgaagaagattggaccaactatttacaggaaaatccagaagctgcacaatttcgctataaggaactacaattcactgacatattggaaaccatctttaatggaactactgttactggagagactgaacctgctgcgcaacaaaggaaaagtgagggtagtgttattactttccctttagacacaaaagaacctgatacagacaacttagacgagaaaactgaatgtcattgtgatgctgttgcatcaagaaatggtgtgagtattcagaagaatgctagtgcagtttcatccaccgaaggcaaacacaattatagtatcggtgaatgcattgaatgccttgatagaatggaagaaatagagcaaggaagtgatctctacatgtttgctttagatgtattccttaagcaggaatatagggaaatttttctgcagttgaaaacgcctaatctgaggatctcatggttgcagcggcttcagtctg

SEQ ID NO: 939 - DNA, 894 bp, Glycine Max
atgtttctacaaatatataaccaaaggatgctctgcaatcacccaagagcatatcccataggcactatgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgcttcttcagataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagggtgatgtaatcaaagaagggcaagtcatagggtatttggatcaatttggcactggacttcctattaagtctgatgtggctggagaagtgttgaaactacttgttgaggatggagagcctgttggttatggagaccctcttattgctgtgttgccatcttttcatgacatcaagtga

SEQ ID NO: 940 - DNA, 1050 bp, Glycine Max
atgtttggctccgctcaaccttcttcttctcccttcggcacccctgcattcggtaccccttcttctacccctgccttcggttcttccctcttttccacacccttctcttctcaacaaccacaaccacaacaacagcagcaacaacaaacacctctgtttcaacagcaacaacaacaacaaacttcttctgctttcggctttcagaattcactcgcattcgcagcaccgcaatcctcgcccttcccaaatgctcaattaaccactcagatggctaacgttgcacctgttcctttctccctcgccgatcgcgatgttcagactattgttgatgcatataaggatgatcctgggaaccccaagtacgcctttaagcatttgttgttcagtgtaacagaaccgcagtttagagtgaagcctgctggtgtatcagatatcatgtgggcagaggcaatagggaagcttcagggtatggaaagtcctgatagagaacgcctgtggccacagcttgttcagggttttaaggatctttcacaacgccttaagatacaagatgaagtcatcgtttctgatgcggagagattgcgtataacccaaagcaatgttaaaatgctccaaagacattttcaagctgatactcttccttggattcaaagactgaaacaaaaagaacaaattctccagcaacatcttttaagagtaatgagaatagtggaggcattggaggaaaaaggctgtcgtatacccttaacaaaaggggaagctgaacttgctgagaaattagccacaataactagaaagctgaaaggatctggagcggaactgtctagaagagtacaaaatctactaattgtatctcgtgttaaagctaatagcaatggatttggtagctccgtttatcttccagggtcaaccaaaattcatgaacagagtcttggtgatctacaagaggttttacagcagcagctggaggccattgcaagactaggcaatgttctgaagcgagatatacgggatatggagattatgatgaccgaggacacgaagaactga

SEQ ID NO: 941 - DNA, 414 bp, Glycine Max
attccaggagacggtagatgtttgtttagatctgtggtttatggtgcatgtctaagatcaggggaaccatctccaagtcttagcaggcaaaaagaactcgcagatgaactcagagccaaggttgtggatgaattcatcaagaggagggtagacactgagtggtttctagaaggtgactttgatacctatacagtacagatgcgaaagcctcacatatggggaggagaacctgaacttctcatgtcctcacatgtcttacagatgcctataacggtgctcatgcaggataagagttcgagtaaccttaaagttattgcagaatacggtcaggagtatgggaaggataaccctattcgagtgatctatcatggttatggccactacgatgcattattgaagagttccttccactag

SEQ ID NO: 942 - DNA, 468 bp, Glycine Max
attcttcttgacgccacttggacagcaagagtatctgattttggattgtcatttatgaagaagacagcaggaaccgttggatacattgatcctgagtacttagctggacatgtggtgacagcaaagagtgatgtgtatgggtttggagttgtacttcttgaacttttaactggtaagacagctatattcaagtctggggacgatggaggcagtgtggtggactttgcagtgcctcatattttgtctggagaatgggtgaaaattttggatccaaggattggacctcctgacgagaatgaagcagatgcagtcgagttagtgacctacacagctctccattgtgtgaatttggaagggaaagatagaccaaccattgatgaagtagtggtcaatttggagagcgctttggctagttgttgtcatagcgggggatcatctacattaccctgtagtattgcagattgttga

SEQ ID NO: 943 - DNA, 1206 bp, Glycine Max
cagatacaaatgttgttgaatagtaaattttgcttatcgtatttgtgctttggatgtttagtgtgttctaaactttgtagtttctatggacagaaagcacctgaagtggaccaaccatcaaattcctttctgcttctcttgaatggaattggagtattttcttccggtgtgttgggtgctctctataaacttgctcagaaagaaaagtccactgttgttgcaacaatagaaacagtaagcttatatgcactcttaggagtaaatgttttaagagaaaaagaagaggagcttcatcagctaaaggatcagtttgaacttgccctaggtgaagcaagcaaaagccagatcgtcattgctgatttatcccaagaaagagatgatttgaaggaggctctagataatgaatctagcaaggtgaatcatttgaagcatgaactccaagttacccaggagaatcttgcaaaatcaagaaatgagtctgctgaattggaaaaccttctaactttgtcaaataaactgtgcaaagagctcgagctcgaggtctctaagctctcgtctgagctcactgaggttaatgaatcgctacagagaaaccttgatgatcttacaactgccaaggaacacttgagggaagcacaagcagagctgcaagatttacgagcattagagcagcaagtctcaaaagacaaggagtcccgaaaatctcttgagggggacctggaggaggcgaccaaatcattagatgaaatgaaccgaaatgcggtgatcctttctggggaactacagagagctaattctcttgtttctagccttgaaaaagagaaagatgtgcttattaagttcctaaacgaccaaagaaatgcatgcaaagaggcccaagacaacattgaagatgctcataaccttatcatgaaacttggcaaagaaagagagaatttagagaaaaaaggtaagaaatttgaggaggaattggcttctgccaagggtgagatattgtgcttgaagagtcgaatcaattcttcaaaagttgctgttaacaatgaccaagtgcagaaagatggagtgcagaaagatggaggtgaaaaaaaggtcaattcttcaaaagttgcggttaacagtgagcaagcacagaaagatgaaggtgaaaacaaggttactgtaagcgcacggaagactgtcagaagaagaaaggctaatccacaataa

SEQ ID NO: 944 - DNA, 311 bp, Glycine Max
cataattcaattgtggctccaatcaagggcgtagtggtgaaggagccaaagtggatggtggcagcgatgacagcgacattggagaagcataacgcgaatctaagcgtgaatttaagcagcgagggtagtttggaggatgatgattcaatggagagggaggatcgtgttcatgttgtggtgtttgaggaacatagttgggttttcgtggggatctatgatggttttagtggaactgatgcacttaattaccttctctccaatctctacatcccaatgcataaggagcttaaagggttgctatgggatgacag

SEQ ID NO: 945 - DNA, 199 bp, Glycine Max
ccccgaagctcaccacaacaccgggccccacacactgctccgccaaattcccaatctccctcacgcgcctccccaccacctccgcatccccacccgccacctcctccgcaatgcaaaccacgcgcagccccagcaactccaccggcaaagccccttctctccgtttctccaccgcctcggcaaagccacgcagagcgtc

SEQ ID NO: 946 - DNA, 1581 bp, Glycine Max
ccttatctctactttacatggaatgttacttacggcaccatctctccattgggtataccccaacaaggcattttcatcaatggccaatttccaggacccaatatcaattccaccagcaacaacaatctagttatcaatgtcttcaataatcttgatgagccattccttttcacttggaatggcatccaacacagaaagaattcatggcaagatggggttgcaggaactaactgccccattcctccagggacaaacttcacgtatcgtatccaggtgaaggaccaaataggcagttacttctactacccaagcacagccatgcatagggcagctggtggttttggtggccttcgtgtaaacagtcgcttgcttattcctgtgccttacccagatcctgaggatgaatacaccgttctcattggtgactggtacacaaagagtcacaccattctgaggaagttattggatagcgggcgctctcttggtaggcctgaaggtgtccttatcaatggcaaaacagctaaaggtgatggaaaagacgaaccactcttcaccatgaagcctgcaaagacctacaaatatagaatatgcaacgttggccttaagaactccctaaactataggatccaaggccattccatgaagcttgtcgagatggaaggctcccacgtggtgcaaaacatgtacgactctcttgatgtgcatgtaggggaatgtttttctgtgcttgttacagcggacaaggaaccaaaggattactacatggtggcttccacacgtttcaccaagactgttctaataggtaaaggtatcattcgttacacaaatggtaagggtcctgcctcacccgacatccccccggctccagtgggttgggcttggtctcttaaccaattccataccttccgttggaatctcaccgctagtgccgccaggcccaaccctcagggttcctacaaatatggtcaaatcaacattactcgtactatcaagctcgttaactcagttagtaagtctaacggtaagcttcgttatgcccttaatggtgtctcacatgtcgatcccgaaactccactcaagctagctgaatactttggaatttcggacaaggttttcaaatatgatactatcccagacaacccatcacctaacattggaaacgctgtaaccgtacaaccaaatgttcttaacattacccatcgcaacttcatcgaaatcatctttgagaaccctgaaaaaacaatccaatcatatcacttggatggttattcgttcttcgtactcggcatagagccaggcacttggaccccagagaagaggaagtcctacaaccttctagatgccgtgagcagacacacagttcatgtgttcccaaaatgttgggccgccatcatgttgacattcgacaatgctgggatgtggaacctaagatcggatattgctgaaagtcgctatcttggccagcagttatacattagtgttttgtcccctgagcattctcttagagacgagtacaatatgccagacagtaacttgctttgtggtcttgtaaagaatttgccaaaaccagcaccatactcc

SEQ ID NO: 947 - DNA, 360 bp, Glycine Max
ctaagcttagctttcacatcgcaagagtaccatgaagctcttgaaaaatccattatcttctttgagggacaacgatctggaaaattgccttccaaccagcaacaaacatggaggggagattctggattgtccaatggctcttcctatcatgtggacctagtatgtggttattatgatgctggagacaacggcaagtttgagttgccaatggcttttaccattacattgttagcatggagtgtgattgaatttggaagctcaatgcaggaccaaattgaaaatgccagagctgctattcggtggagcacggattaccttcttaaggcagccaccaccacctctgacgcattatatgtccaa

SEQ ID NO: 948 - DNA, 531 bp, Glycine Max
ctaatagccaaggaaactaccacccccaactcttcttcaaggatcttctactacggagaaacttcggttgcggttcctttcacatgggaggcacaacctggtaccccgaaacaccctttgtcagagacatctttgccacctcttacacccccaccttcctacttttcaagccccaaaaagtcccacaacaccaagagaagaaactactactcaaataaggccagcaacatattttcaagcatttttctgaggcttgtaggatcaagaaagtctcttcataatcatcatcatgtgtcaccatcgtcatcttggtcgtcaccttcttcatcgtcttcatcttcttcttcgtggtctttggcgcattataataataataataataactcatcgccctcgttttccatgagagacaaaggtcgaggtcaaggaggaagaagcagcaaacacaacaaatgttctaatggatttagaggctgctatccctttggcaacatgaggaacgcaaatgtaagccatggtagtgtggactaa

SEQ ID NO: 949 - DNA, 369 bp, Glycine Max
ctctgtgacgccgcggggttccatggcgccaccgcctcggctctcgacgccttcgccgacatcgccatccgctacctcctcgacctgggccgaaccgctgagtcccacgccaaccacactggccgcacgcagtgcaccgtctttgatgcaattcatggcatggaagactttgaatcgccacgagccttcatcggcgccagcggcatcagagagatcataaacttcgtcgaatctgctgccgacgaaatttcatttgcccaaccgatttctaatttttcgattgttcaggaacgacgccacatcatcccgagttttgatcagatgggtgaggctccactggcgaagcatatacccgcgtggctaccggcg

SEQ ID NO: 950 - DNA, 2565 bp, Glycine Max
ctgcttaagggggtttgtttcactgttgaaaacaaagcagcttcagcaagtgatggaagatcaatacatgtgtcaaatcccaatgatatatggaaaagtgaaaacatcctgtttttctaccttcctaactttgcagcccaagttgcttttatgttgttgtccactcgtcttttgtactacatcctcagacccttgaaccaacctcgtcttgtatctgagattttgattggtattctgataagtcctgaactatttggaatatctgctttatctgaggttctgacccctataaagtcaatcctaactactgaaaccatatcatatgtgggactcgtttactctgtgttcctggctggcttggacatgaactttgacacaatcctaggagcaagaaagaaggccacaagcattgcaattgctggcattgtcatcccaatggtattgggtgctggcatatatgctttgactctaagcatgtacaagggacctgctgagtattgggcaaatttcaacaccactaatgcttatatgttttgggccttaattttaagtgtcacaggttttcctatggttagtcacatccttgctgatctcaagctcctctacacaggacttggcaaagtggcgttaacaacagctatggtcagtgacttctataattgggtcatgtttgcaatgttgattccattcgccatcaacggggcaagcgccatctactcggtgcttggaaccataggttttgcgcttttatgcttctttgttgtgcggccttatttggtacagataatagtgagcaaaaccaataaaaatgagtgggacaattatgggttgttctttgtgatcatgggatcttatgctagtgcacttgttactgatctcctagggacacaccctgtggttggggctctggtgtatggaataatgatacctcgtggtaaatttactcagatgctcatagagaagtcagaggattttgcagctgtttatctggctccattgttctttggtagcattggaataagactcagaatagtatatgttgtaaacactcaaggtttgggcctggtgcttttgattttgttcctctctttcatcccaaagattttaagcactgttatagcgactcaattttatggcatgtctgttcttgatggtgtctcaattggactgcttatgaacaccaagggcatcttaccagtattaatgctcgtcaacgcctgggacaagcagattttgagtgtggagtccttctcaattttgacagtagctgttgttatgatgacaatgatggtgcctctaatcatcaatgccatatacaagcctaggaagttatacaagcaaagtaaactaaagaccatacagaacttaaagggcgacatagagctgagaatactagcttgtgttcacaaccctcggcaagccacaggaatggtcaacattctcgatgcatgccacaccacaaaactctcccctctgcgcgtttttgcgcttcagcttattgaactaactggaaacaccatttcccttttggcttctcatctcaatcagcacaaccaacagcagagtggtagagcacaagccctcacaaaagcacaagaagacttggagagcatcaccaacattttccaagcatacacaggcacaaatgagaacaccagtgtggagacatttgctgcagcatcaacttactcaaccattcatgaggacatatacaacgtgtcgcaggagaagcaagcgaacttgattctccttcctttccacaaacagtcaaacatagagggcattctggagacaacaaacactgcattccaagacataaaccgaaatgtgatgagggatgcaccgtgttcagttggaatctttgtcgaccgtggactaggatcattgttcaaggtgaacttgcgcatgctcatgcttttcattggtggcccagatgaccgcgaggccttggcggtcgcgtggaggatgtcaaagcatcaaggggtgcaactatcagtgatgaggatccttatgtatggtgaggctgcagaagttgatgttttgtcgtcccatcttgagtctcgcggactgttagccatggtgctagacagtgaaaggcaaaaggaattggatgaagagtatgtgagtgcatttaggctcaaggcagtgagcaatgaagattctattaagtattcagagaaagaagctcgttgtcgtgatgatattcctcgagtgcttaaagagattgaagaaattgggtatgatttgtatattctaggacaagggacaggtaggaactcattgatcttgtcagagttgatgcaatgggctgattgccctgaacttggtgttataggggacatagtggcatcaaacagttttggttcaagctcttcagtgcttgttgtacagcaatatggttttgggggaatgcaacctagggaagtagtgcctgcagatgatgatgatgattctggggcacttgctatcaaggtagaacagcatcatcaatatggcttagaccaaagaagagagaaactggttgtaatttttgccactgaggttgggaattgtttgattgagtag

SEQ ID NO: 951 - DNA, 159 bp, Glycine Max
ctgggattaagcatgttgaccatgtctcaattcatcccaagtctaaaaccatgcaacaataatgagatatgtcatcgaccaaggaaagtccatgaagtggtttcttccttgctatctacagtatcgccttgggaactggaggattcaaaccgtgcttag

SEQ ID NO: 952 - DNA, 1149 bp, Glycine Max
gaaaagcacagagaaaaaaagcataaaaaagggaagagggacaaagagaagaaggaaaagagagacaaagaaggaagggatggaaagcgtaaggaaaagaaggacaaaaaagaaaaacatagagaaaaaaagaaagacaaggacaagaacagagataaagaaaagagcaaaaccggtgctgcaattgagaaagaatttccaggacaagctcagggtcccaatgctggtaaactacatcaaaaggaaatcaaaccaattgataagattgttttacttgaggataaacttaccaaacagtttgccagtaacaatggagagaaggctagagagaataatcatttttttgaggaaaacaaggattctaaattcctcctggatttggaaaggaggattagggataatgacggaggagctgagaatcaattggctcaaaagtttgcaactgcaggacacagaaagaatgagggagctgttagattggttactaagggtagtggcacctggcctgatggtaaggaaaggcttcaggataagggcattgatactagaatggttgataggagagaaatctgggctgagtcccgaccagttggaaatataacagttcagaataatgctggaaaatttcatcacagggttgatgaaatgcccaaatctttggaaaataatttttacaaacctttggaagcagcagttgaaggaaaagagagggttaaggaaaaaaaagatgataaacacagagataaaaagaaaaataaagagaaggggaaaaaaggacatgggaaggacaaagacaggagtaaagaaaagaaaaaggaggagaaagcaaaggagaatgctgaacatgaaaacagagagcagcagaataaattaaaagaaagcaccaaagctggtccattaggctcaaattctttcacacaggtttccaggcacatctatgagaattctgctgttggggaaaatctcaagaaacggaaggacattgaatcaaatggaattatgcatgcaaatgacaattggcccagtaagttgccaacgccctccccctctccctcccatctcactgaaaatgggaggatattggaaccctgccaaatttcccttcagaatacatctgataataggctagcagcagcctctaatatcaag

SEQ ID NO: 953 - DNA, 372 bp, Glycine Max
gaattgaaaatgagtcatggtagaatacaggagcatcaattcaagattggtattctttatgtggtcaggactcaggagaataaaaaagaaaggctcaccgtcaactataatttaatttgttataatatcttcaatattaattatgcccgaatggaaaaagaggcctacgggaaaaccattacctttgggcacaagtcaaagctttctattcaggagcagaggcaaaatttgccaatttacaagttaaagaaggaactgattcaggctgttcatgataatcgggtgttggtagtgattggagaaaccgaggaagttggttattccattcagtttgacccaaattcgtggcgtttgagtaaacgccgagcatga

SEQ ID NO: 954 - DNA, 399 bp, Glycine Max
gaatttgttgttggcgatgatcatggatggacaataggctttgattacgcagcttgggctgcagataagaccttccaggttggggacctacttgtgttcaagtatgctgttggaaaacacaacgtgttcaaagtgaatggaacagcatttcagagctgcacgattcctccagcaagtgaggcattgaccactggaagtgatcgtattgtgttggcaattcctggcagaaaatggtacatatgtggtgttgttggtcactgcaatgctggccaaaagcttgttatcacagttcaaccccaaacactgcctccaactcctgcccctgcaccttcaccttttcaacatcgccctcattttggtcgatggattcctaagaagctatttacaatattccattaa

SEQ ID NO: 955 - DNA, 321 bp, Glycine Max
gagctgaaaagatccgattcaaagaaattttccttgatccaggaactacatactaaagaaaaagaattagagaacatgaagcttgatatgatgggcttggaacagagtcttttcgaggccaagaaaatccagggtgaaactatagatgaaaataatagaatgagtacatcaattgaggagctccaggtagcattgcaggatgcccaaaaaaacatcatcactctcgaaacagaaattagggagcttgaagagaagcttgatactgccaacaaaaactctagaatttcttctcaaaaggatgaatactggctggaaaacaag

SEQ ID NO: 956 - DNA, 145 bp, Glycine Max
gagttcacggagaagaagtgcagagtggtggccaccagcaggttgcggtcgagcatggtagagctggaacacgacacacaagaattcgatgttcagtccgatgagagcatgagtaacgtggttgatgctgttgttgacaagtatg

SEQ ID NO: 957 - DNA, 1764 bp, Glycine Max
gatgcatctgtggattataaaggaagacttcctttccgtgcttccacgggcgtatggaaagcttctctttttgttcttatatttgaatttagtgaaaggataagctactttgcgatgttctctaatcttatcacgtacctgactaaagtgatccatcaagacctcagtacagctgccaagagtgtaaactactgggcaggaacaacaaccttgatgcctctggttgggggatttgttgctgatgcctacactggtggatttaacatgatcatattttcttccctcgtatacttaatgggattaagcctcttgattctgtcacaattcatcccaagtctaaagccaaacaacaataatcagcctagggtggctcatgaagtggctttcttccttgccatttactgcatctccttgggcactgggggacacaaaccatgcttgcaaagctttggagctgatcaattcgacgaggatcaccgggaagaaaggaagaagaagatgtccttcttcaacttgtggagcttcactgtgtgctttgctatgttgcttggtgcaacagtggttgtttatgttcaagactttgtcagttggggagttgctagtctcatcataactattctcatggctctcactaccatagctttctatgcagggaggcctttttataggtacaagcagccagcaggaaacccttttaggccaattttacaggttttagttgcagcaattaggaaaaggaatttgtcttgtccttcaaatccagctcttttgtatgaaatcccagagttagagaagtcgcaaggaagacttctgagccacactagcggactcaggtttctagacaaggctgcaataattgaagagaaatatgttgagcagagagataatgcatggagattagcaacagtgacaagagtggaggagacaaaacttgttctaaatgtagttcccatatggctaacttcattaacaactggagtatgctgggcacaagcctcaacactttttgtcaagcaagcaactaccatgaatttaaagatgaccgaaagtttcacactgccacctgcttcccttgtttctgttgcggcaattggtgtcttaatatctctcccaatatacgatagggtcattgttccaattctaaggaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgattggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaagcagttacacttacaagactgtacagaggacaactatggatactgatgttcttgaaagtaagagttataaagagggtgacagccaaatgtgggatattggtagagatgaatgggatccacttgaagggggtgaaattcttgaagttgttactctttctcttgatggataa

SEQ ID NO: 958 - DNA, 1194 bp, Glycine Max
gattgggacagattcaatggaaacaacagtgtttgtttcttctgtaaaatcctttcttgtctggtgcctttcaaagagtgcgtggaaaagctactaagtgatgtgtccgaggaagctgttgtttcgtgcttcatctcagatgctttgtgttacttcactcaagcggttgccgacaaccttcagctgcccaggattgtgttgagaactggtggagtttcttcctttgttgctttcgccgcttttccaatacttagacaaaaaggttacctacccatacaagaatgcaaattggaggagccagtggaagagctaccaccactcagagtgaaagacttacctatgattaagacagaggagccagaaaaatactatgaactattgcacatattcgtcaaagagagcaaaagctccttgggagtgatttggaactcctttgaagagttggaatcatctgcactcacaacactgagccaagaattttccataccaatgtttccaataggaccatttcacaagtactttccttcttcctcctctttttgtagcagcttaatatcacaagaccgaagttgcatctcatggttagatagtcacacacccaactcggtgatgtatgtgagttttggaagtgttgctgcaataactgagactaacttcttagagatagcttggggtttagtcaatagtaggcacccatttttgtgggtggttcgacccgggctcatcgagggctcgaaatggctcgaaccattgccaagtgggttcatggagaatttggaaggtagaggcctaatagtgaaatgggcacctcaacaagaagtgttggctcattcatcaataggtgcattttggactcataatggttggaattcaaccttggagggtatttgtgaaggggttcctatgcgatgcatgccttgtttcactgaccaaaaagtgaatgctaggtatgtgagtcacgtttggagggttggattgcagctagagaagggagtggacagaaaggaaatagagaagacaattagaagattgatggatgacaattttgaagggaaggagattagagatagagccttgaagttgaaggaagaggcaaaggtttgcttgaaacaaaatggttcctcttgctcttctttggaagttttggttgcttacattttgtcgttggagtcatttgcttttgaagcctcctaa

SEQ ID NO: 959 - DNA, 1833 bp, Glycine Max
gcatataaaaatgcacatatatgcttttgtcctatctattacttttgttctctcttaggcctatcaatacacccaaattcatctgttgcgtcatcgcactacttattgcgtgtttctcacatatgtctgaaaatggacatggtgacaacattaaaatcagccaaacgttgttggcgattcggtgtgtttaccttcttggcttctttcttggtcacagcaaccttgttttctttgtattctcccaacggtgatgctaaacaaagtcaaatttttgctgttttatccgaaaccttgatggaacgcaacctcgtggccacggaattgggccaaattgctctatcttcagccatgattagagaaatattgcaatggattacgatggaactccaattcaacacaaaattcagcttgcaatttacaatcgtatttttgacaggtgcaactggattcgctgtgttattacttcttattatacgaccactagtgaatattgttgtggagagaacaccaccggggaagccaattaaagaatcatacattctattagtgacacatttggcatatatttcatcatgggaactttcctctatggtttgttttttatgcctttcttcttctcgtccattagcacaaattaagatagatttgactgcaattcatgagcattggaaggtggttttagtagttctgtctatcttgtttgtggggtgtttgttgaaggtacttgcatgtgcgctcatttctcccacatataatattaagcccaaacatggcgttgtgcttgggctcatattgaaggtcaagggtatagtcgaactcatcttttatagtagaatgaataaactcaaggttattgatacagaagtatttagtgtaacagtgatgtatgtggtggtcttgacatcactgtgcatacccttgatcaaatgcttgtacaggcatcgtcgagcagcgttaaaacaatccaaaacatcaccgaaaacacagttcaacatggtttcatgtgtacacacagatgaagacgtgcacaacatgattgccctaatagaagcatgcaaccctaccacacaaagccccttatatgtctacgtggtacatctcattgagctcgttgcaaaaagcactcccattcttcttcccatgaacaagaacaatagaaaatctttgtccgtggactaccccaacaccaaccatattttacgtgccttcgagaactactccaacaactcaagtggtcccctaaccgttcattcatacgttaacgtggctccctacagaagcatgcacggaaaccacgtggccaacaccattcgcaaccttaacacaaagggtacgtcggggatactagtggatagatactcagtgctaagttggagtagctccaagttgtcttttgatgttggtatcttcttcattggtggaaaagacgatagagaagcattggcattggggattcaaatgttggaacgccccaacactcgtgtcactttgttccggtttgttttgcccacaaagcaagattcaaagtttgttatatacggacttaaagaaaatgaagaggaggtgttagagagcacgctggatgagagtttaatagatgagtttatttccaagaatgatattagtagtgatattattaatgttgtttaccatgaggttgtggtggaagattgcattcaagtgttggaagcaattcgtggaatggagaaagactatgcggatcagctgggaattttgggggatatgttggcatccaatgagttttgtaatgggaaagttcccgtattggtgatgcaatgcggtgatgagaagcgggtaaaacaattagaaaag

SEQ ID NO: 960 - DNA, 669 bp, Glycine Max
gcatcaacacttcctcgatattatgatgggaactattttcagatgaaattatcttacagcccctttgctcctatttttttgtacttgatcgaatggttggattttagttgtacagacactttgcccattctactttgcccgtggaaatctgtcatatacccttcattaaggttacttcaaggcgagtttaataatgataaaagaaacagttgtgcagaactgagcagaaagaggcttgaaaaggttctcagtaaagatctagagggagatgaggaatgtggcatatgcatggaaaacggcatgaagatggttctgcctaattgtggacattctttgtgcattagctgcttccatgattggtatatgagatcagaatcatgcccattttgccgtggaaacctgaggaggatcaatcctagagatttatgggtggttattggcagcagtgatgtggttgacaggattaccattgcaaaggagaatttaagatgtctctacctttacattgaaactctgcctccaatcatatcggatgcacataatacaattatacaaacatgcttttcctgtgtgatggtacaaagcacaaactatgaaaggcatcatagatattttgaattttttacacttatgaagtctaaagttctcgttgaatggcttggaaattga

SEQ ID NO: 961 - DNA, 1309 bp, Glycine Max
gccattgttgatggcggcggagttccaacaactctggatggacccttcaagcctgtgaccgttcctcttgatcagagcttccgagcggttgacctgccagatacagatcctctggttcaaagaaccgttcaagggttccagccagaacaaatctctctttcactctctgtttctcatgattctgtttggatttcttggattacaggggaattccaaattggggacaatatagaacccttagatcctgaaactgttgctagcatagttcaatatggaaggttaggaaggtccatgagacacaatgctacgggctattccatagtttacagtcaactttatccttttgaaggccttcagaactacacctctggaattatacatcatgttcgtcttacaggattgagacccaacacactatatcaatatcaatgtggcgatccttcgttgtcagcaatgagtgacgttcattatttccggactatgccagtttcaggccccaagagctaccctagcagaatagcagtggttggagacttgggtcttacatacaataccacatccacagttgatcatatgaccagtaaccatcctgatcttattctgttggttggagatgttagttatgccaacctctatcttactaatggcactggggcagactgctcctcttgctcattttctaacactcccatccatgaaacctatcagcctcgttgggattattggggaaggtacatgcagcctctgatttctagtgtcccggtaatggtaatagaagggaatcatgagattgaagaacaagctgaaaaccagacatttgttgcttatagttctcaatttgcattcccatcagaagagagtggatcatcatccactttctattattctttcaatgcaggagggatacattttataatgctcggggcctacatatcctatgacaaatcaggggaccagtacaggtggttggagagagacttggcttctgttgacagggaagtgactccgtggttgatagctacatggcatgcaccttggtatagcacctacggggctcattatagagaagcagagtgtatgagggtagagatggaagacttactatataaatatggcattgacattgtcttcaatggacatgttcatgcatatgagagatcaaacagggtatacaactacacattgaatccttgtggtcctgtttatatcacggttggagatggtggtaacagggaaaagatggcaatcacacatgctgatgaacctggacagtgtccagaaccatcaactacaccagatgactatatgg

SEQ ID NO: 962 - DNA, 114 bp, Glycine Max
gcgagaaacacgaagagaggttcatgggtactagtacgaggagtacgttttcaggttcagctctttgtgttactcttaccggcaatcaatgctaatgaaatgctgagatactag

SEQ ID NO: 963 - DNA, 1995 bp, Glycine Max
gctgagcccaagttagtacagcaccacttcaagcgtagtttcagtggctttgttgctatgctaacagaggaggaagccaatagaatggctagacatgatagagttgtagcagtctttcctaataaaaagaagcaactccatacaacaaggtcatgggattttattggctttccactacaagcaaatagagcaccagctgaaagtgatgtcatcattgcagtatttgactctggaatctggccagaatctgagagcttcaatgacaaaggtttcggtccaccacctagtaaatggaaaggcacctgccaaacttctaaaaatttcacatgcaataagtatgtagttagttgtaaacttgtagtctacaaggatgatccaaaatctgtgagggatatagatggtcatggcactcatgtagcatcaacagcggctgggaatccagttagcacagctagcatgttaggccttggtcagggaacatcaagaggtggcgtgacaaaagcacgcattgctgtgtacaaagtgtgttggtttgatggttgtactgatgcagacatacttgctgcatttgatgatgcaattgcagatggggttgacataataacagtttctcttggagggttcagtgatgaaaactactttagagatggaatagccattggagcatttcatgctgtgagaaatggagtattgacagtaacttcagctggaaacagtggtccaagaccttcctccctgtccaacttttcaccttggtcaattagtgtggctgctagtaccatagacaggaagtttgttaccaaggttgaattaggtaacaaaatcacctatgagggtacctcaataaatacatttgatctcaagggagaattgtatcctataatttatggtggagatgcaccaaacaaaggcgaaggcatagatggatcatcatcaagtgctaatagtgcttgcaggtattgctccagcggttcgttggacaaaaaattagttaagggtaaaattgttctctgtgagagcagaagcaaagcactaggccctttcgatgctggtgctgttggggcattgatacaaggacaaggttttagagatcttcctccctctcttccattgcctggatcttaccttgccttgcaggatggtgcctctgtatatgactacataaactctacaaggactccaattgcaaccatatttaagactgatgagacaaaagatacaatagctcctgttgtggcttctttctcttcaaggggtccaaacattgttacacctgaaattctcaagccggatttagtggctcccggagtttccattctagctagttggtctccagcttcccctccttctgacattgaaggtgacaacagaacattgaatttcaatattatctcaggaacttcaatggcttgtccacatgtttctggggccgcagcgtatgttaaatcatttcatccaacatggtctcctgctgctattcgttcagctctaatgacaacagaatttgcatacggcgcaggccaaattgatccttccaaggctgtgtaccctggtttagtatatgatgctggtgaaatagactatgtaagatttttatgtggacaagggtatagtacaaggactttacaactcatcacaggagataacagtagctgccctgaaacaaagaatggttcagcaagggatctaaactatgcttcatttgcactctttgtcccaccctacaactccaatagtgtaagtggcagttttaacaggactgttacaaatgttgggtcaccaaagtcaacatataaagctactgtgacttctcccaagggactgaaaattgaggtgaaccccagtgttctaccattcacttctcttaaccaaaagcaaacatttgtgctcacaattacgggaaaactagaaggacctatagtttcaggctctttggtttgggatgatggtaagtaccaagtgaggagccccattgttgtgttcaatacagcataa

SEQ ID NO: 964 - DNA, 342 bp, Glycine Max
gctgatagtattgataaatctgatcaactattcaatcctatatttggagttctaacacctgaatttttgaactcattgaaaacatatggaatacctaatcacaagttaaaaatcaaggttgacactcccataatactattacgaaatttggaccaggcagatgggttatgtaatggaactaggcttattgtcacaagacttggtgtacatgtggttgaagcagagattattactagccccaatataggacataggacatacataccaagaatgaatatgtgtccttctgattctccatggctattcaaattaattagaagacaattttcattcatggtttaa

SEQ ID NO: 965 - DNA, 889 bp, Glycine Max
gctgttcctgcacgattattcacctgggctgagcttgtagcagccaccaacaatttctcaattcacaaccagattggtgctggctgtttcagtgttgtgtacagaggtaaacttgtcgatggtcgagaggttgcaatcaagacgggtggaacctggccaaagagagagagcaaattgaccttgttatccggtttacaccacaagaacttgattgggctggttggattctgtgaaacgaattatgaaagactcagtgtgtatgagtacatgaagaatgggtccttgtatgatcgtttgcatgacaagggtagcagtgtcttgaattcgtggaaaatgaggatcaaaattgctttggatgcctctcgaggaatagaatatcttcataattatgcagattcctttattattcacggagatatcaagtcttccaacattcttcttgatgccacctggacggcaagagtatctgattttggatggaagtttatgagaaacagacgacgaataattgagaacactgatcctgagtacgttattcgaggtgcattgtcagcagagagtgatgtgcatgggcttggagttgtactgtttgaacttctaacaggaaagagacctacattcgtgtacggggaagatggaggcaccctattaagtagaaagcatttggtagactttgctgtgactgctatttcaaatggatttttggagaaaattttggatcaaagggctggacaacccgatgtgaatgaagcagaagcagtaaagttagtggctgataccgctatccgttgtgtgaatttgaaactgaaagatagaccaaccatggctgacattgtagtcagattagagcgggctttggctatttgtgaatatgatagcattttcaggg

SEQ ID NO: 966 - DNA, 105 bp, Glycine Max
ggagaacggtggccagagtctccgcgattccggtcgataaacggagaagaagctctcggagcggggaaggtggtgacggtggtttcatcgattggcactgattag

SEQ ID NO: 967 - DNA, 5154 bp, Glycine Max
ggagagcgtgctgatctcagaggtcctgaagatggaaaatctacagaggatgctgccagagatgacatgtttgttgattgccctgatgagttaagcacatttgatggtaggcaaagggaggaagacgctgcagctgtggaaaatgaagatgaccggtcggaggaaaatgaagttatgcaacaacagcagagtcattttgataaattgggcaatggagtgggagatgcttactcctcaggccagctggagaaagttgttgccgagaaggaatgtattttgaaggaatatcagctagcacggattgagtttgttatcaagtgctcatgctttgttttttgggtgggtgtgcttgatcttcgatgtcagctgaagactctcactggtcaacataatgaagctcaagttgaagatagggaagcgactgatgttccgttgagggagatgataaaggaatgtttggagtctgtgaagactgcctcagaagaatggtcaaacagtgaaactactataaataatcttcgcgaacatctatctacgaaggaccgtgagatagaagatcttaatgcaaagcttgcccaattaatggtatctaatgaaagtttgcaagtttcatccaaagctcaacttgaaaaggatcgtattgttgagattgtgatagataagacgatatcctctcttgcaacagttgttactcgagagcaagtattggatgattctattagtgggaaaatagtttatattgaggaaggcactatgcatgtagttgaaaagtataatcagatgctttctgaaatttatcaacttgggcaatctttctctgaggtaggcttggagactaacgaccaggaatacgggaacatactcgctgatgctcgtggtgggttactggagctcaaaagaaaggaaacagaattggttgaaaaactggctcatttagaagatgaaaatcagaaactagttgatgagcttgacaaggaaaaggtgatgatagggacattaaatactgaacttggaaaactgaaaatagaactcgagcaggaaaaggctaaatgtgctaatacgaaagaaaagctcagtatggctgtgacaaaaggaaaggcattggtacagcagcgagattcattaaagaagtctctggctgataaatccggtgagcttgagaaatgtttgattgaattgcaagagaagtcagttgcactacaagctgctgaacttgctaaggaggagttatcccaaagtaaaaatatggttgcatccctagagaactcattactagaaaagaatgcaatttttgatcaagtggaagaaatcttgtctcgggccaaacttaatgaacctgaaatgtttgatatgccagagaaactaagatggcttgtggatgacagaaacactctgaaggaagccttcctagagctatgcaaattgaaggaagctatatctctagtggacctaccggagcctgtttcatcatctgatttggaatcacaaatgaattggcttgcagattctttgcttagtgcccggggcaacatgcatactctacaggaagaaatttccacaatcaaggaagcatcccgtgactatgttgatcagcttagtgtttctcttttgctggcattgcaggaaaaagattaccttctgtcagaattaactgacttgaggttcaaatatgatgagcttgttaacaagaaccatcagatttctttggagaaggatcagatagtgaatatgttagtcgatctttgtggcctgaacttggaagatgaagggattgatcaaatctcttccagcacctctatgatcattgatttatgctttaaagttatcaaaggacagggtggtcccttgtctagagcatcccatattgatgctgagttgtttgaaaggattcaaagtctcttgtatgttagagatcagggattaatactctatgaagatatactggaagaggagatgctaattagatcagatgagaataagctgtcaaatgagttgaaagtggcatctgaggaaattatagcactgaaagaggaaaggagttctctgctgcaagatcttgaacgatcagaggagaagactgccatgcttagggacaagttgtccatggcagttaagaaaggaaaggggctgtttcaagatagggacaatctaaaaggtcttgtaaatgaaaagaaatcagagattgagcagttgaaggctgatttgcagaagcaagaatctgcagtttctgaatacagggatgagatcaatagattgtccagtgatgtggaaagcatcccgaagctggaggctgattttctggaaatgaaaagggagaagaatcagtttgaacagttcttaatggagagcaataacatgttacagaaagtgatggagtgtattgatggtgttgctcttccagttgctccagtttttgatgaaccaatagagaaggtgaagtggcttgctggttatgtcaatgaatgccaagatgctaaggtacacatagaacaagagttgcagctagtgaaggagagtgccagtatacttgaaattcaattagcagaagcccaagcaactgtaaaatcccttgagcgggaattatcttcttcagatgacaatgtttctcaacttgctgaagaaaaaacagagttagaacatggcaaagagaaagttgaggaagagttacagaaagttaaagaaaaagtcgctgaagtttgtaatacgactaagtcacttgaagatgccttatcacaagcagaaaaagatatttctattctttccgaagagaaagagcaagctcaagttagcagagttgctgcagagagagagttagagatttttaaagatgaagcagctatgcaaacaagcaaactggcagaggccagcaagaccataaaggatctagaagataaactatctcaggttgagggtaatgccaatttattgactgaaaagtataatgctgatcaagttgtcaaaattgacatggaaaatgaattgaagaagctacaagatgaagcttcaaatcatgctagtaaattggcaggtgcctctgcaactataaaatcactggaggatgcattatcgaaggcgcaagatgatatttctgccttagaagatgcaaataaaattgctaaacaggagatatcttcacttggctttaagttaaattcatgcatggacgagttagctggaaagaatggcagcttagaaaacaagtccttacagctcattggactccttaatgatcttcaggggctcatgaaagacactactctatttcccagaattaaacaatgctttgagagcaaatgtgagacactgaagaatatgactctcattctgaacaaaataagagataatgttgccatgactgcaaaggattcaaaggggcagcctgtgatggaggaaaatccacttatgagagaaacattcttggatggccctgaaaattttgaagttgaactggacattacagagattgatggtgctgatattgacaccataatctcatcatttggaaagattgtgaaaggatttcagtcaagaaacaaacacattgcagataagtttcatgaattttcagattgtatggatgagtttatttctcctctccatgaaaaactactggaaacagagaccatgtcaacgactattcatggaaaattgaaagaacaggaaaatattattgccactttagaaaacaatgtcagtgtattgctatctgcatgcacggattctaccattgcacttcagagtgaagttgacaagaatgggcagccaggctccatttctgaggttgaacagttaaacctggaagcaggtgcacaagtagagcatcatgagaacaacaaatacacggaagccacacataagttgatgaatgcttctagaaaagctcaaactttgattagacagtttggatgtagaagtgagcaagtagatgcaacaattgaagatttgcagaataaattgaaagaaacaacagttgcttttgaattagtcacagatgagagagacttgaataaaaacagagtttcagaactggagtctgaagaaaaattggaggacaaagaggctgagatttcatcgatgcacaatgctatgttggcaaaagaagaagaaaacttcctccttccagcatctcaaatgagagatctctttgacaagatagattggatcaaaatccctattgtagagtctgaagaagatgatttggagccacatacttcagcccctatgaaaaaactcttttatattattgatagtgttactaggttgcatgatcaaataaactctctgtctcatgataaagaaaagctgcaatcaatccttgaaactaaggatcttgaaattaaggatctgaatgaggaagtcaaacaactcgatagaaattgtgaagactctaaaatgatcaagaatgaattgtctgacctcacctatgtattagaaaaaattatggatattttgggagctggtgaatgggttgtagataggaaatctaaaggtttgaaggaattaataccagcactggaaaagcatatcattgccattctttcagaatctgaaaattcaaaatccaaggcccaggaacttgatattaagttagttggaagtcagaaggttattgatgaattaacgaccaaggttaaagtacttgaagattcactccaagataggacttctcagccagacattgtccaggaaaggagcatatatgaagcaccctcattacctgctgggtctgagataattgaagttgaagagggatcatcacttggcaagaaagcaatatctcctgtcccatcggctgctcatgtgcggaatatgcgaaaaggatctaatgaccatcttgcacttgatattagtgtggagtctgataatctgattaacagggtagataaggatgacgataaagtgttgagtagtatggcccacaagatgctaaagatccatggtttggagttatttggggaaaaaattatctttctcatagtatcaaatcaccatactcctaatgacattttccttggaataaatggggtatctggtggacgggttctcatgagtcgtcctagagcaagattaggactaattgaaacaggtttttggagaggttatgtgtgtgtgtcatgggaaagggattcaacatttaatttgtgctattgttaa

SEQ ID NO: 968 - DNA, 3657 bp, Glycine Max
ggccatcgatcttcgttgaaccttcaaacgcacgatgaaggtggctccctctgcctcgtgtgcttctccaaccttgtctccaatcctctctccccaaccgtccatgtctcctacgctctctcccagctctctcgctccctctccatccctcacttccttcaatcccttctcactttccaccctcacttcctcctctcccctctcctcgccgccctctcctccttccacgaccaacctatcgccgctcagctcacgcatctcatcctctctctctcttcctccgctgatccttccctttgctcccaattcatcgctaggatttccgatcgcatcgcttccgctgctttgggttggacttcccctcagttgcacatgattcactgccttggggctcttctgaattgtgagaaggatgatgatctccatgcacacatcaaagacatgtatagtttcatttctgttcttgttacgggccttcaattgccgagtgaggagattcgcggggaggttctctttgtcctttacaaactatatgttcttcagagtacatcagcagggggagatggaagtgatatgttgattcccttctgtccacagatcttgtatctgttggtggatgttctcatgaagactcaaaatgatgatgttcgcttgaattgtattgcacttttgactatgctggctcgaagacatttgctcagggaagaatgtgcatacgatactagtaacatgtcttccaatggaggagttaactctaaagaaaccgaggacggaaccaagggcacatctctggtaaatctgtttgctgaagccatcaaaggcccattactttcgtcagacagtcaagtccaaatcggcactctagatttactctttcactatttgtcttcggtcagaaattcagactatcagattcgagttttggtggaagaaaatattgcagattatttatttgaaatattaagattatcagagtataaggacccagcagtcaagatgtgccttcagacactgaagctcatttatgaatgcatttctgagtgccctggatctgtatcaacttctcaactagaggagctgattcttgttttgataagaatgcttagaaagcattctgatggggagatgggtatgattcccgagacgtttataatggtctgctctatctttgttgctcttataagatctccatcttgtaatggagctttagatctctcaaaatcgattgaggaagcaacgaaccatgccattttagcttgtctctctgtctctgaaaggaacataaaccaaattttgcaatgtttgtacctacttaaagaggcatatgcatatagtcatgatggaaactccattaactctagtaagctggagcttagaagtggcattctagatatatgcagaacccatttactgccatggcttgtagtgggcatcaatgaaatggaagaggacattgccctgggattgctggaaacttttcattcgatattgcttctgcactctagtattaattccatggaatttgcagagactctgatttcaatcggttggttcagtttttcatttgaatgtctgggtttgtttacaggagataggatgaaaaatagaatatatttgttgctcagttcactcatggattctctcctgggaaatgattctggacaaccaattagagaggctgctttgcacctgcctcgcgatcctattgatttactctttttgcttgggcaaaggagtactaacagtttggatttgccttcttgtcaatctgctgttttgctgattatgtacaccagttcgctatatgatgaaagttcactaaggggtcttggcagtatgaactaccaaattcactatagtcgagatgcggaggagataatattccagctcataaacaatgatgaatgggacttactttcagcaagaattcacacggtgtcattgaagtggctgtttcaacaagagaacataatcaactcattaagccatcagattttgaaattctgcagaagctataacttagaagaggctgacataattatcggaaacaattatcaaactgtaaatgtacagacactttcggagttggtatcaactgaagataactatggagctagacttttcgtgtgcttattagcacagctcttggaggaagaaggccgggaatatgatataatatgtgttctgaatgtcatggcaactatggttctcgtctgtccagctgcttgtgaacaattatctttgcatggaatagcgacaacaatcaggacttggtgttatttgagcaatagcttgtcgacaacaacatacatgtccatcttgattttggtttttaacactttgagttcagtgcatcctgaaacactatcggttgatcaaagctgggtagcgataaccatgaaggtgtgggtagctgaacttctatttattcacattgcatcccgtataaattcaatcatgatcatgattagagactctgatttttatatgatggagtgttcaattccatccaaagaggttgatatcttgagtgacgaaagcctctttgttattggcattctttccttaattttgcatctttccaccaataaagcacttgaagagacttccaaggccattctttttaatacttgtataatctccatggtcaacactgtagtctgcgcggcttcttcgaagggacctgctttggttgaccatgacgagggaacaagtacaggagaaactttaatatttgttcttttgcttcattacttcgccgttaaaagcttgcatgctattctaccagggttcgtggattggcaaagcttctttgcttcaacgaatccatccgagccgctagccttcattggaatccgttgccatgacttgtgcagacttctgcattttggttcaactgtaatcaagattgctgcttcttatagcctgttagagttatttaaaagaatatcagatcaaataaacagtaatcatgaagagttgagatgtactattgggtacataatgtccataaggagtatattggaagggctagttttctataatgatctgagagtggctacaaattgttccctctgtctgtcaatgattctgggatgggaaaagctgacaaaggaaacaaaagtcttagaagagagtagctggtgtagattgattatagaggagatgacagtatctttggcagctcctgctttagcatcacaatcattcatgaacaaccaaaggcctgcagtgcttgtagctattgcgttgctgaaactgcataaaatccctcagtggatgagatctgtgtttgataattcaagcatatctggcatattggggaacctttctgctagtaacttgagctcggagattttggctttatttcgagaactactgaaatctaacttcttaagtacagagcaaattgcaactataaatcaaatgctccaggaatgcagaaagcgtatgtacagtaacaatgctcaagaggatctcccaaatgagccgataaagaaggtcctcaccacatcgtataatatgggagacatttgtgagtatctcattgatttaatgacatcagaggcgtacttagatacgggcagtaagaagctcttagaagaaattgagctgtttttcagtaccttgtctgtagataatggtagttgtatgtag

SEQ ID NO: 969 - DNA, 264 bp, Glycine Max
ggtattttctctattgaatatgcttttttcctagctcttccttccatgaagcaaattgttgactcaaacactctatttcattatgacatgttcaaccttcacaggcgatatggaacttcacctcatacttggactccgacactctccaataatatgaaaagtcatgcatcttatgtttataatgattattatcagagaaagcataatagtggtggaacttgtgactttgatggtaccgctacaattactaccaaggatcctagt

SEQ ID NO: 970 - DNA, 2211 bp, Glycine Max
ggtggagtgctgtttgggccatcaatgttggggaacaaaaagattctggggctagccttatttcctacgaagggcgctgtagtgcttgacacagtttcattgtttggtcttatgttcttcttcttcatatggtgtgttaaaatggatattgccacattaatgaagactgaaaaggtggccatcactcttggtatttctgtattcgcatttacattgataatccctactggactggccttcctgatgatgaaatacattgcgatggacgggagcctcgcaaaggcactgccatttctagctatgtcgcaaaccttaactgtgttcattagcatagcagtgctcttgaccgatctcaaagtccttaacactgatataggacgcttaacgatgtcagcagcaatgtttgctgatgtagctggctttatcttgacagtgattctgtttgcaatactgcaggatcagagtggtagctttgtgagactagcatgcatccttctgtccatagttggagtctggcttcttgttatatttgtaatgaggccaacaataatttggatggtaaagcacccaggtcgaggttcggttaatgaaatctgccttgtttgcatctttctcttagttctcttatctgcatttgtcagtgagttaattgggcagcattttataatgggacctatacttttaggcttggctgttccagaagggccacccataggaacagctttgatgagtaaattggagacaatctgtacggcatttctttatccaatctttctcgctgttaatggactgcaaactgatttcttcaaaattgataagcagtctctgtggattgtgtgtgtcattctgattgtcgctttctttgtaaagattggtgctgtcatgttgccaggatactattacaatctacccttgaaacaatgttttgtcattggcctctttctaaatggaaggggtatagctgagcttgccacttacaatatgtggaaaagaggcaagttaatatcggaacaagagttcgctttgatggtggcctcgattatagtagtaaattgtatcctagtaccactcataagatacatatatgatccttcagaactatatcagaccggaaaaagatgcacaattcagcatactaggcgagatttggagctccgagtgatggtgtgcattcacaacaacgaaaatctccccatgatcctgaacctcttagaagcatcctatgcaagcagagagagcaggattgaggtaacagcattagtcctagtggagcttcaaggaagagccaggcctatcctttttgctaatcaagaacaaccccatgatgagatgcgctcaatgtcttgcaatgcaagtcacattgacaatgcattgaggcaatacgcacaacagaacgaaggatatgtatctgttcaatccttcacttcaatctccacctttgaaaccatgtatgatgatatttgtaaaatctcactagacactggatccaacattttgatcttgccattccacaagaggtgggaaattgatgccaccgttgagatttctcataggaccatccaaaccatgaacattgaagtcctcgaaagggcaccatgttctgttggaattctagttgataggggcatcttgagtccttctccttcactcttgatggctagagcagcattctatgtcgctgtgttcttcatcggcggccaagatgacgccgagacattagcctatgcttccagaatggttaggcatgaatgtgtgtatgtaactgtggtaaggttccttttatttggacaggaaaattctaaagatagaaaacgtgacagtgatcttatagatgagtatagatactacaatgcgggaaatcaaaggtttgagcttatgaatgaagtggtgaaaaatgggatagagatgtcaacatgtattagaagattgatagattattttgatctagtgatggtgggaagggagcatccagacagtgttatttttcagggacatgatcaatggagtgagtgccaagaactaggggtaattggggacatgctagcatcaccagattttgtgaccaaggcatcgttgttggttgtgcaacaacagaaaataagagggacgcttgttaaacacaatgtcaatgcgaatccagtgcctaatcacagagatcagctcgtatatgatattccaaatgatacagtggacaagtatgacagagtgtag

SEQ ID NO: 971 - DNA, 457 bp, Glycine Max
gtaagtgtttcactcaattcacaacttaaaatatcccagtttaactttgactttcatctcaacaatttcatacttctaagcaatcaatttcttactcaaaatctactaactagaagatgttttctcatcttctgttttcttcttattcaacatctctctcaatttcacacactctgcaatgtgccttacctcattcagaaccgtaaggttattaaagacccaacctcttacaatgtcaatatcagaggaatcaaatcagctgatacagcaacagatatcaagaaggcataccacaaggcagctctcagacatcatgcagacaagttgttggctagaagtgaagttggagatgaaggccaactttggaaggaaatttcacaggaggtgtacaaggatgctgataagcttttcaaaatgattggagaagcatatactgtgctttcagacacagcccaag

SEQ ID NO: 972 - DNA, 531 bp, Glycine Max
gtaattggtgtaagtgatttttgtggtgaaagtttttttctgaattttgaagtgaatgaatactggtttaagtgcatgttttatgtctcaccttgtgcctgttttaaaccatttattgactacttattttgttctccagattgtttaggtaggcggttgggaccgaggcttcttgggagggctgatgattcaggggtaaataacaagttgatttacatacagaactacttcataccaggatcctgttgtagaggtaaattaattattacccttacatacataactatagttattgattattattttgtgagccctgattgtcttctccagcaaagctcaactgtagaagattcaatttctttcaaattttctgatggtataactgaatcagttccatgctcatacactgaatttgccaagcgactggtgttgccgcagtataaaaatttacctgacacagtggttaaagagttccatagaagagatggttttgaggtagcaagtgctgacaagatggctaagtcatgcatg

SEQ ID NO: 973 - DNA, 1899 bp, Glycine Max
gtcgttgcacagaaagttaaggaagctgaaatcaccgagcaggattcacttcttctcacgaggatcctgctccgaattgccatattcaacatcagttatatcagaggactatttcctgagaagtatttcaatgataagtctgttcccgcgttagagatgaagataaaaaaacttatgccggtggatgctgagtctcgcagattgattgattggatggagaaaggcacgattaagctattgtgtatacgacgccttacagaagaaatacctgaagacgcttctgttctgtgtgtgcgaagcatttcatttagctattcagattctgataatcaagaggtgtcgatgaatatcaaccgcactggaaacaaaaagaaccgggggaccttcaagtgtaattcgactacagaagttactccccatcagatgaggagttctgcgtgtaagatgatccgaactctcgttcagttgatgagaactctggagaaaatgccagaagagcgcactattatgatgaagctcctctactatgatgatgtgacgccagctgattatgagcctcctttcttcaagggatgcactgatgaagaaacttatcatccatgggagaagaatccattgaaaatggaggttgggaatgtaaacagcaagcactttgtgttagctctgaaggtgaagagtgtgctcgacccttgtgaggatgataatgagggagtccaagacgatttcagcgctggagatgattccatgcaacagaatgaatattatgatactgacagtgaggtttatcttactcaagggaatcgatatatagttgctccaatagaacaggaagattatggcattattgaagaagacaatacccaggacccggtggatgatgagcaacaactggtccgggtcaaggagtggatcaactgttgtcaccgtgacactatcgagtttaatgatgttctatcgaattttccagacatctccgtgccattattagattacgatctatctacaatttttagtttcttttctcatcttttgccaaatataatttcagttgaattgttttacttgcaggttctatccgaagagatcacagacaagcttgttgaggaaggtgtgctatcaaagatagggaaggaaacctacgccattaacaaggacaagaaccttgaatatgagttcgccattgtgaaggaagaaattgacggtcaaattcctcaagtctttgacagagctttgcaggttgaagatcgcatatacatgaaagctctctatcatgttcttccgatgacacacgtttcagtcactaagcttcaaagcttgcttgagggagaagtaaaccagatagcagcacgaaagatcctagataaaatggtgcgggatggaattattgaacccaaaggcagcaaaagattagggaaacgtgttatccattctgacttaactgaaaggaaattcattgaagtccagaaagctctaagtgctactactgaagcaatggatgttgatcactgtgaaccaaatagcaagtccaaaaaaactggtttccgtttaaatggaagcaactatgacgtgtctacatatggggttctccactctattggatcagatttaacacgaatgaaagtgacatctgagacaaactatagtgactccgggaatggacagaaagcatcaaaggcaaaagagcccgggaacacccccataagcaggccagttatttcaagagagagttttgcgcaaggcaaagagaacggaagaacaaatggaatagcaaatcaaggggacgaagctgacacaatcatatgcagcaagtcttcccaagacaaacgaccaaggaaaactagcgcggcgaaggagcctatccatcaaaacatgaagcgacagagatctgaggctcagtga

SEQ ID NO: 974 - DNA, 968 bp, Glycine Max
gtggggcttttctgggacttggacaataaaccacccaattcaatcccaccttatgaagttgccaataagctgagaatagctgcatcttcctttggtgttgttcgttatatggtggcttatgcaaatagccacacttttagccatgtccctcaaggtgtccgggagagtaggaaagagaaggaactgttgtatcgtttagagaataagggtgtcatcaagccaaatcaaccttatcgttgtaaggtttgtgggagaaagttttatactaatgacaagcttgttaaccatttcaagcaactgcatgagagtgagcacacgaaaaggatgaaccagatagagtctgctagggggagcaggagggtgaagttggtggccaagtattctatgaaaatggaaaagtataagaaggctgcaagtgatattctcactcccaaagtggggtacggtttggcggatgagctcaaacgggctggtttttgggttcgaacagtgtcggataagccacaagctgcagatcaagcactgcaaagccacattgtggatatcatggatcataggcgggttgagtgtgtggtccttgtgtctgatgattctgattttgttgatgtgataaacgaagcaaagatgcgatgtctgaagacggttgtcattggggatattgatgaaggtttcttgaagaggactgctgatactgcattttcttgggaggaaattctgatggggaaagctaaaaagcaggctgtttcggttgtgaaaaactggaaggatcgtgatatcttaaaaaagttggagtggacatacaaccctgatgaggataaaagtaatttcaatctggatgataccgttactgaagcatctgaagatgataatattgaagatactacctgtgatgaagttgatgatgcctataaggatgacagaggttcttggtgggaattagattctgatgatgatgccacaaatagaca

SEQ ID NO: 975 - DNA, 119 bp, Glycine Max
tacttgaaggttttggcaccactttcaattggctttgttgtgttcatggttcacttggaaaccatcccgataacaggaactggcattaaccctgttaggagtctaggagctattgtcat

SEQ ID NO: 976 - DNA, 648 bp, Glycine Max
tattcaagtatgagattgcctctaatgaagtttagtggtcaaattttttatatcaggacttttgatgctgtagagaaagctgcaacaaagctcttacaaattctccaagagatgatgcaaattgcaattggatttgacattgagtggaaacccaccttcagaaaaggtgttccacccggaaaggtagcagtgatgcagatatatggtgacactagacattgtcatcttttgcttgaagatcccacagtcttgaaggttggagctgggattgatggtgatgctgtgaaggtttttagagattataacatatctgttaaaggtgtgacggatctttcttttcatgctaatcgaaagcttggtggagatcataagtggggtcttgcatctttgactgaaaaacttttatcaaaacagcttaaaaagcctaacaaaataagactgggaaattgggagactcctgttttgtcaaaggagcaactagagtatgctgcaacagatgcttttgcttcttggtatctttatcagccttatcttgatttcaaactactaacgaattggtttattcttttgcatgcgattaaagatctcccggacgcccagaaagtcactgacagaagtggcgaagttgatggtgtacctcaagaatga

SEQ ID NO: 977 - DNA, 405 bp, Glycine Max
tcaatatcttcaaaatcttcagtagcatttaatcaaacaccttgtagaaaaactaaaactttaatggaggcaaacaattatgatttcttagatgaggctttgactgttgctggcagaggaagactaagaagaagaagaaacaatacaatatctaaccttcctgatggttctggattgggtgatcacattcaattgctgcagatatacgagtgttgggatcaaactgattttgacattggtgcaatgcgctatgtgccaccagaagccagtcacgttgatgtcgatgaggaagggtgtcgcgcgatccatgcctatgaggaagtgactcaaaggagcgtgttttcgagacaaagtgctggtgaaggaggtcgttgctgtcgtgaatatgtgaataaacgctggtga

SEQ ID NO: 978 - DNA, 219 bp, Glycine Max
tctacctccaccgaggactccgtcgttgtctcctacatctccgaactcaagcgccgcggctcagagtccctgagaaacatgataaccgccgctaaacaagaagggcaagccttcacatgcttagcctacaccctcatgcttccctgggccgcattggtagcgcgtgagcttcacattccggctgcgcttctttggactaaacccgccactgttttcgat

SEQ ID NO: 979 - DNA, 774 bp, Glycine Max
tgggtatgggtgatgttcttgaggacaccaaagaatctcatcaaagagtatggttcatgggctatgatcactggcttcactgatggaattggcaaggccatggcctttgaattggcatctaagggactcaaccttctcttggttggtagaaaccctctaaaacttgaggcaacatcaaaggaaataagagatggacatgatgttgaggtcaagtttgtggaaatagtacaaaaagtggaggaagcaatagatggtttggatataggtttgctagtcataaacttgggtcacaaaggctgtgcctccatctatgatcaagaagaaaaagggagcaatagtgaacattggctctggttccactgttgtgcttccttcatatcctctagtcacactctatgctgctacaaaagctttttgtctttcttgtatctatctaaaccatgcttagaacagaaaagtgacttcatttcatttgctcagaggagtcaagactttattgggggaaatctcctataccttgcaatgttctcgagatgcatcagtttaaaataccagcatcaaggaattgacatccagtgtcaggttccattatttgtatcaacaaagatgaccaaaatgaagacatcgctttttattggctacgaaaaactggttgagccatacttcttagattctgtgcaggggtttctcataagggcaattcctgattcatttgtgaattcctatatgctgcgctattttctttgttggcgcagaagaggactccaacattaa

SEQ ID NO: 980 - DNA, 1341 bp, Glycine Max
ttaaaattattgcacatgctactctgtcatctctcacctaatatcctgcacattggaaggagtctcttacaccatgccatcatttgtcacaatgaaaaggccgtaactatacttctaaacaatggtgctgatgcagaagtggtagtgcaaattaaactacagaagaaaccaatgaacaccctattcacatggctgcacggcttggatcgactcccaaacaaaatctggagatacagcattgatgatctgtgcaaggtactacacgagaagtgccttggagtactagtatcagcaggtgctgatttgggtatggtaaattcatctggtcactgtgcaatttcaattgcaaactgtgttcagtggactaaagtcttccagaaagcaatttcggatgtaatcagagctgggaaggttgttaaatcaagcaatgcctctagattttcggctttgttattcgtaactcgtgcaaatgatatagagggtttgaataaactcattgaaagtaagaacattgatctagatgagcaaaatgcaaatggattttcagctgctatgatagctgctgtagggggcaatgtggaggctttcaagttgcttctttttgctgaggccgatgtgactaatcttaaaaacaaccaaaatggtgaagtgttccacaaggtgatgcttgaatatgcacttaaaaagggagggaatgtttcaattgaggtgaatcctctccatcgtgcagcttgctgtagggacatgatcattgctcacaaaaaactactaaaagaagggtatgatgtcaatgcttttgatggtcaaggacatacccctttgatgttagcagcaagaggatgccacggcgaaatgtgtgagcttttgatctcatatggtgctaaatgtgatattcagaatgagagacatgagacagcacttttacttgcaagagaaaatggtgcaggaaatgatgcagaacgtgtgatattggatgaggtagctcgaagactagtcttgtgtggtggtcgtgttaaaaaacatacaaagtgtggtaaaggttcacctcatggtaagttactagagatggttggagctgctggaatgttacgttgggggaaatctagtaagagaaacgtgatttgtaaagaagctgaggttggacctagtgcgaaatttcgatggaatcgaaggaggaagtttgatgttgatgagccaggaatgttccatgtggtcactacaaaaaataaacaggtacattttgtgtgtgaaggtggggttcaaatggctgaattgtgggtaagggtgattagattagtaactagagaagccatttttggtcgaagagctgataaagtttga

SEQ ID NO: 981 - DNA, 2361 bp, Glycine Max
ttacgacgatcgaaacgaaggaacatacaacctgaacgttactctgattgtggtaatgtttctgatgtaacaaaggttggtaattttcgaacctggccatacaagttaaacaaaaggaaagatgacgacgacgacaacaataaagagccattgccactagcacaagagaatggtggcaatagtcaaaaggtcatgaagagaaatgaaaagaaggaattaaagtcaggtgaggccaagcaaactccacttgctagtgttcctcttcttgaagaaggtgatacattagcccttgagtatcatcctctcaatgtcaatgttactagaataagtgatgcatattacagcacccctaagcttaagaagaagagattggttggtctggaagatgatgtagatttttatcctggaagggaaggcataaatttcaataaaggagttagagagaaaagacatggttcatcatggtattcaagaagcaggagccatgatactggacacagttattacaaagatagaagcttaaatgcaactgcctacaaggaaatgatagattcatacttaaagaatgctaacagaacactaacaaaagaagatccacctgtaatagaccaagatacctcagagaggatgaggaacaaatctcttgagatcgatatgttgtggaacgaaatggaaatggcactggcatcaagttatcttgaagaaacagagattatcaagataaaacttcaattagagaacaacaccaataatactgatgaaattgctactaaggttcaaatggtgccaaattttgctgagactacggaagaatctaatcacacttgtccacatgattacagattctctgaagaaattggaatttattgctacagatgtggctttgtgaaaaccgagataaaatatattacgccaccctttgtaattcctcatattgactataacctcctaatttgttcaaaagcctgttcatattggcagattgaaacgcaacgctcatcaaaggaaaaggttaataaagttgatgatttacatctgttcttaactcatgctcctacagatgaacataactctatggaacatgacaacgtttggaagttaattccccaacttagagaaaagttgcatcaccaccaaaagaaggcttttgaatttctttggcaaaatattggaggctatttaaagcaattcccagggaagaagcctcttatccttgctccaaaaaacacactttacacttggtgcagagaattcagcaagtgggagatttttatgccagtgtatccgattcatgggcgtggtggaactcagagagatactgagcaaaattcaattgctcttcctggttttccaaatccaaataaagaggtcaagcatgttttgaactgcttggaaaagataaaactgtggcaagagaaaccaagtgttttggtcatgagttatactgcatttctagcattaatgagagagggttcagagtttgcccatagaaaatatatggttaaagcattaagggaaggtcctgggatcttgatacttgatgaagggcacaacccaagaagtactaagtcgaggttgagaaaagggttgatgaaagtggaaacagatctaaggatactgctttccggtacattatttcagaacaatttctataacattgctaagaaaattgactcgggtattgaaaatgagagggtgcaaggtctaaacatgttaagaggaaccacaaatggttttgtagatgcttatgagagtgcgaattttgatagtactcctggtttgctaatgaacacaactgacaagcagcatgagattttgttaaaactgcacacgagaatggacgagtgcattggttactctctggagctagagcttttggtaactctcggatcaatacattcatggttggttaaaacaactgcatgtgcaaataagtttttcacagtgggccaactgaagttgctagaagaatacaagtatgatatgaaagcaggatcaaaagttaaatttgttttgagccttgttttccgtgttatgccaagagagaaagtacttatcttctgccacaaccttgcacctgtgaatttgctaatagatttgaggagcatggaggagcatcaaagtttaacagtagcttctagagtgattttcttggactcagcgtggaatccattgaagatgaagcaggctattgcacgcgcttttcgtcccggtcaagaaaagatggtttatgtgtatcagctcttggcaacaggcacattggaggaagataagtacataagaaccacttggaaagagtgggttactagcatgatttttagtgaggcttttgaggagaacccttcacactcgcgagcatag

SEQ ID NO: 982 - DNA, 1038 bp, Glycine Max
ttattgtacatgttgcaacttctctgtacactccttgtgatacagattattaatactaaatcacttttgcttaaaaaaaataagtacattaattttttccacttagtagcttctcttggcttgcctcgcaccttctcaattaatatatatatgtatgtgctttggtgtctgtatatgacatatgtgctcagtgcctccgccaaagcaaataaaatggatactgaaatggttgagagcattgttgagaatctcgtgtccgtagttttgtttcatttgggatcatccccttccccagcgcatgcttttgcttccgctgtggatatcaggactgttgctgcaccattattcacccccgctgagcttaaagtagccaccaacaatttctcatttgttgatcatgctaatgtttttgtcaaaattatcattttcaattattgcacttgttattatcgcctttcaaatagtgctcctagagtatctctaatgcgacataaaattaattcgtctattattcacggagatataaagtattccaacattcttactgatgtcacttggactgctaaagtatctgattttgggaaggcagcaggaactattggatacattgatcctgagtacttaactcgacgtgtattgacagaaaagagtgatgtgtataggtttagagttgtagtgctagagcttttaacgggaaaaacacctatattcgaatccatgtatggggaagatggaggcacccgattacatgtgataccttatgctgtgcctgctattttggctggagagttggtgaaaattttggatccaagggttggaccacctgatatagatgaagcagaggcagtggagttagtagcctatacaactatccactgtgtgaaaagggaagggaaagatataccaaccatggctgataatgtagtcaatttggaaagggttttgattatttgtggaatgttggtcggtcatacttgcaatgctgatccaaagaaatcaccttgcagcatagcagcggctgttacagcaatttgttag

SEQ ID NO: 983 - DNA, 99 bp, Glycine Max
ttatttagtttatgtcactcttttctttatttcttccagttacattctttaaagtatgaattacattctttatttcttttaattaagcacacaaattaa

SEQ ID NO: 984 - DNA, 297 bp, Glycine Max
ttccttttccctttgcttccaataattggacctatatatccaaaaaaattgtcggcctacggatgtggtttcgatcctttgggtgatgctagaagttgtttcgatatacgattttatcttgtttccattttatttattattcatgatccggaagtaacattttcctttccttgggcagtacctcccaacaagattgatccatttggatcttggtctatgatggcctttttattgattttgacgattggatctctctatgaatggaaaaggggggcctggatggggagtagtcactag

SEQ ID NO: 985 - DNA, 236 bp, Glycine Max
ttcttacctaaaattaaacataagacaacagagagtgcaagactcccctttgtgcttattctgaagcaaattcctgtgaaattgagttttgtaattaccataaataaacatggccaattatatgttgttttgtcaagagatgtttctcaagcttcctcaaaaatccttattaaagaaggacaacttgaagaggaagatgaaaacttcaccaaaaatgttgtttacaatgaattttt

SEQ ID NO: 986 - DNA, 2811 bp, Glycine Max
ttggagtacagcatcgatgatctgtttcaagaagctaagaggagatggctcaagcctgtggaagctctttacattctacggaatcacgaccagtgcaagttcacccaccagccccctcatcagccagctggtggatccctgtttctgtttaatcgtagaatcatgcgttccttccgtaaagatggtcataactggcggaagaaaaaagatggcaaaactgtgggagaagcgcatgaacggcttaaggttggcaatgttgaaatcctaaactgttactatgcacatggagaggagaaccgtacttttcagagacggagctattggatgttggagccggaatatgatcatattgttcttgtgcattatagagaaacaagtgaggtgagtttccagaacatgatatcagataaacataatatagggaaatccaattctgagcatgtcacacaattgccatcaggttcctctcctgcttttagtcagagtcatagctcgtatactgctcacaacccaggaacagcatccatgattggtgattcatgtgaacctaatcagaatttttcttttcctgggtctttagaagttacgttcgaagcacaagccttgcgccaattggaagaacagctgagtttgaatgatgatggcttcaatgaaattgcacttgatttagtgtcaggtcaagatcaaagggtggtttataagcaagataaatctgcagctttgtctggaccaaatgatctaggacaaccttgtgatggatataatggaagacaagcaacaatcaacctctatatgtttagtcctcttgagaaagatcagattggaggaaagatgctaagcttggttgccacaagcaagttccataggacctcacaaatgacagtggcacatattatcatgattttcttgatgattgtcctggtggaaatgaaaaaactatatactggacgaaagtgctggaatcgtgaaaatacattattttcttcgggaaggggagtgattgccaacctggaaaacaatcagtggctaaactccaacaatggtggggtcaaatttccaccatattctctagcagaaactccaggagctaactctgactactatgaaacattttttgaccaattccaaaatcaaggacctctgggtgtagattcaagcttgactgttgtgcagaaacagaaatttaccattagggcagtatccccagaatactgttattctaccgagactacaaaggtgatcattattgggtcatttctctgccatgactcggattctacctgggcctgtatgtttggtgatgttgaagttcctgcagagataattcaggacggcataatctgttgtgaagctccatccaatcatcttggaaaggttaatttgtgcattacttcaggaaatagggtgccatgcagcgaaatgagggagtttgagtttcgaaataagactactagttgcactcgctgtaattcattggaaacagaaggaagcaaaagtcctgaagatctgttattacttgttcgatttgcagagatgctcctttcttcttcaactacaaaggatgacagaatagaatctggaagtcatctttcaacagaacagaaagatgatgatgattcgtggagccatattatagacactcttctagatagcactagaacaccatctgatgctgttaaatggcttcttgaagagctgctgaaggataagttgcagctctggctttctaaccgaagagatgaagggacgggctgttctttgtccaagaaagagcaggggataatacacatggtttctgggttgggttttgagtgggccttgaaccccattctcagttgtggtgtgaatataaatttccgtgacatcaatggatggaccgctcttcattgggctgcacggtttgggagggaaaaaatggttgcttcacttatagcttctggtgcatctgctggagcagtgacagatccaagttcacaagatccaaccggtaaaactgctgcatctattgcagccagccatgaccataagggtctggcaggttatctttcagaggtagacctaacaagccatctgtcgtccctcacattggaagagagtgagctttctagagaatcttctgagcttgaagctgagttaactgtcagtagtgtctctgaagaaaatcttgtggccagtgaggatcaggtttcactaaaagcttccttggatgctgttagaaatgcagctcaggcagctgcacggatacaagctgcttttcgtgcacattcttttagaaaacggaaagaaagagatgctgccgccacagttctagatggatattgtattgatgcaggtagcattgataataacatttcagtgctttctgccatgtcaaaacttagttctcagagctggcgtgattacaaagctgctttgtcgattcagaagaaatatcgaaattggaaaggtcgtatagaattcttagcattgcgccagaaaatagttaagatacaggcttgtgtgaggggttaccaggttcggaagcaatacaagctaatattatgggcagttggaatcttggacaaggttgtgttacgatggcggagaaaacgaattggtatacaaagtgtccggcaagaaatggagtcaaatgaagaagaaagtgatgatgcagattttctcaatgtgttccggaaagagaaagtaaatgcagcaattgaaaaggccttgaagcgggtgctttccatggtccactccactggtgctcgtcagcaatatagacgcttgctttcgttgtatcgtcaagccaaggtctgggataccaccagttag

SEQ ID NO: 987 - DNA, 1120 bp, Glycine Max
ttggggcaactgtcaactccatatgctgtagaaaatggagggtggtcatctgcattcttgcttatgggactaggagtgatgtgtgcttatagttctcacatacttggagtatgccttagaaagaatcccaagttaacaagtttcatggatattgggaagcatgcatttggatcaaaaggtagaaacgtggctgcaacaatcatctacatggaaatcttcatgtccctcgtttcctacaccatctcactacatgataatttgatcacagtgtttttggggacaaatttgaagcttcacttgcctaatttttcttcatcccagctcctaactgcggtggcagtcttcattgcaatgcctagtttgtggatcagagacctttcttccatatctttcctttcaagtgttggcattctcatgtctctactcattttcctgtgtgtagcagccactgcactcttaggacatgtccaatctaatcattccatacctgtcctccacctccataatattccatcagtatctggcctctacgttttcggctatggaggacatattgttttccctgaattatatacagccatgaaagacccctccaaatttacaaaggtttctattgtgagcttcgcagtagttacagcaatttacacgacattggggttcatgggtgcgaagatgtttggtaaggatgtgaagtctcagatcacacttagcatgccacaagagcacattgtaacaaagattgctctgtgggcaaccgtggtggcacctatgaccaaatatgcacttgaattcaccccatttgcaattcagctagagcatgcacttccaacttccatgagtgtcagaaccaaaatgataattagaggctgcgtaggttcattttcacttttgttcatactaacccttgctctgtcggttccatatttcgagcatgtactaagtctcactggctccctggttagtgttgccgtttgtttaattttgccaagtgctttctacgtgaagatatgttggggtcagatatcaaagcctcacttactactaaacctcttcctcatcatattcggctttgttcttgccgtgatgggcaccatttcctcctcacagttactactcaaaa

SEQ ID NO: 988 - DNA, 1442 bp, Glycine Max
ttgtctgagttagtgtgtaaagcaaaagaactagtgcaagcatacaagcttcaaaatgtagttaagactgcagacaacttctgttcatgtttgaagcttgatagaaacacagatgttagctatagtaatatgaggaaggctgcttcttgggaagatttgactgacaactatttattctgttctaaagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacgtcatgtaactaataccaagcatggccaatatttggcggagaaaacaattgattgcttagattggactgcgggggaaattaatatccaccaactttttactggctatacaaatggtcgtagagattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactgtcattgagaagttgaagcaaaagcatctcgagcaagagaaaagggagctacttggtgatgatcaggatggagaaactaattttcatcaaccgtctggtagtaatgaggttgccattgctaatgaggatggtatttcatatggatcagagctcatagaggttgacaaagtaaaaataaatcaagatggtgctctctgggatattttttggagacaggatgtccctaagttgcaggaatatctgaagaagaatttcagagagtttaggtatgtccattgctgtcctttgcacccttataacattgacattctcccattcccttattttattctgataaaaatttcattaaatatgcatgtcataaaggattgggagcttttcattaatatgacaatagatgtcatgcaattgcaactgttgagagagtacaactgggaaattgagtgtatccgactagaccgagtttcccagttcttactgatccctttggtcttgaatcacagacagtacactgcccacttaccttgtactgaaattcaacattttattaaaagaacgaagacagcacgtttgaactctattcatgttacattagctctaacaaaaaaactaattcaaattcaatttataattttttttttttgcgggatgattgacttttggat

SEQ ID NO: 989 - DNA, 2097 bp, Glycine Max
ttgtgtgaagatgaaagttgggacggagtggttgtgacagcatcaaacctcttagcacttcaagctttcaagcaagagttggtggacccagaagggttcttgcggagctggaacgacagtggctatggtgcttgttcaggaggttgggttggaatcaagtgtgctcagggacaggttatcgtgatccagcttccttggaagggtttgaagggtcgaatcactgacaaaattggccaacttcaaggccttaggaagcttagtcttcatgataaccaaattggtggttcaatcccttcaactttgggacttcttcccaaccttagaggggttcagttattcaacaataggttaactggttccatcccttcttctttaggtttctgtcctttgcttcagtctcttgacctcagcaacaacttgctcacaggagcaatcccttatagccttgccaattccaccaagctttattggcttaacttgagtttcaactccttctctggtactttaccaactagcctaactcactcattttctctcactttcctttctcttcaaaataataatctttctggcaaccttcctaactcttggggtgggagtcccaagagtggcttctttaggctccaaaatttgatcctagatcataattttttcactgagaacaacctccttgaaaatcaaatccctgaaagtttaggtacattgcgtaatctttctgttctgattttgagtaggaaccaatttagtggacatattccttcaagcattgcaaacatttccatgcttaggcagcttgatttgtcactgaataatctcagtggagaaattccagtctcctttgaaagtcaacgtagtcttgatttcttcaatgtttcttacaatagcctttcaggttctgttccacctctacttgccaagaaatttaactcaagctcatttgtgggaaatattcaactatgtgggtatagcccttcaaccccatgtctttcacaagctccatcacaaggagtcattgccccaactccagaagtactgtcagaacagcaccatcgtaggaacctcagtaccaaagacataattctcatagtagcaggagttctcctagtagtcctgattatactttgttgcatcctgcttttctgcttgatcagaaagagatcaacatcgaaggctgagaacggacaagccacggggagagcagccgctggaaggacagaaaaaggagtccctccagtttctgctggtgatgttgaagcaggtggggaggctggagggaaactagtccattttgatggaccattggcttttacagccgatgatctcttgtgtgcaactgctgagatcatgggaaagagcacctatggaacagtgtataaggctattttggaggatggaagccaagttgcagtgaagagattgagggaaaagatcactaaaggggaaaagcttctggtttttgattacatgcctaaaggaggtcttgcttctttcctacatggtggtggaactgaaaccttcattgattggccaacaaggatgaaaatagcacaggacatggctcgtggcttgttttgtcttcattccctggagaacattatacatgggaacctcacatccagcaatgtgttgcttgatgagaacacaaatgctaaaattgcagattttggtctttctcggttgatgtcaactgctgctaactccaacgtgatagctactgctggagcattgggataccgggcaccagagctctcaaagctcaagaaagcaaacactaaaactgatatatacagtcttggtgttatcttgttagaactcctaactaggaagtcacctggggtgtctatgaatggactagatttgcctcagtgggttgcctctattgtcaaagaggagtggacaaatgaggtttttgatgcagacatgatgagagatgcatcgacagttggcgatgagttgctgaacacgttgaagctcgctttgcactgtgttgatccttctccatcagtacgcccggaagttcatcaagtgctccagcagctagaagagattagaccagagagatcagtcacagccagtcctggggacgataccatatag

SEQ ID NO: 990 - DNA, 393 bp, Glycine Max
tttatttattttattgtcgcactcatccttattttcctcttcaccttcaactcccctcctcttgccaacactacccaccgccatgttcacacccacttcctctcttttacattcagcacctgggagaagcaagcaagccactccaacacctcacgtcgcttccaatggcctcaccattatcgtcgttggctttgttggcactcattgttttgtcgctctcaaaaacacactgcaatgatgtcctgggccaagacaagggagactagatatggcttattttttcttcaccaaagacatcatccaagcgaaaaccattggcatgtgacttcacatacattgaaatattgtgaaggactgccttggcgccctcgacatcgtcgagaagagcactgg

SEQ ID NO: 991 - DNA, 186 bp, Glycine Max
tttccaataggcacccaaaacagtggagaaaataacaagggcaaagttgacaaagtttgcaactatagttggggtggtcaaacaaagatgccatcttatgtaaacaaactggtgttccctgagatatgcatgactactttgaggaccatagtcatgcaagaagatgagcttttcaagttttcctga

SEQ ID NO: 992 - DNA, 195 bp, Glycine Max
tttgaaaggaagctaaatgagatgttaagtcacttggagcgccagcccagaaacaaagagcgctgcatcacatggcttaaatctgctgattcactatttaatggagttggtcttatgcttttagctcacttcaggcgcattttcccattactttttcagtggatgcatgctgataacaatgagattattattttg

SEQ ID NO: 993 - DNA, 1197 bp, Glycine Max
tttgattcgttagtggacagtgccataaggagtagtagtgctactgaagaagatttgggatcatccccggtccatgtttttgctatggcagaagacagggcgatgaggagtagtagtggagctgatttgggaacattcccttttcatgtttttgctacggctgcggatatgaggactattgcagcacgattaacaaaagccgtgtcgaatgcaaaaagacattttgctgaaggattatttacccgggctgagcttataccacttaaagcagccaccaataatttctctagtgacaacatgattgatttttatgtgtacagaggcaaactcgttgatggtcgtgaggttgcaatcaaaaagaggatagcaaccaggggagactcgtttggtaagtctgaatttgccatcttttcccgtttacatcaccggaacttggttgggctggttgggttctgcaaaaacagaaatgaaaggctgctggtgtatgagtacatgaagaatgggtcgttgcatgatcatttgcatgacaagaacaatgtggagaaggctagcagtgtgttgaattcgtggataatgaggatcaagattgctttggacgcttcccgtggaatacaatatcttcatagttatgcagttccatccattattattcacatagacataaagccttccaatattcttcttgatgctacttggacggcaagagtatttaattttgatttgtcgttcatgaatcgagaatctgactgtgatgatgtacacactgagccagtagcgagaaccgtgggatacatttgtcctgagtacttgggtgtggtgacaacaaagtgtgatgtgtacgggcttggagttgtactgcttgaacttttaacgggtaagacagctttcttcaagtctgaggaagatggaggccctgcattgtatgtggtggagtttgcagtgcgtgctattttggctggagatttggtcgaaattttagattcaagggttggaccaccccatgagaaagaagcagaggcactggagatcctggcctataccgctatatgttgtgtgaaaaggaaaggaaaggatagaccaaccatgaatgacattgtggccagtttggagctggctttggctctttgtgtgtttccagcccttgtaacccaaagttcacttactcggatggattttctatatttatgtaatacttga

SEQ ID NO: 994 - DNA, 1170 bp, Glycine Max
tttggaacagcaattgaatttagtgagaggataacccactttgggatatccagtaatcttataatgtatccgactagagtgatgcatgaagacctaaaaacggcaaccaataatgtaaactgctggaaaggagcgacaaccttgttgcctctaattgggggatttgttggtgatgcctacacagtggcggatcaacttgaccaaaaaatttttggagcatatcaatttgatgatgaccactttgaagaaataaagatgtctttcttcaactggtggacctttacactcagcgttgcatggctgctagcgacaacagtggttgtttatgctgaggacttgtacaggagactacaaggaaacccttttatgccaattctacaagtcctaattgcagccataagaaaaaggaatttgctttgtccttcaaatcctgcttcaatgtcagagaatttccaaggaaggcttctaagccatactagcaggctcaggtttcttgacaatgctgcaatagttgaagaaaataatattgagcagaaagatagtcaatggcgatcagcaacagtgacaagagtggaagagacaaagcttattctaaacgttattcccatatggctaacttcattagtagttggtgtatgcacagcaaaccacactgtcaaacaagcagctgctatgaacttaaagataaacaatagcttcaaaatcccaccagcttccatggagtctgtttcagcttttggcaccataatatgtaatgaaagaggcatcagcatatttaggaggaatggcattggcttaacattctcaaaaaaaaagagattaagaatggttggacatgaattcttaacagttgggggaattactaggcatgaaactatgagtgtgttatggttgataccccaatacttgatccttggcattggaaattctttttctcaagttggtttgcgagagtatttctatggtcaagttcttgactcaatgagaagcttaggaatggctttctttctaataataattgtggaccatgtcacagcagggaagaatggcaaagattggattgccgaggatgtaaattcaagtcgtctagataagtattattcgattttgtctgtcataaatgctttaaatttgtgtctcttcctattcttggcaaagaggtacacttaa

SEQ ID NO: 995 - DNA, 507 bp, Glycine Max
aaaaagataattataagatacaaggaatgtctgaagaaccatgcagctgcaattggtggcaatgcaactgatggctgtggtgagttcatggctgctggagaagaaggcacccttgaagctctcaagtgctcagcttgcaattgccacagaaactttcacagaaaagagatagagtcttctgattctaatgccattcctttgatgattattcctgacactactcagataataagaccaattttggctcatttatctcccaacaaaagtggctcaattagtccttctgatttgtctgatgagaaggaaaacgaagatgggatgatgattaaggaggtggaaaatccaaatgagaaggtgaagaagaggttcagaaccaagttcacacaagaacagaaggagaagatgttggcttttgcagaaagagcagggtggaggatacagaagctagatgaatcattggtgcagaagttttgccaagagattggaatcaaaagaagagtcctcaaa

SEQ ID NO: 996 - DNA, 1000 bp, Glycine Max
aaacaaaaagcagacgaacaaaaccaagctggcactgccaatattcaggcacaggctttcagtttccgtgagctagcaactgcaacaaagaatttccgtcaggaatgcctacttgacgaaggaggtttcggcagaatctacagagggataattcctgccaccggccagcttgtggccgtgaagcaactcgaccgaaatgggatgcaaagcagtaatgagtttctggctgaggttgctgagctaagtctcttgcaccatgaaaatctggtcaatctcattggttattgtgctgatggagatcaacgtcttttggtatacgacttatttgctgcgcgtactcttgaaaatcgtctttttgagaataaaccggatgaaggtccattaaattggtttgacagaatgaaaatagtagtgggtgcttctaaaggactagagtacttgcatgagactaccaaccccccgcttatattccgggacttgaaagcgtccagcattttggtggacagtgatctccttgcaaaactatgtgatgttggcatggccaagctttctggtggagacaagataaacaatggacctccaagacttatgggtacctatggtcactgtgctcccgagtatgtaagagctggtcaactcaccatgaaatcagatgtatacagtttcggagttgtcttgctagagctcataactggacgaagagccattgacaccacaaggccaaacgaagagcaaaatcttgttgcatgggcaacaccattatttagggatcccaagagatacccagacatggcagatccacttcttaataagaactttccagaaaaagatctgaatcaagttgttgcaatagcatccatgtgcttacaggaggaagcagaagctcgtcctttgatcagtgacgttgtaaacgctctcagctttctatccgcgcctcctcctcctgctgctcctgtccctaaaaagagtgatgttgctgaaagcgaaagggaaagcgaga

SEQ ID NO: 997 - DNA, 321 bp, Glycine Max
aaactagggtcaaatagcgaacaatctcccctcgcaagacgacgcgttgcgttggtgaaatccatgggagcaacgaaggtgaagctctacgacgcagatgtgaaattaatggtaggcctgggaaacgagtacttttctagaatgaaagatccaaagcaagcccaggcatggatcaaatccaacctccaagcctacccctccaatcgatgctgtgtattccgcgttggactcgttggctttccaaggggcatctggacgaagccggtgcgaaactcgagaacgccaagagctataacgggaatcttattaagatggttatga

SEQ ID NO: 998 - DNA, 228 bp, Glycine Max
aaagtggggaggataagatccgaaatagagcaaatggagaaggtaaaggacaaaggagatgaagcattgtatgacaaattggattctgcctatcctagcgatgatgagaactcagaggtggaggatggtgagcagggtgatgaggcatatctcaagacctataatagcgaaaatgatagtgaaattgaaagtgaagttgaaagtgataatatgtatcctccaatctga

SEQ ID NO: 999 - DNA, 1644 bp, Glycine Max
aagagtggttacgattcaagaacaggcatctatcactctctaattaagcttgtcaccaagcatgaaatcccaacaaggcctgatcttaacactgccaattttgtgctgtcacagttcccacagacacaccttgctgaggcaagaattgcattcattgattcaggtactagtaggagtgtaagctatggtgagctaaaaaggtctatttactcccttgcatcagctttgttccatggacttgagattaggaaaggtgatgttgtatttgtattgtcaccaaactcaaccttgtactcagccatatgcctagctgttttatcagttggagcagttcttaccactgccaaccccatcaacactgcaacagaaattgcgaagcaagtgcatgattcgggtgctaaactagccatctcagcacctgaggagctacacaaattggtcccaactggggttcctataattctcacttctcgtccttctgatggcaacatgttatcagttgaagagttaatagaaggctgttgtacttcaccagagttgcctcaagttcctgtggcacaatcagacactgctgctatactttactcttcaggaaccacaggggtaagcaaaggtgtggttctgacacatgcaaatctcatttccataatgagactactcttttggtctgctgatgtaagtggatcccaagatgatgttttcttggccttcattccaatgtttcacatctatggacttgtgttctttggattaggattgttgtgtgttggtgtcacgacaattttgatgcagaaatatgacttccaaggcatgcttgatgcaatccagaagcacaaggttaacaacatagcagcagtgccaccagtgatccttgcactagtaaaacaagcaaagaaaactaggtgtgacttgtccagcctaagaagggtggggtcaggtgctgcacctttgagcaaggaagtggcacaagagtttagaaggatgtttccttgggttgaactaaggcaaggttatggcctaacagaaagtagtggtggagcaacattttttccctcggataaagatgctaaagctcatccagattcatgtgggaagctgattccaactttttgtgcaaaagttgtagacatcgaaacggggaagcctttgcctcctcataaagagggagaattatggttcaaaagtcctactattatgaaaggatatctaggaaatttggaggcaacaagtgcaactattgattcagaaggttggttgaagactggtgatcttggttacattgatgagaagggatttgtttatatagttgaacgaataaaggagctaatcaagcacaatggttatcaggtggctcctgcagaactggaatctgtgctgctaagtcatccccttatagttgatgcagcagttataccggttgaagatgaagaaactggacagataccaatggcatatgtggtgagagcagctggttctgaactctcagaaaaccaagtcattcaatttgttgcaggccaggtggctccatataagaaagtgagaaaggtgagtttcattgtcactattccaaagtcagctgctggcaagatattgcggaaggatcttgtttctcaaagcaaatatcaacttgtctccaagttatga

SEQ ID NO: 1000 - DNA, 2298 bp, Glycine Max
aagcaaagagtccctcttcataacggcgccgttaaacaagagacccattcgaagaaacgccgtccggagaagaatcccgaagagtgtgttcctagaaagaccaaaccggagaagtcgcacaccaagtgttcgatgaaacgcgtctcttatggtggatgcattaccgccattctagaagcattggatgtagttctcgacgtggatgaggctcttgggccgtgggaggacaggcttagcaacaaggagaggagcatcattttgaaggagcagctgaggtgggacagagctttggagattttcgagtggttcaacaaaaagggtcatgaattgaatgtgattcattacaacatcatgctgaggagcctcggcagagcacgccagtggagacgcgtggagagcttgtggaatgagatgaatgccagaggcattgctgccacctgttccacttatggaactttgattgatgtttatagcaaaggagggcgcagagacgatgctctttcttggcttaacatgatgttgggacaaggggtgcagcctgatgaggtcactatggtgattgtggttcagttgtacaagaaagcaggagagtttcagaaaggtgaggagtttttcagaaagtggtcatctgaattggatgagagggtggcatgcgctaatgcttcttttggctcgcatacttataacaccttgatcgatacatatggaaaggctggtcaacttaaagaggcatctcagacttttgtggagatgcttaaacaaggcgtggcgccgaccacagtgacgtttaatacgatgattaacatttgtggaaaccatggacgattagaggaagtgagtttgcttgtccggaaaatggaagaacttcgatgctcgccgaacacaaggacatataatattctaatctctcttcatgctaagcatgatgatataggtatggcaacaaagtattttgaaacaatgaaggaggcctgcctcgagcctgatcttgtaagttaccgtactcttttgtatgcatactcgataaggaaaatgattcgtgaagcagaagagcttgtaaaggagatggataagaggagacttgaaattgatcaatatacccagtctgctttgactaggatgtacatagaagcaggaatgcttgatcggtccttgttatggtttctgaggtttcatgtagctggcaatatgacatccgagtgctatgctgccaatattgatgcatatggggagcacgggcatacattggaagctgagaaagtcttcatttggtgccaaaaacagaagaatctcagcgtccttgagttcaatgtgatgattaaagcatatggcatagggaaatgctatgagaaggcatgtcaattgtttgatagtatggagaaacatggcgtagttgcagacagatgcagctatacttctctcatacacattttggccagtgctgaccagccacatattgccaaaccttatctgaaaaaaatgcaggaggcaggattagtaagtgattgcatcccatactgtgctgtgatttccagctttgcaaaattaggccaattggaaatgactgaagatatatacagggaaatgattaggcatggtgtgcagcctgatgttatagttcacggcatattgatcaatgttttctctgatgctggaagagttaaagaagccatcggttatgttgatgaaatgaagaaagctggcttgccagggaatacagttatatataattcattgatcaagttgtatgcaaaaattgacaacctggaaaaagcaaaagaagcatacaagttgcttcaattgtcagatgaaggtcctggtgtatactcttcaaattgtatgattgatctttatgttaagaggtccatggttgatcaagcaaaagagatatttgagaccttaaagaaaaatggagctgcaaatgaatttacatttgcaatgatgctatgcttgtataagaaaattgagaggtttgatgaagccattcaaattgcaaagcagataagaaaattgggacccttgacagatttaagttataacaatgtgcttgacctgtatgctattgctgggagacccaaggaagcaatagagacttttaaggaaatggtaagagcttccattcaagttaatgattgtagtcttagatcacttggaaatcttttgttgagatatggagtatcaaggctggctgttcacaaattagaagcattagtgaaaaaggatgcttccaatggtttgcaggcatggatgtcagcactcgcaagtgtgcttgaagtagatgattatgatcatgactag

SEQ ID NO: 1001 - DNA, 192 bp, Glycine Max
aatgggagtgtcgtccctacagacccgcaggcaatggcggttgtgaagaagaagacgcagtcttcgaggagttggattctgtttgaccccacaggacaaggctccttgctcgatgttgacaaatatgccatcatgcatagggccattgttcttaacttggagcatatcaaggcaattatctccgctgaagag

SEQ ID NO: 1002 - DNA, 557 bp, Glycine Max
acaagaagcaagactctgaagacgaaggaagacagacttagtggattgcctgatgaaattttgctaattattatgtcattcatcatgattaaagatgctgttcaaacatgcatcttgtcaaagaggtggaggaatttgtggaaattcctccctaatcttactttacattctaatgatttcaaaaagaatcgagttttctatgaatttgtgtccagaattgtgtcttgcagtgatcaaaaccataccctacacagtctagacttctatcgccctctttattgtaaacccaagattatgacaaatctcattaactatgccatctgtcataatatccagcagttgaaactcaatgtccccaacaatttttctttgccggcttgtgttttctcttgtccatctttaacatctctcagcatatcagtttcacataatgtcttaaaaagaacaagaattcccaaatctctgcaacttccagcattattaagtttgcatctgaataatgttccaatttctgcggatgaaaatggccatgctgaacccttctccaactgtaaaaa

SEQ ID NO: 1003 - DNA, 99 bp, Glycine Max
accatcttttccacagtatatatatttctacctcgtgagactaaaaaatatgtctctaagttcttgatccatcaacttcagcctcgatatatcttatga

SEQ ID NO: 1004 - DNA, 426 bp, Glycine Max
acctctcaaatttctaaaccttcctcccatgggaggataacttcaattcaggacattcctgaattgaaaaatactaaccaaataagtttacttaaaaattttaaatacctatttgtttcatgcgttgactacaacatggtcactatactttgtaagcacttatgggtgctcataaactctatagtgtgtgcttgtgctcataaactaattgatgagaagatgtttgggattgacaacttctgttggatctctgcaaagacaacattagaagcttcaaagcatccagagtttttaattctgcagacaggcttgggacatttattgcttgctttgcttttagacctgcttctcagcttagatcttaaactaaagtgtggagcatgttgttcctattttatcattagcttgccattaccatgcttatat

SEQ ID NO: 1005 - DNA, 1368 bp, Glycine Max
acgagtctgataagatcacacagccatcccctttttttggatgaaatttcaagccctcttagtgctcgaatcttcgaactttgtaacactgatttttttccagaggctttgcagaattctgaggttacttccagctcaaactgttgttacgaggagaactcctcatatgccacaacaaatatatctgtaactgtagatgtagacaataagttgaatagcaatagcaacacagtcaccaccccaactagcactaccaccaccaacaccaacaacaacacaaccaacagtagtaacctgtctattttctttgactcccaagaagagattgacaatgacatttctgcctccatagacttctcactctctccatctttcaatgttcccccatttctcccagtctcatcccagcaagaacagtttgatttctcttctgtgcagcatcaggtccaactagcagcatgttcggttgtggagggcttcactcagtatcccactgacgctgttgcacctccttttatgggggctccattaccttctgtttttgaagaggactgcatatcttcagtcccttcttatatgcctcttaacccctcatctccttgcacttatctcagtcctggcatgccaccatacatgcctcatggcccccttactactgccttatcaactgatagttctggaatatttggtgggaacattcttcttggttctgaacttcagacacaagaattggaataccaaggagaaaatggaagaatgtattgtacagattcaattcagcgggtgtttaaccctccagaccttcaggttgcagcagtaaggttcttgactataaagagtggctttacaagaggtgaaaaatctgcaaaagataacggtccacaaatttctaagaagctgatatgccccatagaatatatgcccatatccatccatacagtagctagcatatcaaccccttttataatctcattctcacctgtaaaaagtagcataaaatctgagctagctaaaatctcaaacttagaggactcctccttcaaggttggaaaactttctgttgagcaaaggaaagaaaagatcaatagatacatgaagaaaagaaatgaaagaaacttcagcaagaaaattaagtatgcctgccgcaaaactctggcagatagccgacctcgagttagaggaaggtttgcaaagaatgatgactttggagaaaccaatagaactactagtagcaatcatgaagaagatgatgaagaagaagtagttatgaaagatgaagatgatatggttgattcctcagatatctttgctcatatcagtgggctgaactccttcaaatgcaactattccatccagtcctggatttga

SEQ ID NO: 1006 - DNA, 2782 bp, Glycine Max
acgggtgaagaattttctgccgagttcttacgtgatcgggttgcctcaaggaaatttcctgtcattactgatgcagaccagcatctgccaaacaggttggatgctaatattagagaaaatagtcctcaactggtttatgaggatctaaagcatgttcttgggctaaggagaacagaatctgatagtaactcagatttgttggagattgcttcagtcagaggatatgttgatgaagttgacagcagggcttatcctaataatttgaacagataccagtgtgaacacagcggtttcagacaagcatcaggtacattttctagacaactgtcaggtaaattttctgagggaaatggttgtgatcaagttaattcaggacccaatgctccatctgtttacgtcgttgagtctcctcattcatgccatccttatggatcagtattctcagaaggttctttctataagaagataaagtttctgtgtagctttggaggtagaatactaccaagaccaaatgacgggaagctcaggtatgtgggtggagagacacggataatatcaatcaggaagaacataaaatgggaggaacttatgaggaagacttctgctatttgcagtcaaactcacattatcaagtaccagcttcctggagaagatcttgatgctcttatatctgtttgttccaatgaggatcttcatcatatgatcgaggaatatgaagagcttgaaagagctggaggctctcaatggctgaggatttttctcataccttcaaatgaatgtgagagtccaagttcaaatgaagcaagagtcaatcagccaagtgatgcagattatcattatgttgttgctgttaatggtatgctgaatccaagtccacaaaagaattccaatgggctgagtttggcaaaccatactagtcagtttggaaataccactgattacaacagtccacatttctatagagactcatccacatctgcatttgcttcagagatgaaggattgcaccccaacttctccaaatttggtaggcatactctcaaaacctggttctcaatattttacagccttagcaggcaagtcagtcaatcaaatgtctcctttatctcccgcttgtgtacagcctacagatcccaaaatttctaatgtacagatatttaaggataaaccatataatgctatcaatgaaagcatcactccctttgttacggaaaaagttccatgcaacaattctttgtatgtagacaataccaattatattgatccagttgcataccataataaccaatatatagtgaaatctgacctgatcaggaaacctggcaagaatcttcatcttcacagacggaacaacagcagtaatgagtttgtctcttctacggcatgtagtctaactgacttgattttcgagagacctttagtcaccaatgaaggttcatatcattttaacaaggttgtctctcgtcctcatgagtcgtcgagtttattctcagagtctgatgttagagaggggtctcggtacagaatgttgcatgcacattctgactcaacacttaaggagaatgatgagaactataaagttcacttgcaatttccccttagcgtagagagagacaattttccatcattgaaaaattcatgttctttagaagaatgttcaatacagcctggaaagacaattgataggaaagaacactcagcaaagtatcaaaatttgcccatttttggaatgacggatagttttaatgtgtcagaaaagggtaaagagatcttgcaacatgcagataacagcaatgatttctttaatgaaaatgttggagctatgtcacaagacaattccatagatttaaaacatttacagtacatttacaccccacatggtgtttgctcttcttcaccagatttccaaagcagtgaatgcaatttatctactgcatcatctatctctttggaatccacaagaaacctgagggggcaaccacatggtctatcattagacagaactgcttctgagttttccacgaggagccaaaattcatcaatgcatcaccaatatgctatgccggagacaaaagacggtcaaccactttttcctggctcttttgagtcccaaactgagagagggtctatactacctatctcatatatggacatgggttcttccctaagagaggttgttatccctgttgaagatcctgcatacaacctgcaccaaaaggaacaaaacacagtcattaagaatcagtgttctgaatatatcaatgaattctgtgtcaacaagcctgtgccagaatcagtggctgttgtcaagggagcaatggattatatttcttcaggtatccagtcatgcctaaaagatgtctcaaatgtagatgaagaggctgaagttgaacctacatctcctgaaaaggaagggatagaatgtgataatccagaatctgaaagtaagactaaagatttttggagagaggcacagattctgtcaactcttcaccatccaaatgtggtagcattttatggggtagttccagatggcccaggtggaacattggcaacagtaaccgaatacatggttggagattttggcctatcccgaattaaacgcaacacacttgtttccggtggtgttagaggaacccttccatggatggcacctgagttactggatggtaacagttgtagggtatctgagaaggttgatattttctcatttggcattgcaatgtgggaaatcttgaccggggaagaaccatattctaacatgcactgtggcgctatcatag

SEQ ID NO: 1007 - DNA, 1101 bp, Glycine Max
actgcaatagagagtacatcacagttggtgccattcccattgttgacgaatgggaattacacagcatgcaccattccttggaggttcccttcagacgatccaagcattcccactcccaccgagctatcttggattaatctcctcctcaatactatccccaccttcaagaagcatgctgagaatgatacttctgttcctgatgctgcaaataaagctgaaaattttgctcaaaggtatgctagaatacttgaagatttcaagaaagatcctgcaagtcaaggcaggcctcttgatatccttattctatgcagacttcgtgagcaagtccttagagaacagggattcagagatatcttcaagaaaataaaggatgtagagaatgcaaatgccatatccctatttgagaatgttgttcgtcttaatgatgccattgaagatgaagggaaacgactagagaatttagttagaggaatttttgcagggaacatatttgatcttggtgcttcacagcttgcagaggttttctctagggatggaatgtctttttcggttacttgtcaaaatcttgtccctcgaccttgggttatagatgatcttgaaactttcaaaatgaaatggagcaagaagtcctggaagaaggcaagtgtaatcatatttgttgataactctggtgcagatatcattttgggtattctgccatttgcaagggagctacttcggcatgggagtcaggttatattggctgctaatgacttaccttccctcaatgatgtgacttatgctgagctacttgaaattatatcaaagttaaaggatgaagaaggatgtctcatgggtgtcagtacttcaaatcttataattgccaactctggaaatgatttacctgttattgatcttacaagggtgtcacaggaacttgcataccttgccaatgatgcagatcttgtcatcttagaagggatgggtcgtggaatagaaacaaatctctatgctcaatttaaatgtgattccctcaagatagctatggtaaaacatcctgaagttgcggaatttcttgggtcacgtttgtatgattgcgtgatcaaatatgatgaactttag

SEQ ID NO: 1008 - DNA, 726 bp, Glycine Max
actgtgtacttgcgcgtccttacccttttttctgtctttgcttctcttttcaaggctaattcgtggcctcgtcttctctttttctgtatcgtttttactttcaaccacttccaattttctttttcgtcagatcttaataccatcatggaggatgctgctgcttctgctgctactgctaatgtattggaagccaaagatggtactatttctgttgcttcagcatttcctggtcatcaagaagctgtacaggatagagaccacaagttcttaacaaaagcagttgaagaagcatacaagggggttgaatgtggtgatggaggcccatttggagcagttgttgttctaaatgatgaagtagttgtaagctgtcataacatggttttacgaaacactgatcccactgcccatgctgaggttactgctataagagaggcttgtcaaaagctgaatcaaattgaacttgctgactgtgaaatctatgcttcttgcgagccttgtccaatgtgctttggtgcaattcatctttcaagaattaagagactggtttacggagctaaagcagaagctgcaatagcaattggatttgatgatttcattgccgatgcactgaggggcactggtttttatcagaaggctcagttagagatcaaaaaggctgatggtagcggtgctgttattgcagaacaagtatttgagaagacaaaatccaagtttactctgtactga

SEQ ID NO: 1009 - DNA, 900 bp, Glycine Max
agaagccacaacagacaatatatgttgactaagcttctgtctactaagaagttcatgcatagcttggacttggtgaatgttcgcatacttcaagacatttcagggtcatttggcacgacagtattcttggttcctggtgacttgagaaacttaagtcaagggaaagatgaaggggttgattcattatataaagacgtaagactctgtatatgttctttgtgccttataagggtggggtcaggtgctgcacctttgagcaaggaagtggcacaagagtttagaaggatgtttccttgggttgaactaaggcaaggttatggcctaacagaaagtagtggtggagcagcattttttgcctctgataaagatggtaaagctcatccagattcatgtgggaagttgattccaactttttgtgcaaaagtgatacgcattgaaatggggaagcctttccctcctcataaaaaaggaaagttatggttcaaaagtcctacaattatgaaaggatatctaggaaatttggaggccacaagtgcaacaattgattcagaaggttggctgaggactggtgatcttggttacattgatgagaatgaatttgtttatatagttgaacgaataaaggagctaatcaagcacaatggttatcaggtggctcctgcagaattggaatctgtgctgctaagtcatccccttatagtcgatgcagcagtcataccctgcattatcctctcacattttcactcccatttttcattatctgtcctggttctgaactcagaagaccaagtcattcaatttgttgcaggccagctccatataagaaagttcgaagggtgttttattgacactattccaaagtcagctgccggcaagatattgtgcaaggatcttttatga

SEQ ID NO: 1010 - DNA, 684 bp, Glycine Max
agccagactcgagccaataataagtccttggcgagatcactatatctaaagaaaagagtgaagattaatgtgagtgcaattttgaatagaaccaagatggccattttttcaagtcaccacagaatgttggtgtctctcttgcttacgttggtccaaatccaagccaaggtgttttgctatcaatacaaagtgggagatctagatgcttggggcatacccacatcagcaaatccacaagtctacacaaaatggtccaaatatcataatctcacaattggagactcccttttatttctatacccaccaagtcaagattcagtgattcaagttacagaggaatcctacaagaggtgcaacattaaagacccgatattgtacatgaacaatggcaactctttgtttaacattacatcaaagggccaattcttcttcactagtggtgagcctggccattgccaaaaaaatcaaaagcttcatatatctgttggtgaaggaataatagaaactatggatacagcacctggtccaagttcgtcattgcctgcatctgcaccctcctatcccacagtatttggcaatattccagtagctccttcaacctcaacctcacctcaactcacatcaacttttcaacttctcatcattggatttatgatatgtgcgcacttcgcttccttaatgtga

SEQ ID NO: 1011 - DNA, 627 bp, Glycine Max
aggaaggttgtgcagagccatttggtgagattgtttgcaaaagtgggtcttatactgcacctttcctcttctatattctattcatattgcattttgctacttattggcattttttctaacctctctataaaattttccttgtttcattatggtgataataatgctccatatttctacatcgctataatttggaatatacatgcattcatactctctttttcgacatacacaaacaacaactttatctcttatctattgagtatagaatatatcatagactcagttgaatattgtaagttaaaaattaatgacctctcattatattcactctatcagcagtaccacaatgccaaagtccgtcaaggaatattttattgtgttaaagccaggaggcatggtttttttagggactatggcctctgtgatatgaccatgcttcgatttgagccagacaagcaagtgggattcagggaatacatgcggtcagatggaacacgatcatatttcttttgtttggatactgtccggagcctatttttgggtgcaggcttcactgaggttgacttgtgctcctgcatacaccgtaaaaaaaaagataggtacatgttaattaacgcaatggtttag

SEQ ID NO: 1012 - DNA, 1542 bp, Glycine Max
aggaggtggttgctcaaaaggggactctgtctgggaaggaagatcttagtggctggcttcttagcttctgctgccccggtggttgttccacctcttgtggttgcttctgctgttggcattgttgtttctatgccttgtgctattttcttggctagccatgcttgcactcagagtttaatgagtaagttgctccctaggcctactcctcaggatactttgttgcgtgaagagatgtgttttcagacaggcaatgatgttatacacacatatgaagaggaacaagtccttgtatatgaaataaagagagacattgaaatggttggtgttcaatgtttgaagaatggggaaaatatgacatcagggagtgagtgtggtccacaagaagaagatgccaccgatggaatagaaggacactcaagaggagaaactaatggggtgcaagtgcaactaataagtggggataaaaatgtagttgtgacaatgattgaagaatttaagactccctttgatgttacaactgtggttttagaggaatccgaggatcaggccatggaggaaaaaattagagatgaagctagaactgatatgacacgggagagaggagaatatgtagaaggaatatgtggaggggcaaatgaaagtgataaaaaatttggtccagctgttgaagatatggaggtagcatgggaagacacacatagtggtatcgttgaagaagacttgggaaaggaacaagatccaaatgtatgtgaagagatgcttcattcaagaaatgatgaaagtaaggatactatgttagaaggaaaagtatttgataacacaaatgattcacataagccaatggctgaaccttctgaactgctgattccagctgaaccaattggagatttgcctatagaagcgctggtttataatatttcagttgaggaggactcgtctgaaaatattgacatacatatagttgccaaagaggaacaggagcctccgccggattgtcctactatactgcaaaatgagaagttagataataacaattctgactttgaaaatcaagaatcacagctgcatgaattaaataaaaggacgtacccgctagatgcagaagctatagaaattgctaatgaaggtgaagttgatttgtttgatggaaaacggatagaccctgacgagtgcggatacacaatttatttgcatgaaggatcttcaaaagttgatgggcagacagattctacggaggttcttgtttcgtctgtagaagaagagtccaggccatctgaatgttcctctggagaaaacattgtttgcccttctcaagaggttgttgtattggatgaggagaagatatggaaagcgatgaatattatacgtaagatagtaggatatgaaggtagaatgcaaggatcatgttcagatgaattaaaggctctctacatcttcactggagttgagcccccaactggtactctcgatgaccccgctgaaatcaaggagaagctccacttccttatgtccatcgttggaattaagtcgaatgatgcttag

SEQ ID NO: 1013 - DNA, 1359 bp, Glycine Max
aggcaaatgggattcttagagagcgaggttccagcagagctgtgtagattggcagatgagtatttgataaaacccaaggagtgtgtagaaagcatccttgaatatcttgctcatcagaaggatcctaccactttatgccagaaattgattgatgagtttgaccgatgcatcctcagttatttcgcatttaattggaaccaagcttcttatatgattagtcaggtattgagtgttgagtcacctcagaaaatacggctaaaaaagattctattggaagctacaagggaacagaggtttgagagagtaaccaagaatctgaaggtggcaagagtgttctctacattggtggaagagatgaaagcaataaaggttgactcacaaaaaacaaacgacatagtccacactgtccacactgagaggagtccagtgcttctgcttatgggaggtggcatgggagctggaaaaagcactgttcttaaagacattcttaaagaatcattttggtcaggagcatcttcaaatgctgtggtggttgaggcagatgcttttaaggagagtgacgtcatatatagagcccttagctccagaggtcaccatgatgacatgatccaaactgctgaattggtgcatcaatcttccactgatgctgcatcatctctgctggtgacagctctaaatgagggtcgagatgtgatcatggatggtaccttatcatgggaaccatttgtggagcagactattgctatggcaagaaatgttcacaaacacaggtaccgaatgggggtaggatataaagtatctgaagatggtacaacaattactgaagattactgggagcaagtaaatgaggaggaagaagaacatcaatcagaggaaaattgtaatggagaaccacgcacacgaaagccttacagaattgagctagttggtgtggtttgtgatggctatcttgctgttgttagaggcattaggagagctattatgacagggagggcagtgagggtgaattcacaattgaaatctcacaaaagatttgctaatgcatttccaagattttgcaaacttgttgatgatgccaggctctattgcacaaatgatgtgggtggtccaccacagctcaaatggcggaaggatgatgatcagaatctgccatatcccaaagatataaaatgcttggaaaggataggcagtgtaaatgttgaagctgattccatctacgaactttacaaggaacccagccctataatggaaccaggttctgtttggaaagacattgttctttcaccttcaaggtctaatgatcagaaggaattaaaggaatccatacagaaaatagaaaaattcatcagaaaacggtaa

SEQ ID NO: 1014 - DNA, 804 bp, Glycine Max
agtggaactactacgataaatttgctgccggagggatgcatctcatacatactgtcctacactacacccgtggatgcatgcaggctctccctcgtttctaaggccttccgttcagccgctcaatccgacactctatgggatcgttttatcacctccgctctatcctctctcgtttccccttcttccttcccttcctctcactctaagaagcatctctatttcgctctctgcgaccgtcccatcatcatccacaatggtacaaagagcattcaattggacaaaaggactgggaaaaggtgttacactctttccactagagtacatctcatcgactctgagtggggtctggctcctcttcaatgggagcacatacgcctgccaaattccaggttccaacaatttggtgtgcttgttagcgctcctgaggcctggtttgacattagtgggaggataaaagccctttccctgtccccaagaactgaatatgcagcttttcttttgttcaagatggtctatgccacgcccaccgaagttcattaccatccttgggtgttgggctatttagtaattactcttccagacagtagcagtgtgaggacaatagatgtttgtttgctgaagaacttacagcaacattcttgtgtgagaagaagcgatgggtggttggagtttgagctggtagggttctttgatttgggcctagaagatgaccaagtgcagataatcaaagtcactgacacaaggcctaatagcaactggaagcacggtttcattctcgaaggaatagaaattaggcctaaacat

SEQ ID NO: 1015 - DNA, 177 bp, Glycine Max
ataataaggagtttcattattgcccgccaaaatggagcttactacagagaaggatggtttctatttgctttcaggacaatagggttaataattcctggggtacctgctcatggtccacaagattactttaattctacccttttaggaaagattgaaaaacacttcaaagtagagtga

SEQ ID NO: 1016 - DNA, 1941 bp, Glycine Max
atagatagaggctatggaaacctaagaaattgtacgaatcactcttcgaccaactcaactccaccttcggctgtggccaattgttcaagacctttctctctcttgatgtcgcccaacgtggcgctatattttccagttaattgctcgattttatcgtacatgataatttgtttcaatttggatggaactgaatgtctatgggataaggattttgcaaaaggggttgtccggtgcatgaggctcctacctggtgaggatttgaattgtaacttccaggtcaccaggcaacaacttactgttgtgccaaggcttgtccctctaatatttatgattgttacagtgtatcaaaaaatatttacatttttgtgcattgtttcttgctggagttctatccatctaaatttgaacatgttatctcaggtatttgcagatgagcttttaagaaatcaatctttgagaagatatcttatgaaggttgattcagtgtcttccaccattgaaaaactttttgtgtgccatttcaaccaaggtgatattgccagtgtcctggaggtgataactacccatttcatcatgtcagtttctaatgagaaagcatttgaggatttcacaagtggatttttttttacattccttgcgccctccatgatgttactgcttgaccctgttgtgttttctgcaccaaagatgttccaggcacacacattttcaatggtttctgaagccattggttctggcttatctgcagagattttagctccagatatgaattgcgacctaacagcacttcaaaaactattatctttgactctatgcacgtgtctattgaaatgttcctataattcatacctgcttgagagagatcagctaacttttaaagcttatatccagcaaggcacaaggaacaaattaaatcaagtcttatcaaaatcagataattcatgggactcctatcaatgcaaaatgtcttccaaaacaaaagctgaccttttggctgactacattgcatttatgaaagatagacagtacatatttgttgattcatgctgggacgcgactaccttaatcttagattgtattatccatcaagctttctctcaggatgccattggagatgcagtataccatataaaggaaaatactagtgcccaagacatacaccttcttgcatccatattgaagttgatgagtgcttcattgctgcagacaattaagtatctaagcaatagtgagatcgagggtctcttgttgtataagaattttgaacacaaagaaaagattgtccttgtgtgttcaaaacttgtaaaaggattttacaagatagtggaactctcaagcgggttgcttggagactggaccatcattgaccattttcaacaatttaagttctgtttaccaattcaaactttattgtgtgatgcgctgaaaactcagcaatcaaattacaaagtctccaaatcaatgcttgtgcactttataggcttcctatctttaagttttagcaatggatttgatttgatttgcttgctaagggagggagatttagttgctttggggtcattgaggggtctgtcattgcaaccttgctcgtctgaaattccatctgataagagtggaaaggtgaatcgtgccttcatttctcatgctaaattaacaataaatgcttgcttaagtgaatggagtgttggggatggaacagcgaaaacctgcaatggggaaatgttccttaattgcatattagaagaccccaaaaagctatctgattatgatgatcttgcagatttccttgagtgtaagacggggaaaaattattccaagtggttgaatggccgagaagtatatacaaaccggaggtatcagaaaaaaatagatttaaggaaaaagaagaaggaaacattctggaattcttctaacattggaggtgatagatctgacccatga

SEQ ID NO: 1017 - DNA, 321 bp, Glycine Max
atatatatgttctacaccccttgcatagttatattaatcatccgacaaggagatccaattctgacctcaaatgcagtctttattgatggagatcaaagtagtaagtctacatcacatgaactcgtactccattatttaaaaataaaaataaaatacttacattcagctatctttttggcacctaattactgtggagagtttgacaatgttgctgctatgatgactgatacccttgtgtgctgttttcaaatattgaagcctctagataaaatgcctagtaaattcttaaaggggtggcataacaataaggttttcttgtga

SEQ ID NO: 1018 - DNA, 1986 bp, Glycine Max
atcaatccatgcaaatccaaatgctcgctgaaaaattccaccgatttgttcttgactgcgaactcaagcaaccgtcaatcgctcagtgctctgaaaactacaaaaataaatggaaaattgaatattctctctctctctctctctctctctctctctctctttatggttagtttagttataatactaaggttttgcgattttctactggtattaggtgctgaatacgaactcttaaaaagaaagtactcagaggagtcctctgaacggaggcggctttacaatgaagtaattgaactcaagggaaatatcagggttttctgcagatgcaggccattaaatgagaatgaaattgctaatgggtctgtatctgttgtcaattttgagtcgtcttcagataatgagctacaagtcatttgcgcagattcttctaaaaagcaatttaaatttgatcatgtgtttgggccagaagataaccaagagactgtttttcaacagaccaaacccattgttacatcagtattggatgggtacaatgtctgcatatttgcctatgggcaaactggaactgggaaaacatttacaatggaagggacaccagaacacaggggagttaactacagaaccctggaagaattattccggataactgaagagagacatggtacaatgaagtatgaattgtctgttagcatgctggaggtttacaatgagaagataagagatctcttggtggaaaattctacccaacccactaagaaattggagataaagcaagctgccgaaggaacccaagaggtcccaggacttgttgaagctcgtgtttatggaacagaagatgtgtgggaaatgcttaagactggaaaccgagtcagatcagttggatccacctgtgctaatgaacttagcagccgttctcattgcttgttaagagtaactgtaatgggggaaaatttaatcaatggccagagaacaaagagccacctttggctagtagacttagctggcagtgagcgtgtggggaaaactgaagctgaaggagaaaggctgaaggaatctcaattcataaataagtcactttcagcacttggtgatgttatttccgcccttgcttccaaatcatcccacatcccttacaggcaattcccttttcctctcttaaacatgaactcaaaactcactcatattctgcaaagctctttaggaggagactgcaaaactttaatgtttgtgcaagtgagtccaagttcagcagacttgggagagacactttgctcactgaatttcgccacccgtgtccgtgggatcgagagtggcccagctcgcaagcaagtagaccacactgagctgtttaagtacaagcaaatggctgaaaagctcaaacaagatgagaaggaaacaaagaaattacaggatagcttgcaaatcatgcaactcaggcttgcagcaagagaacatcattgtagaagccttcaggaaaagattttttctttgcaaagtgattcacaattttcttatattccacgacaggttcgggacctcgagaaccagattgcagaagaaaggaaaaccagactaaagcaagaaagtagatctcttgctgccgttacagttcaaccctcatcatcaacagctcataaaaccatgacagacaagaagcctccactgaatccttcaaaactgagattgccactgagaagaataaccaattccttgcctccacggtctcctcttagatcaaagagttacactgccttcatgagtggaaaggaaaactctgtcagaaggaactcaatggcgacaaatgctgttaggccagcttcaccatcaacaacagcacagttccttcaggcaaggaggcgggtgtccgttgctgtgagaccccctgcaccatcaacaacgcagccaacaatcacggataagaagccaaaggaaagatcggtattcaagtttgttcgccccattgccagagttgagaacatcagttga

SEQ ID NO: 1019 - DNA, 1692 bp, Glycine Max
atcttagagaaagtggaatttttggagcaaacacaaagcgtactcacagagatggatgatgatatgggtatgtttgacatgccgggaaatgcagttttaccactggattgtgaaaataatgatttaaatgggttcttggattccatttcttctgcaactctagttgtattatcagatagggatagtgctgatgtgcttttgaagcctaactcttctacgaacaatttaattgccgaaaacccatattttggccaacaattggtatcctgtgtaagtgcacaagaagatgcagatgatttggcattgacctcattgtgcagtatggacagagggtcatttcaaggcaaattacaaaattcactcgataaccaatattcaactcagtccagtgttgtgacagatgttgatttttcctcgagtttaaatgcattgcatggactctctgagaacttagagcgagttgatatgtcagaagaaattttgaaattcagctccatggaagatctttgccagtggtttggtccttctcccaaggataaatttaatcccacttcctttgatctggttggatctagttctttaaatgatatttcagtgacatgcctaactggacagaattccaactcagaggggaaagaaacatctgtagttatgcatagcactgaaaacgctctcttggataacctgaaacttgattttagctatgaccaagctgatgaatggtgggggaatatgcttacaccagtggtgagtggtgttactgatactggcttctctgaatgcatttcagagttgaatactgatatcccaactggcacccgaaagagattattctcagagttaggaattgatgagcttttgaggggtgaagcaaattacaatccttttaatagttcagaacttgagcatgagttattattacccaataagaggcagacagtagaatcttcatcagtgaatagaaattcaatacctttcaccaaccttcattggcctggcatgtggaatgatgatagtcatagcattaatattgggaaggctgttccagtacaccctcaaaagccagaggaacccgcaaagccacccaagaagagggctagggcgggggagagtactcgaccacggccaaaagatcgtcagcagatccaagactgtattaaagagttgagaagactcattcccaatgatggaaagtgtagcattgattctttgttagaccgcaccatcagatacatgcttttcttacaaagtgtcgtcaagtattcagacaagctacaggaaccaaatgagcctaaggcaaataaagtggttctaaaagacagtggtgcagcggatggcaaaaactgtggcattacatgggcatatgaagtagcacaccaaccaatgctatgcccaattatagttgaggacatgagtctacctggccaaatgcttatagagatgctttgtgaggagcaaggtttcttccttgagataattgacattattcggcatttcgggctgaatatcttgaaagccaagatggaaagaaggaggaacaaactatgggcacgctttattgttgaggcaaacaacagacacgtgacaaggatagatgtgtttttgtccctaatccgttttctacagcaaacaaacacctctggcattgattcttctaataagaattgcgacgttattgatgccaatatttag

SEQ ID NO: 1020 - DNA, 540 bp, Glycine Max
atgaaaagttttgcttttctatttaatttagtctttttgttggccactacttacactgttggagatagctctggctgggacattagcacaaatcttgatacatggattgcagataaaaatttcaaagtaggggatgctcttgttttccaatattcatcaagccaaagtgtggaagaggttacaaaagaaaactttgacacatgcaacaccaccaatgttttagcaacttatgggagtgggaacacaacagtgccattgacaagagctgggggcaggtattatgtatctggaaacaaattgtattgccttggagggatgaagcttcatgttcacgtagaaggcgatgacaaatcactagcaccaactatagcacctaaggctgtggctggaacagatcaaaacacttccacacttccgcagtctccttcttcaaagaaaaacacacacttttcggcaggagctgcgaattgtgcaagggatgcaattcagttagtttatattgctctcgtggctgccgtatatgggatgatgaagatttga

SEQ ID NO: 1021 - DNA, 2811 bp, Glycine Max
atgaaaggggggcgatcgcaccgccctcggagctcggacccgccggacgagtgggtggacgggtcctggacggtggactgcatctgcggcgtcaccttcgacgacggcgaggagatggtgaaatgcgacgagtgcggcgtgtgggtccacacgcgctgctcgcgctacgtgaagggcgacgacaccttctcctgcgacaacaacagcactaccaaccccatggagaccgaggtcgcgcagttcctcgtcgaactccccacaaaaaccatctccatggacaataaaaaagccctcccctccaggcccaggctctggaccgacaagcccatcgaggagcgggtccacgtccagggcccaccgggcggcgacccctccatcttcgccggccaaagcgcctcctcgattttcacgccccagctctggaaggcatgcgggtatgtccccaagaagttcaattttaagtacaacgagttccctttctggaataataacaacgataaggagggtgtgccagcaaaagatggtaataataacgataatggggttggggtgtctaaagaggctaataacactgctgctgctccccctgttgcgccttcggttgaaacgagatctggtcacgccaaggacgcggacacgggcaagtttgggagccaggatgtgccgccacgtgtccacggtgacgtcaagaaggagcggactctgctgaggcctccggttgttcataacattccaaggagaggattgggaagaaacgccttaggacttctgacagggaggcatgagcaaacaccatcagctatggtggtgtatcacatcttggcatgcttggcgtgtgcttttgttgactccatttctttgtttctcctttgttttggatcaaagatgttcaaggctgatgctcggagcataaagaataaaaacttaaaagacatggtggttcaagagcatgtgtctgatgatcctgttgctgtggatactatcatggaggagtcaaataacaacttaaccactactgaggactcctcagaaccgttatatcctgacatgactaaacatggtgtttctgttggagatgttgtagcagaagagaaggctagtcgtaaaactcctactttggttgagatgtcttctaagactgatgatgctgttacatcagctttaaagcagaattatgttggaaatgcttcagttaaagaaaaggatggagattgcttggtagctgataatgcagatgatgctttagtagtaagaagcgctgctagtcctcgcacagaaggtcattgtgtttctgcaccagaacttgtggataaccaagtttctcaagatcttggccgtaacatgcgtcctagctctgcaaaatgcaaagttaagatggggagagatgataatgttgataattttcggaagccctcaaattttcattcttctcctatcagtgatcataaaaacaatgaaaaaccatctgatcacacatctgatattgttaaagtgaatgatgctccagttcccagtttaccatcatgtgaaagtaaggtgggtggtgttgacatttcatcagaactaatccctgctgatcataccaataaaccaattgaattatctggtgatttttgtcaaagaaaactagaaccggtggggtctgaaggttccttggaaacacaaaagggattttcagaaacaaaagatggtttggatgctgctaaagatccatcaaaatctgaagcacttggatgttcgcctaaagttggaaagtcatctccgacttcatcaaccatgaactccaaatcattgggtcatgactgcagatctgaagatactgaaatccctaattcttttacgaagcatggagtgatggctgatagtaacattcacacaaagaatgaaaattgtccaagtgttgctgccagggatgaaaattcaaagaagtctgtaaaagagcgaccaaaatcctctttgaattccaattcaaaaggattgcattcaagcaggagtgtgcaaaattctgtctcaaagcaagtgaactcagatgcgagagattctgttcatgttttgtcttctaaacctttgatacatcagactgcaagtattttaggctctagtgagtctaaccatcagaaggttttacaagtgcagagtaagatttcttcttcagcgccccagaaagttgaaaaacttaaccaaacaaacatccacacttcctccaagttgaaccaaagtcatgttccatcagtgaatccttctttaatatcgaattcttcaatgctgagtgatgaagagcttgctctgctattgcatcaagaactgaatagttctcctcgtgtacctcgtgtaccccgagcacgccatgctggtagcttgccccagttgacttccgctagtgctacaagcatgctgatgaagcgaacatcgggtggaggaaaggatcattattttgcatctagacgaaaacacaaggatgcatctagagatgggtctggcagttctcgtgaacttgaatacgaagctaaaaggatagagaaggagaagggtccatcctcgtctgatcagaggaaacaggatatgtcatacgcggaagatgctcctgcaagggaagaaggccttgcatctatggcagcagcaaactccatcaccaacaatactgtttcttccacctctggaattgcaaacagtgatgcatccactcctcctgaggatcagaatttgtcatctatgcgtaactcacctaggaatgtatctgatgatgatacagcaactgctggaaggccagttcatcgcaccttacctggtagctccctgtcagggaaataa

SEQ ID NO: 1022 - DNA, 3222 bp, Glycine Max
atgaaaggggggcgatcgcaccgccctcggagctcggacccgccggacgagtgggtggacgggtcctggacggtggactgcatctgcggcgtcaccttcgacgacggcgaggagatggtgaaatgcgacgagtgcggcgtgtgggtccacacgcgctgctcgcgctacgtgaagggcgacgacaccttctcctgcgacaacaacagcactaccaaccccatggagaccgaggtcgcgcagttcctcgtcgaactccccacaaaaaccatctccatggacaataaaaaagccctcccctccaggcccaggctctggaccgacaagcccatcgaggagcgggtccacgtccagggcccaccgggcggcgacccctccatcttcgccggccaaagcgcctcctcgattttcacgccccagctctggaaggcatgcgggtatgtccccaagaagttcaattttaagtacaacgagttccctttctggaataataacaacgataaggagggtgtgccagcaaaagatggtaataataacgataatggggttggggtgtctaaagaggctaataacactgctgctgctccccctgttgcgccttcggttgaaacgagatctggtcacgccaaggacgcggacacgggcaagtttgggagccaggatgtgccgccacgtgtccacggtgacgtcaagaaggagcggactctgctgaggcctccggttgttcataacattccaaggagaggattgggaagaaacgccttaggacttctgacagggaggcatgagcaaacaccatcagctatggtggtgtatcacatcttggcatgcttggcgtgtgcttttgttgactccatttctttgtttctcctttgttttggatcaaagatgttcaaggctgatgctcggagcataaagaataaaaacttaaaagacatggtggttcaagagcatgtgtctgatgatcctgttgctgtggatactatcatggaggagtcaaataacaacttaaccactactgaggactcctcagaaccgttatatcctgacatgactaaacatggtgtttctgttggagatgttgtagcagaagagaaggctagtcgtaaaactcctactttggttgagatgtcttctaagactgatgatgctgttacatcagctttaaagcagaattatgttggaaatgcttcagttaaagaaaaggatggagattgcttggtagctgataatgcagatgatgctttagtagtaagaagcgctgctagtcctcgcacagaaggtcattgtgtttctgcaccagaacttgtggataaccaagtttctcaagatcttggccgtaacatgcgtcctagctctgcaaaatgcaaagttaagatggggagagatgataatgttgataattttcggaagccctcaaattttcattcttctcctatcagtgatcataaaaacaatgaaaaaccatctgatcacacatctgatattgttaaagtgaatgatgctccagttcccagtttaccatcatgtgaaagtaaggtgggtggtgttgacatttcatcagaactaatccctgctgatcataccaataaaccaattgaattatctggtgatttttgttccttggaaacacaaaagggattttcagaaacaaaagatggtttggatgctgctaaagatccatcaaaatctgaagcacttggatgttcgcctaaagttggaaagtcatctccgacttcatcaaccatgaactccaaatcattgggtcatgactgcagatctgaagatactgaaatccctaattcttttacgaagcatggagtgatggctgatagtaacattcacacaaagaatgaaaattgtccaagtgttgctgccagggatgaaaattcaaagaagtctgtaaaagagcgaccaaaatcctctttgaattccaattcaaaaggattgcattcaagcaggagtgtgcaaaattctgtctcaaagcaagtgaactcagatgcgagagattctgttcatgttttgtcttctaaacctttgatacatcagactgcaacgccccagaaagttgaaaaacttaaccaaacaaacatccacacttcctccaagttgaaccaaagtcatgttccatcagtgaatccttctttaatatcgaattcttcaatgctgagtgatgaagagcttgctctgctattgcatcaagaactgaatagttctcctcgtgtacctcgtgtaccccgagcacgccatgctggtagcttgccccagttgacttccgctagtgctacaagcatgctgatgaagcgaacatcgggtggaggaaaggatcattattttgcatctagacgaaaacacaaggatgcatctagagatgggtctggcagttctcgtgaacttgaatacgaagctaaaaggatagagaaggagaagggtccatcctcgtctgatcagaggaaacaggatatgtcatacgcggaagatgctcctgcaagggaagaaggccttgcatctatggcagcagcaaactccatcaccaacaatactgtttcttccacctctggaattgcaaacagtgatgcatccactcctcctgaggatcagaatttgtcatctatgcgtaactcacctaggaatgtatctgatgatgatacagcaactgctggaaggccagttcatcgcaccttacctggtttaatcaatgatataatgagcaaaggcaggcgtatgacatatgaggaactctgtaatgctgtgctaccgcactggcataacttgaggaaacataatggagagcgttatgcttactcaagtcactctcaggctgttcttgattgtttgaggaaccggcatgaatgggcaaggttggttgatcgtggtccaaagacaaattctaataggaaaaggcgtaagctggatgctgaagagtctgatgataatggatatggcaagggaagaactgcaaaagatgttgaagggaagaactttgagttgcaaaaagaagagttccctaaaggcaagcgtaaagctcgaaaacgcaggcgccttgctcttcagggaagagcagtgaaggatgtcagaaggagacagaaagctgactcgctaacggatgaggatctcggtccattctccaattctagtgaagagagcatgttcagtgaagatgaaattcaggctggcagaatacgtccagcaggaagttcatcagatgaggcaggtagtgcctaa

SEQ ID NO: 1023 - DNA, 1626 bp, Glycine Max
atgaaattgtgtggaagtatatggttatggctgatacttctgctggcttcagttcaatcactgggatctgagaggacggatgtggcatacgtgactctattgtacggagatgaattcttgttgggtgttcgagttctcggcaaatcgatacgcgacacgggatccaacaaagacatggtcgttttggtctctgatggtgtctctgattatgccaatacccttctccaggctgatgggtggatagttgagaagattagtttactggcaaatcctaatcaagtacgtccaaagagattttggggtgtctatacaaagctcaaaatatttaacatgactgactacaagaaagttgtttatcttgatgctgatactattgtggttaagaatattgaagaacttttcaaatgtggaaaattctgtgctaatttaaagcattctgagaggttgaattccggagtcatggtggtgcagccatctgctactgttttcaatgacatgatgagcaaagtaaaaactctaccatcttacactggaggggatcagggatttctcaattcatattactctggatttcccaacgcacatctttttgagccaaatttgtccccaaaaatgttggatactagaccagttcctgaaatggagcgactttccacactttataatgcagacgttggtctttacatgctggctaacaagtggatggtggatgagaacgaactccgtgtaattcattatacactaggccctcttaagccttgggactggtggacatcttggcttgtgaaacctgttgatgtctggcagaatgtaagggaacagctggaggaatcccttcctggaactggagggggccaaaatcctaaagataattatcttgtgaagtttctttttctgctaccattttgtgctgtgctgttctgctgctatcgttcatttctaaagaatcagggatactttggttcctgttatagaacctcactatgtgatcatgtcagacacctttattacaggattaaatcaggggggccacttgcatatactaccatttctacctcaactctcaattcccctcataagctcataaatggtgctcagtacaaggcgcctgcatatatgggcagtatttctgtctgtgtctgtttattggctgcagtggtgtctcttggattagctctcttgatagtaccacggcaagtggctccatggactggtttgcttttgatgtatgaatggacattcacaatcttctttatactatttggaggttatctaaatttgatttatcatcgtggaaggattatgacatcacaaacaccttcctcattgtctcatcatgaatattctgatgatgattctggaaaagttcatcagcgtcagatgtcatcatgtaatgctgctacgtggttctatggattagggatggccttcttggccattgctactccatctttgccttttctttttgggatcactgcattgtttttacggttagctttgatggtcgttgggggcttaatattaacatgtttcttgacatactcctctgaacatcttgcaatcagatcatttctgaaagggcttgaagagagggatgcttcacgcaatgcaaacttctgttgttga

SEQ ID NO: 1024 - DNA, 416 bp, Glycine Max
atgaacaacagcaccagcaacaaggaagataatggctttgatccaagtgagtttacatatggtgtagcttttgtaattggcttggtcttcttacttgtcaccatagcttttgcatgtgtgcgtcttcgcatggctcgtggtcctaacatgctaaacattttggctggtattccaccatctcgccaagcacgatcagaagaagattcagctgaacaggggcttcatcacattgacacaagttttgagagctatccgaagttgctttactctcaagtagagaagggttcaagtagttcaagtgttgtttcttctagctgctccatatgcttaggtgactacaaagaaagtgacacgttgaggttgcttcctcactgtgaccatcttttccaccttgcttgcgttgatccttggcttag

SEQ ID NO: 1025 - DNA, 186 bp, Glycine Max
atgaacaatatgcctgaagttttcaatgcttggttaacggatgacaaggctatcttgtccacgtttcagcctattttgcaggttgacgataacattccaaaaaagatgataagacttgaacattttttgcacaagataatgcaagatgaaagattgtgttattttgaatgtatacaaacgttataa

SEQ ID NO: 1026 - DNA, 3720 bp, Glycine Max
atgaacacttcaacaaggttggatttagctgtgtttcagcttacacccactagaacaaggtttgacttgattataactgtgaatggaaagaaggagaagattgcctcaggcttgctcaacccttttctttcccacttgaaggctgctcagaatcagatggacaagggtggttattcaattgttcttgagccacctgagggtaacactgatacctcatggtttaccaagggaactgttgaaaggtttgttcgttttgtgagtactcctgagatattggaacgtgtgtatactgtagaatcagaaatcttacagattgaagaggcaattgcaattcaaggaaatagttctttagggactaacactgtattctgtttcattagtcgagtatttgtacaggtggaagaaaatcaagtaaaacatgttgaaagcactgaaggtacttctgaaagcacaagtacaactgttgcaagcaggaagactcagcaggatactaatgaggagagagcaattgtactttacaagcctgaagcacagccacctcaagcaaatggaagcacctcattggaagaaagctcaaaagttcatcttctgaaagtcctagacacacgtaagtcagcattgcagaaagagcaaggcatggcatttgctcgtgctgttgctgctggttttgacattgactatataccacctttgatgtcatttgctgaatgctttggagcatctcgcatgaaggatgcatgcacaaaattcagggatctttggagaagaaaacatgaaactggacaatggcttgaaattgaagctgctgaaacaatgtccaatcgctcagacttctcttcgttgaatgtttctggcattatacttcccaatatggcctccgcatcccatactgaattggactctgagagtaatgggaaggcaagttcagataaccaagataatattcaaggccaatttccacatcatatgttccctccttggcctgttcattctcccccaggttctgtaccagtcttaccaccatatccagtgcaaggcattccctattatccagcatatccaggaagcagtccatttatgcagccaaattattctcctatggaggaccccagactaattgctggtcaaaataacgggcgcagaaggcattccatggatagtaggcacagcaatactgaatcagaaacacaggatgaagtggatatggagagggaaggtagacagaaatctggcgtggtggtcattcggaacatcaattacataacaatggcagaaaattctggcagtggatcatattcagattctgcctcagaaaccggtgaagataataaggaatctgtgaagacctctaagagaagggaacccggaaaagaatctttgaagaaattggattcatctgataaggaagaaaccaagcatgggaaggatgcagatggaggccattggcaagcattccaaaattgtttactaagagatgttgatgaagacagacatgtcattgaccaagaccaatatgatcaggaaaaggtgaatgacgtgagaagaaaaaaacacattgctgtcaatgatcctttagtttttaatgaccgggaaatgcatgaagttcaaggaagattggctcacatgcctaagacatccagtgatgatttattgttatctgcaagcgcaggacagtctggtgatggttggagggcttcccgtgatgagttcatcatttccaagcaagaacatcaatttggcaatgcttacccttcctcggatattgaaacttcactaggttgttcaaacagtaaactagaaaggaagttgtttcatgatatgaatgatgattcctacatattggagcatagatcaatgggagtcaatgatgcaggaaatgttgagagaaatgctattaacatggactcggagatcccaatggtgcagcaatcttctgatgagataaaccatatcaattatgagccagatgaattgagcatgttgcctgaacgaggagctgaaaggggatcgatgagttatgaccctgctttagactatgaaatgcaggcccaggctggtggatctaagaggttggataaggaggcaaaatcaaaacttacctcgaataattctgataaaagaaagaccggtgggccgataaggagagggaagacttctaaacttaatcctttggatgaagcacgagcacgtgctgagagcttacggaactacaaagctgatctccagaaaatgaagaaagagaatgaagaggaagagatgaaacgcctagaagccttaaagatgaagaggcaaaagaggattgctgccaagagtagcgcaatcactgcacagtcgccatcacagctaaccaagaaacaacttccaacaaaactttcgccaagctcccataaagggtcaaaattttgtgattcggagccaggagaatcctcaccccttcaaagattccctgtcagaactgcatctgttggatctaatgattctttgaaagcctcaaaaaccagcagattgatttctagaagccacttggataataacaaattaagccgatcagtgtcttctttgcctgaatctaagctagagaaggatgataacacaactgatactaaggcatcaatggcaaggattagaagattgtcagaacctaaaataagtactactcatcagacttcctcagttaaaccacatggcactggaacaatatcaaagactaaagcagctgatggacccgagagcaaaaagatttctgctattgtgaaccatgataaaagcaagacagcagccctcccagaactgaaaatcagaacatccaaagcaactgaggttcctcagaacagaaccacagtcaaagagaaggcacataagttgaatgataacaagtcttctatgaattcacaagacaataatcctgtagttgagaagactgttgtgatgcttgagcgtgagaaaccttatgtcccccctattcatagttctgaagaaaattttgatatcccaaagaaacaatatgataatgatgaagtgatggaaaaaacagagacagcatctaattatgggcgtgaggctcccaccattgttggacttcggttctgggaagggttgtttgtgcaaccttactctcacacttttattgtgtttgttaatgtttctacccatagttcacatcacagaccagcatccttacttttgcaccaagagtcatcatctggtccaccttgtactttccatctttgtattgctgcggaaacatatcatgccccatatgctcgggtttcttctatggaagatcctagtaccagaaatagtgagtatggtaaagcagcccctccaagtttagagactgcagcaattggtgtggagactgttaaagtacatgtgtctaacaacgagaactcaacacttgagaagattcctgaagcaattgagaagcctctggtaaaggaatcatcatccaaagggtttagacgactgctaaagtttggaaaaaggagtcatagcttagcttctgaacgcaacatggaatcagataatgtcagcattgacaatgaggcagatgaggttggaaccaacggttcttctaacgaagttcatactttaaagaacttaatatctcaagatgaaactcccactgccagcacaactcaacaaaagtcttctcgatctttctccttgttatcaccatttcgaagcaagaacagtgaaaaaaagataatgatggtttga

SEQ ID NO: 1027 - DNA, 1614 bp, Glycine Max
atgaacatggaggtcgtcactgatgcggcgtcgttggacgtcgaattgttgcagctcccagaattttctggtttggccctcaagtctaacctcaatttcatcgagaagctcttcaaccagtggttgtcgcttcccgaaagtaatcgattggtaacatcattactcaatgaagcaaagtctggtgttcccttgaatgtcccagggaattgctctagtccaaatgcttcaagtaattctttgccttcaatgtttcccgctggcactgctcctcctctttcaccaagaagtacatctggttcccctcgcattgtgaaacagagagttggcccttctaatttgggttctcccttgaaagttgttagcgagccagttaaagaagtgatacctcagttctactttcaacatggacgtccacctccaaatgaactgaaagaagaatgcttgtttaaaattgatcggctattctatgatcatatggatggcatgcaggtgcatgaattcaaatcaattactaaggaagtttgcaagctgccatcttttttttccacttcccttttccagaagattgacaatggaactggtgttgtgacaaggaaaacatttattgaatattggattgatggcaacatgctggtgatggatatagctgctctaatattcaaaatattaaagcaaccacagctgaattaccttactcaggatgattttaaacctgttctacgtgagcttttagctactcatccagggctggagttcctgcagggcacgcctgagtttcaagagagatatgctgaaactgtaatatacagaatctattattacattaatagatctggaaatggttgtctcaccctgagggagctgaagcgtggaaacataattgatgcaatgcagcatgctgatgaagaagaagacatcaacaaggttttgaggtacttctcttatgagcatttttatgttatatactgcaaattttgggagctggatacagatcacgatttctttatagacaaagagaatcttatcagatatggtaaccatgcgcttacctatcgaattgttgatagaatattttctcaggtcccaagaaagtttaccagtaaggttgagggaaagatgggatatgaagattttgtttacttcatactgtcagaagaggataaatcatctgaacctagtcttgagtactggttcaagtgcatagatttggatggaaatggagttctgacaaggaatgaactgcaatttttttatgaggaacaattgcatcggatggagtgcatggcccaagagcctgtgctttttgaggacatattgtgtcagataattgacatgattaaacctgaggatgagagtgttataactctgcatgacctgaaaggcggtaaactttcaggaagtgttttcaacatcctgttcaacctaaataagttcatggcctttgaaactcgtgacccatttttgatccgtcaggaacgtgagaacccaacattgacagagtgggatcgatttgctcatcgagaatatattaggctttcaatggaagaagacatagaagatgcctctaacggaagtgcagaagtctgggatgaatcactagaggctcccttctaa

SEQ ID NO: 1028 - DNA, 150 bp, Glycine Max
atgaacgagaacaagcttcttgtaggttggaggcaactccttgtgcttgccttcgatgaatttggttatcgcgtattggctcgaaccggttctctccttcagactcgctatcgcctccgctatcatctacaaaacaatgaaactaattaa

SEQ ID NO: 1029 - DNA, 468 bp, Glycine Max
atgaacggtgtcggtgtagctgagcaatggagcgacgtgccgtttaggatggacgacgcggacgacatgatcatcttcaactccctctgcgacgccaaaacgacgccgcggatcagagaccagtcacgaaataagttactccgattgccagaacgacgattccaagctgccgttttggcgcagaagaagaacatgggaacgtgctacagaggagtgaggcaaagaccatggggaaagttcacggccgagattcgcgacccggctcggaacggcgcgagggcgtggcttggcacttatcaaacggctgaggatgcggctttggcttatgatcgagccgcgttcaagctacgcggctcgaaggctttgctgaactttccgcaccgaataaacttcaacgagccgccgccggtgagagtcacggccaagaaacggaaagttccggcttcggtgaagctgagtcgaagttga

SEQ ID NO: 1030 - DNA, 1365 bp, Glycine Max
atgaacgtcgccagaatcaacatgtgccacggcaccagggagtggcacaaggaggtcatcgaccgcgtccggaggctcaaccacgagaagggcttcgctgtcgccatcatgatggacaccgaaggcagcgagattcacatgggtgatctcggcggagcttcctccgccaaagccgatgacggtgagatctggactttcagtgttagagccttcgattcggcgcttccccaacgcaccatcaatgtcaattatgaaggcttcgctgaagatgtgaaagtgggggatgaacttttggtggatggaggaatggttaggtttgaggtgattcagaaaataggtccagatgtaaagtgccgttgtactgatcctggcttgttgctgccgcgggccaatctcacattttggaggaatggtagtttggtgagagaaaggaatgccatgctccctactatttcttccaaggattggttagacattgattttggtatttctgagggtgttgattttattgctatttcatttgtcaagtctgctgaagttattactcatcttaaaagctatattgctgcacgatctcgtgatagtgatatttctgtcattgcaaagatagaaagtattgactcattgaagaacttagaagagatcgttctagcggcagacggagctatggtggcacgaggagacttgggagctcaaatacctttagaacaggttccatctgctcaacaaaggattgttcaggtttgcaggcaattgaataagcctgtcattgttgcctctcagctacttgaatccatgattgagtaccctacacctacaagagctgaagttgcagatgtttctgaagcagtcagacaacgagctgatgctttaatgctttctggtgaatcagccatgggccagtaccctgacaaggccttaactgttttaaggagtgtcagtttgagaattgagagatggtggagggaagaaaaacgctatgaagctatgttgctcccatcagttgggtcttatttttcagaaaagatatctgaagaaatctgcaattcagctgctaagatggccaataatttagaggtggatgcgctttttgtgtacacaaagacagggcacatggcgtctctattgtctcgttgccgtcctgactgcccaatctttgcttttactaccacttcatctgtgcgtaggcgactgaatcttcagtggggcttgatacctttccgcctgagcttcacagatgatatggagagcaatctcaacagaaccttttcattgctcaaggccagaaatctgatcaaatctggtgaccttgtcattgccgtctcagacatgttgcagtcaatacaagtgatgaatgttccttga

SEQ ID NO: 1031 - DNA, 2850 bp, Glycine Max
atgaagaatctgagcaaggacaagggttgcagcaggagcaagagcagcaatggattcgttccttcttccttcaagttcatatcgtcttgcattaagaccgcctcttccggcgtccgctccgccggagcctccgtcgccgcctccatctccggtgacggacacgaccgcagagaccagatgctttgggcttgttttgataggctagaactcagtccgtcttctttcaagcatgttctcttactcagctattccaatggatttcaagttcttgatgtggaagatgcctccaatgtaagggagcttgtctcaaaacgtgatgatccagtttcatttttacagatgcagcctatccctgcaatatcagaaggctgtgaaggatttagagcatcacatcctttactcttggttgttgcatgtgataaatcaaagatccctggtaaaatgctaaatgtcagagatggccataatgaagctcaagcagaaaatattgtcagctcagctacagcagttcggttttactcactaaggtcccatacttatgttcatgctctgagatttcgttcaacagtctacatggttagatgcagtcctcgaatagtggctgtgggtctagctactcaaatatattgttttgatgctcttactcttgagaataagttcagtgttctcacttaccctgtgcctcagttgggaggacaaggaatgattggggttaatattggctatggtccgatggctgtagggccccggtggttagcttatgcctcaaacagcccattgttgtcaaacacaggtcgcttgagtcctcagagtcttactcctcctgctgtcagcccatcaacatcacccagcagtggaaacctggtagcccgatatgccatggaatctagcaagcatttggctgcagggcttatcaatctcagtgatatgggatacaaaacattgtctaaatactatcaagatctaacacctgatggatccagttctcctgtatcttcaaactcgagttggaaagttactcgatttgcattaaattctacagaaacagatccagctgggatggttgttgtcaaggattttgtttctagagctgttgtggcacaatttagggctcatactagtccaatatctgccttatgttttgacccaagtgggacacttttagttacagcctcaattcatggcaacaatattaatatatttcgaattatgccatcctgctcaaggaatggatcaggttcccaaagcagtgattggaactattcacatgtgcacctttacaagctccaccgtggcatgacatctgctgtaatacaagatatttgttttagccattacagtcagtgggttgccatcatttcctccaagggaacttgccatatttttgttcttgccccatttggtggtgagacagttcttaagatgcacgatcaagacactgatgggcctgctcttttgccaatttttcctctaccatggtggttcactccacatttcccagtaaaccagcagcagttgtgcctgacacccccacctcctgttgttctttctgtggttagccgaataaaaaatagtaatgctggatggctcaatacggttagtaatgctgcgtcttctgcagcagggaaagtctcaattccatctggtgctgtttctgctgtctttcacagttccattcctcatgattcacacaattcatacttaaaaaatcatgccatggagcacttattagtttataccccttctggtcatttaatccaatataaactactaccaccattggcggcagagtcaagtgaaactgtttcaagaacagccctagttccttcagcacagatacaagaagaagatttgcgtgtgaaggttgaacctgttcaatggtgggatgtctgtaggagatatgattggccagaaaaagaagtgtgcatattggggaatactgttggtggactggaagctgcagaaatgatcttggatagttcagattatgaagataataatagcgtcaggaacaataattctataaaacttaataagcaatgtcacttctcaaatacagaggtacatataagctctgggcggataccaatttggcaagaatctgaggtgtctttctttgtgattagtcctttggaagctggagagctgaatttatgtgaacttaatacaagtggagaaattgaaatagagaatattcctgttaatgagattgaaataaaacagaaggatctgttgcccatcttcgaccatttccatagaattcaatctacttgggggcctcattgcatgaaatatgatcaatcaaaatcctcttttgtgccattaaaaatagcaaagtcagcagatgatagaggccctgatagattacatgaattgtgggtccctgttttaacttcatctccacttctgttttcttcctcctctaagtactgtagacaagcccaaagatctggttggaaccacttgagcacaaccttctcaaagaacagagaggtagttgtattggcatcacctcttttaagcctcaaaagtgcctcaaattttgcagatggtgcaaatgcaaaggtaaaatcatcaaaacatgaaaaagccggtgacagtttcaattcaagcttaagtggctgtgatttgaatatgaatgtaacttgtgaggagtcaatacgtgactcaccagactttgagcaatattttcaagaaggttattgtaaagcatcagttgactgtcatgaatcaacagaggttattactgatgtggattgtagcagtccctgtggcagggggaaatctgacgaagatggtgataatgatgacatgcttggtgatgtatttgacttctctgaggaaggttga

SEQ ID NO: 1032 - DNA, 2331 bp, Glycine Max
atgaagaatctgagcaaggacaagggttgcagcaggagcaagagcagcaatggattcgttccttcttccttcaagttcatatcgtcttgcattaagaccgcctcttccggcgtccgctccgccggagcctccgtcgccgcctccatctccggtgacggacacgaccgcagagaccagatgctttgggcttgttttgataggctagaactcagtccgtcttctttcaagcatgttctcttactcagctattccaatggatttcaagttcttgatgtggaagatgcctccaatgtaagggagcttgtctcaaaacgtgatgatccagtttcatttttacagatgcagcctatccctgcaatatcagaaggctgtgaaggatttagagcatcacatcctttactcttggttgttgcatgtgataaatcaaagatccctggtaaaatgctaaatgtcagagatggccataatgaagctcaagcagaaaatattgtcagctcagctacagcagttcggttttactcactaaggtcccatacttatgttcatgctctgagatttcgttcaacagtctacatggttagatgcagtcctcgaatagtggctgtgggtctagctactcaaatatattgttttgatgctcttactcttgagaataagttcagtgttctcacttaccctgtgcctcagttgggaggacaaggaatgattggggttaatattggctatggtccgatggctgtagggccccggtggttagcttatgcctcaaacagcccattgttgtcaaacacaggtcgcttgagtcctcagagtcttactcctcctgctgtcagcccatcaacatcacccagcagtggaaacctggtagcccgatatgccatggaatctagcaagcatttggctgcagggcttatcaatctcagtgatatgggatacaaaacattgtctaaatactatcaagatctaacacctgatggatccagttctcctgtatcttcaaactcgagttggaaagttactcgatttgcattaaattctacagaaacagatccagctgggatggttgttgtcaaggattttgtttctagagctgttgtggcacaatttagggctcatactagtccaatatctgccttatgttttgacccaagtgggacacttttagttacagcctcaattcatggcaacaatattaatatatttcgaattatgccatcctgctcaaggaatggatcaggttcccaaagcagtgattggaactattcacatgtgcacctttacaagctccaccgtggcatgacatctgctgtaatacaagatatttgttttagccattacagtcagtgggttgccatcatttcctccaagggaacttgccatatttttgttcttgccccatttggtggtgagacagttcttaagatgcacgatcaagacactgatgggcctgctcttttgccaatttttcctctaccatggtggttcactccacatttcccagtaaaccagcagcagttgtgcctgacacccccacctcctgttgttctttctgtggttagccgaataaaaaatagtaatgctggatggctcaatacggttagtaatgctgcgtcttctgcagcagggaaagtctcaattccatctggtgctgtttctgctgtctttcacagttccattcctcatgattcacacaattcatacttaaaaaatcatgccatggagcacttattagtttataccccttctggtcatttaatccaatataaactactaccaccattggcggcagagtcaagtgaaactgtttcaagaacagccctagttccttcagcacagatacaagaagaagatttgcgtgtgaaggttgaacctgttcaatggtgggatgtctgtaggagatatgattggccagaaaaagaagtgtgcatattggggaatactgttggtggactggaagctgcagaaatgatcttggatagttcagattatgaagataataatagcgtcaggaacaataattctataaaacttaataagcaatgtcacttctcaaatacagaggtacatataagctctgggcggataccaatttggcaagaatctgaggtgtctttctttgtgattagtcctttggaagctggagagctgaatttatgtgaacttaatacaagtggagaaattgaaatagagaatattcctgttaatgagattgaaataaaacagaaggatctgttgcccatcttcgaccatttccatagaattcaatctacttggggtgacagtatcagtttgttgaccttgcatgactcgctcgctaccatgactgaatga

SEQ ID NO: 1033 - DNA, 714 bp, Glycine Max
atgaagagagtattcggcgtcaagaagaacaaggatccacccccttccattcaggatgcttccgaaaggattacaaaacgaggtgacacggtggatgacaagattaagaagcttgatgccgagcttagtagatataaagagcagattaagaaaactagacctggtcctgcccaggaagctgttaaagctagagccatgagagttcttaagcaaaaacgaatgtatgaaggccagcgtgacatgctgtacaatcagacgttcaatctcgatcaagttcaatttgctgctgagggcattaaagatgctcaacaaactatgacagctttgaagtctgccaacaaggagttgaagggaatgatgaaaactgtgaagatccaagacattgataacttgcaagatgagatgatggacctcatggatgtaagtaatgaaatccaagagactttgggtagaagctataatgtgcctgatgacattgatgaggatgaccttatgggtgaacttgatgcattggaattagacatgggaaatgagactgaagctgatggggtcccatcctacctccaacctgataaagaacctgatttggatgcagaacttaacttacctccagctccaacaggacaaacagctgtgccacctggcagatccaatgcgcagactgaggatgagctgggtttacctgctgtccctcaggcatccatacgcggttaa

SEQ ID NO: 1034 - DNA, 1140 bp, Glycine Max
atgaagatcgttcggaaagacctcgtacccaatggacctggcagcgttaagatggttgcagtggattcggatgatctctggtttgcgtataacctgatagctcccggagactctgtcatggccgttactgtcaggaaggttctaagagaagctgctagtggcggacgggaagcagaacgcgtcaagctcaaattggaaattaaagtccaagagcttgctgattatgacaaagaaggttctattttacgtgttcgcggaaagaacattttggagaatgaatatgtcaagataggagcttttcatactttagaactcgaactgcagcgcccgtttgtgctcagaaaggatgtttgggattctttggctttggaggtactacagcaggcctctgatcctggtgcaagtgctgatctagccgtggtgttgatgcaagaaggattagcccatatcctccttgttggtagaagtatgactgttactcgttcgcggatagaaacatcaattcctcgcaaacatgggcctgcaattgctggttatgagaaagctttggataagttctttcagaatgttttgcaggctttcttgaaacatatagatttcaacgtggttcgttgtgctgtaattgcaagtccaggatttacaaaggatcagtttcaccgtcacttatttttggaggcagaacgaagacagttgcgacctattattgaaaataaatcacgcatcattcttgtgcatacaagttcaggatacaaacatagcttaaaggaggttttggatgctccaaatgtcatgagtttaataaaagatactaaagcagcacaagaggttcgagttatgaaggatttctacgacatgctttcaaatgatccatcacgtgcttgttatggaatgaaacatgttgaggttgccaatgaacgactagctgtacaaacgcttctcattacggatgagcttttcaggaattcagatatagcaacaagaaaaaagtatgttaacttggtcaactctgttaaggattcaggaggctctgtccatgtattttcgtccatgcatgtctctggagaacaactagcccagataagtggcattgctgcaattcttcgatttcctctccctgatcttgaagacattgagatgtga

SEQ ID NO: 1035 - DNA, 177 bp, Glycine Max
atgaagattgatatcccagatattagatgcaaagattggatctggatttttggggaaaataaaaagatatctatagcagcatgggggtataagagcctcaaatcgctaccaaagtcgaccaacaaacaagtagcttatcatgaagtccaacttggatgccactttgcttttatgtga

SEQ ID NO: 1036 - DNA, 903 bp, Glycine Max
atgaaggactttccttcatgcttcggtgagaatgcagttcaggttgcggattcatcatcttcaagcgcgagccaaactgcacagaatctggttatctgcgtttaccaatgccggataaggggtaagtgctgcttgataaccatcacgtggagtaagagcttgatggggcaagggcttagcgttgggatcgatgattcgtcttcaaatcagtgtctttgtaaggtggatatcaaaccctgggtgttctccaagaggaggggttataagagccttgaggcttattcttgtaagattgatgtgtattgggacctttccaatgctagattgggtgttggtcctgaacccttggaggggttttatgtaggagtagttgtagatcggcaaatggttctccttcttggagatttgaggaaagaagctttcaagaaatctagtgctattccattaccctctaatgctgtttttgttgccaaaaaagaacatgtttttggcaagaagatgtttggtaataaggctgtgttttgtgacaatggtcagattcatgatcttgtcatagaatgtgacacctcaggggtgtctgatccgtgccttataattcgcatagatagcaaaaccgtgatgcaggtgaagcggctcaagtggaagtttagggggaatcacaccatcttggtggatggacttgcagtggaagttttctgggatgtctataattggctttttggtacatcccttggaaatgctgtctttatgttcagaacatgcatctccgaggaaaaattgtgggttggtcaacccctttctgatgcaaatgtggtgcagtggtccttctctcagaggttttctgagaccaagtcgcaaggtctcggcttctcacagattttatacgcgtggaagaacgattag

SEQ ID NO: 1037 - DNA, 459 bp, Glycine Max
atgaaggatttccctgggacaccgggcactggtcttggtttggctctaaggatatcacagttcgtttttgctgctggatcaattgcttccatggctaccactcccagtttctttaactttacggctttttgttacttgatagcttcaatgggtttactagtcatttggagttttgtgcttgctttattggatgcatatgccttggtgaaaaaaaaggtcctccacaacgctgtactggttagcctctttgtagttggagattgggtaacagcaacactatctctagctgcagcgtcttcctcagctggcatcacggttttatactttaatgatctgggacactgccattttggagaggaatgccaaaagtaccagatttcagtagcattagccttcttgagctggttcccaatttcaatatcatccctaatcatgctttggctattagctgcagggtag

SEQ ID NO: 1038 - DNA, 273 bp, Glycine Max
atgaaggatttccctgggacaccgggcactggtcttggtttggctctaaggatatcacagttcgtttttgctgctggatcaattgcttccatggctaccactcccagtttctttaactttacggctttttgttacttgatagcttcaatgggtttactagtcatttggagttttgtgcttgctttattggatgcatatgccttggtgaaaaaaaaggtcctccacaacgctgtactggttagcctctttgtagttggagattggtcttcttga

SEQ ID NO: 1039 - DNA, 2085 bp, Glycine Max
atgaaggcactgtcactgttacgttcctcgaacaagaacgtttggacaatgggcaatcgtaacttggcccaactcacccacacctccctcacacgtgccgtccacgctcacatcctcacctccggcttcaagccattccctctcatcatcaaccgcctcatcaatcattactgcaaattctccaacatctcctacgcccgccacctgttcgacaaaattcccaaaccagacatcgtcgccacaaccaccatgctttctgcctactctgccgcgggcaacgtcaaacttgcccacctactcttcaacgccacaccactgtccattcgcgacaccgtcagttacaacgccatgataacagccttttcccacagtcatgatggtcatgctgctcttcatctcttcatacacatgaaaagccttggttttgtccccgacccatttaccttctcgagcgttcttggtgccctgtcgttgatagctgatgaagagaggcattgtcagcaattgcactgtgaggttctcaagtggggtgcactctctgtgccttctgttttgaatgctttgatgagttgttatgtttgttgtgcctcttcgtggttggtggactcttgtgtgttgatggctgctgctaggaagctatttgatgaggtgcctcctggtcggagggatgaacctgcttggactaccatcattgctggctatgtcaggaatgatgaccttgttgcagcgcgtgagcttcttgaaggaatgactgatcacattgctgttgcatggaatgccatgatttctggctatgtgcaccgtggtttttatgaggaggcgtttgacttgttgaggagaatgcattcattgggaattcagctggatgagtacacaccaacaggtgcatgcttacgttctcagaacagtggtgcagccttcacagcattttgttttatatgtggtaaattagttgaggcgagggagatgccggagaggagcctgttaacgtggactgtgatgatatcaggcttagcgcaaaatggctttggagaagaaggtttgaagttattcaaccagatgaagttagagggactagaaccgtgtgattatgcatatgctggagcaattgcctcttgttctgttcttggatcattagacaatggacaacaactacactctcagataatccgattaggtcatgattcaagcctctcagttggcaatgcactgattacaatgtattcaaggtgtgggcctgttgaaggtgctgatacagtgtttctcacaatgccgtatgtggattcagtatcctggaatgccatgattgcagctcttgcacagcatggacatggtgtccaagcgattcaactttatgaaaagatgttgaaggaaaatatattactttataggataacttttctcacaattctttctgcatgtagccatgcaggtttggtcaaagagggacgccattattttgatacaatgcatgttcgttatggtataacctcagaagaggatcactattctcgtttgattgatttgttatgtcatgctggtattgcaccaatttgggaggctcttcttgctggttgttggatccatgggaacatggaattaggtattcaagctactgaacgactcttagagcttatgccacagcaagatggaacctacataagcctttccaatatgtatgccgctttagggagcgagtggttaagaaggaacctggttgtagttggattcaggttgaaagcatggtccatgccttttttggttgatgatgctgtgcactctgaggtgcatgcagtgaaattgggttatgttcctgatccaaagtttgtattacatgatatggaatctgaacaaaaggaatatgctttgtctactcatagcgaaaaacttgctgttgtttatggaattatgaaactgtctttaggagctacaatttgggttttaaaaaatttgaggatatgcagggactgccataatgcattcaagtatatttctaaattagtggaccaagagataattgtcagagataggaagaggtttcaccattttagaaatggtgaatgttcttgtagcaactactggtag

SEQ ID NO: 1040 - DNA, 1587 bp, Glycine Max
atgaaggctgaagatgatgtttatttggttcttgtttttgggcagtcatcatcaggttttgggcagaacaattcaagtatcaatccttttgctcttaagccatttggtattacaactccatttggttcgccaattggttttggaggttcttccactggggtagctcaaccatcttctccattcgcttccaatacagctttcggtttttcatcgtcaccagctttcagtagttcagttccctctttttggtcatcttcaactcctgatcttggtagttcatcgtcatcctttagtggtaagatcatcagtttttggtcagcagcctcttttggaggttctgaatctgcttctactcaaacagtatcatttggtgccacccagccatcacaactagcatttggaagcagcatatttggtttctcagcaccttttggtgcatcatctcagccagcatttggggcttcaagtacccctatatcaagtacatctgcatttggcacttcaacaccctttttgtttagttttggatccactcaaattggtcagtctcctgcatttggtagcagcagcccatttgggggcataacctcacccttgggaggtcagagttcagcatttggatttcaaactccgagatcaggttttggaaatactggtactgggcagtcaggttttggaggtaaacaacggagtgacagtagagtagccagttacatggcaactactgaagcagatagttgtacctctggatcaaaattggagtccatatctgcgatgcctatttacaaagacaaaagtcatgagcaactaagatgggaggactatcaattgggagataaaggcttcagtttataccaatcagcagccaatcctttctctaccacaacacctaattctaacctttttgtgccaaagagttcacctttgtcttctggatttggaacttcagctgctcctgctttcagtttaccagcttttggttcttcaacatctgcagcagaaccatctatttttggctcaaccccatgtccatttggagctaactcttcttcaacacccagctttgggcaatctttgtccctgtttaatactgctcctgctcaggctacatcttcaccatttggcagaaacatttttggcaacacacagtcatccccattatttagttctgcagcccctacaaggctacaaccgcacagactggttctgcttttggacagtttacctgcccttttgggcagactacaccttcttttagtcaatcaagcttgttcaattcaccttcctggcttgttcaaacatccaatgggagcaatgaagatcattctccacaaaaggcagacagtggtcacagctggtgaggatgccattgtacctgaacataaatctggtgttgaggcactaatgccaaaactgcggcagtctgtgggacaagggctgaataagcctgctgaggtaacactactaaaccttagacgtttcagcaaaagaattggacatcagtatatggaagggccaaagatcgagaaatacaagagagtggaagatcaaggtcaaacacttcagcatctacaagctggtagataa

SEQ ID NO: 1041 - DNA, 1143 bp, Glycine Max
atgaagggggtgaaaggaaaattcctgaagaagctcaaatccatcaaaccaatcctgaagcaagagcgaattctccagcttaaggcctcagatgggtacgtcgattttctcccaaagattccgagtttcaatctgcattccccgtttgtttcccgagaaaacaagcccgagaaagttgttcagaggtgcgagaaaatgcaggatgaacccgaggtcatcgacgtggcagagctgatgaaagaccttgaagaagaagaagatgatgaaatggatttggatgattacaatgacaacaaagagaacataggtccatgttctcagaaaccccaacaacaccacaagggtgttttgcagaatgggaacagagcaaaaacagagccaaaacagagaggggttttggaggaaaaatggtcttcacctgcaaaagctgcaagtaacagcaacagaaaaaccccttcgttagagactgatattccatcgttccggcggccggacttgaactccggcagcctattcgatccgaatctactggcggcgttcgagcatgccgtgaaggaacatgctagaatgacagaagaacagaggagagccagagtcgaagaagagtcttcacagaaagtggaagatgatgaccctgaccctgaccctgaccctgaccctgatcctttgatgttctttgaagagaagtgtccacccgggggcgatggcacagttattttctacaccacgacgcttaggggaatccggaagacattcgaggactgcaacaaaattcgcttcctcctgcagagtttcaaggttttgtattttgagagggacatttcaatgcacaaggaattcaaggatgagttgtggagcagtttggaggggaaatcactgcctccaaggctttttgttaaggggaggtacattggtggagcagaagaagttttgagtttgcatgaacagggaaagctgaggaaaatcttagtaggggttccaatggattattctaatggtccttgtgatgcatgtggagggataaggtttgtgttgtgcttcaagtgtaatggaagccacaaggtcgtggaggaaaatggagagagcaatcagtgccttcagtgtaatgagaatggcttgattgtgtgcccttactgctgctag

SEQ ID NO: 1042 - DNA, 669 bp, Glycine Max
atgaaggttgtttacttcttcgttgtgctattggctttggcatcctccattgcctttgcttatgatccaagccccctgcaagacttttgtgtggctatcaatgataccaaaactggtgtgttcgtgaatggaaaattttgcaaggatccaaagcttgctaaggctgaagatttcttctttcctggattgggacccggaaacacttcaaaccccctaggctcaaaggtgacagctgtcacggttaatgaaatattagggctcaacacacttggcatttccttggcacgcatagattttgcaccaaagggtttgaaccctccacacactcaccctcgagggacagagattcttgtagtcttggaaggtaccctctatgttggctttgttgcgtccaatcaaaacgataaccgtttattcaccaaagtgctgaacaagggtgatgtgtttgtgttccctattgggctcattcacttccagcaaaacataggttatggaaatgctttggccattgctggtcttagtagccaaaaccctggagttattaccattgcaaatgctgtgtttggatctaaacctcctatctctgatgaagttcttgccaaagcttttcaagtgggcaaaaacgtaatcgactaccttcagaagcaattctggtacaacaatagttag

SEQ ID NO: 1043 - DNA, 297 bp, Glycine Max
atgaaggttttagaatttattttggcactgattctggttcttgctgtggttcatgttcagccaaacctagctgttagggtattgaacatgaaggaacaactgaaccttatgtctctagacaagggtcctgtgaccccctcagggccttctacctgcacttacattcccggaaccggtggcaaaaactgcccccctttggaggaaatgaatgtcgcaggaaattacgttcagcaccacagtgatgaaacttatcctcgtctagttgttccatttggtgttgcaaccaatcaacattga

SEQ ID NO: 1044 - DNA, 699 bp, Glycine Max
atgaaggttttttacttcttcgttgtgctattggctttggcatcctccgttgcctttggttatgatccaagccccttgcaagacttttgtgtggctatcaatgataccaaaactggtggtctatatggagtgttcgtgaatggaaaattttgcaaggatcctaagtttgcttatgctgatgatttcttctttggtggattgggacccggaaacactgcaaacccacaaggatcaaaggtgacagctgtcacagttaatgaaatattagggctcaacacacttggtatatccttggcacgcatagattttgcaccaaagggtttgaaccctccacacactcaccctcgagggacagagattcttgtagtcttggaaggtaccctctatgtcggttttgttgcgtccaatcaaaacgacaaccgtttattcaccaaagtgctgtacaagggtgatgtgtttgtgtttcccattggtctcgttcacttccagcagaacataggttatggaaatgctgtggccattgctggtcttagtagccaaaaccctggagttattaccattgcaaatgctgtgtttggatctaaacctcctatctctgatgaagttctcgccaaagcttttcaagtggacaaaaacgtaatcgactaccttcagaaacaattcgggtacaacaacaaagttaacgggaaacataattaa

SEQ ID NO: 1045 - DNA, 246 bp, Glycine Max
atgaagtacacttttatctttcaattttacactttggtccaaacaattttaaaagatttgtgcttgggttctgtctcgctgtcatcgattcaaagtctcagggcttcagaattccttttggtgatcctcatacctcagtacacagtcatcttgcaaggtttatacatgcagaatagatcacgttcaaaaggtgtttgtctattctcacaacttcaacccaatgctgttggaaatttgaattggtga

SEQ ID NO: 1046 - DNA, 1074 bp, Glycine Max
atgaatattgttcattgtttttcttttccatccacctttatgtttctgaatcttttaacaacagtttgcagggaatgcatagacaagaagttaatagatgagaaattaaagcattgtccaatatgcaatagagacttgggttgttctccacttgataaattaaggtcagatccttgtctgcaagatttgagggataaaattttcccatttgaagaacaaaatgcttcagtcaaattgaacatctacagaaagaagaattctctatcttcgttaaaaaagaatgcaaaaatagacaaagcagcttcaaaacctgataaagcggaagatgaaaaccgtggatccgcgagaagagccaaagctgcagctagattaaaatttacttgctctgcaccacctgctgcttgtcaacttgacaaagtagcaggagaagataagaaagatggtgcaaattcaagtcaacaatcagataccaacaagagggacaattctgagtttaggaatgaaacggctgatatgttagagccattaaattccctggtggaacctggaagcaaaaagtctcgtaaaaagtccaccatgcgctccaatgacaatgccgctgatcaaaatgaatcaactccttcaaactcagattcagtccaacaccaaaggcctctgagcaatcaagagaaaacactcagaatctctgaggacttaaattttcctgcacaacctgagattggttccaacattgaaggcaacaaagaatttggtccaatctggttctgcttggttgctgcagaagagaagaaagcaagtgcacgactgccacagctatattccagctacctaagggtcaaggatggtagtgtaactgtttcctatattaaaaagtatctggtgaagaagcttggtcttgctagtgaagatgaggtggagatcacattacaaggtcgagcacttttgtcttcattgcaactgagaaacctagtagacatgtggttgcacacagtgccaaagaataagattcagacatttgttggaagctcagccaaggattttattatggcactttcatatggtcgaaagacttga

SEQ ID NO: 1047 - DNA, 1818 bp, Glycine Max
atgaatgacatggcttggactaccctcaaaggttctcccagaatgtcttctcatccaaggcctctttcttggattgtggttatggtgggagcacttgcatttttcttaatttatgcttcctgggttcttgtatcatcccctattggtgccacggtccagggttatttttatagtgtaggtagttcagagaagttagatttgcctgtgtcttcagtgaatggagcttctattaatgatggtcactcgaatgtgagtttagatcttgttgataaaaaaccaccctctgaggatctacaatcttccacaatttccactgaggtgcctagtgatagtaagacagaacaaactgatactacatcaaactcacaagtggactcgggtgagtctacttcagtgaaccttccaatgaccaaggaagtgaatagcgacacgacagttttgaattcaggagaactagggactttgtttggtgaccgttcagatgtagccaatagtagctcgcctactcaagacaattcacaagttgatttgaattcaaaaacaactaagccattggtaggtaccaattctttcaatgagacaggtaatattagaatggaggaacccacttctgtggctttgatcaatcagtccagtgctgtaactacagcatcaaatgagacctctatctcttccggtgattccacttcaactgctgttccagaatcagcagagaagctaaataacacaccctctgctggctgtgatctgtaccatggaaattggatacatgatccactgggaccattatacacaaacaattcatgccctgtattgacacagatgcagaattgccagggtaatgggagacctgataaggattatgaaaattggcgatggaagccctttcaatgtgacctccctcgatttgatcccaaaaagtttttggagctgatgagagggaagactttggctttcattggagattcagtagcccgaaaccagatggaatcaatgctgtgcattctgtggcaggtagagaaaccgaagaatcggggaaatcgtaacatgcaacgatattattttaggtccacttctgttatgattgtcaggatatggtcctcgtggcttgtcaaactaacatctgaaccatttgactatgctccagctggtgtggataagctccatcttgatgcccctgatgagaagttgatggaacacatcccaaactttgatgtggttgttctttcttctggtcattggttcgccaagcagtctgtgtatattttgaacaatgagatagtgggaggacagttgtggtggctggacaagtctcggaagatgaaggttgacagtgttaaagcatatggcatatctgttgaaacaattctaactgctattgctacaattccaaattacaaagggctgacaattgtgcgttcctactcacctgaccattatgagggtggagcatggaacaccggtggatcatgcactgggaaggttaggcctcttgcacctggtgaactggtgaaaaatatgcacacaaatataatgcatgaacaacaggtgacaggttttaaccgtgcagtggaaagggcaacaaatggatcaaagttgaggctaatggatatcactgaagcctttcaatacaggcatgatggtcaccccggcccttacaggagtcctgatcccaataagattacgaaacgtggccctgatggaaggccaccaccacaggattgcttgcactggtgcatgccaggccctgttgatacctggaatgaacttgtgtttgaaatcattaggagagaatatgaaggtggaagtgcatcatga

SEQ ID NO: 1048 - DNA, 2097 bp, Glycine Max
atgaatggggtcacacaccttgaaccagatgagtctgagtttgttgaagttgatccaactggaagatatggcagatacaatgaaatccttggcaaaggagcttcaaagacagtatatagagcattcgatgagtatcaagggattgaagttgcttggaaccaggtcaagttgtatgatttcctgcaaagccctgaagatcttgaaaggctttactgtgaaattcatctcctgaaaacattgaagcacagaaacattatgaagttctacacttcttgggtcgatactgctaataggaacatcaacttcgtgactgaaatgttcacatccggtacacttaggcagtataggctaaagcacaagagagttaacatcagagcagtgaagcattggtgtagacagatcttgagcggacttctctatcttcacagtcacgacccgcctgtgatccatagagatctaaaatgtgataatatttttgtcaatggaaaccaaggggaagtgaagattggggatcttggtttggcagcaattctccggaaatctcatgctgctcattgtgtagggacgcccgagttcatggccccagaagtatatgaagaggcatataatgagttagttgacatatattcctttgggatgtgcatattagagatggtcacatttgaatatccttatagtgaatgtactcatccggctcaaatctacaagaaagttatttctgggaaaaagccagatgctttgtatagagtgaaggatccagaagtgcgacaatttgttgaaaaatgcttggtcacagtgtctctaaggctttctgcaagagagcttctaaatgatccatttcttcaaattgatgattatgaatatgatttgaaaactgttgaaaatggagaactggatgaatttggttctctcatgaggcagccattctttgatcttcatcgaagctatagcaacttcagtaatgaatactcaaatggctttgggtatgaaggagactggggtcctcatccagctgagatcgaacctagtggaattgaactttttgagtaccatgatgatgacgaaccctctgaagatgtcgacataagcatcaagggcaagaggaaagatgatggtggcatctttttgagactaagaattgctgataaagaaggtcgcatccgaaatatttatttcccatttgacatagagctggacacagcaataagtgtggcaactgaaatggttgcagagctggacatgactgatcaggatgttaccagaatagcagatatgatagatggggaaattgcgtccttggtacctgaatggagaccaggaccaggaattgatgagactcctcgttatgctaatgaaggtttctgtcacaattgtgtgtctaatcatacttctagcggttcttttctggattttctttcaaacaatccaggtaacaagaacttgcaacttcttgagtgttgtaggcatggatgtgcttcaatgcatgggcggtttggggagattaccttccaatctgaagacttgcagtatcaagagttatggaatcagcatgaaagtcgtgaactgagtccggtagagtctgatcaaagccattctgacgaacaatgtgagcaattagataaaccgattccggctaaagacaaagcacaggatgtttgggaaaaaaagttttcccccaatgcagcaaattctctaagaaatttatcaggaagtcatgatttctctactatccgatcgacctattgcgaccttgaggatgactatgagaaagagatccaaaaggaactcagatggctcagagccaagtaccaaatggagttaagggatcataaggatggacagtttgggcaatgctcacatagtagtaacagtgagcacagaacagaaaatggctttttgtcaccttcactgacagaaacattaaaaggaggcaacaatgggactcgtagccaccctcatgtccatgaaagcagccccaattcggacacccaaagggcccaaaattgtgaggcgattgaatcccctggagaaggctcattgctgccgcactctttgcacaggacagtttctctcccagttgatgctgttgatatataa

SEQ ID NO: 1049 - DNA, 525 bp, Glycine Max
atgaattcagagaagtcagtgagtcttgatatttcaagtgaagaaaatgatcatcatgatcaagatgatgacactggtggaaccaaacggtcttatgagtgcacattctgcaaaagaggcttcacaaatgctcaggctttaggggggcatatgaatatccataggaaggacagggccaaggccaagcaattcacaattgatgcttcaccttcagttaacaaattcaacaacgatgattccacggcccttccttttgtctcagaaattatgaatcaacccacaaagcctaattactactcccttttggagtctcagatgaactttcaaccaccacatgccttttattatgagttttgtaactcaaggtctcagcctttgagtttgaaccaagggcttcatggtgccaatttgagtctccaaattggtccgagtcatgttgatgataacattcatcaattcaggagaggaaatcagaaaacgagtgaagtggacttggagctcagacttggccatgatccatactga

SEQ ID NO: 1050 - DNA, 600 bp, Glycine Max
atgaattcctttcaagaatttgactcatcaaacacaaacagtaccaaagccaccaatttcccatcatcatcatcagcagcaccagcagcaacagcaccaccatgttcttcttcttcttcttcgaccactctgagccgctacgagaaccaaaagcggcgcgactggaacacgttcgggcagtacctccgcaaccacaggcccccactctcgctctcacggtgcagcggcgcgcacgtgctggagttcctgcggtacctcgaccagttcgggaaaaccaaggttcacacgcagctttgtcccttcttcgggcacccgaaccctccagcaccgtgcccttgtcctctacgccaagcatgggggagcctcgacgcactcatagggcgcctcagagctgcttttgaagagaatggaggaaaacctgaagctaacccttttggcgctcgcgctgtgagactctaccttcgtgaagtgcgtgattcgcaagccaaggctaggggtattagctacgagaaaaagaagcgcaagcgtccccaacaaccttcattgcctccctctaataatgcaatcaaccaattaaaatttttgcacatacccagataa

SEQ ID NO: 1051 - DNA, 735 bp, Glycine Max
atgaatttcgttaagaactcaatccaaagcattgggaccagcacaggccttcaaaacggggctccaaatccactgcaccagaaacttccgtccatttctaccgttaagattaaacgttctcccttcgccgtctttcataacggaaccaatatagccgccgccaccacccgttccgtacaagccctcgcacaaatctccgatctcggtgggcgcggtggggtcctcgccggcgtaccatgcgttcacgagcgggttcgacgagagctccgccagctcgtgcccgatcacgctcaccatgccgtccaccccgacgtctccgttcggcggcgtgaggtggccgggtccgccgccgcccatgtacccggggacggcgaagggataagcgcaaacctcggggcactgttttccggagttccccacccacgcgtaagggagcgtgtagcccaccttcgacgggaagggcttggcctggacggcggtggcaatgacctcctgcacggagaggcgcgtgaggtgggtgccgtgggagtagcggaggtcggagtactcgccggcgatggagacggagcgggagatgttggcgccggtctggtcggtgtagagggagacggtgcgccaccagtcggagacggagggggagggggcggcgcggtgatattgatcggagatgaaagcaccggccccatgtgcgcttcgaggacgagagggttcggaggggtgggacctgtgggttga

SEQ ID NO: 1052 - DNA, 2034 bp, Glycine Max
atgacaaatgatattattcggggtctgatcacaaaagtaatctggaatgtattggaactcagatgcgtggttttattgagtttcttcttgcaagtattccttatattttttggcaacagaagaaagtacatagccaatacatggctacatgtctgtgtctggttgacctatctgttggcagatttggttgctacctttgcgctgggcaagctttccagagacataaatccttcaacagaccccaatttcgtaatctgggtacccttccttcttgtgcatctcggtggccctgacacaatcactgcctacggcctcgaggataatgagctatggctacgacacttgcttgggttattctcccagcttgcagtagcaagttatgttgtttacagttcatggaatggcaacaaccttaactatgttaccattccagttatggtggtaggaataatcaaatatggtgagaggacttggtccttgtggttgggaagcagcaagaagttcagaaaatccattctccctcctccagacgctggaccaaattatgccaaattcatggataactacactgcaaaagaagctgaaggatataaagttgaattgaagggggaatgggaatctacgcccatactattggatcacccaccagggacaatagcaaatgaaagtgtaccagatgctttgcttttacaggatggattctatttccttgaaattttcgagtgcctatttgcagatctcatccttagcattcaagaccaccgaagcagccaacatttctttcagaacagatcatgggaacatgcgtataaagtaattgaggttgagcttggattgatgtatgataagctatatacaaaggcagtggtaacatactctcgcccccttggccttgtcctcaaatttgtgaccttttcctgcaccctctttgcatttattgcattttattgtctgatagataaagcacacatagattatgaccaaattattactttggtgcttttcgctggggctatttttcttgagatatacgcggtcattgttttactttgttcaagtcagaccatgcattggttaagcagcaagcataagagtaggaaagtggatcttctctacaaggccatcgcatatgagccagtcaaatgcatcaacgtccagaaatttcttggcgtctatgagtttttcgagaagtcttactaccaacacacacatgctattttggacaagtcttgggatgcaaaagacaccaaagcatgtaaaacattatgtgctctcaggggtgatcgagttcttcacaaacggaaatgccgtttcattgactggagcactgaggtagagttcgatcaaagccttctgctttggcatattgctactgatctttgttactattcagataaatcaaaatcagatgaatcagatgaatcagatgaaaattgtatgttatggctttggcatattgctacagatctttgctgtgaatcagaatcagatgaatcagaggcaaattgtgctgcctggctccaaaattataaaataagcaaattcttgtcagattatatgttatatcttcttgtggaatgtccttttatgttgcccaacggaatagggcagatcagatttgaggacacgtgtgcggaggccagtgaaattttgcaagaaaggaagtacatttcacaaagagataaagtttgccaagtgatacttcgagtgaatacagatgttctaccatcaaaggttaaaggagatagaagcaagtctgtgctctttgatgcacgtaggcttgctaaatcgttacagtctttagaaacgaaaaggaattggtcgaaagaagagaaatgggaaatgataagtcatgtttgggtggagatgctgtgttatgcagcaagccagtgtagagggcttcatcatgccaagcagctaagccgaggaggtgagttgctcacacatgtctggctgttaatggctcatttgggtataactgaacagtttcagatttcacaaggtcacgcaagggcaaagttgattgtgagctaa

SEQ ID NO: 1053 - DNA, 2814 bp, Glycine Max
atgacaatcgccgattcagtttttccgatggataatgtggccagttgcatactgcttccgccggaggaggaaaaccggatcgtgtcggagttgatcaaggagtcggagcttaatttgaaagaaggcaacttatattacgttatttctaacaggtggttttcaaggtggcagagttatgttgggccttgtgttggtatgctttcagtcgacaagcaatcttctgatggccataatgccaacatgactcacccaaagattgcagatagacctgggcctattgataattctgacattatttctaagggaaatagctgtgacaacaataatttagatattcatcgaatgttggaagagggtacagactatgttttagttcctgaaaaagtgtgggaaaggctgttggaatggtacaaaggtggacctgctttaccaaggaagttaatttctcagggtcatgaacataagcaatacaatgttgaggtttacccacttagtctaaaggtgactgatgcgagagataagaggcagtcaattgtaaaattaagcagaaaggcgaccattggtgaacttcatgagctggtgtgcaaaattaaaggagtagaacaaaacaaggcctgtatttgggattacttcaatttgaacaaacaatcattgctgacagtctcagacccgaagacattagaggatgcaaacttgataatggaccaagatctggaaatagaactccaaagctttaataatttcttcttttgcctacaaagtggagatggctcttctcattctggcatggattcaatgggaaatgaattagctttggtgccattagaaccttcaaggtcatctatgtccattgctgggggacctaccatgtcaaatggtcactcgactgggtctagttttagtttgtatcagggaagttctgtaagttcatcgttgaccaatatggatgatagatatgatgtctataaaggtgaaaggggtggtttggcagggctgcagaacttggggaatacctgcttcatgaacagttctattcaatgtttagtccacactccaccactttctgaatatttcttacaagattacagtgatgaaatcaacatggacaatcctttaggaatgtgtggtgagttagcacttgcatttggtgacttgttgaggaaattgtggtcttcagggcgaactgctattgcaccccgtgcattcaagagcaaattggcccgatttgctccacaattcagtggttataaccagcatgattctcaggaattgcttgcctttttattggatggattgcatgaagatttgaatcgtgtgaaacaaaagccttacattgaaatgaaggactcggatggtaggccagatgaggaagttgcatctgagtgttggaaaaatcatatggctcggaatgattcattgattgttgatgtatgccagggtcaatacaagtcaacattggtttgtccagtatgtggcaaaatttcaattactttcgatccattcatgtacttatcattaccactgccttccactgtcactcgcacaatgacaataactgtcttttattgtgatgggagtggtcttcccatgccatacaccgtgacagttctgaagcatggtagctgtagagatctttgccaagcattaggcattgcatgctgcttgaagagtgatgaaatgcttttgcttgcagaggtttatgagcataaaatttatcgatatctagagaatccgatggaaccattgaattcaataaaggacgatgagcatattgtggcctatcgagtcaaaagtggagccaggaaaacaaaagttgaaataatgcatcgatggctggataatatgaaggctggagacaggaagctctttgggaccccgttggttacttatttggtagaagatcctcaatttggagccaacattgaggcatctgtacataaaatgttggaacctttaagaaaagcatattcctcaagtaagtctcatgatgggaaggaaaatggtttcatctcagctggcagtgatgagcaatcaaacatctccaatactcaaagtgaatctcagagtttaacaactggcaacaaagaacaagagggaacatcctgtggggagtcatctttccaacttgttttaactaacgaatgctgtttgagttgtgaacccattgagaaggcttcttttataaaacccaaccaagttgtaagagtctttcttgactggactgacaaagaacatgaattatatgatgctagctacctgagggatctcccggaagttcacaaaactggattcactgtgaaaaaaacccggcaagaagctatttctttgttttcttgcttggaggcattcttgactgaagaacctcttggaccagatgacatgtggtactgccctagatgcaaggaacacagacaagctacaaagaagcttgacttgtggaaattgccggagattcttgtttttcacttgaaacggttctcatacagtagatacctgaaaaacaaacttgacacttttgtgaattttcccattcacaatctggatttaactaaatatgtgaaaagcaaggatggaccgtcttatgtgtatgacctttatgcaatcagcaaccattatggtggtctaggtggtgggcattacactgcgtattgtaagttgatcgatgaaaataaatggttccatttcgacgatagtcatgtctcttctgttactgaagctgaaattaaatcttcagctgcatatgtgttattttatcagagaaatagaattaaaggccagatggaaggggagacatctcaggttcatacagtatag

SEQ ID NO: 1054 - DNA, 2439 bp, Glycine Max
atgacagattttcagccgctacagcagaagcctgagcctgctgatgcccatgctgagtttgagcttggactggaggagtttatgcgtgggcacttggatgattgtatgtcgtttgcttcgtgtagctcgtctcgtgctccggatgatgaggatgacgagggtgatcagctggttcggaggagaaggaggtctgaccttgaaggggatgatttggctgagtcgtcggctgcacgccggcggcattcgaggattttgagcaggtgggctgcacggcaggcacaggagatgataactactatagagaggaggaatcgagagtctgagttgatggcgcttgcggggttgcataccgtgtcaatgctggattcttcttttctgaggggttcgcagtctccaacttctggccaggagggggctgtggagaggccgagcactcaggcgtctgccattctgcagatgtggcgtgagttggaagatgagcatttgttgaaccgggcgcgggaaaggatgagggtaaggttgcggcaccagagaaattctgactctaataccaatgtgtccagtaccatgtctgatagtcgaggcagtgagaaccaagggagtttgggggatgcaagtgaaagtgaaactgattatggtacttggtcacatgatcagattggatcaaggaatgcacatggggatcataatgggtctagcagggaacaatctcctgatcttggcgaagttgagagggagagagttagacagattgttcagggatggatggaaagtggtattagtgatcattcatctaatgtgagtcagagaaacaataaccggagagcagaatggcttggagaaacggagcgtgagagggtaagaaatatcagggaatgggtgcaaatgattagccagcagagaagttcgcgtgggagccggagggatgctcaagtaagtgagggtgctcaatctgatcgagcccgcgatgtagtagctgataatgatgagagtcagccagagcatgttcggcgggacatgttaaggttgcgtggaagacaggctctagttgatttgcttgtgaggatagaaagggaaagacaaagagagctgcagggcttgttggagcaccgagctgtttctgattttgctcatcgcaaccgtattcagtcactgctcagaggtagattcctccgaaatgaaagaactgttgaagatgagaggccaccgtctatggctgcaagtgaattagttcagctaagacaacggcacacggtctctggtttaagggaggggtttcgttcaagattagaaaatattgttcttggtcaagcaggcaccagtcctgattccacatcaaatagtaacgcgagtgaaacaagaggtgatgggagccaagcaaacagtctgcagattaggagcctggaaactgatgtgcctagtaatcaaggggggaattggcaggaacaaattgctgaagaagggggaggaaactggcaacggagtccatttgatcagacgagagatggaagggcagtcagtgattggccacaggaacctcccagaaacttaactggggaagatcctcatccccaggaagctcaaagaatttggcatgatgataacacaagggaaactgttggtaattggtccgaaggaccttctggagcttcgaggaatcgccgtggggttcccataagaagattcaatagatttcatccacctgatgatgataatgtatacagtatggagcttagagaacttctgagcaggagaagtgtttctaaccttcttcgtagtggtttccgtgaaagtctggaccaattaatacagtcatatgtggaaaggcaaggtcgtgcaccaattgactgggatttgcatcggaacttgccaacaccaactcctgcctctcctgaacgggacccagaccagcagggtgaggaacgtgatgagggtcaacatgaaaccattaacaggccttcactggtgttgccttctccaccagtacctccaccacaacctctgtggcaccaggatttgcatcaaactggatggtctcgccatagcatgcatcgttctgaaattgagtgggagataatgaatgatttaagatcagacatggcaagacttcagcaaggcatgaatcacatgcagaggatgttggaggcctgcatggatatgcaactggagttgcagcgctctgtcagacaggaagtatctgctgctctgaaccgctcaggattgagtgctgagacatctgatgatgggtctaaatgggggcatgtgaagaaaggaacttgctgtgtttgttgtgataaccatatcgattctcttttgtacagatgtgggcacatgtgcacttgttcaaaatgtgccaatgagttaattcgtggtggtggtaaatgtcctttatgccgagcaccaattgttgaggtggtccgagcatattccatactgtaa

SEQ ID NO: 1055 - DNA, 984 bp, Glycine Max
atgacaggctcagcagatccattagtgatatcatttggtgagatgctcatcgactttgttcctgacacatctggtgtctccttggctgagtcttgtgcctttatcaaagcccctggaggtgctcctgccaatgttgcttgtgccatatccaaacttggtggtaacgctgccttcattggcaaggtgggagatgatgagtttggaaggatgctagtagacattttgagggaaaatggggtgaacacagatggtgtttgctttgatatggaggcaagaactgcattggcttttgtgacattgaggaaggatggagagagggagttcatgttttatagaaaccccagtgcagatatgttgctgaaagagtctgaattgaatatgggtttgattaagctggctaaggtattccattatggttctattagcctgatagcagagccatgcagatcagctcacttggctgccatgaaagttgctagagaaggtggtgctttgctgtcctatgatccaaatgtgaggctccctttatggccttctgaagaggctgctaggtctgggatcaagagcatttggtttgatgctgacttcatcaaggtgagtgatgacgaagtacattttctaacacaaggtgatcctgagaaggaagatgttgtgatgtccctgtggcacgacaagttgaagatgcttcttgtgactgatggagagaagggttgcagatatttcaccaagaacttcaaaggaagggttactggattctcagccaaggtagttgacacaactggtgctggtgattcttttgttggtgcactcctcactgctgtggccagggaccctaacatatttgataacgaaccaaaaatgagagaggctttgacatttgcaaatgcttgtggagcaatgtgtacaacacagaagggagcaattcctgcacttccaaccgctgcagaggctgagaagtttatttctaactctaaggccgaatag

SEQ ID NO: 1056 - DNA, 1695 bp, Glycine Max
atgaccactagtgctgatatattccttgattggcacgtttccgctgacttcaatttaaagcctgtgtccactgatcaaccggtaattacaatcaatggcatgttccctggaccccttataaatgcaacaacaaatgataatattcatgtcaatgttttcaatgatttggatgatcccttgctgtttacatggaatggcatacagcaaaggctagactcatggcaagatggagtgtctggcacaaactgccctatccaacctggcaagaattggacttatgatttccaagccaaagaccagattggcacattcttctactttccttccatcaatttccttaaggctggtggagggtttggtccaattcgagtcaacaatcgacccttgattagcgttccttttccaaaacctgaggcagagtttgatcttctaattggtgactggtacatcagtagctacaaggacattaggtccaggttgaatacggcagatgttccttctcctgattggatgctaataaacggaaaaggaccatatatgaacaatctttctcaatcatatgagaccttcaatgttacacaaggcaagacatatttgcttaggatatcaaacgtagggacagcctggagcttcaatttcaggattcaaaatcatcaactggttttggttgaaactgaaggttcttatgtcaatcaaatagagctggagtctcttgatgttcatgtaggccaatcctactcagttcttgtcacagcaaaccaaaatgctgttgattactacatagtagcctctcctaaactgagtaatgccacaaataataacactcttgttggcgttgctgtgcttcattatgacaactctaccacaccggctaatgggtctcttccaagtggtaattgcatttcacaaaatggtgctctgtatgccaaagaagagtttttccaattttctttctttgcttgctcaatgtggaacctcaccactggagctgcaaggcctaatccccagggaatgttcaatgtaacaaatgtgacaataattgaaactttcattctaaacgcatcaacagcaactattgatggattatctcgctattctgtcaacaatgtgtcttacttgatcccagatacaccactgaaactagctgatttcttttccaatggaactggtgtatatgaacttgatgctttttctaagaacacttcaaatgctaacgccgtgcgtggagttttcgtagctagtgcattacataaagggtggactgagatagtgctagaaaacaatttagacatcattgatacttggcatttggatggatatagcttctttgttgttggaatgggggaaggagattggaatccagaatcccggtcaagttataacctttatgatcctgttgctcgctccactgtgcaagtgtaccctggagggtggagttcagtgtatgtgtaccctgacaaccctggaatgtggaacctaagatcacagaacttgcaaagctggtatttaggtgaagagctctatgtgagggtttatgatgctgatcccaaccctgccaaggagaagccacctccacagaatctccttctatgtggcaagtatcagccaccaacccctcctccctcagtgtccccagcaccaaatgctccatcatccaacgcatatgcatataatccacatagaacaaggtattag

SEQ ID NO: 1057 - DNA, 744 bp, Glycine Max
atgacgacaccaccgtcttcctcctcagcttcgcactcgcaattcgcctattcaaacccttcctcctcctcctacttccccgttccctttcaccttcagcaacccgcaaccactcactacgctgcgccctacgtcgccgccccctccgtgcaaatccccgctcctcccgtcgtcggccccattgctcccgcgccggttcccggcgtgtactccgccgtgccgcaatatcaggcacagcagttatttgagagggatgcgcagataataacgccggaggctcttgagaatgttaaggcagcgattgcgagcagcgacgtggaacacaaaactgatgccaaaaagaaagcggttcctcgcaaagctgctggccaagcttgggaggatcctatccttgcggagtggccagaagatgattatcggctcttctgtggggatcttggtaacgaggtgaatgatgatgttctctcaaaagcattttcacggtttccttcctttaacttggcacgagttgtcagagacaagcggactggtaaaacaaaaggttatggatttgtgagctttgccaatccttctgaccttgctgctgctcttaaagaaatgaatggtaagtatgttggaaatcgtcctataaaactacgcaagagtaagtggagggagaggacagattatgaagcactggagaaacagaagaatcacattcaaaagaaaccgaaaatgccaaggaaaggtgtgctgcacaagtga

SEQ ID NO: 1058 - DNA, 762 bp, Glycine Max
atgacgatgaagataatggtagcgataaagcgagtggtggactacgccgtgaaaatcagggtgaaggcagacaagacaggggtggtgagccagaacgtgaaaatgtcgatgaaccccttctgcgagatcgctctcgaagaagcccttcgcatcagagagtctggcttggcctccgaggttgtcgccgtcaccatgggaccctctcaatctctcgacactctccgaaccggccttgccatgggagccgacagaggcatccacgtcgactcctctgcttccctctaccctctctctgttgccaaaattttgagaaaactcgtcgagattgagaaacccgctcttctcatccttggcaaacaggccattgatgatgattgcaatcaaactgggcagatgatagcaggactcctcaactggcctcaagggacttttgcttctaaggtggtccttgacaaagagaaacaggttgccacagtggacagagaggttgacgatggtattgaaaccgtgtgtctgaacttaccagcagtaataaccactgatctgaggctgaaccaaccaaggtatgctactcttcccaacataatgaaagcaaagtcgaaacccataaaaaaattcactccggaggagttgaatgtggaaatcaaatctgatttggagattgttcaagtcacagaacctcccaagagaaaagcaggggttattctttcttctgtggatgagctgattgacaaactaaaacatgaggctaatgtcatctga

SEQ ID NO: 1059 - DNA, 540 bp, Glycine Max
atgacgatgaagataatggtagcgataaagcgagtggtggactacgccgtgaaaatcagggtgaaggcagacaagacaggggtggtgagccagaacgtgaaaatgtcgatgaaccccttctgcgagatcgctctcgaagaagcccttcgcatcagagagtctggcttggcctccgaggttgtcgccgtcaccatgggaccctctcaatctctcgacactctccgaaccggccttgccatgggagccgacagaggcatccacgtcgactcctctgcttccctctaccctctctctgttgccaaaattttgagaaaactcgtcgagattgagaaacccgctcttctcatccttggcaaacaggccattgatgatgattgcaatcaaactgggcagatgatagcaggactcctcaactggcctcaagggacttttgcttctaaggtggtccttgacaaagagaaacaggttgccacagtggacagagaggttgacgatggtattgaaaccgtgtgtctgaacttaccagcagtaataacgtaa

SEQ ID NO: 1060 - DNA, 1758 bp, Glycine Max
atgactatggaagagggcagggtcgagaacgaggactacacacaagatggaactgtcaacattaaagggaaacctattcttagatccaaaagtggtggttggaaagcttgctcctttgttgttgtatatgaggtattcgaaagaatggcttattatgggatatcatcaaatttgatcctttatcttacaacaaagcttcaccaaggcacagtatcctctgcaaacaatgtcaccaattgggttggcaccatttggatgacacccatattaggcgcctacgttgctgacgctttccttggccgctattggacttttgtcatagcctccaccatttatctctcgggtatgtctctgcttacactggcagtgtcccttcctagcctgaagccacctcaatgctttgtaaaggatgtgacaaaatgtgccaaagcctccacactacagctagctgtgttctatggtgcactttacactctagcagtgggaactggaggaaccaagcccaacatctccaccataggagctgatcaatttgatgattttcaccctaaagagaagttacacaagctatccttcttcaattggtggatgttcagcatcttctttgggacactctttgcaaacagtgttctagtttatatccaagataatgtggggtggactcttggctatgctcttccaactcttggccttttagtatcaatcatgatattcgtggcagggacacccttctataggcacaaagtgcctgcagggagtaccttcactagaatggctagggtcgttgtggctgctttgaggaaatcaaaagttcctgttcctagtgactctaaagaactatatgagcttgacaaggaagagtatgcaaagaaagggagctacagaattgaccacactccaacattaaagtttcttgacaaggcatgtgtgaaaacagattcgaacactagtgcatggacgctatgcactgttactcaagtagaggagaccaaacaaatgataagaatgattccgatcttggttgctacatttgtgcctagtacaatgatggctcagataaataccctttttgtgaagcaaggtactactcttgacagacacctcggaagcttcaaaattcccccagcaagtttggctgcatttgttactgtgtccttgcttgtttgcattgtgctctatgaccgtttctttgtgaagatcatgcaaaggtttaccaagaaccccagaggcattacccttcttcagaggatgggaattggccttgtaatccacacactgatcatgatcattgcatctgggactgaaagctatagactcaaggttgcaagagaacatggggtagttgaaagtggagggcaagtccctttgagcatattcattttgcttcctcagtttatactcatgggaactgctgatgcattcttagaggttgcaaaaattgagtttttctatgatcaatccccggaacacatgaagagcattggaacttcatattccacaactaccttaggccttggtaacttcatcagttcctttcttctctcaacagtgtcaaatgtcaccaagaaaaatggtcacaaggggtggattttgaacaacctcaatgagtctcatcttgactactactatgcatttttcgcaatactaaacttcctcaacctcatcttcttcgcgtatgttactaggttctatgtatatagagttgaattattggaggtcgttttagcatcatgtgatcattttccttatcctttgtaa

SEQ ID NO: 1061 - DNA, 921 bp, Glycine Max
atgactgccaaacaaaccaagcagcattataatagaaagaggacacaaagtgaaagagaagggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtgggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaatcctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctga

SEQ ID NO: 1062 - DNA, 1503 bp, Glycine Max
atgacttcgcaaaatggtgacgagagccaccacccaccaccgcaagcgcaagctgaaaaggttactgaagttggatggtacgttcttggcgaggatcaacaacagattggcccttacgccttctctgagttgtgccagcatttcttgaatggatacctctccgaaaatacgtttgtgtggtctgaaggaagtagtgagtggcagcccttgtcctcggtttctgacctgtgggctcaaattaaccggcagggacctgattcttcaactactgtgtctgctcctgatgttgatgagtttgaaagatggcaaaaggagattcaggaggtggaggcacaggtggaaggttcggaatttggatccttatctggcaatgttggtggtactggggcaggagaagattctgagagaccttcgacgccacctgagggtgaagaaggatttactgatgatgatggaactgtatataagtgggataggagtcttagagcttgggttccccaggattatccaactggcagcactaagccttatggggttgaagagatgaccttcttggaagaagaggaagtttttccaacaatacctaattctgatgcctctgaaaagtttgaagatagtccaaaattgagtgtttctgtgcctcccttaaaggaagaagaaaataataccaatgtgatatcaggtggaaaaaggatgctttcagatcaacaaacagacaagaaggaagctaataaaccccctgatagttggtttgaattaaagattaatacgcatgtttatgtcactgggttgcctgaggatgttaccactgatgaaattgtggaggtattttccaaatgtggaattataaaggaggaccccgaaaccaaaagacctcgtgtgaagctctatgttgataaagagacaggaaggaaaaagggagatgctctggttacatatcttaaggaaccttctgtggctttggcaattcaaattttggatggagcacctcttcgccctggtggcaagattcctatgtctgtcagccaggctaaatttgagcagaaaggagacaagtttgtatccaagcaagtagacggtaaaaagaaaaagaaattgaaaaaggtggaagacaaaatgcttggatggggtggtcgcgatgatgcaaaagtttcaattccagcaactgttatccttcgttatatgttcgctccagctgaaatgagggctgatgaaaatctgcatttagaactagaagaagatgttaaagaggagtgtacaaagcttggtcctgtggattcagtcaagatatgtgagaatcatcctcagggagttgttttggtaagattcaaggataggaaggatgcccaaaagtgcatagaattgatgaacggacgatggtttggtggtagacagatacatgccagtgaagatgatggttcggttaaccatgccttagtccgggatctggaagaagatgtcattcggctggagcagtttggtgctgaacttgaaggtgactga

SEQ ID NO: 1063 - DNA, 999 bp, Glycine Max
atgacttgtgtacactcactcgtgttgttcctgtttggggtggtgattctcactactccagtgttggctaatttctttccacccatttatgagcctcctccaattgagaaaccacccatatatgaacctccacccagctatgagcctccaccaactgaaaacccaccaccattatataaacctccattctaccctccaccagtgtaccagcctccatatgagaagccaccaccacctccatatgagaagccaccaccagtgtaccaaccaccctatgagaagccaccaccagtgtaccaaccaccaaatgagaagccgccaccagagtaccaaccaccaaatgagaaaccgccaccagagtacgaaccaccccatgaaaaaccaccaccagagtacgaaccaccccatgaaaaaccaccaccagaagtaccagtgcactgccacgagaagcctccaccagagtaccagccacctcatgagaagccaccaccaaaatatcaacctcctcatgagaagccaccaccagagtacaaaccaccacctcatgagaaacccccttatgagaatccaccacatgaaaaaccgccaccagaataccaacctcctcatgagaagccaccaccaaaatatcaaccacctcatgagaaaccaccaccagtgtatgaacctccacatgagaagccaccaccagcatttcaacccccttatgagaaaccacccccagtagtgtgcccaccaccattgtatgaacccccttatgagaagccaccaccagtgtaccagcctcctcatgagaagccacccatttacaaacctcctttcgagaaaccaccagtatacgagccacctcctttggtgaagccaccaccatttgaaaagcctcccttttacaaacctccttacgagaaaccaccactttacgagccacctcccttggtgaagccaccgatctacaatcccccaccttatggccactatccaccatcaaagaaaaactaa

SEQ ID NO: 1064 - DNA, 1255 bp, Glycine Max
atgagaagtgggcagaacgtatttgggacccgcgttctgcgactgagggtgattcggaagaaaatccccgcgcacaagagggaagctttcattcctcagttcgtgggccttggtccataccataatttaagccctgacctcatcttgaccaaggaaaggaagttggccgcagccaagagggtcctcaaagacctcctctccgacagcatgaacctaatccaacaacgcatcatctcaaagcttctcaccagcagcagcagtacagctggcggcgaccttgatgatgcagagttctctaacttcctaactggaaaaatcaggatgctcctgtttaacgctgctgttttcatgctcgagaaccaaattccctctctggtacttgagcagatcactggatcagctcagggtctgggactgggttcaaacgtggtgactttctgtaaaaaccactgtcctgttctcaacttagaagagctccccaacgtggactatgttcatttgctggatctaatgtaccatttgattgtacctagggctcagtctccgcctcagccccaagagcctgaagctcggcctgaagctccgctagaaactgagtccaatgatgacgaacctcagccagagcccgggattggacaatattttccatcaatctttggaggcggggaatgggaattaattatagtgccgctgatagcatttcggcggagaaacttcaactctgcgttccgatggtctcatgaagctctaaagaacatgggaagtagggttaattatccattggtgggatccttaacacaagcgaaactccgcagtgctgggatctacttccaaccagctaaaagtggcgccatctcatctattgatttcgttgaagaaagttgcattttctacttgccatgtatcagaatgggtgtcaactcagaagtgataatcagaaacctcgtggcttacgagactttaattaaatctgacacccccttggtcttcacaaggtacattgagttgatgagagctattatagtcacttctgaggatgtgaagattttggtagatagccaaatcatcacaagcgagttaacgaatcaagccgtcgcggactttttcaatgggatgagcaactcgattaggcctaccaagactgaagtattggataaagtgatccacaaagttaaatccaagttcgacagtacgcggaaacgaaactgggctgttatcaagcatatgtctaagacattctttgcagttatggggg

SEQ ID NO: 1065 - DNA, 852 bp, Glycine Max
atgagacgaaaccattcgaactccggcaattatcggaatccatgtttaaccatgcaccagccttgggcttctctcctcgtttacgggatcaagcgcgtcgagggcaggtcatggcccgctccaatcacaggtcgtctttggattcattctgccagtaaagtcccggaggagtctacaatcaaagcaatggaatacttctacaaggagatttatgcactcaatggcatcagtgatatccaatttcctcaacactaccctgtctctaggcttttgggctgtgttgaagtggttggctgcttaacacgtgatgagctagcatgctgggagatggttcctgaaggggtgaggttggaagcacaaactgattattgctggctgtgcgaatggccacagaaattgttgattccatttgagatgcgggggtaccaaggtgtttataacctggaaaagaagatttatgaagctgcagttagagggctgtctccagttaatagtccgatgccggtgaaatttccgcttccagatccacgaaatccattttcattgaagccaggttccatctctgcgcttacttctaacttaaaagcatctgaagtggataaatcatcaagcataagtctggccatagctggggcacaaacagcagccactcagttctcaaagaaggatcagaattcccgtagtactgcttggaacaatgcacctactaacatgaatgctaataatgaggatacagaagttgcaagatcttataatctaagatcacgaggcaggtctacggaaaaggacaatatatcatcgacagagttaaatatgaaatttggtgatctgaccttgccatcatatcactaa

SEQ ID NO: 1066 - DNA, 435 bp, Glycine Max
atgagagcagaagaaagttgggaagcttccagatatgtgcactatgcacctgctgtggtggagcaaaagggatctgcttgccctctccctgttgctatgccatcaattgcaacattcccaatagaccttttggcttttgttccttcacccctaaaacctgtaattgctttgaatgccatctttaatgctttctcttgcaactttcctagtgtcaatcccagaatattgggcttaatcataattttttaccttaatttcaatcaacatactaattcaggtgttatgttttgtgggggttggaataggacagttaagccaaagttacaaacctgctatgtttgtaataggttttgctggttgtttcataatggatcatgtatcaatgcaatgagccttggtatgtgtatttttttctcttttctatgtgttttatga

SEQ ID NO: 1067 - DNA, 2487 bp, Glycine Max
atgagaggaggtatttgtagcatacagcttcaggctcttacacctgaagctgcaactgttgttaagcaagctgttaatcttgcaacaagaagaggccatgcacaagtgacacctcttcatgttgcaagtgccatgcttgcaacttccacaggccttctccgcaaggcttgtcttcagtgtcactctcaccccctccagtgcaaggctcttgagctttgtttcaacgttgcactcaaccgtctaccagcttccacttcaagccctcttctggcacctcaatattccaccccttcactctccaatgccttggttgcagccttcaaacgtgctcaggctcaccaacgccgtggttctattgagaaccagcagcagcatattctggccttgaagattgaggtggagcagctcgtgatttcaattcttgatgatcctagtgttagcagggtcatgagagaagctggtttctctagcacccttgtgaaaacaagggtcgaacaagctgtttcaatggaagtttgttcacaaaaggctcaagcaaaagaaaatatcactaagcctcatcatcaacctaatttggaccatgttaacaatgatgatgtgactagtgtgttgagtgagttggcaaagagaagaaacacagttattgtaggggagagtgtgaccaatgctgagggtgtagttaggggagtgatagagaggtttgaggttgggaatgttcctggagacttgaggtatgtgcaatttgtgagccttcctctcatgtgcttcagaaacattagcaaggaggaggttgaacagaagcttatggaggttagaaaccttgtgaagagctatgtgggaggaggggttgttctttacttgggtgatctaaaatggctgtttgagttctgggctaattttcgtgagcaaaaaacaaactactgttctgtagagcacatggtcatggagcttaaaaaattggtatgtggtagtggggagtctagtagattgtggcttatggggatttcaacttttaagacatacatgaagtgtaaaatatgtcacccatccctagaaaccatttgggagcttcatcccttcacaattcctgttggcatcctcagcctaagtttaaatcttgacagtgattttcaagctcaagagagaaacaaggtatttttcaaggatgtggcttttgaagatagagcaggagtcagaaaccatctaacttgctgcagggattgcacaataaattttgaaaaagaagctcagagcataactagcactataagtaagaaagcttgcactactagtagcttgccaacgtggctccaaaattgtaaggaagagagaagtgacataatggaagatcaggaaaatgcaaggcttaaggatctgtgcaagaaatggaactcattatgcaactcaatacacagacacccttccattaatgagaaacaagttttctttgtttcatcatctccttcatctcccacttctgtttcctcacatgaaagaaagtccaactttcaccacagccacctaaattggccaatcatttctgaatcagaaaagtcaccaaaagaatgtgagttatacactgaaactggtgatgatggctatgatagcaactttataatgttcatgccagatagtgatgtccctaaaccagatcttctgtcaaatcccaactctagccccaactcagcttcttcaagcgaagcagtggatggtttggaaagcactcaaatgttcaaagaacctaatgctgagaatcataagattctgtgtgatgccttggagaaaaaggttccacagcataaagaagttattccagagattgcaagtaccgtccttcattgtagatcaggaatgagaaagagagatcagaaccactcgatgaagagagaagacaatcaagaaacatggatgttctttcttggtgtgaattctcaagccaaagagagcatctcaagagagctagctaaagttgtttttggctcttatagcaactttgtcacaattggcatgagtagtttctcttccccagaagatgatgatgattccactgatgaaaaatccaaaaggaagaggccaagagaagagttgaaaagcagttatgctcaaagattcggggaagcagtgaatgagaaccctcacagggtgttcttcttagaagacttggatcaagttgattacttttctcaaaagggtgtagagcaagcaattcaaagtggaagcataacacttcctggtggtgaatctgttcctctcatggatgccattgtcattttcagttgcgaaagcttcttctcttcaccaaagctgagaaaatcaccatgtgctgaaaacaaagggaaagagactgtggaagatgaaagttctagcctctctttggatctgaacatagccattgaagatgaaagtggaggtgtggcattcggtggagacaatggtatcctagagttagttgataaacaaattaatttcaacatacaagaatcgtga

SEQ ID NO: 1068 - DNA, 2652 bp, Glycine Max
atgagagttgcagtggttggtagtgggattagtgggttggcttcagcttatcttttggccaaagggggagtgaatgtggtgctctatgagaaggaggattcgttgggaggacatgccaagactgtgaatgttgatggggttgatgttgaccttggcttcatggtcttcaatcgggtcacctatcctaacatgttggatttttttgagaatcttggagttgacatggaatcatcagacatgtctttttctgttagtttagacaaaggtcgtggatgcgaatggggaagcagaaatggtttgtcaagcttgtttgcacagaagaagaatgtactgaatccttacttctggcaaatgataagggaaattgtcaagttcaaagatgatgttattaggcaagttgcaaaaagttcaaagttctatcttgatatgcttgagaataacccagatattgaccgcaacgagcctctaggggaattcatcaagtcaaggggttactccgaattatttcagaaagcctatcttattccaatttgtggttctatctggtcctgctcttctgaaggagttatgagtttctctgctttctcagttctttcattctgtcgcaaccaccatctacttcagctctttggcagaccacagtggctaactgtaagatggcgctcacaaacttatgttaataaggtcaaacaagagcttgagagggaaggtagtcaaataataactaatcgtgaggtgataaagcaatccatctgttactttttcaattccttcctcttcagaaagggaagtaacaatgttggaaaaattattgcaggatgtgttgtgtactgcaatgatggttctcaagaaatgtatgatggatgcataatggcagtgcatgcacctgatgccttgcgattattaggagatgaagcaacatatgatgagcgaagaatactcggagcttttcaatatgcttacagtgatatttttcttcatcgtgacaaaaatttaatgccccaaaacccagcagcatggagtgcatggaattttcttggtagtaacaacaacaaagtttgtctaacatactggatcaatattcttcagaatattaaagagacaagtcaaccctttcttgtaactctcaatccagaccatataccagaaaataccttgctaaagtggtcaactggccatccagtcccatcagttgctgcattcaaagcttcattagagcttgaccatattcaagggaaaagaaaaatctggttttcaggagcataccaaggttatggatttcatgaagatggatttaaggctggcatgatcgcagctcatggcattctaggaagctgctgtgcccttcagaccaacccaaaacacatggtaccttcttggaaggaactgggagcacgcatttttgtgactagattcctgagttgctatatcactactggttgtttaatgttactggaagagggaggaacaatgttcacctttgagggaactgggaaaaactgtggtctgaagagtgttttgagggtccacgatccacaattttattggaaggtgatgacacaggcagatttaggccttgcagatgcatatatcaatggggacttttcatttgttgataaagatgaaggtctcttgaatcttattttgattctcatagccaacagagattcaaatgcatccaactcaaaactgaagaagaataggggttggtggacacccgttttctttacgtctgctttgacatctgcaaagttcttcatggatcatgtttcaaggcgaaatactctcacgcaggctcgcaggaacatctctaggcattatgatctgagcaatgacctctttgcgactttcttggatgaaacaatgacatattcatgtgcaaataaagatgaagacttgaaagatgcacaaaagagaaaaatctctctcctgattgaaaaagctagaatagataagacacatgaaattcttgagattggatgtggatggggaagtttagccattgaagttgtcaaacaaaccggctgcaaatacactggtatcactttgtctgaggagcaactgaaacttgcagaacaaagagttaaagatgctgggcttcaggaccgcatcaattttgttctatgcgactatcgccaattgcccaagacatataaatacgataggattatatcttgtgaaatgatagaagctgttggtcatgaatacatggaagagttctttggctgttgtgaatcagtattggcggataatggacttcttgttctccagttcatatcaatcccggatgagcgttatgatgaatataggcgcagttctgattttataaaggaatatatatttccaggaggttgcctaccctctctaagtaggataacatctgccatggcagccacatccagactatgcgtggagcacgttgaaaacataggtattcattactaccaaacactcagatgctggagaaaaaacttcttgaaaaggcagaatgaaattttggctctcggattcaatgaaaaatttatcaggacatgggaatactattttgattactgtggtgcaggttttaagtcactcacactagggaattatcaggtggttttctcacgccctggtaacgttcctgcattaggcgatccatacaaaagctag

SEQ ID NO: 1069 - DNA, 365 bp, Glycine Max
atgagattgctagttaaactttggcaacttggttgtccaaaagtccaagttggttcaattgctactggtggccgatatgataacctgatagagatgtttggttcaaagaaatttacagcagttggtgtaagtctgggaatagagagagtttttgaaataatggagcaacgtcagaaggatcagaaccagatcccatctcaacaccgattttgctacaaaatttatttagaacttccggcatacaacttaaagcactttgagtatgaaaacaaatcaaggatcccttggatggtacttgtaatacatgtaaacattcctaggcaaaacttttggagcaactgcggagacggttgtacccatgagag

SEQ ID NO: 1070 - DNA, 3699 bp, Glycine Max
atgagatttgttgatttggtgaggaggtggggtgtggttgttcaacaacgacaatgggagaaatgtggtggtgattcaattacgacaatgagaaaggtgaaggtgggttgtggtggtttgatggttacaatgggaaagatggggcgccatagcggcaatgaaaaaggtggtgggtggggtagcaagggaaaccatgggctgattttggctgtctgtgtgattcttattcagttggcttctcagaagagtgttagtgaagtatttattgaccagagaatggctgggactgtgagtgaggagtctggagtgggaaagtccgtggagggtatttcaaatgggcagcgttgtcaatctggggaagcattggcagagtggcggtcttctgagcaggtggagaatggtatcgcgtccacttcgcccccttactgggacactgatgatgaagatgatggaccaaaacctttggcattatatggaagatatacgtggaagatagaaaagttttctcaaattaccaaaagggaacttcgcagtagtgcatttgaggttggcggttacaaatggtacattttaatctatccacaaggctgtgatgtttgcaatcatctctcgctgtttctgtgtgtagctaatcatgacaaacttcttccaggatggagtcattttgcacaatttacaatagctgtggtcaataaagatccaaagaaatcaaaatattctgatacattgcatcgattttggaagaaggagcatgactgggggtggaaaaagtttatggaactgtctaaggtgtatgatggatttgttgactcttcagacaatctaataataaaagctcaagttcaagtcataagggaaaaatcagacaggcctttccgttgccttgattgccagtataggagggaacttgttagagtatatttgacaaatgtagagcaaatttgtcggcgttttgtggaggagagaagaagcaagcttggaaagttgatagaggataaagctaggtggtcaagcttctttactttctggcgagaagttgatcaaacttccaggcgccgcatgtctagggagaagacagatgtaattttgaaagtagttgtaaaacacttctttatagagaaagaagtcacttctactttggtaatggattccttgtatagtggattgaaggctcttgagggccagaccaagagtaaaaaaggtagggtgaaattgttggatgctgaagaaataccagcaccaattgttcatgtcgagaaagatatgtttgtactggtggatgatgttttactgctacttgaaagggctgcaatagaaccactgcctcctaaagatgagaagtgtcctcaaaaccgtacgaaggatggaaattctggagaggatttcaataaagattctgtagagcgtgatgaaaggcgcctaacagaattgggccgtaggactttggaaatatttgtccttgcccatatattctgtaataaaattgagattgcctatcaggaagctgttgctctgaaaagacaagaagaactcatccgtgaagaagaagctgcatggcaagctgaaagtgatcaaaaagcaaaacgtgggggtgagagggaaaagaagtccaagaaaaaacaggccaaacaaaaacgtaacaaccaaaaaggaaaggataaagagagggaggagaggactgctgtgtctgtaactgacaagaaccaaaacaatgctgttgatgagaaaaatgattctagcatggaggaggctcaagctgtgtctgaaaagcctgatcccatggaagatgtttctgacgtgtccgactctgtagatggagttgctgaaacgcttcagcttgattcagaagacagagatgctagtcctgttaattgggatactgatgcatcagaagttaatcctccaactgaggctagatacaatggcataggtagtgtttcaaccatacaaaatggaacgtctgagaaaaggagcagttcagtgatagatgatagttcttcaacatgttctactgattctttgccgtcagtagtcatgaatgacccccacaagggaaactgcttttcaaattataaagtccaaaagtcacctagcagaggtaagaaccaaggcaaaacatcatctaatgtgggtagattgacgattgaaatagatagtctgccatctggttctgcagcagatgctggggatattaacgatgagtctggaaatggtaagattggcaaatctgagtctgaggttgctgtaatctccttacaggatcggttgaagtgggctgagcagcatgttgtcagaaaggaaggggaggttctttcccttgataaaccgggcatcaaagacctggttgagacaaagagatctgttgacaatgaaagcctacagaaagagaagatatcagctgtgccatcctcgcctattagtcctcccagaaagttgtccccctctgttcaagtgaagttagaacacaaaactagttctactgtagatcctgttcatgtcaggaaaacatcttcaagtggctcccaacagactgataaagatccatcttcaccttttacttctgcatcaccagttccagttgtgtccaaaactgagatccaaaagacttcaactgcaagattaactgaaagatctgtggcacaagtgcctatgatgtcaagaccttcaagtgctcctttagttcctggtcccaggccaactgctccggttgtctctatggttcaaacttctcccctacttgcacactcagtgagtgcaactcggttgggtcctgatccctcaccagctactcatagtcatgttcctcaatcctacagaaatgcgatgatggggaaccctgtggcctcaactgctgctagtctgacccattccagctcctcaagttcaggagtgatcccatcacctggctattctcaaccatcttccttcgtgtcgtcaatgtttttatcccggagctctgacagattggacactagtgctggtcagtcttgtgttccttttaccatgattacacgggatgttttacagaatggtacccagtggattgagagttctcaaagggaatcaagtagaagcatgcactatgatcaaccctctgggctttatgaggttcaaaatcatgacttgtacaggccactacacagtagatcattgggcaatatgtcaactgcattctcagcctgcacatctgggcgtcagaaccaagggttgttggtggatgagttcccacaccttgatatcataaatgacctgcttgatgatgaacatggtattgggaagacggccaaggcaagttcagcattccagtctttgaatagtggaccacagttgctgaatcgacagttcacttttcctggggacctgggtgcggatgatgatttgggatcttcaaccagttcttgcaggttggagcgatcacggagtttccagcatgaccatagattgcaaggagggtatggcttgtctggtgggcattatcattcactgagggattatattccaccggttagtggtgtgcctggcgtcaatgggcaggtcgatgggttgattccaaaccaatggcaggtggctggttctgatctgttgtatttaggtatgagaaacacagagaatgatagttatggatactacccagattactcaaatatagcatgtggtgtcaatggttatactgttttcaggccatcaagtggtccttag

SEQ ID NO: 1071 - DNA, 2010 bp, Glycine Max
atgagcattatcatgtccaccaagtcatcgctgaagtctctcctccaaaagggtgagaatgagcataatccattaaccatgtctgatgaacagattttggaacaaatttactcaacccacgtccacagtgacaccaagtttgatgtggattctcttttcacccttgttgagaacactcttagacgttcaacccacattgttgacaatcttgtgcagggatcccatgcaagcttggagcacattgatgacaagatcccccaattcaattcaccactttgtaccttgaagcaaatttcttttgagatgtcatgcaagcctccaagtgaggaaattggtcaccgaactacactggccatacttaacaagctctcaaactatgagtgggatgctaaggctgtgctgacactagcagcttttgcactcgaatatagcgagttctggctgctagcacagtaccaaccaacagatcctcttgcaaaatctgtggctattttgaagcgagtgccagtgctcgcaaagcccgcagcacttcaaaagcatcgacaagccatccttgaggttaacaatttggtgaaagcaacgttgcaagttattgaggttatctttgagctggagaagcttaccacttatgacaccaaagatgtacctgctttggggcttgcaattgaacaaatccctgttgatgtttactgggccatcatcactatcgtcgctgtggttactcagattgattgtctcaccactgattcagagcacaagcaagaactgtctcactatggtcaaaagatcaacatcatactcagcaaactcaggaagcagataactctctgcagacaacagatagatgaggcacaatattatcgcaagctgaggaaatttttccaaacccccactgaaataatggaggtgtttaaggttctgattttcaataaggatgctcctcagccactgttcgatggtgctactaagactaaggtcgatatcacggtgctaaaaaagaagaacgtgtacttgtttatttcttccctggacatcacggaggaagagatttcagtactccgaccagtttatgattctattaaaactaacgatcagtataagattgtgtggattcccattgtagaagaatggaccgagcaattgcacaagaaatttgaggttttgaaaagcaagatgccttggtatgtggtgcagcattctggaaccatagcagggtacaagtacattaaggaggaatggcacttcaaaaagaagcctatggttgtggtgttgagccctcaagggaaggtgcaacactcaaacgcattccatttgatccaggctcatggaaccagggcttttccctttacaactttgaatgaagaaaaaataaacagtgagaacgattgggttggctccgtattaggcagcattcaccccagcataagcacctcgatcaaagagcaaaagtacattttcttttatgggggcaacgacaaagactggatccaacagttcaccaagtacgttactgcccttgcaaatgatgctgctataaaggaggcaaagatttccatagagttgttttgtgtggataaggaagacaaaagccttgtgaggcgcttttggagtggcattgagagtttatttgtgactaaggttcacaaacaagctgatgcagtgactcaagaagtgcaaaagatgctttcttacaagaatgaaactggatggtctctcctcagtaaagggccatcagtggtggtgagtggtcatggaacaacaatcttgaagacagtggcagagtttgagaaatggaaagaggttgtgatcaaaaagggctttgcggtaaccttcaaagaataccatcagaagattgtggggaccactcaccgttgctcacaccttgagattcctaacgttgcagggaagttacctgagaccatcaaatgctcagattgtcctagggtaatggagattttcatcagctataaatgctgccacaatgagaatactgccaatgccattcactag

SEQ ID NO: 1072 - DNA, 297 bp, Glycine Max
atgagccggccaatggaggaagatgctgcgggtaaaaatgaggaagaggagttcaacaccggaccactatctgtactcatgatgagtgttaaaaataatactcagcttctgggtcgtgtaagggcttttgacaggcactgcaacatggttcttgaaaatgtcagggagatgtggactgaggtgccaaagactggtaaaggaaagaaaaaggcccagccagtcaacaaggatagattcatcagcaaaatgtttctacgtggagactctgtcatcattgttcttagaaaccccaaatga

SEQ ID NO: 1073 - DNA, 327 bp, Glycine Max
atgagccggccaatggaggaagatgctgcgggtaaaaatgaggaagaggagttcaacaccggaccactatctgtactcatgatgagtgttaaaaataatactcaggtactgataaattgtcggaacaacaaaaagcttctgggtcgtgtaagggcttttgacaggcactgcaacatggttcttgaaaatgtcagggagatgtggactgaggtgccaaagactggtaaaggaaagaaaaaggcccagccagtcaacaaggatagattcatcagcaaaatgtttctacgtggagactctgtcatcattgttcttagaaaccccaaatga

SEQ ID NO: 1074 - DNA, 588 bp, Glycine Max
atgagcgaggaaaagcatcaaaagcatcatgacaccttgtcttcatcttcttctactcctacttgttatttttcctcctcttcttcttcttcttcgccgggcgagtcggaggaggagcttcagcacatgctgctggtgccgccgttgtggaaaaacaaaaagaggctgtcgaagcagttgtcgatgtgcgagaagcctcgggacattgcatgggagagaaggcgcatgcaagagcggaggaggagttcgaccgtgtgcgatgatctcacggatgaggacctgcatgagcttaaaggctgtatagaacttgggttcggattcaacgaggaagatggtcagagactctgtaacaccttgcccgcacttgacctttatttcgctgttaaccgcaggttgtcacctagtcctgtctccacccctcagagccgtgcctcttccctcggatgccgttcttcgtcgtttggaagccctagaagcgattctgattcctggaaaatatgtagcccaggggatgaccctgaacatgtgaagaccaagttaaggcattgggctcaagccgttgcttgttctgtgatgcagtcttcttga

SEQ ID NO: 1075 - DNA, 354 bp, Glycine Max
atgagcgaggcttatttgttcattcattcaatatctggtgcaaagtttcagtatttcccaaaaaaacagttatggatctctccgtttctttctccaaaacccgtcctcctccgttctctccctctttctgccgtccaatcactccgcaactgctgcgattctcccgaaactccggaacctttcgccgccgttgatttcccgccaaaacaagctcgcggtcacagccattcaggtttcggatctatccgagaattacgacgattctgtcctcgaagacgttccgcacctcaccgacttccttcccaatttgccggtaccactccgtttcttatcgttttcaatctgtttccatga

SEQ ID NO: 1076 - DNA, 354 bp, Glycine Max
atgagcgtagcggtagtgaacagcttcaccataacagagttcgtaaatgacaaggctaagtttgatggtttcgtgaatgaatggtttgcgaggatagatgagaatggcgatgggaagctttcgcgtgacaaaatccgagggaggttagggatgctcttgcctttcggttcggagttgcagccacagcaagagaacgaagagatattcaaaaggttcgatgaagatgggaatggtgcacttgatctgaaggagttcaaggccttaatgaccgagattatgaatgccgctgctcgtagcattggtggctctcccgtcattgtgcttcttggaaaagatagcttgctcatgaaggct

SEQ ID NO: 1077 - DNA, 915 bp, Glycine Max
atgagctgctgtagtgatctaaatgcacaatggctacctcctggcaaagacacaatcgaatatttcactctgaaagatctttgggactgctactatgaatggagtgcctttggtgctggcattcctatgatattggaaaatggtgacactctggtgcaatactatgctccatatctgtctgctacccaaatctatatcagtaaatctaggattcggaaagagtacggtgaaggagttgaagttgaatgtgattccttgagcgaggacagtgcaagtgataacctttctagatcacccagtaacaattctagcaaagcatgggatgatgcttctttggattcaggctctgaccaagtgggttcatgcacaacaaaggatatgcttggcgccctttacttacagtactctgagaactctccaccttaccagcgggttccattttctgagaagataaccgagttagctaaaagccatccaggattgatgaggttgaagagtgtggatatttcccccacaagttggatggctgtttcatggtatcccatttattccgtaccatgccacaaaaataaaagggaccaaacaagcttcctcactttccattcactttcatctttccaaggtatcttaaacaagctaacaactattattttgtttgttttgcagactgtgcaagcaaatatgacgaaattcacacagggaataacaaaaaaatgcaagaaaaaagagaggggttgcatgtctctctctccttttgggttagccacgtacaaaatgaggaaaaacatatggttaaatccctataacaataaccaagtggtgaccgatctatacaacgctgcagactggtggttgaagcatatcaacgctgaccaccctgacttcaacttcttcacacgccaacctaccttgtag

SEQ ID NO: 1078 - DNA, 2892 bp, Glycine Max
atgaggattatgattaagggcggtgtttggaaaaacaccgaagatgaaatcctgaaagcggctgttatgaaatatggtaagaaccagtgggctcgaatctcttcgctccttgttcgcaaatctgccaagcaatgcaaagctcgctggtatgagtggctcgatccctccataaaaaagactgagtggacgagagaagaggatgagaagctacttcatcttgctaagcttatgcccactcaatggaggacaattgctccaattgttggccgtaccccttcccagtgtcttgagcggtacgagaagctccttgatgcagcctgtgtgaaggatgagaactatgagcccggtgatgatcctcggaaattgcgtcctggggagattgatccaaaccctgagtcaaaacctgcacgcccagatcctgttgatatggatgaagatgaaaaggagatgctttctgaagcacgagcccggttggccaacacaaaaggaaagaaagcaaaaaggaaagctagggagaaacagcttgaggaagccaggaggcttgcttctttacaaaagaagagagaattgaaggctgctggaattgatattaggcagcggaagagaaaaaggaaaggaatagattacaatgcagaaattccatttgaaaaaaggcctcctccagggttttttgatgttacagatgaagatagaccagtggaacagccccagttccctactacaattgaagaacttgaagggaaaaggagggttgatgttgaggcacaattaagaaagcaggacattgcaaaaaataaaattgcacaaaggcaagatgccccatctgccatattgcatgccaacaagctgaatgacccagaaacagtaagaaagaggtcaaaattgatgcttccaccccctcagatttcagatcaggaattggatgaaattgccaagttgggttatgctagtgaccttgcaggaagtcaggaacttgctgaaggtagtggtgcaacacgggctcttctggctgattatgcacagacacctggccaaggaatgactccgttgcgaacccctcaaagaacaccggctggtaaaggtgatgctatcatgatggaagctgaaaatctggccaggctgagagagtctcaaacaccattgttaggaggagagaacccggagttgcatccttcagattttaatggcgtcactcctaagaaaaaagagattcagactccaaatccaatgctgactccttctgcaactcctggaggtgcaggtctcactcctagaattggcatgacaccaacaagagatggtttttcttttagcatgacaccaaagggaactcctcttagggatgcactacatattaatgaggacatgaatatgcatgacagcactaaacttgagctacagagacaggctgatatgagaagaagtttgcgttctggtttaggaagccttccacagcccaaaaatgagtaccagatagtgatgcaacctgttccagaagacgccgaagagcctgaggagaagattgaagaggacatgtctgatagaatagctagagaaaaagcggaagaagaggcaaggcagcaggcattgcttagaaagcgatcaaaagtccttcaacgggaacttcctaggcctcctacagcatcattggagcttataagaaattccttgatgagaactgacgtggacaagagttcctttgttccaccaacctctattgagcaagctgacgagatgattagacgggagcttctaagtttactggagcatgacaatgctaagtatccacttgatgagaaagtgattaaggagaagaagaaaggagccaagcgtgctgtaaatgggtctgctgtccctgtgatagaagattttgaggaagatgaaatgaaagaggctgataagttgataaaggaagaggccctgtatctttgtgcagcaatgggtcatgaagatgaacccctcgatgaatttattgaagcacacagaacctgtctcaatgatcttatgtactttcctacccgtaatgcatatggtctctctagtgttgctggaaacatggaaaagctaacagctttgcagaatgagtttgagaatgtgagaagcaaattggatgatgataaggagaagacggtacggcttgagaagaaggtgatggttctcacacaaggctatgagatgagagtaaagaaaagcctctggccgcaaattgaggccactttcaagcagatggatgttgctgcaactgagttagaatgctttaaagctttgcaaaagcaggagcaattagcagcatcacataggataaacaatctgtgggctgaagtacagaagcagaaggaacttgagaaaactttgcaaaataggtatgggagtctaattgaagagctggaaaagatgcaaaatgtcatggaccaatgcagattacaagcacaacagcaagaagaaattaaagccaaccatgctcgtgagtcaactgagacccctgagaccaaggctgatggaattgatgtacagggtacagcaaattgtgaagctgtacctcactcggtagagcatggacgagctctagcagttgagtcatctgctgatggaactgctgaccagcaagtagatattgtgcatgaccaggctacttctagtgtcagtcatgacatggatgtggattctgataaattggcaaatcctacaccagctgcagagaatgtcgatgaaaaagtggaaggtaccggcaccggcaccggcagctatactgacgatggggagaccatgctggaaatgggtgctgcagtggaagtaagtagcccaaatcatgatgtagttgtggatgctgtaaactcacatgataacaacagcatggaagaaaccaatgctgttggggaggagacgtattag

SEQ ID NO: 1079 - DNA, 579 bp, Glycine Max
atgaggctacaacaactcaacttgttctttctgttgctttgtgttgccaaagcaaacgggtctctgctcccattcatggatcctcccatcactctcttggctgatctctggtccgatcgcttcccagacccgtttcgcgtgctggaacatattccgtttggggttgacaaagatgaagcatccatggccatgtcacctgctagagtggactggaaggagaccccagaggggcatgttataatgctggacgtgccggggctgaagagagaagagataaaggtagaggtggaagagaatagggtgctgagagtgagtggtgaaaggaagaaggaggaggagaagaagggggatcactggcacagagtggagagatcctatggcaagttctggaggcagttcaggttgccacaaaatgtagacttggattctgtcaaggccaagctggagaatggggtgctcactttgacacttgacaagttgtcacctggtaagatcaaaggtcccagggtggtcagcattgctggggaggatcaccaacaaggtaatctcaacaatgatggggccaagcaggagctttga

SEQ ID NO: 1080 - DNA, 1593 bp, Glycine Max
atgagtaaacaagacatgatgaaaagtcagaattgccttctcaaggtcaatatccactgcgatggctgtgaacagaaagtaaagaaaatcctgcagaaaattgatggggtgtattctgtgaacatagatgcggagcgagggaaggtgatggtgtcagggcatgtagatccagctaaactgataaaaaagctgaagaggtcagggaagcatgccgaactttggggtggccagagaggcatgatgtacaaccaaaactaccccacctaccctcagttcaagaacttgcacatagataacaccaaagggggtagcaaggacaataagtctcagaatcacaagggtggtgctcagaaaggtggtggtcaactagcacacttccaaagtgctaatggagggtcaaaagtaccccccaagaatcagaaatctgtcgacttcaacttatctgaagatgaacttgatgagagtgattttgatgaatttgatgatgactatgatgagtttgaagatgattttgatgaagaggatgaagaggaagagtatggtcatggtcatggtcatggtcatggtcatggccatgggcagcaggggcatcctatgcaacataacaagatgatggctatgatggcccagatggggaacgggcgtgggccacatgggcctggtggaatgatgaatgggccttccatgaacggccataaagggaatgggggtgtcaagaagggtgaggtcattgatctgcctatacaaatgaagggcaaaggtggaaacttcagcttcagcgagggtaaaaatgaaataaagggcaatggagatggtggtcaaaagaacaaaggtggaaagcaaaagggtggagataataatcataacaatggtaacaagaaaaagaactccaaaggcaaaaatggtggtggcttcctagttcggttcctaggcttaggaaaaaagaacaagaagggaggcggaggtggaggttcagccgacacaacaacaagcaagaataaaaacaacaacaaaggaaagaaagatggaggtaaattcgacaaaattgactttgacttccaagattttgatatccctcctaccaaaggtaaaaatggcaagggtggcagtaatggtaaaaacaataatgacaagggtcatggtagcaataatggtaatgtgggtcaccacatgggtcagatgggcccaatgggtcagagaggtccaatgaatcagatgggcccaatggaccatatgaggaatatgaacatcaatatgccggcggtgcaaggattaccggcagccacggccgccgcgatgaacggtggttactaccaaggcatgcagatgcaaatgcaacaacccaacccttacaacatgcagcagcagcaacaacagcaactaatggccatgatgatgaaacaacaacaacaacaacaaatgcaagcaaacatgaacgtgtacccaccacacatgatgtatggaaggccacacccacaccaagacccatctatgaactactttccacccccaccaatgccttcacacccaatggcggatcctatcacgcacgttttcagtgatgagaacactgagagctgcagtatcatgtaa

SEQ ID NO: 1081 - DNA, 1287 bp, Glycine Max
atgagtaaagcgccgcttctccaaatcgaacccaaggaactcaaatttatatttgagttgaagaagcaaagttcatgctcggttcaattgaccaataataccaaccactatgtagcgttcaagatcaagacgacgtcccctaagaaatattcagtgcgtccaaatgttggagttctcgcgccgaaagctacttgtgaattcatagttacaatgcaaccccaaagggaagcacctgaagatatggtgtgcaaggacaagttcttaatccagagtacaaaggttcctgccgaaacaatcagtgaagatgttacttcccgcttgtttgttaaagatggaagtaaatatatagaagaaaataagctgaaggtgaccctaatctgcccacccaattcaccagatctctctcctattaatggagatttcaagaatgggcttgaccatgaaaaagttcagatatatagtaaagatgaaatccaatccccagagaccatggtcagaggacgcttcactaatgttcttaaaaatccagacatggttcatgaggtattagaactagaagaggatatggagttgaggccagagtattatgtgggacacaccatgaaacatgtaggggagccaaaagaagaagcaaggttgaaagtgtcaaaaaataaggagttgaatatggtcaaggatttagaagaattgaagccacaaaaaaagttagaggttgaagtgccaaaagatctggatttgaacaaaataaagaatgcagaggagttgaaaccagagaaagcagcagagttgaaagtgtcaaaacttctggttttgaacaaagtaaagaatgtagaggagctgaaaccagagaaggcagcagagttgaatgtgtcaaaagttctggatttgaacctcgtaaataatgtaaaggaactgaagccagaaacagaaacagagttaaaaatgtcaaaagatctggagttgaaaacagtaaagaatgctgaggaattgaagccagaaaaagaaacagagttaaaaatctcaaaagatatggagttggaaacatttaaaaatgttgaggaactgaagccagaaaatgaaatagagttaaaaataacaaaagatagggagtttagaacagtaaagaatgttgaggaactgaagccaggaaaagaagctgagttgagagtttcagagagtatagagcagctgaaattattgaaagctatcgaagagatgaaattaaagctagatggacttgagtcaaaactaaatgaggtcaggcatgctactattcttttactgtga

SEQ ID NO: 1082 - DNA, 1002 bp, Glycine Max
atgagtatgacccaattcgccatggttgaggagttggcttttcttgtcaaggacaatcttccttgcaagcatttagttctcacaatggaagaagcactggttaactttcttcaggatgatgacactagttcagatggaatcttggaattggagccaatgaactcttacaaccgtcttttattgcatcgccttgctgagatatttgggtttgcacatgaatcggttggtgaaggagatgatcgccatttgattctggaaagatgtccagatacgtccatacctccaatccttgttagtgatatcctatggaagtatgatgaaccacaatctttggttacatcccaccaaatattaaggagaagtgtagcctctccagattcttgttctgttttgtgggccttaattcgtgtgctgcatcttttagtctcgcagaaaaacacagcatccctttcacagtcactggaggagagaaaagcagcttatttaattgcccgtgagcgaattttctctatgaagttggaagaggtaaaagagcctggtgaacaaaagccgcggagtgtgcctgtggttgcccgcagaatgattgcccatgcccttggtcaaagaatccatacaaagaatcagaatgacttggctagtgatagtatgaaggatggagtcctcacagatgaattgagtgcacaagataagaatcaggaagagtccactctcaagaaagtttctgaagagtcttcacacctaagagggaattcaaacaacagaataagaaacaacagttctaatgcagccacacttaataaaaggaaggatcaaacaacagttgacaaagatttgccacaattctctgcagaaagaaaacaagggctaagtgtaagtaaagactacatgaaaaaggagcacttgggagctgcaaagagaatgtttgctcatgctttaggagtgcattctgggaaggatggttctgttcctagaagtagaagtggagaaataaagaagaattag

SEQ ID NO: 1083 - DNA, 954 bp, Glycine Max
atgagtatgacccaattcgccatggttgaggagttggcttttcttgtcaaggacaatcttccttgcaagcatttagttctcacaatggaagaagcactggttaactttcttcaggatgatgacactagttcagatggaatcttggaattggagccaatgaactcttacaaccgtcttttattgcatcgccttgctgagatatttgggtttgcacatgaatcggttggtgaaggagatgatcgccatttgattctggaaagatgtccagatacgtccatacctccaatccttgttagtgatatcctatggaagtatgatgaaccacaatctttggttacatcccaccaaatattaaggagaagtgtagcctctccagtctcgcagaaaaacacagcatccctttcacagtcactggaggagagaaaagcagcttatttaattgcccgtgagcgaattttctctatgaagttggaagaggtaaaagagcctggtgaacaaaagccgcggagtgtgcctgtggttgcccgcagaatgattgcccatgcccttggtcaaagaatccatacaaagaatcagaatgacttggctagtgatagtatgaaggatggagtcctcacagatgaattgagtgcacaagataagaatcaggaagagtccactctcaagaaagtttctgaagagtcttcacacctaagagggaattcaaacaacagaataagaaacaacagttctaatgcagccacacttaataaaaggaaggatcaaacaacagttgacaaagatttgccacaattctctgcagaaagaaaacaagggctaagtgtaagtaaagactacatgaaaaaggagcacttgggagctgcaaagagaatgtttgctcatgctttaggagtgcattctgggaaggatggttctgttcctagaagtagaagtggagaaataaagaagaattag

SEQ ID NO: 1084 - DNA, 1041 bp, Glycine Max
atgagtcatcgcctccaacttcaaggcattttcgtcacctcctttcgccaacgccacttttccttcttttccccttacacttccaccaccacaagggtatcgttttctagttctagttgcgggaaaaatttgcaaatggaagaagtgaaggttgcttcagacttgttggtgggtgaccctgcttcactggagaagaaaattgatgcaattcgtttgggtggtccccagaagcttcaggtgattgctgattttgatgccacgttaacaaagttttgggttaatggaactcgtggccaaaccagtcatggtcttttgcagcagggtaatccagaatatgatgccaaaaggcagcagttatatgaatattaccatccattagagttttcgccgactattggacttgaagagaaaacgaagctcatggaagagtggtggggaaaaacacacggtcttcttgttgagggaggacttacatatgattcaataagacaatcagttgctaatgccaacatagctttcagggaaggtgtttctgaactttttgagtttctggaggaaagagatattcctgtgttaatattctcagccgggcttgctgatatcattgaagaggtcctaaggcagaaacttcacagatccttcaagaatgtgaggatagtatccaacaggatggtatttgatgatgatggccgccttgtatctttcaaaggaaaattgattcatagcttaaataaaaatgagcatgctcttgatatggctgctcctgttcatgagagattgggtgatatggatggtcctactgacgacaattcctcattgaagaagagaaccaatgttctcctcctcggtgatcacactggagacttgggaatgtctgatggtttgaattatgagactcgaatatccatgggattcctgaatcacaacgttgagaactcacttagctgctatcaagaagcttttgatgttgtttttgtgaatgatgcacccatgtggggagttatcaaactggtctctcatatgtgtttaagtgggaggtga

SEQ ID NO: 1085 - DNA, 2451 bp, Glycine Max
atgagtgagagagtgaagaaagaaaaacaaacgggggacaaaagggagaggatgaagaacatcttcaagaagcttcacataggtagcagccacgatcctcatcgatccaatgagccttcgcctcctgtgccgtcgccttcgtgcgccaccgatcagtctcagagctccgccgccactccgccgagtccttcttcggcgtcgccgtcgccgtcgccgtccacgctggtggtaactcccagctgcggcggcggcggcgcgagtccggtggtgaatcggcaggactttttctcgtcggaggaagagtttcaggtgcagctagccctagctatcagcgcttccaattcggagttccgcgaggatcctgagaaggatcagatccacgcggcgacgctgttgagcttgggaggccatcgaatcgattcgacgaggaacaaggacgatgtggcggaggctctgtcgaggcagtactgggaatataatgtgcttgactatgaggagaaagtggtagatggtttttatgatgtatacgggccctataatgattcagtaatgcaaggaaagatgccatctcgaacagatcttgaagcaaaccctggaggttctgagttggtcattgttaatcaaacaattgatcctgctctggaagaactgatacaaattgcacaatgtattgcattagactgccctgtctctagtttggtacaaaggcttgctgaacttgttacaagtcatatgggtggtcctgtaaaggatgctggtatcatgttagcaagatggaccgaaacaagagcagagttaaggacatctcttcacacaattgtattgcctcttgggtccttaaatattgggctctctaggcatcgtgctttgctattcaaggtattagctgacaacattaatatgccttgtagactgttaaaaggtagtcattacactggtgtggaggatgatgctgtcaacattataaagttggagggtgaaagggagtttttggttgatctcatggctgctccagggacacttatcccagctgatattttaagcaccaaggatagtgcctttaagtcttacaatcccaagattttgccaagtttaccctccactaaggataatgaattttcttactcaagacctatccaaccatttcatggtgaaggtagtagtcaaaattctgtgataaaagattattcactgccctggaatggaaaaccatattttgagaagtcagagccttcaaacttagggactcctaaccaactagacaatttgccagccttgtctggtgcttctctgtacaaagggacacttggaatgaatacagttggtgatgggacaagattgaatgtcaatgttgtaccatatactaatatcagccccaatgactctcggaacctttttgcagatcttaacccattccaaataaaaggaatggggaaagcccctgtgcataacaaacctgtggaaaataaacctcctgagcttaaaagtactaaaaacaatactgtttctggtagacccccagtgccactgatgtggaagaatcgtcctgcttacaatgaagaccccaggaaaactaatcataaccctaatgattacaaccctcccttatttgtttccaatggttcttctacgtctgaaaatattgaccttagtagttccaaaccattgtataattcaaatataaataatgatgtaaatgctcaaactttggcgcaagttactggttcagtttcaccacctactgtacctaaactgaaccagattgaggatctcaatgcagattttaaccaggggggtttggaagattctcaatatgtcatggtagaggcagttagagaacctgaaaatgttgaaatcagacatcatgatcagaggaagtgtacatatgacagattcatgggaagcaatttgaaattaaaagatccagagagtcctagctcatcaattgattccatcacaaacaggattgatccaatattggatgatgtagatgttggtgaatgtgagattccatgggaggatctggttcttggtgaaagaattggtataggttcatatggagaggtataccatgccgactggaatggcacagaggttgctgtgaagaaatttttggatcaggatttttcaggtgctgcattgtcagaattcaaaagagaagtacggataatgcgtaggttacgtcatccaaatattgttctttttatgggtgctgttactcgtcctcccaatctctcaatcatttcagagtatctaccaagaggaagcttgtaccgaattcttcatcgctctaattatcagattgatgagaaacgaagaataaaaatggctctggatgtggctaggggcatgaattgcttacacaccagcacacctacaattgttcatcgagatctaaagtctccaaatcttttggttgataagaactggaatgttaaggtatatgattga

SEQ ID NO: 1086 - DNA, 2871 bp, Glycine Max
atgagtgagagagtgaagaaagaaaaacaaacgggggacaaaagggagaggatgaagaacatcttcaagaagcttcacataggtagcagccacgatcctcatcgatccaatgagccttcgcctcctgtgccgtcgccttcgtgcgccaccgatcagtctcagagctccgccgccactccgccgagtccttcttcggcgtcgccgtcgccgtcgccgtccacgctggtggtaactcccagctgcggcggcggcggcgcgagtccggtggtgaatcggcaggactttttctcgtcggaggaagagtttcaggtgcagctagccctagctatcagcgcttccaattcggagttccgcgaggatcctgagaaggatcagatccacgcggcgacgctgttgagcttgggaggccatcgaatcgattcgacgaggaacaaggacgatgtggcggaggctctgtcgaggcagtactgggaatataatgtgcttgactatgaggagaaagtggtagatggtttttatgatgtatacgggccctataatgattcagtaatgcaaggaaagatgccatctcgaacagatcttgaagcaaaccctggaggttctgagttggtcattgttaatcaaacaattgatcctgctctggaagaactgatacaaattgcacaatgtattgcattagactgccctgtctctagtttggtacaaaggcttgctgaacttgttacaagtcatatgggtggtcctgtaaaggatgctggtatcatgttagcaagatggaccgaaacaagagcagagttaaggacatctcttcacacaattgtattgcctcttgggtccttaaatattgggctctctaggcatcgtgctttgctattcaaggtattagctgacaacattaatatgccttgtagactgttaaaaggtagtcattacactggtgtggaggatgatgctgtcaacattataaagttggagggtgaaagggagtttttggttgatctcatggctgctccagggacacttatcccagctgatattttaagcaccaaggatagtgcctttaagtcttacaatcccaagattttgccaagtttaccctccactaaggataatgaattttcttactcaagacctatccaaccatttcatggtgaaggtagtagtcaaaattctgtgataaaagattattcactgccctggaatggaaaaccatattttgagaagtcagagccttcaaacttagggactcctaaccaactagacaatttgccagccttgtctggtgcttctctgtacaaagggacacttggaatgaatacagttggtgatgggacaagattgaatgtcaatgttgtaccatatactaatatcagccccaatgactctcggaacctttttgcagatcttaacccattccaaataaaaggaatggggaaagcccctgtgcataacaaacctgtggaaaataaacctcctgagcttaaaagtactaaaaacaatactgtttctggtagacccccagtgccactgatgtggaagaatcgtcctgcttacaatgaagaccccaggaaaactaatcataaccctaatgattacaaccctcccttatttgtttccaatggttcttctacgtctgaaaatattgaccttagtagttccaaaccattgtataattcaaatataaataatgatgtaaatgctcaaactttggcgcaagttactggttcagtttcaccacctactgtacctaaactgaaccagattgaggatctcaatgcagattttaaccaggggggtttggaagattctcaatatgtcatggtagaggcagttagagaacctgaaaatgttgaaatcagacatcatgatcagaggaagtgtacatatgacagattcatgggaagcaatttgaaattaaaagatccagagagtcctagctcatcaattgattccatcacaaacaggattgatccaatattggatgatgtagatgttggtgaatgtgagattccatgggaggatctggttcttggtgaaagaattggtataggttcatatggagaggtataccatgccgactggaatggcacagaggttgctgtgaagaaatttttggatcaggatttttcaggtgctgcattgtcagaattcaaaagagaagtacggataatgcgtaggttacgtcatccaaatattgttctttttatgggtgctgttactcgtcctcccaatctctcaatcatttcagagtatctaccaagaggaagcttgtaccgaattcttcatcgctctaattatcagattgatgagaaacgaagaataaaaatggctctggatgtggctaggggcatgaattgcttacacaccagcacacctacaattgttcatcgagatctaaagtctccaaatcttttggttgataagaactggaatgttaaggtatgtgattttgggttgtcacggttgaagcacaacacatttttgtcatccaagtcaactgctggaacgccggaatggatggctcctgaagttctccgcaatgaaccctcaaatgagaaatgcgatgtttatagttttggagtcatcctatgggagcttgccactctaaggttgccgtggagtgaaatgaatactatgcaagttgttggtgccgttggtttccaaaaccgtagacttgatattccgaaggaagtcgatcctatagttgcaagaataatctgggagtgttggcaacaggatccaaatttgcggccctcgtttgcacaactcacagtggctctaaagcctctgcagcgtctggttatcccatctcatcatgaccaggtagctccacctatgccgcaggagatttctgtaaattcaaccccctga

SEQ ID NO: 1087 - DNA, 2520 bp, Glycine Max
atgagtgagagagtgaagaaagaaaaacaaacgggggacaaaagggagaggatgaagaacatcttcaagaagcttcacataggtagcagccacgatcctcatcgatccaatgagccttcgcctcctgtgccgtcgccttcgtgcgccaccgatcagtctcagagctccgccgccactccgccgagtccttcttcggcgtcgccgtcgccgtcgccgtccacgctggtggtaactcccagctgcggcggcggcggcgcgagtccggtggtgaatcggcaggactttttctcgtcggaggaagagtttcaggtgcagctagccctagctatcagcgcttccaattcggagttccgcgaggatcctgagaaggatcagatccacgcggcgacgctgttgagcttgggaggccatcgaatcgattcgacgaggaacaaggacgatgtggcggaggctctgtcgaggcagtactgggaatataatgtgcttgactatgaggagaaagtggtagatggtttttatgatgtatacgggccctataatgattcagtaatgcaaggaaagatgccatctcgaacagatcttgaagcaaaccctggaggttctgagttggtcattgttaatcaaacaattgatcctgctctggaagaactgatacaaattgcacaatgtattgcattagactgccctgtctctagtttggtacaaaggcttgctgaacttgttacaagtcatatgggtggtcctgtaaaggatgctggtatcatgttagcaagatggaccgaaacaagagcagagttaaggacatctcttcacacaattgtattgcctcttgggtccttaaatattgggctctctaggcatcgtgctttgctattcaaggtattagctgacaacattaatatgccttgtagactgttaaaaggtagtcattacactggtgtggaggatgatgctgtcaacattataaagttggagggtgaaagggagtttttggttgatctcatggctgctccagggacacttatcccagctgatattttaagcaccaaggatagtgcctttaagtcttacaatcccaagattttgccaagtttaccctccactaaggataatgaattttcttactcaagacctatccaaccatttcatggtgaaggtagtagtcaaaattctgtgataaaagattattcactgccctggaatggaaaaccatattttgagaagtcagagccttcaaacttagggactcctaaccaactagacaatttgccagccttgtctggtgcttctctgtacaaagggacacttggaatgaatacagttggtgatgggacaagattgaatgtcaatgttgtaccatatactaatatcagccccaatgactctcggaacctttttgcagatcttaacccattccaaataaaaggaatggggaaagcccctgtgcataacaaacctgtggaaaataaacctcctgagcttaaaagtactaaaaacaatactgtttctggtagacccccagtgccactgatgtggaagaatcgtcctgcttacaatgaagaccccaggaaaactaatcataaccctaatgattacaaccctcccttatttgtttccaatggttcttctacgtctgaaaatattgaccttagtagttccaaaccattgtataattcaaatataaataatgatgtaaatgctcaaactttggcgcaagttactggttcagtttcaccacctactgtacctaaactgaaccagattgaggatctcaatgcagattttaaccaggggggtttggaagattctcaatatgtcatggtagaggcagttagagaacctgaaaatgttgaaatcagacatcatgatcagaggaagtgtacatatgacagattcatgggaagcaatttgaaattaaaagatccagagagtcctagctcatcaattgattccatcacaaacaggattgatccaatattggatgatgtagatgttggtgaatgtgagattccatgggaggatctggttcttggtgaaagaattggtataggttcatatggagaggtataccatgccgactggaatggcacagaggttgctgtgaagaaatttttggatcaggatttttcaggtgctgcattgtcagaattcaaaagagaagtacggataatgcgtaggttacgtcatccaaatattgttctttttatgggtgctgttactcgtcctcccaatctctcaatcatttcagagtatctaccaagaggaagcttgtaccgaattcttcatcgctctaattatcagattgatgagaaacgaagaataaaaatggctctggatgtggctaggggcatgaattgcttacacaccagcacacctacaattgttcatcgagatctaaagtctccaaatcttttggttgataagaactggaatgttaaggtatgtgattttgggttgtcacggttgaagcacaacacatttttgtcatccaagtcaactgctggaacggtgagaatatga

SEQ ID NO: 1088 - DNA, 2499 bp, Glycine Max
atgagtggtgcacctaagagatctcatgaagagtctgttcattcatcttcaaagcactcaaatgaagattcgggtacttattccaagttggtttcattgccagtctcaaatgagtaccatatgccttatgatataagtcaggactcccgggtggcaaaagtgcctcgaactgaatttcgtgatgcagatagaagatcccctcttaatccagtgtatcggatgtcgtcacctttgaatgattctcgtgcagataatcctattggtcctgagaataggatagaatcaagggattcgaaggacagtagagatccccggtttgagaatcgtgatacaaagacagagaaggagttgtatggtgaagcaagaagggatcctccaaatgctaaaagtgaaaaggatatgcgcgtagaaggtagaggagatgacaacaaggatgtttggcatgatcgggatagtcataatgatccgaaaggtgacaccaagacagagaaagatggttataatgtggctagcagccacttgaattggaaagattcaaaagagtaccatagaggaaaaagatattctgatgctcctggtggaagtttggacacatggcatatgttacgtggaaatacacaaggctcggttgaggttgggaaggagagttccgcagcaggagagagagattatgttgaagctcatgaagctgttagtgagaacaaagttgatcctaaaggtgatgatagatccaaagagaaagatagaaagaggaaagatgtgaagcatagggaatggggagatagggaaaaagaaagaagtgatcgtagaaacagtccacaagttagcaatagtaccggtgactgcaaagaatctaccaaggaagatagagatgtagaaaggttggagagggagaaaaaagatcttccagaagagaaagaaaatataaaagagagggaaaaggatcagatgaagagggaatcatggaatggaatggagaaagaggtctcaattaacgagaaggaacctgttgatgcatcagctaaacttcctgaacaagaacctgtgttaccagagcagaagaaacaaaaagaagttgatagctggaaaaatgtagatagagaagctagagagaagagaaaagaaagggatgctgatttagaaggagataggtctgataagcatagcaaatgtcttgacaaggaatcaaacgatgggtgtgctgatggagaagggatgatggagaaggagagggaggtctataattatagcagtcagcaccgtaagaggatacaacgatctagagggagccctcaggtgcctaaccgggagcctcgtttcagatcccgtgcccaagataatgatggactactgaatttgtaccttcatgaaataatgcaggttttagcagagattgttattactgacccgttgctttatacgatatgtaaagtagaagtttcttctgttgtttataaagttggcgaaagcatgcaagaactgataaagttgtggaaggaatatgaatcatctcaatctcaaatggaaaaaaatggtgaaagctctaataatggtcccactctggaaattcgtataccatctgagcatatcacagctacaaaccgccaagtcagaggtggccagctttgggggaccgatgtgtacacatacgattcagatcttgttgctgttctcatgcatacaggttactgtcgcccaacagcgtctccaccccatgcagccatacaagaattgcgtgcaaccgttcgtgtactacctcctcaagattgctatatttctacactgagaaacaatgtccgttcccgtgcttggggtgcagcaattggttgtagttatagagtggagcggtgttgcattgtgaagaaaggaggtggaactattgatcttgaaccttgccttacacatacatcaactattgagcccacccttgctccagtgactgttgagcgaactatgactaccagggctgcagcttcgaatgcattgcggcaacaaagatttgttcgagaagtcacaatacagtacaatctctgcaatgagccttggataaagtatagtataagcactgttgctgacaagggtttaaaaaagccactttacacatctgcacgtttgaagaagggggaagttttgtatttggagacacatttgtccagatatgaactttgttttactggagagaagatgctcaaggttacaccagcagccccgttgcatgaccctgccacagaaaagtctcaaaatcaccacccacattctgcaaatggtgaaaaaaatgattgtgagaatgtcatgattgacgcattccggtggtctcgttgtaagaagcctctgccacagaaactgatgcgtacaattggcatccctttgcctcttgaacatatagaggtactggaggaaaatttggactgggaagatgtgcaatggtcgcaagctggtgtttggattgctggaaaggaatataccctggcacgggtgcatttcttgtcaatgaattaa

SEQ ID NO: 1089 - DNA, 708 bp, Glycine Max
atgagttcatctaaccagttaaaccagagcagcaggttcctagcaaataaaccaaggaatgaggttaatgtgcagggatacaccttcagaattgatggaaacacaacatttgtgatgaactatggacgttggtcagaaaagcgtaagagacttatttctgagatacggagtgctttaaatgttcataatgatcaagttcttgatgacaaactactgtttctcatagacacagtcatgaagcactattttgaactcttcgagatgaaaacaagtgctgcaaatttagatgtcttcagtgttgtttctgctatttggtgcacaacagctgaacgcaatttgttgtggattggaggctttcgcccttctcaattgcttcaggctattctgcctcaagttcagcattcatgctcccagcaacaactttctgatatttttagttttgtacaatcctgtcaacaagcagaagatgctcttgcacaaggcatggaaaaactccagcaaaaccttgacaaagcaacagcagctggtgacaaagcattaaaactgacgtgtgtctcacaacaaatgtcatttttaaagcaggccaatcatgttcgccagcaattcttgtatcaattatctcgtctccttacaatttgtcagtatgctgaattcttacttgccttcggagaatgcctctataactcccagccttggagctcactttga

SEQ ID NO: 1090 - DNA, 618 bp, Glycine Max
atgagttcatctaaccagttaaaccagagcagcaggttcctagcaaataaaccaaggaatgaggttaatgtgcagggatacaccttcagaattgatggaaacacaacatttgtgatgaactatggacgttggtcagaaaagctcatgaagcactattttgaactcttcgagatgaaaacaagtgctgcaaatttagatgtcttcagtgttgtttctgctatttggtgcacaacagctgaacgcaatttgttgtggattggaggctttcgcccttctcaattgcttcaggctattctgcctcaagttcagcattcatgctcccagcaacaactttctgatatttttagttttgtacaatcctgtcaacaagcagaagatgctcttgcacaaggcatggaaaaactccagcaaaaccttgacaaagcaacagcagctggtgacaaagcattaaaactgacgtgtgtctcacaacaaatgtcatttttaaagcaggccaatcatgttcgccagcaattcttgtatcaattatctcgtctccttacaatttgtcagtatgctgaattcttacttgccttcggagaatgcctctataactcccagccttggagctcactttga

SEQ ID NO: 1091 - DNA, 1581 bp, Glycine Max
atgataaccacacgtggaactccagaatgtgcacaccagacagcacttaggatccttcagcaactgagtggcttctcgtgggatgcgaaagcactagtagctgtggctgcattctctttggaatatggagaatttttacgccttgatcgggttcaagcagcagaccaatttggaaactcactgaagcagctgaaccaagttcaaatcagcagaagggtccctgcagatatgactgatctggtcacagttataggagaagtgcttaattacatcaatctgtgggcaaaatggtctgccatggattacgacatagaggctgtgcattccttgcaagttgccatgcaagagatccctcttgttgtatactggacaatagcttccactgttgcttctattggcaaccttgtcggtatatcgctattgtctccacttgtatcaggaaggatacaagattactgcttccgtaacactattagatatcctaaacttaaagatgtggtagagctgttggatattctgattattccaggttctgacaatggaacttcgatacccaaaatatttgaaggcggcgtcctaattaaaaatgttagtgataaagtagacagttaccttaataagtccttaactggtattgaagtgttcaagcagaaatatgtgatgctgttcttttcgagccttgacaacattggagatgagatatctcttttgaattccatcaacaacgggttgcaagagaacccaggagaagaaataaaaggtttcaaaaaaggggatttcaagattttatggatccccattgtggatgactggaagactacgagggagcagtttaataatttgaaggaaaagatcaaattctaccttgtggagtactttgaaaagttaccaggatatgatataatagtggacaaatttaaatacgaaggcttgcctatagtgtctgtggtcaaccctcaaggtcagataatgaatgataatgcaatgcagattatttttgaatgggggatcgacgcctttccttttaggcgaagtgacgtttatgatctcaacaaaaaatggaaatggttttggaatttgttggagaaaaccgatgataatgcaaagcgcttggggaaggataacactagttacgtcttcatctatggaggtaacgacagtagctgggtgcagaacttcaagatcgcaattgggaaaattgagaagcatgtgatcaacaatgtggacatcaacatagagccctatcagttgggggagagtaacccggacaatgttccttcattttggatcggcctagatgggaagaagaagaacaaggggtgcaaggacaaagtggactgtgaaatccaagaagttgtgaggaccttgctttgcctcaaacaagacccttcaggatgggttgttcttggtagagggcgtaacttgaagattctgggtcatgctgagcccatgtatcaaaccaaagaaacctttgatgtggccttcaaagaatattatgatgtggttaaggagaagttacatctattaattacaggtgctgccatggtagtgcaaacagctgcaatctctgaggaccaacat

SEQ ID NO: 1092 - DNA, 132 bp, Glycine Max
atgatatgttatgtatatccttctctgctctacaacagctgcttttgtaatactacttgtatgaaagttttattatacctcagtttttctcttttctgtttgttcaattggattcttagtttattgtattga

SEQ ID NO: 1093 - DNA, 597 bp, Glycine Max
atgatcaagatagggagtgtgggtgtggccgtaagtaccaggaagaaacaaacaatgtttctcaaagtccagctgcactggaatgtcatcatcgctgctgaaaatctgcaaccggaaggtctgatgcttcatagggcaatcattgtccgccttctgagtgactttgctgtgaagaaggccaccaaagatctgggatactttcttgcagtgaccacactggagaaaataggggaaggaaaggtcagacaacatactggggatgtgctcttccctgtggtttttaatgtcatcaccttcaagtttttcaagggtgagatattagagggtgttgtccacaaggttctgaagcatggagttttcatgagatgtggtccaattgagaatgtctatctctcaaatttgaagatgcctgattaccgatatgttcctggcgaaaacgcatgcttcatgaatgacaaaatgtcaaagattggaaaagatgtcacggtccgcttctcggtgataggtacaaagtggatggaagcagaaagggaatttcaggcattggtcagtttggaaggggattatctgggaccaatttcaactccggatatttag

SEQ ID NO: 1094 - DNA, 996 bp, Glycine Max
atgatcccagcttgtttcagccaacccaacacaccttcaagctcaagcaccactcaagtgccacaaaacctagtaacatgcatataccaaactcaactttgcaactcctccacgcacctcaccctcacgtggtccagaacccttctctctcactccttaaccatttatgcacctcacaccttctccatcaccattcctctcaacccttcaactttctccttcttccgaactcgaccaggatccaaatccatctacctcactcgccccaacaaacgttctcagaaaatcaaacttcactgggacttctctgaagcaatttttagtactcggaactcagctgagcctgagtcacgcttctaccttgcagtctgctgcaatggcagggttgaattctttctgggtgatcttgttcttgttcttcccatgcagctttcacctcaccaaccaagtgaccaagctcttgtgtcgagaagagaacacgtgtttggaagcacgagttacgagtcaaggggtgagttcgtgggttcaaaacgcgaaatagagattgaattgttcagtggagaagaactgagagtgaaagtggatggtcaagtttgcttggtggtgaaaaggctgacgtggaaattcagaggcaacgagaaaatcttcattgatggcgttgaagtagagttcttctgggacgtgttgaattgggtgtttaatagtgaaaatggcaatggcaacaatggttatggtgtttttgtgtttcaagttggtgatggtggcgccgtgtggcctgaaatggtggggccagagaagaagttgatgaagaagaggttggtgggacccactatggtgccttcggtggtaacaacgtcaccgtcgagctccagtgtgttgcagtggacggaggagagcagtgatggtgggaggagttcgtgctcttcatcaacaaggtcgtgtgggagtagtaatggtggtttctctttgttgctctatgcttggcggagagactag

SEQ ID NO: 1095 - DNA, 975 bp, Glycine Max
atgatcgatgccggtggatttcactacgatcctgcggtgttatcagtaggtattttgggaggcaatagcagtaccaaaaatgtttacttcaacaatctccccgaaggttgcatagcaaacattctctccttcacatctcctagggacgtgtgtagactctctttgctttcatccactttcagatccgccgctcaatccgacgctgtctggaacaagtttttgccttcagatttccacaccatactttcccaatcttcctctttatctcttccttctaagaaggacctctttctctatctctgccaaaaaccgctcctcatagacgatggtaaaaagagctttcaactggataaagtatacggtaagaaatgctacatgttatcagcgaggaatctcttcattgtatggggagacactcccaggtattggcgctggacttcgcttccagatgccaggttttctgaggtagctgagctaaggagtgtgtgctggttggaaatccggggctggatcaacacggggatgctgtccccggagacattgtatggggcgtaccttgtgttcaagccaaacccttctggattctacggcttcgattaccagttagtggaagtgtccatcggaatcgctggcggcgagaatcgcaagcgaaacgttttcttggacgccgaaagaggacggaggctaaggtaccagattgttcctcgccgtgccgggactgggatattcaaccgtgcacgtttccttgcccctgttgaggcaccccctgtagaagataacgatagtctcgatctccagcacccaaaggagagagcagatgaatggttggaggtggaattgggagagttcttcaacgatggacaagaggacaaggaattggaaatgggtgtttatgagatcaagagtggtgattggaagggtggccttcttgttcaaggaatcgaaataaggcctaaaaggacgcccataaattaa

SEQ ID NO: 1096 - DNA, 1332 bp, Glycine Max
atgatctacacagcaattgacacgttctacctcacagatgagcagctagcaaactcaccttctagaaaagatggcatagatgaagccactgagaccacccttagaatctatggttgtgatctcatccaagaaagtggcattttgctcagattgccacaagcagtcatggctactgggcaggttctatttcatcgtttctattgtaagaagtcatttgcacggttcaatgtcaagaaagttgctgccagctgtgtatggttggcttcaaaactggaggaaaaccctagaaaagccagacaagtaattattgtttttcacaggatggaatgcaggagggagagttttcccatggagcatttagacttgtattccaagaaatatgttgatttgaaaatggagttgagcagaacagaaagacatattttgaaagaaatgggattcatttgtcatgttgaacatcctcataagttcatatcaaattaccttgctaccctcgaaacacctccagaattgagacaggaagcttggaatctggctaatgatagtttgagaactacattgtgtgttcgatttaagagtgaggttgtggcttgtggagttgtatatgctgctgctcgcaggttccaagtaccccttcctgagaatccaccgtggtggaaggcatttgatggggagaagtctgggattgatgaagtaggcagggttctggctcacctttatagccttccaaaggcacaatatataccagtctgcaaggatggagactttacattttccaacaaatcatcagaaacaaagtctcaatcaacaccaaaggatgttccacaaaatagttccccagctgatactgacaactcagtgccaaagggagctcaaggagaagctaatactgaatccaatggtggcaagggtgcaatggtaaatgtagccattgataagctgaaagattctaaaaggtctgatgatgaatccaaaggcatgagtacagaaggagaggcaagagacgaacccatactgaagtccaaggctgaccatattggggagacacgcaggaaccgggatcgggacagggatagagaacgagataggggtagggaaagagacagagatagggacagggacagaacaaaatccagagatagagatcgaggaagggattctgacaaagaacgtgaacgagaggaagctgagagggacaaactcaaggatcgtggtcaccgttctagggagagagcaaaggattcaggacattcagagaagtcaaaacgccattcgtcgcatgatcgggtttcttactcgtcaagggagaaagatcggcatagacatcattga

SEQ ID NO: 1097 - DNA, 2016 bp, Glycine Max
atgatctccccatcaagtggccttaacatggaagaagagaagaaagaagaaatagttgaaagagatgaggacttggaggagcaggtacctgctgctgctgaagtcgagcctcagccatggacagaacagataacagtgagaggattatttgtgagcatgattattggaatcacattcagcataatagtcatgaagctcaacctcacaactggaatggttcctaactgtaatgtctcggccgcacttctagcctttgtgtttatccgaacctggaccaaactgcttcacaaggccggctttgtagccaagccattcagtcgccaggagaacaccatcatacagacttgtgcagttgcgtgctatagcattgctgttggaggaggatttgcttcttatctgttgggattaaacaggacaacttatgagttgtcaggagtggaaaacgagggtaacaacccaggtgctattaaagaacctggatttggttggatgactggcttcctttttgtggtttgttttgttggtctctttgtcttgattccactcagaaagatcatgatagttgacctcaaattaacttatccaagtggcttggcaacagcggttctcatcaatggtttccatacacagggtgacaaaatggccaagaagcaagtacgaggcttcacgaagtatttttgtaccagtttcttgtggggtttatttaagtggttcttctcagggatagaggactgtggattcgaacagttccctaccttcggattgcaagcttggaagcaaacattctacttcgattttagtatgacttttgtgggagcagggatgatttgctcccatcttgtgaactgttctttgctccttggagctgtgctctcttttggggtcatgtatccgctcattgatcggcttaaaggagactggttccctgacaatttagaagaaactaacatgaagggcttatacggttacaaggtttttgtttccattgctcttatcctgggtgatggcatatacaatttcaccaagattctaatttctacagtcctcaatgttaatgaaagaatgaggagcaagaataataaaaatgtagctgctgatcggcacgagaatcctaccgaggaccttaaacaaactgatgaatttctaagggagaccattcccctgcggattggagtcattggatacgttgttttcacaatgatttccataattataattccacgcatgtttcctcagctgaaatggtactacgtggtggtagcttatatatttgctccatctctggcattctgcaatgctttcggagcaggtctcactgacataaacatggcatataattatgggaaggttgcactctttacgctggcagctgttacaggaaaagaaaatggtgtggtggctggacttgtgggttgtggtctcattaaatccgtgatctcagtgtcttgcattctgatgcaagatttcaaaactgcacattacacacgtacctctcctagagcaatgttcatatgccaagtaattggcattgcaatgggttgtgtgacagctcctctcagcttcttcctatactacaaggcatttgatgtgggaaacccgcatggagaattcaaagctccatatgcgttaatttatagaaacatggcaatcatcggggtccaaggtttctcagcattgccacagcattgtttgcagctatgctttgggttctttgcttttgccataggagtaaacatgataagagattttgcaccccaaaagattgggaaatggatgccattaccaatggtcatggccgtaccgtttctggttggagcatactttgcaatcgatatgttcataggtactgtggttgtgtttgcttggcagaagcttgactccaagaaggcagagttgatggttccagcagctgcctctggactaatttgtggggaaggactatggactctaccagctgcgattctagctcttgcaagaattaaacctcctatctgcatgaaattcgttcctacctag

SEQ ID NO: 1098 - DNA, 2967 bp, Glycine Max
atgatctccgtgcagggcgacctccaccgccaccaccaccactaccaccaccagccgcagcttcccggctccgccgacacctctcggcagcagttcaccgcggatcgcgtcgagccattctccgtcaagcaggaacccgcgtcgctcactcttctgccgttgcgcggtcatgattctagtgaagttgatgaagatgtgcacttgtctcttgcacatcaaatgtacaagactggcaattataagcaagccctagaacatagcaacactgtctatgagagaaatccgctccgtactgacaacttactacttctgggtgcagtttattatcagttgcatgattttgatatgtgtgttgcaaaaaatgaagaagcactgaggattgagccacactttgctgagtgttacgggaatatggcaaatgcatggaaggagaaaggaaacattgaccttgcaattcgctactacttgattgccattgagctccgtcccaattttgctgatgcatggtcaaatctagctagtgcatacatgcgtaaaggaagactcactgaagcagcccagtgttgtcgtcaagcacttgctataaatcctctaatggttgatgcccatagcaacttgggtaatcttatgaaagctcaaggcttggtgcaagaagcatacagttgttaccttgaggcattgcgcattcaacctaccttcgctattgcatggtcaaatcttgctggtctgttcatggagtctggtgatttcaacagagcccttcagtattacaaggaagcagtaaaactaaaaccttccttccctgatgcatatctgaaccttgggaatgtatacaaggctttagggatgcctcaagaagctattgcatgttatcaacatgctcttcagacacggccaaactatggcatggcttatggtaatttggccagtatatattatgagcaaggtcaactggacatggcaattctacactataaacaagctgttgcatgtgatcccagatttttggaagcttacaataacttgggtaatgctctaaaagatgttggcagagtggaggaagcaatccagtgctataatcaatgccttacgttacagcccaaccatccacaagcattgaccaatcttggaaatatatacatggaatggaacatggtagctgctgctgctcaatattataaagctacactgaatgtaacaactggattgtctgctccttataacaaccttgccattatctataagcagcagggaaattatgttgatgccatatcatgctacaatgaggtcctccgcattgatcccttggcagctgatgggctagttaatagaggcaatacgtataaggagattggtagagttagtgatgctatccaggattacatacgggcaattgctgtcagacccaccatggctgaagcccatgctaatttggcttcggcttataaagatagtggacatgtagaggctgctgtgaagagctataaacaagcattgattcttcgtccagacttccctgaagcaacttgcaatctccttcatacataccagtgtgtatgctgttgggaggatcgtgataaaatgttcaaggaagttgaagcgataatcaggaggcagattaatatgtccgttattcctagtgtccagccattccatgcaatagcatatccacttgacccaatgcttgctctggaaattagccgtaaatatgctgcacactgctcggtaattgcatctcgtttttctcttcctccattcaaccatcctgctcctattccaatcaagcgcgagggaggatatgaaagactaagggttggttatgttagtagtgactttggtaatcatcccttgtcacatctcatgggatctgtttttggtatgcacaacaggaagaatgttgaggtgttctgctatgccttgagtgttaatgatggtactgaatggaggcaacgtattcagtctgaagcagagcactttgtagatgtatctgccatgtcatcggatgcaatagcaaaaatgattaatgaggataagatacatatccttgtcaacctaaatggttatacaaagggtgccagaaatgagatatttgctatgcaacctgcacccattcaagtttcatatatgggattccctggaacaactggggctacttacatagactacttagtcactgatgagtttgtttcaccactacggtatgcaaatatatattcagagaagattgtacatctaccgcattgctactttgtaaatgattataaacagaaaaatcaggatgtgttagatccaaactgcccacacaaacgatcagattatggtctacctgaggataaatttatatttgcatgcttcaatcaactttacaagatggatcctgaaatatttaatacatggtgtaatattcttaaacgggtacccaacagtgcactctggctcctcagatttcctgcagctggggaaatgagactgagagcatatgctgctgcacaaggggtacagccggatcaaattattttcacagatgttgcaatgaagaatgaacacatcagacggagttctttagcagacttattccttgactcgcctttatgcaatgcacatacaacaggaacagatatactatgggcaggtttgccaatggttactctgcctcttgagaaaatggctactagggttgctgggtcactctgtcttgccactggactaggggaggagatgattgttagcagcatggaagagtatgaagatagagcagtctcattggctctgaatcggccgaagcttcaggctcttactaataagcttaaagctgtacgcatgacttgccctctatttgacacggcccgttgggtgaggaatcttgagagatcatattttaaaatgtggaatctgcattgctctggtcaacgtccacagcattttaaggtcactgaaaatgatctagaatgtccttatgacaggtag

SEQ ID NO: 1099 - DNA, 2589 bp, Glycine Max
atgatctccgtgcagggcgacctccaccgccaccaccaccactaccaccaccagccgcagcttcccggctccgccgacacctctcggcagcagttcaccgcggatcgcgtcgagccattctccgtcaagcaggaacccgcgtcgctcactcttctgccgttgcgcggtcatgattctagtgaagttgatgaagatgtgcacttgtctcttgcacatcaaatgtacaagactggcaattataagcaagccctagaacatagcaacactgtctatgagagaaatccgctccgtactgacaacttactacttctgggtgcagtttattatcagttgcatgattttgatatgtgtgttgcaaaaaatgaagaagcactgaggattgagccacactttgctgagtgttacgggaatatggcaaatgcatggaaggagaaaggaaacattgaccttgcaattcgctactacttgattgccattgagctccgtcccaattttgctgatgcatggtcaaatctagctagtgcatacatgcgtaaaggaagactcactgaagcagcccagtgttgtcgtcaagcacttgctataaatcctctaatggttgatgcccatagcaacttgggtaatcttatgaaagctcaaggcttggtgcaagaagcatacagttgttaccttgaggcattgcgcattcaacctaccttcgctattgcatggtcaaatcttgctggtctgttcatggagtctggtgatttcaacagagcccttcagtattacaaggaagcagtaaaactaaaaccttccttccctgatgcatatctgaaccttgggaatgtatacaaggctttagggatgcctcaagaagctattgcatgttatcaacatgctcttcagacacggccaaactatggcatggcttatggtaatttggccagtatatattatgagcaaggtcaactggacatggcaattctacactataaacaagctgttgcatgtgatcccagatttttggaagcttacaataacttgggtaatgctctaaaagatgttggcagagtggaggaagcaatccagtgctataatcaatgccttacgttacagcccaaccatccacaagcattgaccaatcttggaaatatatacatggaatggaacatggtagctgctgctgctcaatattataaagctacactgaatgtaacaactggattgtctgctccttataacaaccttgccattatctataagcagcagggaaattatgttgatgccatatcatgctacaatgaggtcctccgcattgatcccttggcagctgatgggctagttaatagaggcaatacgtataaggagattggtagagttagtgatgctatccaggattacatacgggcaattgctgtcagacccaccatggctgaagcccatgctaatttggcttcggcttataaagatagtggacatgtagaggctgctgtgaagagctataaacaagcattgattcttcgtccagacttccctgaagcaacttgcaatctccttcatacataccagtgtgtatgctgttgggaggatcgtgataaaatgttcaaggaagttgaagcgataatcaggaggcagattaatatgtccgttattcctagtgtccagccattccatgcaatagcatatccacttgacccaatgcttgctctggaaattagccgtaaatatgctgcacactgctcggtaattgcatctcgtttttctcttcctccattcaaccatcctgctcctattccaatcaagcgcgagggaggatatgaaagactaagggttggttatgttagtagtgactttggtaatcatcccttgtcacatctcatgggatctgtttttggtatgcacaacaggaagaatgttgaggtgttctgctatgccttgagtgttaatgatggtactgaatggaggcaacgtattcagtctgaagcagagcactttgtagatgtatctgccatgtcatcggatgcaatagcaaaaatgattaatgaggataagatacatatccttgtcaacctaaatggttatacaaagggtgccagaaatgagatatttgctatgcaacctgcacccattcaagtttcatatatgggattccctggaacaactggggctacttacatagactacttagtcactgatgagtttgtttcaccactacggtatgcaaatatatattcagagaagattgtacatctaccgcattgctactttgtaaatgattataaacagaaaaatcaggatgtgttagatccaaactgcccacacaaacgatcagattatggtctacctgaggataaatttatatttgcatgcttcaatcaactttacaagatggatcctgaaatatttaatacatggtgtaatattcttaaacgggtacccaacagtgcactctggctcctcagatttcctgcagctggggaaatgagactgagagcatatgctgctgcacaaggggtacagccggatcaaattattttcacagatgttgcaatgaagaatgaacacatcagacggagttctttagcagacttattccttgactcgtaa

SEQ ID NO: 1100 - DNA, 930 bp, Glycine Max
atgatgacgccgttcaaacgcttacacttagttcggacactctatcgttcatctcagattggagaatcttcgtcgtatctgctcggcagctgcaagagttattcctctgctctatcaaacggttctgagggtaatttcaggagcttccattcccatttgttaaagggccaagatggttttccctttgctggtgtaaaatctttgacgcttcgatctacaatggctgctgagttgtccattttcatgaacaataggaggatgttaagtactcaagtcaaagcctcagcacaagcgcgacaagtgggacaacaaatatccctatcaagtcctggatttatctatgaaccttatgaacctcgtgataaaatcccattttggaagagatggttcactagaagtggtttgagaagaacaaaaaatgacatcattcttgagctcaaaagtgcctatgctattgcaaagttaagaaaaacgggatattcaaaaaatcagttctacaatgaggctgccaatatgtacaaggagataaacactctaatagctaaaggtgacaaaagaacattaaggaaagcagttactgagaatatgttttctgcacttaagaatgaaattaaacaaagagaaactgcatggagcagggtatattgggaaatggttgagcctgttgttaagattcggactttgcgtgcacgtctgattggagttgatcggaaagacctaaataaaacatttattcaacttacactagagattttggctaaacagaaatttgaagcatatgactcaaaaggttctgtggtagctggagataaaagcaaggaggttcttgtccgtgatatatgggtatttgagaagtctatgtttcatgctggtgcaacctggcgtctgtgtggacggatatcaccaaaagcatcacagttatctccttga

SEQ ID NO: 1101 - DNA, 1732 bp, Glycine Max
atgatgagctctaacgcaaaccttgactcaacacaacacaacactgatgggaactgggtagtccatatttggcacacgctttcggcgactgaggctgatttggaaaattctcgcgtggtttgcgtctgcgaggtaccggaatcgttgcgttgcagcaagagggaagctttcatccctcagtttgtggggcttggtccataccatcatttccgtgctgacctcatcatgaccccgaaaaagaagttggccgcagccaagagggtcctcaaagacctcctcccttccgacatgaaccaattccaactacaaatctcaaacttaggctcagaagttacgactttctaccacccagatgtcaaatccacatataatgatcataccctctccttcctattaaccgttgatggcttgttcttgttggctttcataaccagcagtggccaccctgatgcagaattctctaacttcttaaccggaaacctcatgatgctcctttttaacgctgctggtttttcatgctcgagaaccaaattccctttcatgttcttgagcagatcagtggcaaaaaaaatcattcaatcagaatcaaatggtcatgagggtctgggctcaaacgtggtaaatttctgtaaacaacactgtccagtactagtcaaggtagaagtgttcgctaacaacactgttcatttgttggatctcatgtaccatttgattgtacctaggcctcagtctcctcctcagcccctcgagcctgaagaagctcagcaaaaccctgtgcctgaacctcagccagcaaccgaacccaatcacgaacctcagccagagcccgtgtttgtgaatttgtcggtgtttatattcgtgactccattcttaattgtgccatttttgccggagcccgagcccgagccccagcccgagcccgagcctgaatctcaaccagagcccgagtcacagcccgagaccgatgaatttcggttcggatcctggaaagaccttggatatcttattgcatttcggcggagtagctttaactctgcgtttggatggttacatgatgctctatccaacatggaaggtagggttaataatccattactgagacccttgacagaagcgattccatccgcaatgcaactccacaatgctgggatcttcttcaaaccaattgaaagtgacatctcatccattaatttcgatgacgaaaactgcgtgttttacttgcctagtatcagattagatgtcaactcagaagttatcatcagaaacctcctggcttacgagacattgattaaatccaacacccctttggtcttcacaaggtacgttgagttgatgagagctattatagacactcctgcggatgtgaagattttggtggatagtgaaatcattaagaccgagttatggagtgaaaaagtcgcggaacttttcaaggggttgagcaaatcgattaggcctaccatgactccagacttggataaaaagcgaattaactgggatgttatcaagcatatgtctgggacattcttcacaattcttgggtgttttttatttttgtttttcacgggtgtgcaaacttattgctccgttgttaattgctccggtacctcaaaacatgttaaactacctaaagatggggaatcttatgtgagtaaaacaatttcaccatgtgagttttataagtattcgagagtttttcgtgatttacaaattgagtttacaaatatgcacg

SEQ ID NO: 1102 - DNA, 333 bp, Glycine Max
atgatgagtcagcatccccgtaggaagctgccacgtggcaacccaagaaagggcaagcacgctgaagttgacaagccggctgcgccgaaagctactgagccgccatcctcaaatcggcttctagccggctaccttgcgcacgagttcttgaccaaagggactctgttgggtcagaagtttgagttcgacttgacccgatccggcgtggctgagccaaagagggagcaggataattacaaggaggtggcaaaccttttgaggacaaagggaacccatgtaaagggaattgtgaatcccacccagcttttcaactggattaacaaggtattatga

SEQ ID NO: 1103 - DNA, 1038 bp, Glycine Max
atgatgcatggactcaaatttctcaaaattttcactaaggcacaactttaccgctacaccagggctcgccctcgggctgttcaactaggtattccagacataatacagaaccatgccaaacccattacagtttctgacttggtttctactcttcaaatttcaccatctaaggctggttttgtgcagcagttcatgcgctttttggcacacgatggaatctttgatatccgtgagagccaagatgatcatgaattagcatatgctctaacccctgcatcaaagcttctagttagttgcagtgaccactgtttatctccaatggttcggatgaatactgatccacttctgatgactacataccatcactttggggaatggattcgtggggaagaccccacagtacatgagacagccttcggaacaagcttttggggacttcttgagaaaaaccctacacaaatgagtctcttcaatgaggctatggcaagtgattcccgaatggtagacttggcactcaaaaattgcacttcagtttttgaagggctagattccatggtggatgttggtggtggaactggaaccacagccaaaattatctgtgaggcatttccgaagttgaaatgtgttgtgcttgaccttcctcatgttgtagaaaacttgacaggaaccaataatttgagttttgtcggtggtgatatgttcaactctttccctcaaactgatgcagttctactaaagtgggttttacataattggaatgacgaaaattgcataaagatcctgaaaaagtgtaaagattctatttcaagcaaaggcaacaaaggaaaagtgattatcatagatataataataaatgagaagctagatgatccggatatgactcgaacaaagcttagtttggatatagttatgtcgactatgaatggaagagagcgaagtgaaaaagaatggaaacaaatgttcattgaagcgggattcaaacactgcaaaatatttcccatctttggtttcagatctctaattgagctctatccttag

SEQ ID NO: 1104 - DNA, 834 bp, Glycine Max
atgatgtcaggacattacacatccatcgataaccaaaaggtttcaggatctgtacctgctgttgagcccccaccattcaaattctcagattcaaatcttcagacatttcctccgtctggagcacaaggcaagattagtggtggctcgagacctccacgtgatgttgatgatacattttcaaaatcagggtctggttctgatgaaccccagcgacagagtggttggtttcaggctttctcacttgcttcttacaaaccatactttgatgttgacactatagatgttctagacaggattaaagactcactttgtccattcagtggaacattcaatgaaaaaactgcttcccaccctgatttgtatggaccgttctggatttgcactaccttaatatttgtagcagcatctattggcacatttgtgacatacatagctcacaaactgaaggaccaggaatggaactatgacataaatctggtgacttggtctgccggcttgttttatggttatgtcaccgttgttcctctttgtttgtatgtaatcctcaagtacttctctgtaccatcgggctttgtccaactactatgtctctatggatattccctgtttgtctttattccagcactgtgtatgtctgttgtgccattggagatattcagatgggtggttgctggtgtggctgggttcatgtcagcaacttttgtggcacttaacctccgggcacatattatgtcagcaggtgaaagatgggttttgattgttgctggcatttttctattgcagttggctctagctgtagcactaaaggtctacctcttcacagtaacagtatga

SEQ ID NO: 1105 - DNA, 684 bp, Glycine Max
atgattaacttcgaagaaaccgagttgcgactcggcctccctggcaacgactcagcactcaagggaagtgctgccaagagaggcttctctgaaactgcttctgttgatttgaagcttaatctttcttcttgcattaacgactctgcctcggattcaccctcatctgtgtctacagagaagcccaaagagaacaagactaccactgctgaacctcctccagctaatgatccagcaaaaccacctgcaaaggcacaagtggtgggttggccaccagttaggtcatttagaaagaacatagttcaaaggaacagcaatgaagaagaggcagagaagagcacgaagaatgctttcgtgaaggtgagcatggatggtgcaccgtatctacgaaaggtggacataaagttgtacaagagctaccaggagctgtcagatgcgctggctaagatgttcagttccttcacgattgaaaagtgtgggtcccaagggatgaaggactttatgaatgagaccaatggctctgactatgtacccacatatgaagacaaggacggagactggatgctcgtcggtgatgtgccctgggagatgttcgttgaatcatgcaagcgtcttcgcataatgaaaggctccgaggcaatcggtcttgcgccaagagccgtggaaaagtgcaagaacagaagctga

SEQ ID NO: 1106 - DNA, 315 bp, Glycine Max
atgattcgggctattgcaagtaatgcctcggacaacatttactgcactcttcttgctcatggtgctgttcatggagctatggctggatatactggcttcacagtcgggcctgtgaacagtaaacaggcttatatcccaattgcctgtgtgatggagaaacaaaataaggtcaagctgactgataggatgtgggctagacttcttgcatcgacgaatcaaccaagtttcgttgcctatgatcaagaaagagtcgagaaagatataaataacatgaatattacctctcaaactagatttaataggtattttgattga

SEQ ID NO: 1107 - DNA, 1326 bp, Glycine Max
atgattggagggaagcagagagcggcaaatgcaaaaaaggaagagaagaaaggaaaagcagcagaaagtgacaaaatcccagtaaagagtgacagtgccagctccctcaagccaaagtcttgtgcttttcacatccccattttcccatttccctttctgcttcctctttcgccaaatgggtctcccataacacaatcttcaccttttttttttcctctttctttcttcttcgcttctcggtggggcttcaagtttcaccataggatgttttctaggttgatacatcctcatgaagggcaggaagacatgcagggtggctccaatcacgctcacctcggagacccttgtcttgttttaacctccgatcccaaacctcgtcttcgttggaccgctgaccttcatgaacgctttgttgatgctgtcactcaacttgggggtgccagtaaagccactccaaaagcaatcatgaggaccatgaatgtcaagggtttgacgctctatcatttgaagagtcatcttcagaagtacaggctaggtaagcaatcaggaaaagattctgatgagggatgcaaagatggttgtgtacatgtttatctttgttcccttgctcagagaaaggttgactctgaaattcccatctgaatgtcagcttcatatcttcaagaaagccctggtactgataactcttctccaaagttaccagatgctaacgagggtcatgaagtcaaggaggcattaagagcacagatggaagtgcaaagtaaactacacttactagtggaggcagagaagcacttgcaaattcgccaggatgcagagcgaagatacatgggcatgcttgagcgagcgtgtaagatgttggcagatcaatttattggggatgtaactattgacatggacggccaaaaatttcaagggctggaaagcaaaacatccagaagttccctagttgatcacgttggcttttatccccaagcgtgtactgaggtcggcggaatgcatgcttcagtagtatcacctattcttcaacctcaaggggctgactgtttcactgaaagttgcctaacatcacttgagagtctgggagggttgacactagaaggatctcctggcggatcgaagaagaggatgctgaacttggactcgatggtagcacctttgatctggagtgaagccaacaccagaactcaaggaattcatttagccaaagttaatccttcaggaatgactagggcgagccctggtgcagcggtaaagttgtaccttggtgacttgttggtcatgggttcgaatccggaaacagcctctttgcatatgcaaggataa

SEQ ID NO: 1108 - DNA, 1071 bp, Glycine Max
atgcaaacgacatcgtatagtcatcctctattctgtttctcttgcagaaacatcagtacaaatgggaagagtaagggttctgtgaaattccgtgcaccatatccctctcaactgggtcggaaatgtggattcaatgggagacctcgtgtttatatttctcccagccccataaaaccaaacaggttgtatgtgcttcataacacaggtgacaaccatccatctgctttttcagtagatgatgaaatgaacacaaaccatgctccaaatggcatgtcaccgacatttctcagcaactggtcacctccaaggtacttgtggagggggttatcagttttaatcctggcagggcaggtggttgtcaagactctaaagggaaagattcattggaggaacactcttcagcaactggagagagttggtcctaaatcagttggagtgtgtcttttaacttcggcttttgtgggcatggccttcaccattcaatttgtaagagagttcaccaggttgggattaaatagatcagtaggtggggttttagctctggctttctcaagggagctaagtcctgtggttacagcaattgtggttgcagggcgcattggaagtgcttttgcagctgagttaggaactatgcaggtttctgagcaaactgatacattaagagttcttggttcagaccctgttgattatctggtgacgccaagagtgttagccacttgtattgctttgccccttttgaccctgttgtgttttacattagggatggcatctagtgcccttcttgctgatggtgtttatgggttgagcatcaacattatcatggattccgctcagcgagctctcagatcatgggatattattagtgcaatgatcaagtcacaggtttttggtgctatcatatctattgtgagttgtgcgtggggagttacaactttaggaggtgctaaaggtgttggggaatcaacaacctcagctgttgttatttctcttgtgggcatcttcattgctgattttgctctttcttatgttttcttccaaggggcaggagatcagctaaagaattgtgtttaa

SEQ ID NO: 1109 - DNA, 3045 bp, Glycine Max
atgcaaagccacttgctgttcttctattattacattggcctctcacttatttttactaaagcttcagcagatgatgaattgtcaactcttctctcaatcaaatccattctcattgacccgatgaagcatctgaaggattggcaaacaccaagcaatgtgacacagccaggctcacctcattgtaactggactggagttggttgcaactcgaaaggctttgtagagagtcttgacctctccaacatgaacctcagcggtcgtgtttccaaccgcattcaatctctttcaagtctatcttctttcaacataagatgtaacaactttgcttcatcactgcccaaatcactgtccaacctcacctctctcaaaagctttgatgtgagccagaactacttcactggcagcttccccactggtcttggaagagctacaggcttgagattaatcaatgcatcgagcaatgaattttcaggttttcttcccgaggatattggaaatgcaacattgctcgagagccttgattttcgagggagctactttatgagtccaatccccatgagtttcaagaatttgcagaagctcaagtttctaggcctttcaggcaataacttcacagggaggattccagggtatctaggggaacttatttctctggagacattgattataggatacaatttgtttgaaggtgggatccctgcagagtttggcaacctcaccagtcttcagtaccttgacttggctgtaggcagtctcggtggacaaattccagctgaattgggtaagctgacaaaactcaccacaatttatttgtaccataacaacttcacaggaaaaattccacctcaacttggcgacattacttcactagcatttttggacctctctgacaatcagatctcaggaaagattccagaagaacttgctaaactggaaaacctgaagctcttaaatctaatggccaacaaactatctgggcctgtaccagagaagcttggtgaattgaaaaatttacaggtgcttgagctatggaaaaattctttacatggtcctttgccacacaaccttgggcagaactctcctttgcagtggttggatgtatcctctaactcgttatcgggggagatccctccaggtttgtgtactacaggcaatctcactaaactaatcctctttaataattccttcactggtttcattccaagtggacttgcaaactgtttgtctttagtacgtgttcggattcagaacaatcttatttctgggactattccaattggctttggaagcctccttggccttcaacggctggagttggcaacgaacaacctcactgagaaaattcctactgatattaccttatccacgtcactctctttcattgatgtatcttggaaccaccttgagtcctctttaccctcagatattctttctattccatcccttcaaaccttcattgcctctcataacaattttggaggaaatatcccagatgagttccaggactgtccatctctctctgtgctggatctttcaaacacccatatatctggcacaatccctgaaagcattgcttcttgtcaaaaattagtaaaccttaaccttcgaaataactgcttgacaggagaaatcccgaaatcaatcacaaagatgcccaccttatctgttcttgatctgtccaacaattcactgactggtaggatgcctgaaaattttggcaactccccagctctagaaatgctgaatctgtcctataacaaacttgagggtccagtaccctcaaatgggatgttggtgaccataaatcctaatgatcttatcggcaatgagggtctttgtggaggcattctccctccatgttctccaagtttggctgtgacaagccatcgaaggagctcacatatcagacacgtcattattggttttgtgactggcgtctcagtgattttagctcttggtgcagtatattttggaggtagatgtttatacaagagatggcacttgtataacaatttcttccatgattggttccagagcaatgaggattggccctggaggttagtagcattccagaggatcagcatcactagtagtgacatcctcgcatgtataaaggaatcaaatgtcataggcatggggggcaccggtattgtctacaaagctgaaatccatagacctcacgtaaccttagcagtgaagaaactatggaggtcacgaacagatatagaagatggcaatgatgcgttgagagaagtggaactcctagggagacttaggcacaggaatattgtaaggctgttggggtatgtacacaatgaaaggaatgtgatgatggtttacgagtacatgcctaacgggaatcttggaacagcactgcatggtgaacaatctgcaaggttgcttgttgattgggtctcaaggtacaacatagctcttggtgttgcacaagggcttaactacctccaccatgattgccacccactagtaattcacagggatatcaagtctaacaacatactccttgactcaaatttagaggcaagaatagcagatttcgggttggcaaggatgatgattcaaaagaatgagacagtttccatggtggctggatcatatggatacatcgcacccgaatatggatacactctgaaggttgacgagaagattgacatatacagctatggagtggtacttttggagctcctaactggaaaaatgcctttagacccttcatttgaagaatcaattgacatagtcgaatggataaggaagaagaaaagcaacaaagccttgttagaagcattggatcctgctatagctagtcagtgcaagcatgtccaagaagaaatgctgcttgtgctccggattgcacttctatgtactgcaaagcttcccaaggaaagaccacccatgagagacatcgtcacaatgcttggagaggcaaagccaagaaggaaaagtatttgccataatgggggacaagacagcaggagcgtggaaaagccaacgatcttcaccacctccccaataatcagtcttttgtag

SEQ ID NO: 1110 - DNA, 1275 bp, Glycine Max
atgcagaaggataccagtaccactgccccatcaaccacaagcggtcgggttaggcaccgaaaacgctcaaatgaggttattccggaggttagcaaagcaaatgggacccagttactggttaatgacaaaagcaaatacaaatccatgctaattcgagcatattcatccgtatggatgattggcggctttgtattgatcatctatatgggtcatctctacatcactgcaatggtggttgttatccaaatcttcatggcaagggagcttttcaatctactcaggagagctcatgaagataggcagctgccaggatttaggctattaaattggcattttttcttcactgcaatgttatttgtttatggacggattctgagtcaacgcctggttaacacagtaacttcagacatggttttatatcggctagtgagcaatcttattaagtatcatatggttatctgctactccctatacattgctggatttatgtggttcattctcacattgaagaagaagatgtacaagtaccaatttggccagtatgcttggacacacatgattctaattgttgtatttggccagtcctccttcactgtggcaagcatttttgaagggattttctggtttcttctcccagcaacacttattgtcattaatgacattgctgcttatatctttggtttcttctttggaagaacccctttgattaagttatctccaaagaaaacttgggagggttttattggggcatccgttaccaccatcatctctgcatttatgcttgctaacatcatgggtcgttctcagtggctaacgtgtccaaggaaggatttgtcaactggttggcttcactgtgatcctggtccactgtttaagccggaatcttatcccttacaaggatggatttcccactggtttgcttggaaagagatatcaatcctaccaattcaatggcattctttatgtcttggcttgtttgcttcaattattgcaccttttggaggcttctttgcaagtggttttaaaagggcttttaaaataaaggattttggtgatagtattccaggacatggtggaattaccgacagaatggattgccagatggttatggcggtgtttgcatatatatatcatcaatcatttgttgtgccgcaaactctctcagttgaaatgattttggaccagatattgatcaacctaacattcgatgaacaagaagctctatattggaggcttggggaaattttacaacaggggattacaaggaaatcttag

SEQ ID NO: 1111 - DNA, 348 bp, Glycine Max
atgcagatcgttgatgtccttcatccagggagggctaatgtttccaaggctgaactgaaggagaaattgggcagaatgtatgacgtgaaagacactaacactgtatttgtcttcaagtttcgaactcattttggtggtggcaagtccactgggtttggtttgatctatgattcagttgagaatgccaagaagtacgagcctaagtacaggcttatcaggaatggacttgatactaaagtagagaaatcaaggaagcaaatgaaggagagaaagaatagagctaagaagattcgtggagttaagaagacaaaggcttccgatgctgccaaggctggaaaaaagaaatga

SEQ ID NO: 1112 - DNA, 639 bp, Glycine Max
atgcagcagcacctgatgcagatgcagcctatcatggcagcctactaccccaacaacgtcaccactgatcacattcaacagtacctggatgagaacaagtccttgatcctgaagattgttgaaagccagaattctggcaagctgagcgagtgtgcagagaaccaatcaaggctgcagagaaatctcatgtacctagctgcaatagctgattctcaaccccaaccatctccaatgcctggtcagtatccttctagtggacttatgcagcagggagcacactacatgcaggctcagcaggctcagcagatgtcacaacaacagctaatggcttcgcgctcctcactcttgtactcccaacagcctttctcagtgcttcaacagcagcaaggcatgcacagccaacttggcatgagctccaatggaagtcaaggcctccacatgttgcaaactgaagccactaatgttggaggcaatgcaaccataggaaccggaggaaggtttcccgactttgtacgcattgctagtggcaagcaagatattggaagttctggtgaaggccgaggaggaagctctagtggccattctggtgatggtggtgaaacccttaattacctgaaagctgctggtgatggaaactga

SEQ ID NO: 1113 - DNA, 381 bp, Glycine Max
atgcagcagggaggaggctcggagacggaagtgacatgggaggaccagcagaacatcaacaaattcggaaggttgaataatcgctttcacgagcttgaggatgagatcaaaatcgctaaggaaacaaacgataatttggaggatgcaagcaacgagttgattctcacagatgaagaggtcattcggtttcaaataggagaggtttttgctcatgtgccaaaggacgaagttgagaacaggatagaacagataaaagaggtgacaagccaaaaattagaaaaacttgaagaggagaaagaatctgtgcttgctcagatggctgaactcaagaaaattttgtatgcgaagttcaatgactcgatcaatcttgaggaggattag

SEQ ID NO: 1114 - DNA, 1164 bp, Glycine Max
atgcagttgtggaagctcttcatcactgcattaatgcccgtacttaagttgctcctgcttactgctgttggcgcatttcttgctctgcaccgctttaatatactgaggaagagtgctaggaagcacttgaatgtaatagtctactttgtcttcactccggctcttgctttcagcattctgactaagactataacatttaggagcctgattatggtgtggttcatgccattgaatgttcttctcacatatatcattggcgcggcactaggatggttgtttctgaaaataactaaagaaccttctgatatgcaaggtcttgtgttggggtgttgtgctgcagatttgatgcaaacaggaaatgtaggtaatttgcttcttatcatagttccagcagtctgtaaggaaagcggtagtccttttggagctgtggatgtttgtaataaaaaagggatggcatatgcttctttgtccttggcaataggaaacatctacctttggacttttgcatacaacattatccgcatttattcaggcaagattttcaacgtgaacaaagttgatgattccacagtaggtccagtgtcagcaatagaaacagatctcgaaagccattcaactgtaccagtggttactgcagaggatatctcagaaaacaatgatcgcacgactcattttggaagtgaatttacattgcctggggaaaaagctagggcatcgttaagaacattagtagataaactcaatctgaaggtcatattatcacctgcaactattggatcgattcttggtctaatagttggtgtagttcctccattccaaaagatgtttgttggcgataatgctcctttaagcgtggttgaagactcagcatccatgctgggatacattgccttaccaattttaggcgtggtcattgtaaaaggtgcaatccattttggcattatccaccacgatccgttataccagtttgttttaatgcttcaatacgcccttccacctgcaacaagcataattatattttacgttatgactctgccaggtacaattactcaattatttggagccaggcaaacagaatgctcgattgttatgctagcaacttatgtctgtgcctcattttctcttacactatggtccacattattcatgtggcttgtcctataa

SEQ ID NO: 1115 - DNA, 391 bp, Glycine Max
atgcataggtctgcaagctggaacaggttctcggatgattacttcaagcatgccacgacgagttctccatcttcaggacatagatcatcttattctatgttcgatggcaacaatttgcctacatatgaccccattgcagagttggctaagagggagagggcacgtgtgaagttcgccgagaatgcagtgcatgttatccctttagtgctaattgtttgtgccatcatcctttggctcttttcaaatccagatgtgggaatcataggagatccaatagaagcaagaatcgaaggattaagtcttgaaggagaaattgaaaatgatagcgacggtactcaaatgggtttcttacctattgtgacctcagaagaaatatcaacgacagaatttg

SEQ ID NO: 1116 - DNA, 954 bp, Glycine Max
atgcattccttcaaagacaaagttacacagaaactctctcatctctttcccaactccttctcctcctcctcctcctctccccaggatagtccatattctcaagaggataaacctttgtcttcatatttatcttacattatcccttcagtcagctttgatggatcgaagacaaacaagaatcaacatgaacttaaaccaattcaatcaacttctgctggatataattatgagaattttgagtatcaggatgttccatcggataattatgttgactgtactaacatggatttgttgaaagatgataatgataatattaatgaagatcctatctctagaaggaccagtagcagtagcagttctgaggtttttgaagaagcaaatgaacagcaaactccaaatacttcaaagaagtctcgactcaatcttactgatgactctacgtttatatctcctgaattgtatgaatttttggaaatatgcctccctaatatagtgaaaggacgccaatgggtcttactttatagtacgttaaaacatggagtatcacttcgtacacttattcgcaagagtgctgagctttcttgtcctggtttgctgattgcgggagatatgcaaggtgctgtgtttggcgggctgctagactgtcccttgaaacctacagcaaagagaaaatatcaaggaacaaaccaaacttttgtctttacaactatatatggtcagccaaggctgtttctacctactggtgtcaaccgatactactacatgtgtttgaatggcctacttgcacttggtggtgggggtaattatgctttatgcttagaagaagatttgttaactggaactagtggaccttctgacacatttggaaacaaatgtctagctcacagtccagagtttgagttgaagaatgttgagttgtggggttttgcacatccttccccttttcaaggctaa

SEQ ID NO: 1117 - DNA, 741 bp, Glycine Max
atgccattgctcgtatccaattgtgcaaaggctttcatcctctcgacgctcccacagtcgaagcgaatgtcccatcatgctcccggcgtcaaaacgcgcctgaggggtgtcgttttcgacatggacggcaccctcaccgtcccggtgatcgattttccggcgatgtacagggcggttctgggcgacgaggagtacctgcggctcaaagcggaaaacccttccggcatcgacattttgggccacatcgaagggtggccgcctcacaaacagcgcaaggcctacgacgccattgctgaggtcgagcgtcagggtcttgaacgccttcaaatcatgcctggttgtgcagagctttgtgccatgctcgattctaagaaaataaggaggggtttgatcactaggaacacgaagtcagcagttgatttattccatgaacggtttgggattacattttctccagcattaagcagggaatttcgtccttataaacctgatccaggtccactactgcatatttgttctctttgggaagttcaaccaaatgaagtaataatgattggagatagccttaaagatgatgtgcgctgtggaaggcaagcaggagcctttacatgcttgcttgatcaaacaggagtatatgattctcccaagtatgctgatgttgaattcaaaccagatttcaaggtgacttcccttgatgaagttcactcagttctgaaggaaaattttgatttgtcaccatga

SEQ ID NO: 1118 - DNA, 1587 bp, Glycine Max
atgcccgaaccggaatcgcaaaacggacacgagcaagacccggagccgcagccagaaacagaaccagtgccaacagagcaaacacaaccacaattggagccgaaatcgaaatccacgcccgaaccagaaccaaatccgcagccagaatcggagccagtgccaacagagcaaacgcaagcacaattggagccgaaatcgggatcagaagctgatccagcggtaaacgacgcagatctcagggaaacgacgattcattccaatgaaacgtatgccaatccttctcccactcctcagctacgtaaagacgaaggaagccgaacgttcaccatgagagaattgctgaacggattgaaaaacgattccgaaccggagagagaagatggcaactccccctacagcccagaacaacagcaacagcaggcagaccagaacaacgctgcaatggatttgataaacagcgttgtaggtgtcgacgaggaaggccggtcccgacagaggattcttacattcgctgccaggagatatgctactgcaattgagaggaaccctgaagattatgatgcattgtacaattgggcattggtactccaggaaagtgcagataatgttagcccagattccacttcaccctctaaagatgctttgcttgaggaggcttgtaagaagtatgatgaggccactcgtctttgtcccacactgcatgatgctttctacaattgggctatagcaatttctgatcgggcaaagatgcgtggccgcacaaaggaagctgaagagctatggaagctggcaacacggaactatgaaaaagcagttcaacttaactggaacagtcctcaggcgctcaataactggggacttgctcttcaggaactcagtggcattgttccagctcgagaaaagcaaaagattgtgagaactgctatcagcaagtttcgtgcagccatacagttgcaatttgatttccatcgggcaatttacaatcttggaactgttctgtatggattagcagaggacactttaagaactgggggatcagtgagtgctcaagaagtttcaccaaatgaattatacagccagtctgcaatatacattgctgctgctcatgcattgaaaccaaattattcagtttatagcagtgccttgcggttggtgcgttctatgctaccattaccacaccttaaagttggatatttaactgcacctcctgtgggggcatcgattgcacctcataatgactggaaacgatcagaattccttttggatcatgaaaagcttcagcagatacccagaggagaatataaacaagtaccacctcaaaatctctcaggcagattggtagatgcagtgagtggagataagaagactatcaaagtagatatagcagatattatttctgtatcagcatgtgctgatcttaccttaccacctggtgcaggcctctgcatagatacaagttatggatcagtttacttggttgctgactcttgggaatcattggatggctggctggatgcacttcgtctagtttacacaatttatgtgcgaggcaaaagtgatgtactggctggtataataacaggatga

SEQ ID NO: 1119 - DNA, 1194 bp, Glycine Max
atgcccgaaccggaatcgcaaaacggacacgagcaagacccggagccgcagccagaaacagaaccagtgccaacagagcaaacacaaccacaattggagccgaaatcgaaatccacgcccgaaccagaaccaaatccgcagccagaatcggagccagtgccaacagagcaaacgcaagcacaattggagccgaaatcgggatcagaagctgatccagcggtaaacgacgcagatctcagggaaacgacgattcattccaatgaaacgtatgccaatccttctcccactcctcagctacgtaaagacgaaggaagccgaacgttcaccatgagagaattgctgaacggattgaaaaacgattccgaaccggagagagaagatggcaactccccctacagcccagaacaacagcaacagcaggcagaccagaacaacgctgcaatggatttgataaacagcgttgtaggtgtcgacgaggaaggccggtcccgacagaggattcttacattcgctgccaggagatatgctactgcaattgagaggaaccctgaagattatgatgcattgtacaattgggcattggtactccaggaaagtgcagataatgttagcccagattccacttcaccctctaaagatgctttgcttgaggaggcttgtaagaagtatgatgaggccactcgtctttgtcccacactgcatgatgctttctacaattgggctatagcaatttctgatcgggcaaagatgcgtggccgcacaaaggaagctgaagagctatggaagctggcaacacggaactatgaaaaagcagttcaacttaactggaacagtcctcaggcgctcaataactggggacttgctcttcaggaactcagtggcattgttccagctcgagaaaagcaaaagattgtgagaactgctatcagcaagtttcgtgcagccatacagttgcaatttgatttccatcgggcaatttacaatcttggaactgttctgtatggattagcagaggacactttaagaactgggggatcagtgagtgctcaagaagtttcaccaaatgaattatacagccagtctgcaatatacattgctgctgctcatgcattgaaaccaaattattcagtttatagcagtgccttgcggttggtgcgttctatggtgagtacacattattctaaattatgttag

SEQ ID NO: 1120 - DNA, 1413 bp, Glycine Max
atgccgccattagcgcctctgcatcttcggaagctcttactccgttctcgttccttatcattcacttctcccactccgattcaccctcctcctctgtttccccaacaaccttcttcccatttccattcccgaaccctcctcactccttcttcgctcttcataatcagacatttctcatcggaaacccaaacggatcagattgcgcactccctctcctcagagcttctcaaagagccagactcggacgctctctccgtctcgcagcgccttcacctgagcttctcccacatcactccaacccccaatttgattctccaaaccctaaacctctcccacgaatctggccgcactgtattagggttccatcaatggctctcttccaacccccaattctcccacacggacgacactctttcctacttcgtcgactactttggccgccgtaaggacttcaaggccacgcatgacgtcctctccgccgcttcccccgccgccggccccaaaaccctagcctccgcgatcgaccgcctcgtccgcgcgggccgccccagccaggcggttcagttcttcgagcgaatggagagagactacgggctgaagcgcgatcgtgcttccttaaaagtggtcgtggagaagctgtgttcgaagggtttcgctagttacgcggaaaaaatggttaaggatttggcgaaggtgtttttccccgacgaagccacgtgtgatatgttgatcaaagggtggctcgccggtgagatgtatcgtggtgggtttgagcttgagaaggtgttggtggagatggagcaccgtggggttccaaggaatgtggagacattcaatgtgttgataacgaatttatgtaagattaggaagaccgaagatgctttgggattgtttcgtagcatgggagagtgggggtgttaccctaatgagactacttttcttgttttgattaggagtctgtatcaggctgctaggttggaagagggggatgagatgattgataggatgaggtctgctgggtttggtgagtttctagataagaaggcttactatcagctcctcaagattttgtgtggcattgagagggttgatcatgctttgagtgtgtttgctatgatgaaggatggtgggtgtgaacccgggcttataacttatgacttgttgatgggaaaattgggtgctcacaatcgtatcgataaggctaatgctctattcaatgaagcgaagagtagagggctgcctgtgatgctcaaagagtatgctgttgacccgaggtatttgaagaagaagaaggttgtcaagggtgtgaagaagagggaaaccttgcctgagaaaatggctaggaagagaagccgcctgaaacagattcggttgagttttgtgaagaagcccaaaagagtgatgggtcgttga

SEQ ID NO: 1121 - DNA, 1182 bp, Glycine Max
atgcctccgatgaagatccaacccatcgacgtcgattcgcagaagctcgcggtggttcgaaacgaccccgttaagccggtgttgaagtcgcgcctgaagaggctctttgtgttcgaccgtcagttctcgaatgtgctgaagacttcgtccttctcgtcggagaaacccgccgccggcgaggctcctcagtccaacaccaaagacggagccgcggagtttgaaccgagctccgtttgtttagacaaaatggtgcagagtttcatggaagagagtaacgagaagcccgcaccggccaccgcgaaatgcggccgcaaccgctgcaactgcttcaacggcaacagcaacgacagctccgacgaggaactcgatatcttcggcgattcaatttcctctggctccttcagcgacgccagtgacgcgctcaagagcttgattccttgcgcgagtgttgtggagagaaacctcttagctgacacatcgaagatcgttgacaagaacagcaaggtttataagcgaaaaggcgatttgagaaagatcgtcaccgaaagcctttcctctctcggttacgattcttccatttgcacatcgaaatgggacaaaaccccaacctaccctgccggtgaatatgaatacatcgatgtggttgtggaaggtgagaggttgataattgatatcgattttcgatcggagttcgagatagctcgatcgacgggaacctacaaggcgatccttcagtctctgccgttcattttcgttggaaaatcggatcgactctgccagatcgtcgccgccgtgtcggaggcggccaagcagagcttgaagaagaaagggatgcacgttccgccgtggaggaaggcggagtacatgttggtgaagtggttatcaagttcctgcactagggcgaatctaacgtcgtcctccgccgtcaatgactcgacggagaatttgagcgacggcggaggcggcggctatgatgccgcggagagtgagtgtggtgaactggaactgatcttcggcgaaaaaacatcgccgccaaagccggagacttttcccggcgttgagaagagctttccaccggtcgcgacgccgacgtggcagccaccggcggtgagagtgaggagtgttgagagaggggttaaggtggtcaccggattagcttctcttctcaaggacaagccatag

SEQ ID NO: 1122 - DNA, 1179 bp, Glycine Max
atgcctctttttggaattttccagataccctcatttatggacataatcactgacctcgccatgttcattactccgctatggattgcggttatcgtcggcgtcgtcgtgggctgggcgtggaagcccaaatgggcctttcaccccaaagacgctcttctcaagtttcgctctcctcgccctcccaatccccaaaacgacaccgcttttacctactccgccaccagttcctccgcgcgtgagaaagacgcgagtgggagtcctgtggtgacggaagacgatttgctgcatctgtggaagttggttgaggaaaaagacggagggcgggcatggattcagatgatggaccgttctaccccgaccatgacctatcaagcgtggcgtagggatcctgagagtggaccgccgcagtaccggagcagaacggtgttcgaagacgcgagtcctgagttggtgagggatttcttttgggatgatgagttcaggttgaagtgggatgacatgcttatacatgcttccaccatacaagagtgtgtcctcactggaacaatgatggtgcactgggtgcgcaagtttcccttcttttgcagtgacagagagtatataattgggaggcgaatttgggacgcaggacgaatttactactgtgtcactaagggagtaccttgcccctccatgccaaggcataataaacctaaacgagttgatttattttattcaagctggtgtattcgtgcagttaaatcaagaaaagatgaccagctgacttcatgtgaagtgttattgtttcatcacgaagatatgggaattccctgggaaattgctaagcttggagttcgacagggtatgtggggagctgtcaagaagtttgatccaggactacggacatatgagaaacaaagggtttctggtaccccattgtcaccctgtgcacgtgctgctaagatcaacactaaagtaaccatggactatgtgaggtctctggaaaacacgaccagtgacttgttggagactgaaaatcaggattcttctgacaaaccaggtggaaggaacatacctaagcttttaattgttggtggagccattgcccttgcctgcactcttgatcaaggactactgactaaggcagttatatttggagtagcccgaaggtttgcaaaaatgggaggaaggaggttgtga

SEQ ID NO: 1123 - DNA, 1164 bp, Glycine Max
atgcctctttttggaattttccagataccctcatttatggacataatcactgacctcgccatgttcattactccgctatggattgcggttatcgtcggcgtcgtcgtgggctgggcgtggaagcccaaatgggcctttcaccccaaagacgctcttctcaagtttcgctctcctcgccctcccaatccccaaaacgacaccgcttttacctactccgccaccagttcctccgcgcgtgagaaagacgcgagtgggagtcctgtggtgacggaagacgatttgctgcatctgtggaagttggttgaggaaaaagacggagggcgggcatggattcagatgatggaccgttctaccccgaccatgacctatcaagcgtggcgtagggatcctgagtaccggagcagaacggtgttcgaagacgcgagtcctgagttggtgagggatttcttttgggatgatgagttcaggttgaagtgggatgacatgcttatacatgcttccaccatacaagagtgtgtcctcactggaacaatgatggtgcactgggtgcgcaagtttcccttcttttgcagtgacagagagtatataattgggaggcgaatttgggacgcaggacgaatttactactgtgtcactaagggagtaccttgcccctccatgccaaggcataataaacctaaacgagttgatttattttattcaagctggtgtattcgtgcagttaaatcaagaaaagatgaccagctgacttcatgtgaagtgttattgtttcatcacgaagatatgggaattccctgggaaattgctaagcttggagttcgacagggtatgtggggagctgtcaagaagtttgatccaggactacggacatatgagaaacaaagggtttctggtaccccattgtcaccctgtgcacgtgctgctaagatcaacactaaagtaaccatggactatgtgaggtctctggaaaacacgaccagtgacttgttggagactgaaaatcaggattcttctgacaaaccaggtggaaggaacatacctaagcttttaattgttggtggagccattgcccttgcctgcactcttgatcaaggactactgactaaggcagttatatttggagtagcccgaaggtttgcaaaaatgggaggaaggaggttgtga

SEQ ID NO: 1124 - DNA, 399 bp, Glycine Max
atgcctttcaagaggtacgttgagatcgggagggttgcccaaatcaactacggcaaggaatatggcaggctcgtcgtcattgtcgacgtcattgaccagaacagagctcttgtcgatgcccctgatatggtgaggtcccaagtcaatttcaaaaggctttccctaaccgatattaagattgacattaagagggtccctaagaagaaagatcttgtcaaagccatggaggatgctgatgttaagaccaagtgggagaagagttcatggggcaggaaactcattgtcagaaagagaagggcatccctcaatgattttgataggttcaagataatgttggccaagatcaagaaggcagcggttgtaaggcaagagcttgctaagctgagaaagagcgcttag

SEQ ID NO: 1125 - DNA, 396 bp, Glycine Max
atgcctttcaagaggtacgttgagatcgggagggttgcccaaatcaactacggcaaggaatatggcaggctcgtcgtcattgtcgacgtcattgaccagaacagagctcttgtcgatgcccctgatatggtgaggtcccaagtcaatttcaaaaggctttccctaaccgatattaagattgacattaagagggtccctaagaagaaagatcttgtcaaagccatggaggatgctgatgttaagaccaagtgggagaagagttcatggggcaggaaactcattgtcagaaagagaagggcatccctcaatgattttgataggttcaagataatgttggccaagatcaaggcagcggttgtaaggcaagagcttgctaagctgagaaagagcgcttag

SEQ ID NO: 1126 - DNA, 1824 bp, Glycine Max
atgcgcatgcggtggttcctccgaagcccaatcatcaaaacctcgctgctgaatctgagcccttcaatctcattaagacctcactgggcgaggagaaccttcacttcttcttcgagatcgtcaatggcggccatccacaaccacagcaatagcaacagcaacagcgaaaccggactggcgagacgcttttggatcaagttcacgcgcgaatccatcttcgccatgtacactcccttcgtcatcgccttggcctccggtaacttgcacattgattccttccaccgttacatcgcccaagacgttcatttcctacgtgcctttgctcaagcgtatgagttggctgaagagtgtgctgatgacgacgatgcgaaacttggaatctgtgagttgaggaaggcagttctagaggagctgaagatgcacaactcgctggtacaggaatgggggttggaccttgccaaagagcacggtattaattctgcaactgttaagtacacagagtttctactggctacagcctctgggaagattgaaggactaaaaggtcctggtaaacttgctacaccatttgagaaaacaaaaattgctgcttatactttaggtgccatgactccttgcatgaggctttatgctgttttgggaaagaagttccaggaacttttggattccaatgaaagtactcacccatataacaagtggatcgacaattattcctctgatggtttccaggctactactctgcaaactgaagatttgctcgacaaactaagtgtttctttgactggtgaagaacttgatgtcattgaaaagctttattaccaagcaatgaagcttgaaatagatttcttctctgctcagccactctttcagccaactatagtacccttgactaaaggacataagcctgcggaagatcatctcatagttttttctgattttgatttaacatgcactgtagttgattcgtccgccatcttggctgaaattgctatagtgacggcaccaaaatctgatcagaatcagcctgaagatcaaattgttcggatgttatcttctgacctcaggaatacatggggttttctatctaaacagtatacggaggagtatgagcaatgtatagaaagcattatgccttccgatagattgaacaatttcgattataaagaattgtctatggctcttgagcaactttcaaaatttgagaacactgcaaataatagggttatcgagtcaggggtactcaagggtataagtcttgaagatataaagcgtgctggggagcgtctgatcctacaagatggttgcactaacttctttcagagcattgttaagaatgaaaatttgaattccaatgtgcatgttctttcatactgctggtgtggtgacctcattagatctgctttctcttcagctgatttgaatgagttgaatgtccatgctaatgagttcacttatgagggatctgtttccacgggtgaaattgttaagaaggtggagtctcccattgacaaggttgaagcttttcgtaacatattgaaaaattgcaatgatgacaagaagaaattaactgtttacattggggattcggtgggtgatttactttgcctacttgaagcagatgttggaattgtgatcggttcaagttcaagtcttagaagtgtagggacgcaatttggtatttcatttgtcccattgtattctggcttggttaagaaacagaaagaatacgttgaaggaagcacttctaattggaagggtttatctggcattctttacacagtctctagttgggctgaagtgcatgcttttattttgggttgctag

SEQ ID NO: 1127 - DNA, 453 bp, Glycine Max
atgcggagcggcttaagattgttgggtgtggtgtggtgtgtgatgatggcaacaagaacgagaacaagagtgttagtgagtggtgagagtgcgaagaacgtgagggctacatatcatttatataaccctgagcagattggttggaacttggtcactgccagtgcctactgcgctacatgggatgccaacaagcccttggcttggcgtaaaaaatatgcatggactgctttctgcggacccgttgggcctcgtggcagagaatcttgcggcaagtgcttgagggtgacgaataccggaactgggactgaggctacggtgaggattgtagatcagtgtgctaatggaggcttggacttggacgtcaacgtgttccgacaattggacactaatggagtcgggaaccagcagggtcaccttactctcaactatcgtttcgtcaattgcgctgattga

SEQ ID NO: 1128 - DNA, 1113 bp, Glycine Max
atgcgtaatgtccttgcagttcaagagaacatggtaactagaattgtggatcttcggtcagacacagttacaaagccaaccgaagcaatgagagctgctatggcaagtgctgaagttgatgacgatgttctaggctatgatccaactgcgtttcgcttagaaacagagatggcaaagacaatgggcaaggacgcagctctttttgttccatctggcactatggggaaccttatatctgtacttgtccattgtgatgtcagggggagtgaagttattcttggagacacttgccatatcaacatttttgagaatggaggtattgcaactattgggggagtgcatcctagacaagtgaaaaataacgatgatggaaccatggatattgatttgattgaggctgctatcagggacccaatgggggagctattctatccaaccaccaagcttatttgcttggaaaatactcatgcaaactctggtggcagatgcctctcagttgaatatacagacagagttggagagttagctaagaagcatggactgaagcttcacattgatggggcccgtatttttaatgcatcagttgcacttggtgttccagtggataggcttgtccaggcggctgattcagtttccgtttgcctatctaaaggtataggtgctccagttggatctgttattgttggttccaaaaattttattgccaaggctagacgactccggaaaaccttaggaggtggaatgagacagattggcatcctttgtgccgctgcacttgttgccttgcaggaaaatgttgggaagctggaaagtgaccacaagaaagctagacttttggctgatggattaaacgaagttaaaggattgagagtggatgcctgttctgtggagaccaatatggtatttattgacattgaagagggtacaaagactagagcagaaaagatatgcaagtacatggaagaacgtggtatccttgtgatgcaagagagttcatcaagaatgagagttgttctccatcaccaaatatcagcaagtgatgtgcaatacgccttgtcatgctttcagcaagctgtagctgttaaaggagtacaaaaggaaatgggcaactag

SEQ ID NO: 1129 - DNA, 4722 bp, Glycine Max
atgctaggaaacaaaatcataagccttctcaaaatccaccttaaagaccatacaagacttcttggatcttcgagcctcctcaatcacctcattagccaccaagactccatgaagcaattgtctgccttttataaatgctgtctacctttcatctacatgatatggcatgacttttctcagtctgttagccagcaatttggctataattttataaatgcagcctatgagggatattggtctgaattcgttgatagcttggggatctttcactttaggaatgagagcaataaaggaggaattgctgcctttggggaaggaggcattaacaaagaattcatcaaaaaatctaaggaagtcaggtttgagctgctgccagaaatgcttaataaatctgaagttaaacccatcaggccttgggcttttatcattaccacagctccacacagcacgagtgatctcctcttctgtaaaagaattctcaatctcattttcttctcttctctcaaaattctctcaactctaataatgaaggctcaagaggctcttgaagaggagtctctttctaaagtggagagtgaagttagacaagaattgaaacaaaatcttcaaggggatgatttggaaactgctgttgctgatgagatggctacttttaaagaagagtgggaagctgttctggatgaccttgaaactgaaagtgcccacttactggaacaacttgatggggctggcattgagcttcctagcctttataagttgattgaaagagaagctcctaatgtttgctccactgaagcatggaaaaagaggaatcattgggttggctctctggcaactgctgaaatttctgagtcaattgctgatgctgagaaacatctgcaagtaaacagacctgttagaaggcggcatggtaaattattggaagagggtgctagtggctttctccaaaaaagactctgtgatgaatcccaagagccagtaaagaatgagggggattgggatctgttcaataaaatagtttctgatgggagtggcactgatgcttcatttggcagtaagcattgggcttctgtttatttggccagcactccacagcaagctgccttgatgggactcaaatttcctggagttgatgaggtggaggagattgatgatgttgatggaaattctacggatccatttattgcagctgccattgcaaatgaaagagaattagatctttctgatgagcaaaggagacaatttaaaaaggtcaaagaagaggatgatgcaattgtagataggaaacttcaaatccgtttgaaacataggaggcaaaaaaggaaaagtaaacagaacttatgttttacgcaaatgatttatgattatttcggtatcatttaccccatattggaccctaattggaaatcgtatgacttattgatgattgaattgatttgtgtaattcagcgagaaatgagcacacctatgctgttgacggagaaccacatacagaaaccttcatttgttgataatttaagccctgctgtgaatgaaggaactagcgatgatgggaaaattgtgtctgacagtggcaaggatgcatatgatattgaacagagaggaatcaaacgtgtaaacagtggggagcttgatgctgacaataaaaagtgtcggattgttgttattgacagtaataatgaagcagaggtcactgaaaataaattagattgcaatactcaagagtgtctggatgaaaaattttggtgcacagtttgtgataaagtggcccttgaagtgcatccacaccctttcttgaaagtgattacttgtggagattgcaattgcttattaaaagaaaagacacataaaaaggatcagggacaagattgttctgagggttactgtacatggtgtggaggaagcagtgaattagtttgttgtaaattatgcaagattttattctgcaccaaatgtttaaagaagaatattggtgtagaattggttcctggagttgaggacactagctggcattgttgttgttgccatccaaatcttttgcaaaagctgtccttgcaactagcgaaagctgtgggggctgctgatttaatagtttccagttctggtagtgattcagatagttcagatgattcagataattcagatgactcagatgattcagatgcgaaggttaatgttacaatcagctccaagcgaagacacaaaaagaagattcggaggatactcgatgatgctgaattaggagaagagacaaagaggaaaattgcaattgaaaaggaacgtcaggaacgcctgaagtctttgcgaggacagttttctgcttcgtcatttgaaatgagctctgacggctgtaatgggaatttatcagaaagtgcaagtgttgaagttcttggtgatgcagtagcaggttacattgtgaatgttgtgagggagaaaggtgaagaagctgttagaattcctcctagcatttccgctaaactgaaggctcatcagattactggaataagattcatgtgggaaaatataatacagtcaatcagaaaagtaaagtctggggataaaggtcttggatgtattctagctcataccatgggccttggtaaaacttttcaggtgatagcttttttgtacactgcaatgagatgtgttgatttggggttaagaactgtgcttatagtcacacctgtcaacgtgctacataattggcgtcaggagttcatcaaatggagaccttctgagttaaagccactcagggtcttcatgctggaagacgtatcaagagatagaagggcagaattgcttgcaaaatggagatctaaaggtggtgtctttttgattggttatgctgctttccgaaatttgtcttttgggaagcatgtgaaagatcggcacatggccagagaaatttgccatgctttgcaggatggacctgacattcttgtttgtgatgaagcccatatgataaaaaatactaaggctgacgtaactcaagccttgaaacaagtaaaatgccagagaagaattgcacttactggatcacctcttcaaaacaatctcatggaatattactgtatggttgattttgtaagagaaggttttcttggaagcagccatgaatttcggaaccggcaagactttcttttctctcatttctctaacgaaatatttttatttatgtgcagcttccaaaatccaatagagaatggacagcacaccaattcaactctgatcgatttaaaaggctttgttcaaagaatggacatgaatgtggtgaagaaggatctaccacccaaaactgtcttcgtgataactgtcaagctatctcccttacagagaaaattgtacaagagattccttgatgtgcatgggttcactactcaggtgcatcctgaaatgttaaggaagagatgtttttttgctgggtaccaggcattagctcggatatggaaccaccctgggatcttgcagttgacaaaagaagtcaaggactatgtaaaacacgaagatgctgttgagaattttcttgtggatgatagttacagtgatgagaattctgattataatgtacttgctggagagaagatgaggtatggaaatgacttgctgcaaaggaaagatgacaatggctttttcctgaagggttggtggaatgatcttcttcatggaaaaatttataaagagattgatcacagtggcaaaatggttttgctgatggagatactaaccatgagttctgatgtgggtgataaggtgttagtttttagtcagagcataccaaccctagacctcattgaactttatctctcaaggatacctcgacgtggcaaacaagggaagttttggaagaaaggaaaagattggtataggttggatggaaggacagagagttctgagaggcagaagcttgttgagagatttaatgagcctttgaataagagggtaaagtgcactctgatttcaaccagagcaggctctttgggtattaatcttcatgcagctaatcgtgttgttatagttgatggttcttggaatccaacgtatgatctccaggccatctatcgatcatggaggtatgggcagaaaaagcctgtgtttgcttatcgattgctggctcatggaactatggaggagaagatatataagcgccaggtaacaaaggagggacttgctgctagggtggttgatagacagcaggtgcataggaccatttctaaagaagaaatgctgcatctgtttgagcttggtgatgatgacaaccctgagactttggctgatctaacaccacattcaaatggcagtagttattctgataagttaatggaaagcttacttagcaagcatcatccgcggtggattgccaattttcatgaacatgaatccctgctacaagaaaacgaagaggaaaagctatcaaaagaggagcaagatatggcttgggaggtttaccagaaatcgttggaatgggaagaagtgcagagagtaccacttggtgagtctattatgcctgaacagaagccagaaatgccaaatgcaatgccccaaaatgtatcagaaagctgcagcatcttgccaactaaactaagcagacgtttcacgacacggaaatgtaccaaccttgcacatatgttgacacttcgaagccaaggaacaaaatttggatgcagtactgtctgtggggaatgtgcccaggagattaggtgggaggacttgaagaagagatag

SEQ ID NO: 1130 - DNA, 591 bp, Glycine Max
atgctctctttcaaacttagtctctaccttcttattgcctctgtctttttcttccacctgcttcctagtccagtgctctgcaacgacgaggaggatctacttcatgacatcaacgtatacagaaaagttttgaaccttcctgttctggatgaaagtggcaaagcttcttgcttagctgaagagatagcagaaaatctagagcacacgaaatgtgaagactttcgtgactactaccctctgcctagttacacctccaaaattcctaagttccaaaagagcataaacaaatgcaagatcaacatcaacaccacaaaagatggggtcatcatgcctctctgtgtgcccaagttggaccccgatgctttgttttccaattataccaaatctaatcgcttctcaaagtatctgaataattccaagtataagatagcagggcttggttctgaggacgattggatggttcttattatcagcaccaacacttcttctggagatttttcctctgcaacttctctgcttgctggggctttgaagggtcactacctcatgctgccattcttcttgagcacgcttattgttttcttcaactaa

SEQ ID NO: 1131 - DNA, 2686 bp, Glycine Max
atgcttaaatggcttcgaacagagctgagcgacatgcaggaattcatacaacaccttgaacgctctgattccagtcagttggagtattttgagggtaaaataaaggacgttgctctccaaacagaaagaatcatagacaccttcatcaaatcagtcgagaggaggaggaggagagaattaaacatttttcgttgttttgacgacaagattgagaaacagctgaagcaagcgtctatcactgacagcattgaagacatctctgacgaaataatgaagtatgaatccagacctgggtcattgtcggaatatcaattagaccgaaggggagaagtctggccctggcaaccccgcatcatctttggatttgatggagacgtagagactttgaaggacaagttactctcagtctcagacgaggaccctcgctgcattatttcaatagtggggattgcaggcacgggtaagactgctctagccacattgatacgtaacaatgaagacatcagagatggttttaagcacatagtgtgggtggcagcgtctccaagtcatacagttgaagaaatgcttgaagaaatatctaaggctgccacacaaattatgggaagccaacaagacacctctctagaagccttggcgagtaaaaagaatctcatagttgttgatggcgtagcaactccccgtgtctttgatgccttgacagagaaaatagctgacaagtcaacagaagacagctttcttcttaccactcacaatgcaaatattataccgcaacaagatgcaggtacaacaagatcatcttttgttcaccatctaaagttattagacgatgaagatagttggattctttttaaaacagagctgaaggtgcacagagatgtacaaatggaaccagagatgacagatcttgggaaaaaaattgtggccaaatgtgggggtctgccatcgcaaatattagacctgagcaaatttttttcagataaagatgtaacaaaagaggagtggttaagattgcaagagcagtggttaagagatcaaggtcaaggtcaaggtcaaaacccttggtctgaaacacttaacgcaatcgtcagtgacttcaacttaccttcatatgaatcacatctgaaatgcttatcttattttaagctatttcctgctaattttgggattcccgcaagaagattggttgctctgtgggttgcaggagatgtagtgcctcacagggaagaagagcaagagccacctgagcaagttgcagaaaggtatttagaagagttgatagatctgaacttggttcaaattgccaagagaaagcccaatggcaaggtgaaaacatgccgtctccctaatgctttgcgtgaactcttgttgagtgaagccccagaaaattccagaatacttcaggtggcagattgtcttgacgaaaatgatatatggtacaaccatattcacggtaatactgcaaccacaagtgattcggtttccctaagagaacactacaaggatgttctctcctttttgtcctttgatgctcgagaaggaagtagaccaggccaagaaatatgtaactttttgaacctgtgtattttgagcgattgtcttctacagctgcaggtgcttgatctagaaggcgttttcaagcccaagttgcctgaaaacattgcaagacttactggattgaggtatcttgggctacgatggacttatttagagtcacttccatcatctataagcaaattgctgaaactccagactcttgatctcaaacatacatacatacatactctaaccagctccatctggaagatggaactgagacacctgttcttgagtgagacttaccgtaccagatttccacccaaaccaatatgtgcaggtgattctctatctgatctccaaacattgtggggactttttgtagatgaagagactccagtgaagggtggtctggacaaattggtcaatatcagaaaattgggaataacatggcaatcaatgtcaccacagcaaaaggcaacgaaatcacaaaaacccaccggggtcgacttactggtaggggttctgggtagtttggacaggatcctaggttcaaaccttgttgatgtcattgcacaaaaaaggacaatggaatcacaagttgatgcagtagttgactggattgtgaaactaacaaaccttgaatcactaaggctaaaatcaagagatgaagaaggtcgaccttggaatttacccttgaagtctttgaaaaatcacaaaaaactcattgacatgcatttgctgggaatcttgagccattcatcaattctgtccgagtttcccacgagccttgttgaacttactctatcgcattcgaaactagaggacgaccccatgcaaattttgaaagatcttccagaacttcgctcattgtctttatgtgcagaatcctacgtgggagaaaaattagtttgcaattctcaaagctttcctcagctttatgtcctaaaagtttggaagctggagcaattaaaggaatggaagatagaacaaaaagcactcggctctctcagacaactggaaatccgatcatgtccctgcatgacaaagcttcctgatggactaaagcatgttaagactctccttgacttgaaattgacaaacatgtcaaaggaaatcaagactgaagaccatgacattcctccctatt

SEQ ID NO: 1132 - DNA, 198 bp, Glycine Max
atgcttaagagaacttcaatgttgattggttgcaacaccaaatggaacaacaagacgaggataagtttcaccaccgtggtgctgagcgtttcctgcgacattattcatttcttccacaggggggcagtttctgccaccggttcggggtatataagtgcaggtagaaggccccgagggagtcacaggacccttgtctag

SEQ ID NO: 1133 - DNA, 1809 bp, Glycine Max
atgcttcaaagtgcacacctagtgttgtcagggcacaccaccatctcagatgtttctgaaactgaaaatcacgtgaaaagccccaaatttggtattggtgtgtgcaggaataatgagtcacctgttcatggactatctgaagtggttgttggggttctaggaggagggcaacttggtcgtatgatgtgtcaagctgcttctcagatggccattaaagtcatggttttggatccacaggagaattgccctgctagttccctatcttatcatcatatggttggaagctttgatgacagcactacagtggaggaatttgccaagagatgtggagtattgactattgaaattgaacatgttaatgttgatacattggaaaaacttgagaaacaaggagttgactgtcagcccaaagcctctacagtaagaattattcaggataagtatcagcaaaaggttcacttctcccagcatggcattccacttcctgagtttatgaagatagatgatctcgaaggtgctaagaaagtaggggagctctttggctatcctcttatgatcaagagtaggagattagcttatgacgggcgaggaaactttgtcgtcaaaagtgaagaggaacttccttctgctgtggatgctcttggaggatttggtcgtgatttatatgctgaaaaatgggcgccttttgtccaggaactagctgtcattgtggcgagaggcagagacaattcaatttcatgctatcctgttgttgaaactatacatagggacaacatatgtcacatagttaaggctccggctaatttgaaatggaagacgagggagcttgcctcggaagtagctttgaatgctgttaactctctagaaggtgctggtgtgtttgcagttgaattgttcttgactaaggatggacagattttattaaatgaagtggcacctagacctcacaatagtggtcatcacacaattgaatcttgctatacctcacaatatgagcaacatttgcgggctgttgttggtcttccacttggtgatccatcactgaaaactccagctgctatcatgtacaatatattgggtgaagaagaggggggtcttggttttcaattagctcatcaattgatcaaaagggcattgaccttccctggggcaactgttcattggtatgataagccagagatgagaaagcaacgaaagatgggccatataaccattgttgggccttcccttagcaatattgaaagcaatcttgctgtattggtggaagggaaagaattagatggcaagactgcagttgcaccacatgtggggatcataatgggttctgattcagatctacctgttatgaaaagtgctgctgaaatcttggagatgtttggtgtgcctcacgaggtaagaatagtttcagctcacaggactccagaattgatgttttcttatgcctcatctgctcatgaacgaggcatacaagtcattattgctggtgctggtggtgcagctcacttgcctggtatggttgctgcccttactcccttgcctgttattggcgttcctgtgcgtgcttctaccttggatgggattgattcactcttgtcaattgtccagatgccgagaggtgtccctgttgccactgttgcagttaataatgcaactaatgctggattgctggcagtgaggatgttgggtgttgccaatgataatcttctgtcaaggatgagtcaatatcaagaggcccaaaaggaaagcgtattgggcaaaggagataagttagaaaaacatggctggaaatcctacttaaacaatagttaa

SEQ ID NO: 1134 - DNA, 2631 bp, Glycine Max
atgcttctccttcacttgcatagctgtcagccatggattataccaccaactcacatccacctctcatcaattaccaacaattccaggaggtttatgccgtgccacttcagctggatcagatcttcagcattacacgtgggtcgtcttagagtgcacggtgaagggagatgggaagttgattctcacaggtcagaggttaagtcaaattccaccacttacaaacatgtcctggaaaatttgggctccgagtttgtttggatgaagaaaaataataatagtactcagggtccacaggctagaagcatgatacaatttatgtcattgtacatcatactcagaatgacccataagcagctgtataatctaatgataaaagttggccaagcagtacttccacatgtgtttcagacttgtagtgcaacaagcttgccttttgcttgtgtttctaatgccttgaataaacctaagcctcttaatttagacgtgtccttgccttctattcatgatattagatggagcttagcacggttgttatacttatttaacatccagcttgaaagaaatgttgccacgttctttgtggtgctccttttagcgtgcttctcatttgttgtcattggtggtctcctgttctttaagttcaggggtaacaaaaattctctggaagattgtttctgggaagcctgggcatgtctttgttcatcgtctactcacttaaaacaagcaacacgtgttgagcgtgttattggctttcttcttgcaatatggggtatattgttttactctcgacttctaagtacgatgactgaacaatttaggagtaatatgcaaaagcttagggagggagcccaaatgcaagttctggagactgatcatattattatctgtgggatgaatagtcatcttcccttcatattaaagcagttaaataagtatcatgaattttctgttctcttaggcacagctacagctaggaggcagagaatccttcttatgtctgatcttccaagaaaacagattgatagagtagcagacaatattgccaaagatttaaatcatattgatgtccttaccaagagttgcagccttagtttgactaaatcatttgaaagagcagcagctaacaaggcacgtgcaataattatactgccaacaaaaggggatcggtatgaagttgacacagatgcatttctttctgttttagcccttcaaccaattccaaacatggattctgtccccaccattgttgaggtttcaagttccaagacatgtgagttgttgaagtcaatctcagcattgaaagtagagccagtagaaaatgttgcatcgaaactatttgttcaatgctctcggcagaagggacttataaagatctacaggcacttgctaaattatcgaaaaaatgtattcaatctttgcagcttgcctaatctagaaggaatgacatataggcaaataagacatagatttcaagaagctgttgtatgtggtctttaccggagtgggaaaatatacttccacccaaatgatggtcatgggtcattgttccggatctttttatcaaagtgcgtaaaaattgcaatcagaacaaaattaatgatcaaacagttggtaaactggaaaaagagagtattgttcattggatcccttcgggatactaatactaaaaagccagaagtaatcctagatgggaaagaaggaaaccacgaaattcataatgaggaaatacttgaaaaggatctggaacatgccattgagttgagtaaagtaagacttgctaatattgtaaaacggcctaatagatcaggttccaagggatcagacgggaatcttggaccgaaagaatgcattcttttacttgggtggcgccctgaagctgtagaaatgattcaagagtatgataactatcttggtcccgaaagtgttttggaagtgttatcagacacaccattagatgacaggattaataaggcaagcaacatcaatggtcataataaactcaagaatgtccgggtttctcatcggattggaaatcccatggactatgacaccttaaaggaaaccattttgaatattcagaattctttgaagaatgaggatgttcctatgtcaattgctgtcatatctgacagagactggcttcttggagatccagctaaggcagacaagctgtctgcttattctctcctccttgctgaaaatatctgcaacaaacttggggttaaggtgcaaaatctagttgcagaaattgttgattcaaaattggggaaacaaattagtagaatcaagccatcagtgacctacattgcagcagaggaaataatgagccttgtaacagctcaagtggcagagaacagtgaactgaatgaagtttggaaagacgtattaaatgcggagggagatgaaatatatgttaaggatattggcctttacatgaaagaaggagagaatccatcattttctgagctttctgagagagcatatttacggagagaagtagccataggatatgtgaagaacaagaagaatgtaatcaacccagttcccaagtctgagcctctctctcttgaaatgactgactccttgatagtcatatctgagctggaaggagagcaacccgtcgttttgtga

SEQ ID NO: 1135 - DNA, 585 bp, Glycine Max
atggaaaacactactgtgacatatcaaactgatctcaacctcaaggcaacagagcttagactggggcttccaggaacagaagaaagtgaggagaaaacactgtctgcaggtgctagaattaacaacaaaagacctttaactgaaacctctgatgagtgtgcttcaaatggtacttctagtgctccacatgagaaaactgaaacagcccctcctgccaagactaagatagtggggtggccaccaatcagatcctataggaagaacagccttcaggagagtgagggtgctggaatttatgtgaaagtgagcatggatggagccccttacctcagaaagattgacttgaaggtctatggaggctacacacaactcctcaaatctctagaaaatatgttcaagttgaccataggagagcattctgaaaaagaaggttataagggatctgactatgcacctacatatgaagacaaagatggtgactggatgttagttggagatgttccatgggacatgtttgtgacttcttgcagaaggctaagaatcatgaaaggatcagaggcaaggggtttgggttgtgctgtatga

SEQ ID NO: 1136 - DNA, 1701 bp, Glycine Max
atggaaaatacaggcctatggattcagaaagagggccatggaagaaaagattcattgcacaataggattccgaagcatgtggtgagtgtggacgagaaatacatccaccgctgccttgaattcatacataacactgcattaaaagcagctcaattcaacatacctgagagcttaagagccactaacatggagactttatcagaaagcttgaatacagctaaattttttggtggaaatgcatgtggttcgggacattttgtctttgaatgtcctgtggtcaccgagactgggagagtagttataagtgctaatgcaggggaccagtggactttaggtacaataatggggagcaagagtatgataaatatattgaatagtactcttcttcagcagtttggtgcttcacatagaactgacaatttgaataggatgaacttttctgatcctgaaggattggtatgctatgattttatggactctcctagtgatttatgtatctcttcttcatataaactagaaaaggaaaaacagttagtgcgaagtcataagtatggccccatttctgttcacaaaaggcttgtttcaacttctagcaccacctctacttgttctgattggttgtcttcaacatcttctaatctatctcagggaatgatccaatgtacatggaagcaagggattcctcattttgttttttccgcagatgatcagaaggaggtctatgtcacaaaattgaggaaggtagactcaacagataataaggctttggactatgtgtatgagtttcacttgaacaagggtggccaaaagggtcgtgaaattcctgatggtgatttgccatttgttgggaagatgcatgtatcaacgagtttcaccctttgcccgaacaattgtagaataagggagacggagtttacattattccataacattgaaatttctgacaaagaaatgtccgcatcagagcatgctcacaggaagagcaaggggctgtcgaagaaggtgtcaaaagtttttaaaactagcccatcatcaaaacgcagaacactctcaaagtttggtgggtcaagtgccatatcggagagttgtccgtgggagccatatgctctaggtgggaccaatttactagatactgatgttcctccaaatattgagatggctgccgttgttgtgaaaaaccatcttccttgtaaaaaaccagagaaagtaggagggtggggtttaaaatttctcaacaaatcaggtgaaaatcaagtcacattgccttctgaaagttgtaatcaaaataatgggaactgctcaactagcacgagcattctaattccggcaggtcttcacggtggcccaagaaccagaaatggtgggccatccagtctgatagatagatggagatctggtggtcattgtgattgtggtggttgggatgaggggtgccctctgacagtgcttgaaagaagatctaacaaagctgatgttatgtctaaaatagacacacaagatgagtgcaagtcagttgatttggttactcagggttcaagtgattacagccccaccttgaggatggtaaatgttcacgatggtctatattatattcattttcatccacctctgtctgcactacagtctttctccattgtggtggcaataattcatgcacaaagtcctacacttcagcccaatggtgcaaagaagctgtcataa

SEQ ID NO: 1137 - DNA, 1311 bp, Glycine Max
atggaaccgccatcgcagcaacagcctccgcaaccgccatcgcgcactgccaccatcctcggaaagtaccagctgacgcgcttcctcggccgtggcagcttcgccaaggtctaccaggggcgatccctcgtcgacggtgccgccgtggccgtgaaaatcatcgacaaatcgaaaaccgttgacgccggcatggagccacgcataatccgcgagatcgacgccatgcgccgcctccaccaccaccctaacatcctcaaaatccacgaggtgctcgccaccaaaaccaagatccacctcgtcgtggagctcgccgccggcggcgagctcttcgccaaaatctcccgccgcggaaagcttccggagtccaccgcgcgccgctacttccagcagctcgtctcggcgctccggttctgccaccgcaacggcgtggcgcaccgcgacctgaagccgcagaatctcctcctcgacggcgacggcaacctcaaggtctccgacttcgggctctccgcgctgccggagcagctcaagaacggcctcctccacaccgcctgcggcacgccggcgtacaccgcgccggagatcctccgccagagcggcggctacgacgggtccaaggccgacgcttggtcctgcggcctcatcctctacgtcttcctcgccggacacctcccattcgaagacaccaacattcccgccatgtgtaaaaaaatttcccggcgagattataagttcccggagtggatttcaaaaccagcccgttttgtaatccataaattactcgacccgaacccggaaacccgaattagcctggaggccctgtttgggaatgcgtggtttaaaaaatcactaaaaccggaaacggcggaagaaaacgcgttggggttcagctacgtgaagagtagttataattacgaagggagtaaaagttcgggtgtgacagcgtttgacataatatcgatgtcttggggtttggatttaacgaggttgttcgaaacgaagtgggattcggggagtaaaagagagaagaggttcacttcgagtgcgagagttgaggtggtggaggagaaggtgaaggaagtgggagggctgttggggtttaaggttgaggttgggaagagcaacggtgcaattgcgttgctcaaagggaaagtggctttggtttttgagctccttgagattgtgcctcatcaacttcttttagtggcggttaaggtgctggagggtgctttggagtttgaggaacttcattggggggattggaaacatgccttgcaagatctcgtgctctcttggcacaaccaagaatcatga

SEQ ID NO: 1138 - DNA, 993 bp, Glycine Max
atggaacgtggggttcttgatagtatcattaataggctgcttgaagtcagaggcagaccagggaagcaggtgcaactttctgaggctgagatcaagcagctttgtcttgtctccagggatatcttcttgaggcagcccaacctcttggaactcgaggcaccaattaagatctgtggagatgtccatggtcaatattccgaccttctgcgactttttgagtatggtggattgcctcctcgttctaattacttgtttctaggggactatgttgatcgtgggaagcaaagtttggagacaatatgtctccttctggcttataaaataaaatatcccaacaactttttccttctgaggggcaaccatgaatgtgcttctataaaccgcatctacggattttatgatgagtgtaaacgaaggtacaatgtgaggctttggaaagtgttcacggaatgtttcaactgcttgccagtggcagctctaattgatgaaaagatactttgtatgcatggtggactctctcctgagttacacaatctgaatcagataaagagtttgccgcgtcctattgaagtgcctgaaactggtctactatgtgacctcctttggtctgatcctagtagtgacattcggggttggggagagaatgaccgcggagtttcctatacttttggtgctgatagggtgacagaattccttcagaagcatgatcttgatttgatttgcagggcccatcaggtcatggaagacggatatgaattctttgctaacaggcaacttgtaaccatcttctcggctcctaattactgtggagagtttgacaatgctggtgctatgatgactgttgatgagacacttgtttgctcttttcaaatattgaagcctgtagaaaataaaaagcctaataagtttgcctttgggagcacaactacagttaagcatagtactccaacaaaaaccaagttccagcaatcattttttggtgctaaagcatga

SEQ ID NO: 1139 - DNA, 1116 bp, Glycine Max
atggaacttgctggtctatctgtgagagaggatgctgttggtaacatatttggtcgttgggatggcgttgaacctgagcttgctgcagttgcaacaggttcgcacattgatgctataccttactctggaaaatatgatggagttattggtgttttaggtgctattgaagccatcagagtcccgaaaaggtctggttttaaacctagaagatcattggaagtcatattattcacatcagaagaaccaacacgctttggaataggtagcttgggaagccgcttattggctggaagtgaggatcttgcaaattctttaaagacaacaactgatattcaaaacatatctttcctagatgctgcacgatctgctgggtattcaaaaaatgaggatgacttatccagtgtatttttaaagaaaggaacatattctgcttttgtagaactgcacatagaacaaggacctattctggaagatgaaggtatatctataggcatagtcactgccattgcagctccagcaagtctaacagttgaatttgaaggcaatggtggccatgcgggtgctgtccttatgcctaacagaaatgatgctggtctggctgcttctgaattagccctggctgtagagaggcatgtgttggattctggttcaattgatactgttggcactgttggtatcctggaactgcatcctggagcaatcaacagcatccccagcaaatctcacctagaaattgacacacgagacattgacgaggaaagaagaaataaagtggttgagaaaattcaccaatcagcaattaaaataaccaaaacacgaggtgtcaagctctctgattttcatgtcatcaatcaggatccaccagccctttctgatgaagcaatcatcaaggcagtagaaactgcaacaaaagaactaaacttgacaagcaagttgatgattagtagagcctatcatgattcattgtttatggccaggctgtctccaatgggcatgattttcattccatgttacaaagggtacagccataagcctgaagagtttgccaccattcaagatatgtcaaatggtgtaaaagtattaacactcaccctagccaaattgtccagtcactaa

SEQ ID NO: 1140 - DNA, 431 bp, Glycine Max
atggaagaagaaaaagaaacagtgatgttaacaccgggggaagtgttgggtagaaccagcgacatcaaagatgttgaacttaactggtcacaagtcccatggacctgttccacagcctggatctgtcgtcattgcgcgggtatatacctatggctacgtgtcaccaaagtgatggctcggtccgcttcagctgatattatgtgtgttggaccaaagtctgttcgagaaaaattcactggcatcattaggcagcaagatgttagagcaactgagattgataaagttgacatgcacttgtcttttcatcccggtgacattgttagagctcttgtgctttctcttggagatgcacgggcatactttctatctactgcaaagaatgaacttggtgttgtttctgcagaaagcattgctggtgcaactatgatcca

SEQ ID NO: 1141 - DNA, 2751 bp, Glycine Max
atggaagataagtcaggggaacccagagagaagctctcacgaaatacagaagtattttatgagaaatgccgaaagtccttttcttcaaaaagagatgcagtctttttactctggacatggcttaggaacttggaaaagaactttgttattcattataatcattggtctagcaacattagcataggggtgcctcaaacagtggtggacaagctaatcaaattacaacgtagattcctatggggagggggacatgacaacaaaaagattgcgtggatttcatgggagacacaccaaggggaactatgggctagagttttggaggctaaatatgggggatggaggggtttagctgaagagggcaggtcaaatttagagtcaatatggtggagggatttaaaaagagctgttcatcattcacaccacggtaaggtcctacaaaatggactgaaatggaaggtagaagcaacaccagcttattcgacaattgggaaagcacaacgattctggttgggagtaagtccattcagcattatggatatgatggctgggagtggacagcagatccatcgggtatctattctacacatagcgcttattcaatgttttgggaggaggcagcagttagaagctaggaggattgttaaggtggaggaggatgcatcccatctttttatccattgcattaagatccaacctatatggtgggaaacaatgtcgtggataaatattaagggtgcctttccattaaatacaaaacaccatttccttcaacattcgtttctgcaggttgaaggcatcaggattaagaggtggcagtattggtggttggctgtaacatgtgtctctgggccttcatccttctccaattgggccttgtcaagtatggctgctaccatttggtggagggtatcctctgactgtttggtcctacccctagtcataggtccttgtatttgggcagctttgggattctcatcaatctgtcagagacaagtaagggttagaggagacaagtgtgcggtcttgaagtattacatttctcaaaaattgaaaaaaatcaagcagaggagaaaggatggcgttgatcccataaagactgcttttgaacagatgaagagggtgaagaaaccaccaataccattgaaaaactttgctagcatcgagtctatgaaagaggaaatcaatgaagttgtcacatttttacaaaatccaagggcatttcaagaaatgggtgcacgggcacctcggggtgttcttattgtaggcgagaggggtacaggtaagacatctctagcattggctatagctgctgaggctaaggtgcccgttgttgaaattaaggcccaacaattggaggctgggctgtgggttggacaaagtgcctccaatgttcgggaattgtttcagacagcaagagatctggctcctgtgataatatttgtggaggattttgacctgtttgctggtgtacgtggtacttatattcataccaaaaatcaagaccatgaaactttcatcaatcaactgcttgtggaacttgatggatttgagaaacaagatggggttgttttgatggctactactagaaatctcaagcaaattgatgaggccttgcagaggccaggtcgcatggatagaatatttcatcttcaaagaccgacacaagctgagagagaaaaaatattgtacttgtcagcaaaggaaaccatggatgatcagtttattgattatgttgactggaaaaaggttgctgagaagacagctcttttacgacctatcgaattaaaaattgttccaatggctttggaaggaagtgccttccagagcaaagtactggacacagatgaattgatggactactgtggtttctttgcgactttcagttctatgattccacaatggctgcggaagaccaaaattttcaataagttgagcaaagcgttggtgaatcatcttggactgacattgacaaaagaagatctgcagaatgttgttgatttgatggaaccatatggccaaataagcaatgggatagagtatttgagccccccacttgattggacgagggaaaccaagtttccacatgctgtctgggcagctggtcgtggtcttactgctcttttattaccaaattttgatgatgttgataatctttggcttgaacctctatcctggcagggaataggatgcacaaaaatcacaaaagcaagaaatgaaggttccatcaatgggaattcagaatcaagatcatatcttgaaaagaagcttgtgttttgttttggttcttatgttgcatcccaaatgttacttccttttggggaagaaaacttactttctacatctgagatacagcaggcgcaagagatatctacacgaatggtcattcagtatgggtggggacctgatgacagtcccgcaatatattactgtagtaatgcggttaccgcattaagcatgggggatgaccatgaatatgtgatggcagctaaagttgaaaagatgttcaatttggcttatctcaaagcaagagaaatgctgcagaaaaatcgccttgtactagaaaagattgtggaggaattacttgagtttgaaattttgactggaaaggacttagaaagaattactaaagataatggtgtaatcagggagcaagagccgtttactcttggtgaagttcaagctagtgagccaatatctggcagcttccttgaaagaggaaatgcatcaggaagtgctctattagcatcctag

SEQ ID NO: 1142 - DNA, 840 bp, Glycine Max
atggaagatgatgacgcagcgattgaggtgaggaaccatgtttccccagagccagaggtggaggattccagttgctgttgcccaatttgcttgggaccattccttcaactttcctacctcgacaaatgttttcataagttttgcttcaattgcattttacgctggaccaaggtggttgctagcaagcaccgttctccaccttcttctgtaaaatgccccctctgtaagaccgaaaatttttctatcatatatgtagttgatgggagttgttttcaacgtcattatgtaaatcaagattttgagaatagttttatcttatcaagagctcacagatatagagtacaatgctattacactgaacaaggttttgtagatgacatattcaatatatcacaatattggagatctcaaaagtactatcagccaaactgctggcttcaaagttggttaagaagagaaattcaagctcttatccaggaggaggatgttgacatcattgtgcaccatatccttgctgtggtcaaagcagcattatggactaggagagagcagaagtcacacatgaatgcacctgaaaagaaacaggaggagttcaagatgccagtctctgaagccgcaaggccttttctggcagcaagaacggacagatttatatatgagattcaactatttcttgcttcaggaatgaatattgaagcttatgatgctgtttacatacaacggttaggttggagctcacctggggtaaacactgaggtttctcaaagtgaattagttgatcgtgcaactgtgattccatacctgtacctatttgatggtgactttgatgaaaatgagtaa

SEQ ID NO: 1143 - DNA, 984 bp, Glycine Max
atggaagcaccagaagaactctctttggggggctcaaaagatcacaccaacattgtcaaaggaaaaagaaccaaaagggtaaggccacaatcccctatgccattctccatcacctccaattcttccaccggagaaggagaaaaagaagaaggttgcaacaacggtgatgatgacaacaacaacatgaaaaatgaagatatcaataacatcaacagctctcccacctcttctgcaggattacaagacagcacagatgaagaggaggacatggcgaattgcctcatccttctagctcaagggcaatcacgggaatccccgaaacacgcggaggaggacgccggcatgaactccgccaagtacagcagtagaaaattcttggaagctgctaccttggggtctagcagggcagggtactatgtctatgaatgcaagacatgtaacagaacctacccttcatttcaagcacttggaggccacagggccagtcacaagaagcctaaggcattgatggctattggcctagagaagaaacagcaacaccttttgtcaacagatgaggaagagtttcaattgaagaccaataagtcaccattttcccttcaattgaatacaaaggggaatttgtacagcaacaacaacaagtccaaggtgcacgagtgctccatctgtggtgctgaattcacatcaggacaggcattgggtggtcacatgagacgccaccgcgctccggtcggaaccaccacccccgccacactctccttcacccctttggctttggaaccagaagaagatcaccccagaaagaaaaggaatgtgttgaatttggatttggatctcaaccttcctgccccagaagatgatcatagagaatccaagtttgccttcacatccaagcaacaacaacatcaacaaccacaacaacagcaacagccacaaacaagtcttgtcttccccgcaccagctttggtggattgccattactaa

SEQ ID NO: 1144 - DNA, 1308 bp, Glycine Max
atggaaggtgttggcgccatcttcctcgactccaatttagaggctgtcggacttggaggtgcaaaagcaaagagagtgaaagtggtgaagggagattctgttcctgtggccaacgtgggagcttcccagaacaaaattcttgctgacataagcaacttaccccaacaaccaaagcaacacatctctgttgatcaccttctcaaggaaaaggaaacgttgataaagcttcttgctaatagagatgccattatagagtcgtgtaaagctgagctgcacaagtgtcaaaccaattttcagaaactaaggaagcaaaatgcggaacttgccctcacaaatgctcaaatgctggcggagcttaattcaagtaggcagaagctaagggaacttcagcttgaactaggaagcaaaaatggtatactcaatgctatgagattagaattgacgctaaaagagcaaacagataaaacgaagcatgaaactgatgcaaatgaggtgagagcatgtcagagtaagctgtcagatcagtcattgcaagaagataacaaggggaatgcaaaaaggaagagagtgtccaaacctcaatcttctgcacctgctgtcattaaacaagtcaaatccactggaaaggtcgacaatcagaggtatagtttgcgaaggcaatctgcagggttgaaagctgaaaaaccagaaccaacaaaagattccttggaggtggttgaagtcaaagatgatatttcacatctacaagaaaatttggccaatgaaaatggaccaacatcattggggtcaaaggtccatgacgaagccagagaagctactgaatgtaactgtacacaacttatttcatttttttactttctcttgcagtcttgctatatcaagccttatgtatattgtttgtatgcagcttcgagacctactaacacagagcaagttcatgttaaaaagaatattgaaaagaagaggcagagtatgagaagacagactaacaggttcaggcctgggaatccagaaccagctgaagacttctttaagatagatgatgcaaaatttactgtctcccaattatctgataatatgtcagaaaaaaattgtccaacaacatcaactgtaacttctgaacaagaaaatgacgcctgtacatttgagcctcaggaaactcgtagatcatctgttgggcggccattgcgtcggacagttgagaagattgtgtcctacaaggaagttccacttaacttgaagatgcgcagagataaatcaggtatttttgtatcaggttctcactcaattaccaataactctgtatag

SEQ ID NO: 1145 - DNA, 1281 bp, Glycine Max
atggaaggtgttggcgccatcttcctcgactccaatttagaggctgtcggacttggaggtgcaaaagcaaagagagtgaaagtggtgaagggagattctgttcctgtggccaacgtgggagcttcccagaacaaaattcttgctgacataagcaacttaccccaacaaccaaagcaacacatctctgttgatcaccttctcaaggaaaaggaaacgttgataaagcttcttgctaatagagatgccattatagagtcgtgtaaagctgagctgcacaagtgtcaaaccaattttcagaaactaaggaagcaaaatgcggaacttgccctcacaaatgctcaaatgctggcggagcttaattcaagtaggcagaagctaagggaacttcagcttgaactaggaagcaaaaatggtatactcaatgctatgagattagaattgacgctaaaagagcaaacagataaaacgaagcatgaaactgatgcaaatgaggtgagagcatgtcagagtaagctgtcagatcagtcattgcaagaagataacaaggggaatgcaaaaaggaagagagtgtccaaacctcaatcttctgcacctgctgtcattaaacaagtcaaatccactggaaaggtcgacaatcagaggtatagtttgcgaaggcaatctgcagggttgaaagctgaaaaaccagaaccaacaaaagattccttggaggtggttgaagtcaaagatgatatttcacatctacaagaaaatttggccaatgaaaatggaccaacatcattggggtcaaaggtccatgacgaagccagagaagctactgaatgtaactgtacacaacttatttcatttttttactttctcttgcagtcttgctatatcaagccttatgtatattgtttgtatgcagcttcgagacctactaacacagagcaagttcatgttaaaaagaatattgaaaagaagaggcagagtatgagaagacagactaacaggttcaggcctgggaatccagaaccagctgaagacttctttaagatagatgatgcaaaatttactgtctcccaattatctgataatatgtcagaaaaaaattgtccaacaacatcaactgtaacttctgaacaagaaaatgacgcctgtacatttgagcctcaggaaactcgtagatcatctgttgggcggccattgcgtcggacagttgagaagattgtgtcctacaaggaagttccacttaacttgaagatgcgcagagataaatcaggtttatggactactttgtga

SEQ ID NO: 1146 - DNA, 1515 bp, Glycine Max
atggaagtcaacaattggcataaggagcttaaatatgatgagtgggtaccaatcactgtatctggtgcacgtccagctgctcgctacaagcatgctgcagcagtagttgatgaaaaattatacattgctggtgggagtcgtaatggtcgacacttatctgatgttcaggtttttgatttaagaagtttgacatggtcttctctgaaactaaaagcaaatgtcagaaaggatgatgacgatagttcacaggagattcttccagccacatctggtcacaatatgattagatggggtgagaaactgcttcttcttggtggcaattcaagggaatcttctgctgaactaacagttcgatacattgacattgaaacatgccaatttggagttattaagacttctggtgatgttccagtagcccgtgtgggacagtctgcctcactgtttggttcaagagtgatattgtttggtggagaagaaatgagcaggaagctgttgaatgatgtccatgttcttgatcttgaaagtatgacttgggaaatgataaagactacgcagacacctccagctcctagatacgatcattccgctgctattcaaggagagcggtaccttctaatatttggtggttgctctcattctatcttcttcaatgatcttcatttattagacatgcaaacaatggagtggtcccaaccacaaactcaaggtgatttagtatctcccagggcaggacacactggtatcactattgatgaaagctggcttatagttggtggtggagataatagaagtggttgccctgaaaccctggtgttagacatgtctaagcttgtttggtcagtattgactgttgtgaagcaaaaagatccactttctagtgagggtcttagtgtctgttcagcaacaattggtggagaaaagtatttgttagcatttggaggctataatgggagatatagcaatgaggtttttgttatgagacccaaggccaaggataccatgcgtcccaagatttttcaatcacctgctgccgcggctgctgcggcttctgttacttctgcttatgcattgtctaagtctgagaagttggatttcatgcaactggatgatataaattccaagttatctgtaaatggtcatcataaagatgatgtggtggataaagttgaagccattaaagaagaaaaacggttattggaattgtcaattgcagaagtcagggctgaaaattctaagcttggaggcgagatagaagaaataaataatactcatgctgagttgaccaaggaactccagtcagtccagggacaacttgtggctgagagatcaagatgctttaacttggaggccaaaattgcagaactccagaagttgctggaatcaatgcagtctgtggaagaggaggtacaggctcttcgtgaaaagaaatctgctctggaccaggagatggagcttgctgcaacagctgagagcaagagttctggttggcgatggtttggtgggagtgagaaatga

SEQ ID NO: 1147 - DNA, 1515 bp, Glycine Max; identical to SEQ ID NO: 1146

SEQ ID NO: 1148 - DNA, 1191 bp, Glycine Max
atggaagtgacaagtgctgttcaccttcactcagttgggtttctgcatttacagacacacgttgaaaggctcaacggtagagctttcttcctctccacaagaccaagaaaagtgaaggttcatcttccttgtcatcaccatcatcatctaaaccacttaagcaataccaacggtattggtgcttgcagtgatagaacaagtgttatactcaactccacttctgttacttccacaacttcttctgctgcggggtccctctctgaagtggaaaagataaagcagaagtgccttacatggcagtggaagggtcaatattccatcaactactttgtttcttctgattctcctcagcagttgcatggcagccaccctcctctcttacttgttcatggcttcggtgcctccattcctcactggcgcaggaatatcagcacactggcccagaattatactgtttatgctattgatcttcttggttttggggcttcagataagcctccaggctttcaatataccatggaaacatgggctcagttgatcttggatttcttgaatgaagttgttcagaagccaactgtactaataggaaactctgttggaagccttgcttgtgtcattgctgcctcagattcaagtcaaactcttgttagaggcattgtgctgttaaattgtgctggtggcatgaataacaaagcaattgttgatgactggaggatcaagttactattacccttgctttggctgattgattttttattaaagcaaaagggaattgcctcagcaatttttgggcgcgttaaacaaagagagaatttaagaaatgttttgagttcagtgtatggaaacaaggagtctgtggatgaagaactggtggagatcattagggaaccagctaatgctccaggggccttagatgcatttgtttccattgtaacgggcccgccggggcccaatccggtgttgttgatgccaaaaatctccttgcctgttttacttttatggggagataatgatccctttactccaattgatggacctgttggcaagtacttttcttcattgccttctcaaaaagaaaatgttaaacttttcttgcttgaaggggttggacattgtccccatgatgacaggcctgacttagtacatgaaaaattgcttccctggttggccagtatttcaaattcagagtaa

SEQ ID NO: 1149 - DNA, 828 bp, Glycine Max
atggaatatgtatgtagcccacttggttgggaattctaccaccaggaagaggggttagaggacttgagacattctcttctgtacacaaccttggagctagaggcaacaattgcatcagctaaggaggagattacaagaagagaatgtgaattgattcgtgtgaatgacctcttaagcagggtcatgaaggagagagatgaggcacaagcaaaatgccagaagctaatgctggaaaaactagagctccaacaagaacttcagcataagcaacaactagaacagaatcagcaccaacaccaacaccaacttgttcaaaaacatcaaagagacaccatatcacaaagtgaagaggagctgcaagaagggttatccgaaaagcattctgcttcttctgactgtgaagaaaacagcagcatgccctcttctggtggaagttcaaccccacatcatacaacaccactgcaggtggtactggagttggcagaaaagaaaccattgcctgaaaaagggaaactcttaaaggcagtggtggaagctggaccactgcttcagacccttctcttagcaggaccactcccacagtggcagcaccctcctccacaactcaactccattgagatccccccagtggccatttcaccccaaaactcttcttctaccaaaagtgcttctttccctttcaataagaagagggaccttcttgtcctctctccaggtaccggttgcccagtttcaaagaatagaaaggtcattcagcacatgccaacacctaccactaccactgcttctgcttcacatcattccctaccacacccatcattttcataa

SEQ ID NO: 1150 - DNA, 1905 bp, Glycine Max
atggaatgcaacaaggacgaggctttgagggctaggcaaattgctgaagccagaatgcaaagaggtgaatttgcggaggcactcaggtttgctaccaaggccaaaagactgtatgccgacgttgaaaacattgcccagattattacggtttgtgaggttcacatcgctgctcagaaaaaactctctggctgtgacatggactggtatgcaattcttcagattgaaaggctggctgatgaagcaaccgtaaagaaacagtacaggaggcttgcactgctacttcatcctgataagaacaagtttgctggtgcagaagctgctttcaagttgattgggcaagccaatgggctcttgtgtgaccaagcaaaacgttctttgtttgacaagaacaaccaaggtgcacagatgacattctggacatcttgccaacattgtgatgctaagtaccagtacccgatccgatttgtaaatgcaaacttactgtgtcaacagtgtaagaagccatttaaagctcttgctaatggttttggaatcatgggtgcggcaacaacctctcaaaattttggaagtaaaagagtaaggcagtcagcaccagattcaggagaaagtttcaaagccagaaatggtgatgataccaaagctgccaatattcgagaaaatgctgttgattcttcaaatacaaggagatcttccaggaaaaagcagcatgtttcatatattgaaacctctgaagatgacgattttgagattccttccaaaaagccacgacaaagtggaccacttaatgctgatgaagctgaggaacaaaacgtgcctgcaagtggtgagtcgtctgataataatattccagctactcccggtgcgactgatcagaacaaagagaaggtatccgagtcagatattggtcttggaacgtcaaaggaggataagcgctccccaaaaaattcaaaggttccttctcgtccacggatatttcattgtcctgtttctgatacagatttcaatgattttgagaaggataaggaggaggattgttttgctgttaatcagttgtgggcagtttatgatagcactgatgcgatgccaagattttatggtcttgtcaagaaagtggcctcccctttccagttgaagattacttggttggaacctgacccagatgacaaaggtgaaattgattggaatgatgcagaattgcctattgcttgcggtaagtttagacttggtggttctcagcaaactacagatcgcaccatgttctctcatcaggtgcggtgcataaaagaaaccggcagaggttcttatctggtatgtcctaataagggagaaacatgggcaattttcagagattgggatatcaactggagttcgaatccaaaaaatcatctgaagtatgacttcgaatatgtggaaatcctatcagatttttctgagaatgttggcatcgcagttgcttatatgggcaaagtgaaaggatttgttagcctttttcagagaacggagaagaatggagtaaacatattttatatcgaacctaatgaactatacaggttctcacatcgaattccttcttataagatgaccggttatgaaagggagggtgttccaagaggatcatttgaatttgatccagcggccctgccgactcatctctttgaagttggtgattctggtaatcatgttctcgaaacttggactttgaataaaagtgaaatatacctaaagaataagataaagtttaaattcaatttttcactagtgtttgtttataagattgaactcgatcgttttcttgatagacagggatgcttcatccaagctttgatggtctttgcaacatggctttctttggtccttcaaacatcgagatcatgttttaaaaactgttttaaaactgtgatgtaa

SEQ ID NO: 1151 - DNA, 717 bp, Glycine Max
atggaatggaggaaatattatttggatgtggtgctggtaccattgggatttcttataaccattggttatcatgtttggttgtggcataaggttcgaacacagccttcttccaccataatcggaatcaatactcatggaagacgctcctgggtccctgccatgttgaaggacattgaaaagaagaacatcctggcagtgcaaactcttcgaaatctgataatgggatcaactcttatggccaccacttccattctcctctctgcaggcttggcagcagtgataagcagcacttacagtgtgaagaagcctctgaatgacgctgtatatggggcccacagtgaatttatggtagcacttaaatacgtgacactcctaaccatattcttattctcatttttctgtcacactctgtcgattaggtttttcaatcaagtgagcatcctcatttgcacaccacaacaagatgtgatcatgtcctcagcagtgacccctcagtatttgactgagcttttggagaagggaactattctgagcactgttggcaacaggcttttctactcagcactccctcttctgctttggatctttgggcctgtgttggttttcatgtcttctgtggcaatgttaccggtgctttataacctagactttgtttgtgggaataataatgggaagggaaagatcatgaagaatgacaaaggggaggactatgtttga

SEQ ID NO: 1152 - DNA, 2175 bp, Glycine Max
atggacaagtccctgatgcctcaagtctttgcaagccatcacgattggtacgaatccaccattcattccataaacttagcaacagctgatgatccctctgagcaacagaaattagtgtacacttacgatgatgcaatgcatggattcagtgcagtgctatcatcagaggagttggagaccctaaagaacactcatggttttgtcacagcttaccctgatagatctgccaccatagacaccacacacacctttgagtttctctcttttaatccctccaatggcctgtggaatgcttcaaattttggagaaggtgtcattgtgggtatgattgacacaggtgtctggcctgaaagtgagagcttcaaagatgatggcatgagcagaaacatcccttccaaatggaaaggaacatgcgagccaggacaagacttcaatacctccacgtgtaacttcaagttaattggggctaggtacttcaacaagggtgtgaaagcagcgaatcccaacatcacaataagaatgaactcagcgagagacactcggggacatggaagccacacatcatccactgttgctggcaactatgttaatggtgcttctttctttggctacgccaaaggggtagcaagaggcattgcaccaagagctaggcttgccatgtacaaggtcctttgggacgaagggggtcacggctctgatgttcttgcaggaatggaccaagccattgctggttgccatgtacaaggaatggaccaagccattgctgatggggttgatgtcatttcaatctcattgggctttgatagtgttccactttatgaggatccggtggcaatagctgcttttgcagcaatggaaaaaggggtgttggtttcatcttcagcaggaaacgcaggtcctatacttggcaccttgcacaatggaatcctttgggtcttaaccgtggcagcaggcaccatagaccgcacatttggaagcttgacactgggagatggtaaaatcattgtgggttgtaccttgtttgctgctaactcaatagtggagaagtttccacttatttacaacaagactgtatcagcatgcaactcggttaaactattaaccggagtagccacaagagagatcattatatgtgatgccttggactcagtttctgtcttaacccaaatagcttctgttaccgcggccagtgtgtatggggctgtgtttatctctgaggatccagaactaattgaaagaagacgtttgttcactccaagcattgtgatcagcccaaatgatgcaaaatcggtgatcaagtacgcgaaaagtgctcaaaaaccatttgccagcatcaactttcaacaaacatttgttggaataaagccagcaccagctgttgcaatttactcttcaagaggtccttcaccaagctacccggggatcttgaagcctgatgtaatggcacctggctccaatgttctggctgcttttgttccaaataaaccttcagccagaattggcacaaatgtgtttttgtcaagtgactacaatttcttgtctggaacatgcatggcatgtcctcatgcatctggtgttgctgctcttttgaaagcagcacaccctgattggagtgcagctgctataagatctgcattggttacaactgctaatccccttgataatactcaaaatccaatcagggataatgcaaacctatttcaatatgcttctcctcttgctatgggagctggtgagattgaacctaatagagcacttgatcctggtctcatatatgatgccacccctcagaactatgttaacctcctttgtgctttgggatacacaaacaaccaaatcttatccatcacaagatcaaggtcctatgaatgttctgccaacccctcatctgatcttaactacccttcgtttatagttttgtatagtaacaaaacaagatcaacagtccgagagtttaggaggatcgtgaccaatgttggagatggtgctgctacttacaaagtcaaggtgacacaacccaagggctctgttgtcaaggtgtcacctgagacattggcatttggctataagaatgagaagcagagctactctgttactgtaaagtacacaagaaacaagaaagaaaacatctcatttggggacattgtttgggtcgaagatggtggtgcacgcacg

SEQ ID NO: 1153 - DNA, 909 bp, Glycine Max
atggacacagctcaatggccacaggagatggtggtgaaaccaatagaagatatagtggtgacaaatacatgtccaaaggctgtggaaagtaagccaaggccacagaaggaacaagcaattaactgtccaaggtgtcattcaattaacaccaagttctgctactacaacaactacagcctcacacagcctaggtatttctgcaagacttgtagaaggtattggactgaaggtggaactctcagaaacatccctgtaggaggtggctctaggaagaacaagagatcttcagcttcttgttccacacctaataatagtcacaataacaataattcaaccaataagaagcttctttctgatctggtcatcacacctccaactctgtcacacactcaaaaccctaatagcaataatgctattcatcaaggccaagatctcaatttggcttttccatcctccaccccagatttcagaaaaatctctgaattggtccaacaaaacaacaacaacaacaatagtagcaacaacagcatgtcagcttcagcttcttcttcttcaaccacaactacaacttccacttctcacctttctgcattggagcttcttactgggatcacttcaagttccagtgctggtttgacttctttcatgcctgtgccggttccatctgatccaaattctatctacacatgtgggtttcctctgcaagatttcaagccaaccttgaatttctctttggatgggatcggaaacgggtacacaagccttcagaatgttcaaagtgggaggctcttgtttccatctgatgacttaagacaggtttctagctccaccatcaccacaatggatcagaaacaacaaggagattcaactgggtattggactggaatgttaggcggaggatcatggtaa

SEQ ID NO: 1154 - DNA, 981 bp, Glycine Max
atggaccaagctcttgtggacgacataatcaaccgccttctcgaagttcgcggccgcccgggcaagcaggtgcaactgtcggagtcggagatccgccagctctgtgccgcttccagagagattttcctgcagcaacctaatttgttggagcttgaagcacccattaagatttgcggtgatgtacatggtcaatattctgatcttttaaggctttttgagtatggcggactacctcctgaggccaactacttatttttgggggattatgtggatcgagggaagcagagtttggaaacaatatgccttctcctagcatataaaataaaatatcccgagaattttttccttttgaggggtaaccatgaatgtgcttctattaaccgtatatatggattttatgatgagtgtaaacgaaggttcaatgtaaggttatggaagacatttacagaatgcttcaattgccttcctgtggcagcactgattgatgaaaagattttgtgcatgcatgggggtctttctcctgacttgcttaatttggatcagattagaaatctacaacggcccactgatgtgcctgatacaggtttgctttgtgatctcctctggtcagacccaagcaaagaggtccaaggttggggaatgaatgacaggggagtttcatatacatttggtgctgataaggtctcagagtttcttcaaaaacatgatttggatcttatttgtcgtgctcatcaggtggtggaagatgggtatgagttctttgctaaccggcagcttgtaacaatattttcagcacctaattattgtggagagtttgacaatgctggcgctatgatgagtgtcgatgagacactaatgtgctctttccaaatattaaagccagctgataaaaaagtaaagctcaacttcggaagtactactactactaagccaggaaactctccagcaggcgtaaagtccttcctgggtacaaaagtatga

SEQ ID NO: 1155 - DNA, 249 bp, Glycine Max
atggacgagctgttatcctgccaccatattgattcattgttggctcgtctggcttcagctaatgctcgccatccaccatacttcgactccaatattccaacccacaattctgagttctactgcagcatgttccatctccacttccctagcaatgccttgttgaatatcctgatttcttttattcccaagccacccttttcctttggtagacagattgtctcccatttgacccacgcaactttcttttga

SEQ ID NO: 1156 - DNA, 429 bp, Glycine Max
atggacttgaccctttccccttcttcttcttcttcttctttagtaatctcgagaccttcttactcttcatcctcttccaccttgtccttcttggccaccaactcaattctctctaggaaagctagaatcagcaccagaagaagcaaggctctaacttgcaacgcattgttcggattgggcgttcccgaactcgtcgttattgctggagttgctgtcctcgctttcggacctaagaatttcccccaagtgggtcgctccatcggcaaaaccattaagagcttccaacaggcagcaaaggagtttgagtccgagattaaaaaggaacctgattccacagaagagaaccctgctgctgcagagaaatcaattgctgtgagtgaacaggaggagcaagagactaaggtgtctggtactaaagatagtgtatga

SEQ ID NO: 1157 - DNA, 864 bp, Glycine Max
atggacttgaccctttccccttcttcttcttcttcttctttagtaatctcgagaccttcttactcttcatcctcttccaccttgtccttcttggccaccaactcaattctctctaggaaagctagaatcagcaccagaagaagcaaggctctaacttgcaacgcattgttcggattgggcgttcccgaactcgtcgttattgctggagttgctgtcctcgctttcggacctaagaatttcccccaagtgggtcgctccatcggcaaaaccattaagagcttccaacaggcagcaaaggagtttgagtccgagattaaaaaggaacctgattccacagaagagaaccctgctgctgcagagaaatcaattgctgtgagtgaacaggaggagcaagagactaaggtgtctggtagttcaaggaactttgccaaaagcgatgcaaaatatcagtggagtgacaccattcaaatcattgatatagggagaaactgcggttgtggaaaagatttaaggttaatgactcccaagttcaatcatgttgtgggcttcattgaagaatccgaggatataagtactttatcagtcaacgaactgcagagcactttacttgggcatgaacaactcataagttacaatgctgaagaaaaacatgctttgaagtatttttcagattttgatgagacgtccatagattcagtaaagttcgacaataactccaatatatggtggtatgggtacttgggctttaaagtcttgaaccacattgcagcagagataaacggtgaatggtttgccattgctgaaatctccctcagctatgcaaggattgtcttatggggaagcaacaaagatatccatttctga

SEQ ID NO: 1158 - DNA, 2190 bp, Glycine Max
atggagaatggtcacgatgggaaattggccgataaattctcgggcttgaatatcaaccagcacgctcaacaacacgtgcatgatcaatctaacctctcttctaacaacaatgataacttgtatcaggtcatgaaggctgttgaagctgccgaggccactattaagcaacaggtagaagagaatagccggcttaggtctgaacttctgagcaaaattcaggaactggaaaaatatgtaagttctgtattctgtgatggcatctgcttgatttatcacatattattattggacaatcttggactacttatatttagatatgaggataggaccataaggatggtacccggattgtatatgtcttcccaatccctcaactatccctcccccataccttcgcatagcgaagagcctctgggcaatgggttgcctatggataatactggctactctcagttgtcttctccatctacaaggtcagtctctccaagcaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaaggttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtggtgtggcaacaagtgttgatgctgatgatttggggagattttcacctcttgcaagcaggtattcatcagcccctgatgcatccacccacctggtagttactcagggtgataaccatcctgctcattatggagatgaaatgaccaacaaacaggtcacatttcgtgaccccatgatcaacaatgaagttgatgaccctgatggagatggaacccatagtacgagagaaacatctactaattggagttctggcaaccctccttatacaaccactgttgatgatcccagttcttcatattctccttatttaccaccagttcttgaagaaccttcttcttcattttctgaggatgaagatccattgccggctatagagggtcttcaaatttcaggagaagcctttcctggaagggaacttcaagcatgtggatactccatcaatggcactactagttgtaattttgagtggattcgacatttggaagatggttcctttaattatattgatggggcaaagcaaccaacctaccttgtcaacgccgatgatgttggtacattacttgccattgaagtccaacctctggataacaggaagcgcaagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgttatgattccatatggacatacttcagagtttattataattggttccagtggtgatgaacaccttttaaagacagatttcagtggtgctagagacactattgtgctcactttgagattattcatcctgaggaggcctggggagaaaagaagagtaaagaagaagggattattcttttaa

SEQ ID NO: 1159 - DNA, 2253 bp, Glycine Max
atggagaatggtcacgatgggaaattggccgataaattctcgggcttgaatatcaaccagcacgctcaacaacacgtgcatgatcaatctaacctctcttctaacaacaatgataacttgtatcaggtcatgaaggctgttgaagctgccgaggccactattaagcaacaggtagaagagaatagccggcttaggtctgaacttctgagcaaaattcaggaactggaaaaatatgtaagttctgtattctgtgatggcatctgcttgatttatcacatattattattggacaatcttggactacttatatttagatatgaggataggaccataaggatggtacccggattgtatatgtcttcccaatccctcaactatccctcccccataccttcgcatagcgaagagcctctgggcaatgggttgcctatggataatactggctactctcagttgtcttctccatctacaaggtcagtctctccaagcaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaaggttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtggtgtggcaacaagtgttgatgctgatgatttggggagattttcacctcttgcaagcaggtattcatcagcccctgatgcatccacccacctggtagttactcagggtgataaccatcctgctcattatggagatgaaatgaccaacaaacaggtcacatttcgtgaccccatgatcaacaatgaagttgatgaccctgatggagatggaacccatagtacgagagaaacatctactaattggagttctggcaaccctccttatacaaccactgttgatgatcccagttcttcatattctccttatttaccaccagttcttgaagaaccttcttcttcattttctgaggatgaagatccattgccggctatagagggtcttcaaatttcaggagaagcctttcctggaagggaacttcaagcatgtggatactccatcaatggcactactagttgtaattttgagtggattcgacatttggaagatggttcctttaattatattgatggggcaaagcaaccaacctaccttgtcaacgccgatgatgttggtacattacttgccattgaagtccaacctctggataacaggaagcgcaagggagaacctgtgaaggtttttgccaatgataataaaaagattgcttgtgatcctgaaatgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgttatgattccatatggacatacttcagagtttattataattggttccagtggtgatgaacaccttttaaagacagatttcagtggtgctagagacactattgtgctcactttgagattattcatcctgaggaggcctggggagaaaagaagagtaaagaagaagggattattcttttaa

SEQ ID NO: 1160 - DNA, 2259 bp, Glycine Max
atggagaatggtcacgatgggaaattggccgataaattctcgggcttgaatatcaaccagcacgctcaacaacacgtgcatgatcaatctaacctctcttctaacaacaatgataacttgtatcaggtcatgaaggctgttgaagctgccgaggccactattaagcaacaggtagaagagaatagccggcttaggtctgaacttctgagcaaaattcaggaactggaaaaatatgtaagttctgtattctgtgatggcatctgcttgatttatcacatattattattggacaatcttggactacttatatttagatatgaggataggaccataaggatggtacccggattgtatatgtcttcccaatccctcaactatccctcccccataccttcgcatagcgaagagcctctgggcaatgggttgcctatggataatactggctactctcagttgtcttctccatctacaaggtcagtctctccaagcaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaaggttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtggtgtggcaacaagtgttgatgctgatgatttggggagattttcacctcttgcaagcaggtattcatcagcccctgatgcatccacccacctggtagttactcagggtgataaccatcctgctcattatggagatgaaatgaccaacaaacaggtcacatttcgtgaccccatgatcaacaatgaagttgatgaccctgatggagatggaacccatagtacgagagaaacatctactaattggagttctggcaaccctccttatacaaccactgttgatgatcccagttcttcatattctccttatttaccaccagttcttgaagaaccttcttcttcattttctgaggctgcagatgaagatccattgccggctatagagggtcttcaaatttcaggagaagcctttcctggaagggaacttcaagcatgtggatactccatcaatggcactactagttgtaattttgagtggattcgacatttggaagatggttcctttaattatattgatggggcaaagcaaccaacctaccttgtcaacgccgatgatgttggtacattacttgccattgaagtccaacctctggataacaggaagcgcaagggagaacctgtgaaggtttttgccaatgataataaaaagattgcttgtgatcctgaaatgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgttatgattccatatggacatacttcagagtttattataattggttccagtggtgatgaacaccttttaaagacagatttcagtggtgctagagacactattgtgctcactttgagattattcatcctgaggaggcctggggagaaaagaagagtaaagaagaagggattattcttttaa

SEQ ID NO: 1161 - DNA, 1302 bp, Glycine Max
atggagacagcctcagactatggagcattcatggagaaattcactttaccaccaaattctgcaccctctcttcctcttaattcactcacctttgcagtcaaagagatttttgacgtggaaggatatgtgaccggtttcggtaatcctgactgggcaaggactcatacagtggctacctctactgctccaacagttttggctctcctcagagcaggtgccacttgtgttggtaaaactgtcatggatgaaatggcttacagtataaatggagagaatatacattatggaacacctagaaatccttgtgcacctgaccgggttcctggaggatcttctagtggctctgctgttgcagttggtgctgagcttgtggacttctcattaggaaccgatactggaggaagtgtaagagtgcctgcatcatactgtgggatttttggttttcgcccttctcatggtgctatctcagaatcaggagttatccctatgtcgcaaagttttgacaccgtgggatggtttgccagggatccaatgattttgagcagagtaggaggtgtaattctacaattgccagatgtagcaccaccaattagacctacttgcattatcattgcagaggactgtttccagctttcgagcactccatttgatgtagttacaggaactgtcatccaagcggtagagaagttatatggaggggatgtattgaagcatgaaatccttggagactatgtgaagaccaatgttccaagtttgaaacatttcatgagtaaagagaatacagaccaaatatatagcattccatcactggctgcactttcaagtgccatgcggttgcttcaaaggtatgaattcaagaataatcatggtgaatggatcagtgcagttaaaccagatttaggtcctggaatatcagaacgtgtatcagatgccttaaggacaacaggggagaacattgatatctgttattctataaaaaaggaactacacgatgctcttgcggctcttcttggggattttggagctctcatgatccccacagttccagggcctcccccaaaactacaaacaaatacatctgacttggaaatttttcgtgcaagggcttttagcctgctgtccattgctggagtttctggattttgtcaggtaagcataccactagggatgtataataaccttcccctatcaatttctctggtggccagacatggtgcagatagatttttacttcaccttgttgagagtctttatgacagcattaaagatagaaagcagcatatcacagagcacaaactttaa

SEQ ID NO: 1162 - DNA, 1176 bp, Glycine Max
atggagacagcctcagactatggagcattcatggagaaattcactttaccaccaaattctgcaccctctcttcctcttaattcactcacctttgcagtcaaagagatttttgacgtggaaggatatgtgaccggtttcggtaatcctgactgggcaaggactcatacagtggctacctctactgctccaacagttttggctctcctcagagcaggtgccacttgtgttggtaaaactgtcatggatgaaatggcttacagtataaatggagagaatatacattatggaacacctagaaatccttgtgcacctgaccgggttcctggaggatcttctagtggctctgctgttgcagttggtgctgagcttgtggacttctcattaggaaccgatactggaggaagtgtaagagtgcctgcatcatactgtgggatttttggttttcgcccttctcatggtgctatctcagaatcaggagttatccctatgtcgcaaagttttgacaccgtgggatggtttgccagggatccaatgattttgagcagagtaggaggtgtaattctacaattgccagatgtagcaccaccaattagacctacttgcattatcattgcagaggactgtttccagctttcgagcactccatttgatgtagttacaggaactgtcatccaagcggtagagaagttatatggaggggatgtattgaagcatgaaatccttggagactatgtgaagaccaatgttccaagtttgaaacatttcatgagtaaagagaatacagaccaaatatatagcattccatcactggctgcactttcaagtgccatgcggttgcttcaaaggtatgaattcaagaataatcatggtgaatggatcagtgcagttaaaccagatttaggtcctggaatatcagaacgtgtatcagatgccttaaggacaacaggggagaacattgatatctgttattctataaaaaaggaactacacgatgctcttgcggctcttcttggggattttggagctctcatgatccccacagttccagggcctcccccaaaactacaaacaaatacatctgacttggaaatttttcgtgcaagggcttttagcctgctgtccattgctggagtttctggattttgtcaggttgtccctttctttgtgtttttatga

SEQ ID NO: 1163 - DNA, 1293 bp, Glycine Max
atggagaccaacaacaacctcaacctcatcgtccctaatcctcaagattcactgtggatgatgaatttgaggactggggaaacaatggattctggatcttatccggagcgtccaggggagccagattgctcatattacatcagaacaggcctttgtagatttggtgcaacatgtcgatttaatcatcctcctaacaggaggctggctattgccactgcaaggatgataggcgagttcccagaaagaatagggcaaccagaatgccagtactatctgaagacaggaacgtgcaaatttggagccacatgcaaatttcatcatcctaaagatcaggctgggattgctggaagagttgccttaaatattttaggctatcctctccgccctaatgagcctgaatgcacttattatttgagaacaggacaatgcaaatttgggaacacttgcaaattccaccatcctcaaccaagtaatatgatgctctcattacggggttctcctgtttaccctaccgtccattctccaactacgccaggtcaggagtcatatgctggaggaattacaaattggtcaagaggatcatacattcctagtcctcgctggcaaggtccttcaagttatgggcccttaattctacctcagggagtggtttcagtgccagggtggagtgcatacagtggtcaaatgggatcaatctctacttcagacagtccacagcaagcaatgagaaatggtcaaacatatgaaacttctcatcaaggtgagctagcaaatgcaggatcacaaggggcatattctcaattccgttctggcactgttccagtagggttttatacactgcagagggagaacatatttcctgagagacctggtcaacctgaatgccaattctacgtgaagacaggagattgtaagtttggagcagtctgtcagttccaccacccgcgagagaggctaattcctgctcctgactgtgtcttgagtcccataggccttcctttacgtcttggagaacctttgtgtgtcttctattctcgttatggcatatgcaaatttggcccaagttgcaagtttgaccacccaatggaaattttctcttacaatatcaccacatcaccttcagctgatgccccaagcaggcatttgttaggatcttcatctggaactgctgcattgaatttatcttccgaaggacttgttgagtcaagctcagcaaagcccaggccgctttcattatcagagataagacagattccttctggtgatgataacattgatgatgatgtagcttga

SEQ ID NO: 1164 - DNA, 516 bp, Glycine Max
atggagacgccaaccacgaatccaacgacggcggcggtgtcgtctccgtcttcgggaagcaacaatagcgggagcactactactccgagccgctacgagaaccaaaagcgaagggactggaacaccttctgccagtacttgaggaaccaccgtcccccactctccttgtccctttgcagcggcgcgcacgtgctggaattcctccactacctcgaccagttcgggaagactaaggttcacaaccacccatgcccgttcttcggtctccccaacccacctgccccgtgtccctgcccgctccgacaggcctggggcagcctcgacgccctcatcggccgcctccgcgcggcctacgaggagaacggcggccgcccggagaccaatccattcggcgcacgcgccgtcaggacttacctgcgcgatgttcgcgattttcaggcaaaggcgagaggtgttagctatgagaagaagaggaagaggccaaagcccaaggtcactcatcccactcctacttaa

SEQ ID NO: 1165 - DNA, 687 bp, Glycine Max
atggagagggagtccttgataactgaagctcctaatgcaccggttactgcacagagaagggtcagaagtgacttggaaaattctctaccaaaaccatttcatgagttctctccctttatgctgctaaggtccctcatcatttatcagtgtaagttactcctgataagggtcacccaaatggaacaacaggcccaaaggcaccacaacttatctgctctccagcaacattgtgctttttttgatcaagatcacaatggaatcatttacccttgggaaacttacatggggctgcgtgctattggatttaatgtcgttgcatctgttattttagctgttgttatcaatgctggattgagttatcccactcagcctagttggtttccttctctcctttttcctgtgtacatgcacaacatacccaaagcaaagcatgggagtgaatcaggagtttatgacacagaaggacgttatgtgccagcaaatattgagaacgtgttcagtaagtatgctcgtacagttcctgacaagctcacacatggggaggtctgggacatgacagagggaaaccgaaatgcgcttgcagctaaacttgaatggggggttctgtacattctggctagggatgaggaaggtttcctctctaaagaagctgttagaagatgctttgatgggagcttatttgattaa

SEQ ID NO: 1166 - DNA, 1146 bp, Glycine Max
atggagatcaaagaggcggcatgggaatatggaaaccaaaaatgcccgggcccaaatggattgaattggaaattcatcaaacaatttgggaacttgcttaaggatgatgtaaagagattcctagatgagttccaccaaaatggagtattaccaagaggtacaaactcttcatttatcacttttattcccaagattgatgatcctttagagctgtgtgattttaagcctatatcacttgtgggcccatcgagtgaatttgggatgcaacaagggcttagacaaggtgatcccttggctcatttcctatatgttgttgttgcagagaggctaagtggcttgatgagggaagcagtttcaaaaaatctatttgctagctatcttgtaggcaaaaacaaggtatttgggatgcttggtgttgagagaagtgaaggagtcaagtttgctagagtgctcaattgtaatctcctcgctttgccttttacatacttggggattccaataggagcaaatcctagaagggtggaaacatggaaatcagtcatagacaagtttaggaagaagttggcgccatggaaatataaaactttgtcctttgtcaggaggatttgcttgatcaatttggacttgttttgggtgaaggtgattgattcaaaatataagggttggaggggtcttgtgaagggtgagggagatcaagcacgtttttggcttgataattgggggagtgaggagtgctttgcaagcaagttccaaaggttgtttggcttatctctacaacaatttgaggtagtaaaaaaggttggggaatggagaaaagatagggggattaaggataattgggtgtgggtagaggatggctctggaatctttaatgttaaatcagcatataggaccattcatgatgatatggtcgggtcacaaatctcaccaccgatgaaaagcgtctggagtctaaagttgaggaatcggcaaatcatggtttcttctcatgtcacaagattgcacctatttggaatacttgttattcatggctacacttgcagacagtcttgccaagctctcctaagatacattattggcagcattgtcatcacttacagagacaaattgaaaaggagatccaagccgtggtatggacatcggtaa

SEQ ID NO: 1167 - DNA, 645 bp, Glycine Max
atggagcaggaagagcacgaggtgtacggtgcagacattcccgacgaggagattgacatggacgcagacgccgaacagcaagacgagcaacttgcccccaatcacacaaacaaggaactggaggacatgaagaagaggctgaaggagatcgaggaggaagctagcgccctacgcgaaatgcaggcaaaggttgagaaagagatgggcgctgttcaagattcgtctggcacttctgcgactcaagttgaaaaggaggaagtggatgctcgatcaatctatgttggtaatgttgactatgcatgtacgcctgaagaagtccagcagcattttcagtcctgtggaactgtgaacagggtgacaatactgacagacaaatttggtcaaccaaaagggtttgcttatgtagagtttgttgagattgatgctgtgcagaatgctctcctgttaaatgaatcagaattacatggtcgacaactgaaggtgtctgccaagcgtacaaatgttcctggaatgaagcagtattttggaagaagacctgctggtttccgatctaggaggcctttcatgcctgctccattctttccaccatatggatatggaagggttccaaggtatagaagacccactcgatacaggccatactag

SEQ ID NO: 1168 - DNA, 1806 bp, Glycine Max
atggagcagtatgaaatacttgagcaaattggaaaaggtgcttttggttcagcgcttctagtgagacataagcatgaaaagaaaaaatatgtgttgaagaagattcgccttgctcgtcaaactgagcgctctcgtagatctgcacacctggagatggagcttatctctaaattaagaaacccattcattgtggagtacaaagattcatgggtagaaaagaaactttgtaagtggctcgttcaacttcttatggctcttgactacttgcacatgaaccacattcttcaccgtgatgtcaagtgttcaaatatcttcctaacaaaagatcatgacatacgtctcggtgattttggacttgccaaaatgttgacttcggatgatcttgcttcctctgttgtgggaactcctagctacatgtgccctgagctccttgctgatataccttatggttctaaatcagatatttggtccttgggatgttgtatatatgaaatgacagcgcataagcctgcattcaaagcatttgatatacaggcattgattaacaagattaataagtccatagtggctccactgccaacaaaatattctagctcgtttcgaggtcttgttaaaagtatgctgcggaaaaatccagagctgaggcccagagcttcagagctgcttgggcacccacatcttcaaccttatgttcttaaggtccatctcaaaattaacagccccagacgaagcacattgccagttcactggccagaatccaactacatgaagaaaactagatttttggtgccagaagatgatcctgtttccatctatagggataagcgacattctttcaccaatgatcggactctaaatcctagtgtatctggagctgatcaagattctgtatgttctactctggagatagattgtactcctgaccatttgaatcaaaggttagcagaactacgtattggagatagccatcaagtgaagtcaatccagaagcctgttgtttccagaacttctagcattgttaagactccaaaattcgcttcctcaaaggtctcagccaccaacaagaaatcaatgaaatcctcaaagaattgtaagacgcttcctctttcacaaaataccacaaaatctgctaatactaatcgcagagcatcattcccactgccaacaaggggtggtaatcggcagcctccttgcaggtccgtcagtttgcttagtcacgtgtcttcaccagatatctcagtcaattctccacggattgataagatggctgaattcccattaacttcatatgaagattctttgttccctatcaataaaacatcatcctctgcacgaggttcctcaggcttcccatctcatagcaaccattcaactgtgatagacaaatgcacggtagaggtatatggtagagcctctaacaagcctggtagtatggatgcgtggcagggaatcaagcagagcgtgttaaaggagattgatgaggataaaagtggttcctcagatcaaaatgcaactgcaggtgcttcaagccacacctcttctgacttgcgccgtcgacaatttgacccgtcatcattccaacaaagagctgaagctttagaaggcttgcttgaatttagtgcaagattgctacagcaggcaaggtatgatgaacttggggttctgttgaaaccatttgggcctggaaaggtttcccctagggaaactgctatttggttgagtaagagcttcaaagagaacactttcaacccagaagaatccatgaaagttaaactgatgcaaaacagtgccaggttttggccttga

SEQ ID NO: 1169 - DNA, 1860 bp, Glycine Max
atggagcagtatgaaatacttgagcaaattggaaaaggtgcttttggttcagcgcttctagtgagacataagcatgaaaagaaaaaatatgtgttgaagaagattcgccttgctcgtcaaactgagcgctctcgtagatctgcacacctggagatggagcttatctctaaattaagaaacccattcattgtggagtacaaagattcatgggtagaaaagggttgttatgtctgcatcattataggttattgtgagggaggagatatggcggaagctataaagaaagctaatggtgtcctgtttcctgaggagaaactttgtaagtggctcgttcaacttcttatggctcttgactacttgcacatgaaccacattcttcaccgtgatgtcaagtgttcaaatatcttcctaacaaaagatcatgacatacgtctcggtgattttggacttgccaaaatgttgacttcggatgatcttgcttcctctgttgtgggaactcctagctacatgtgccctgagctccttgctgatataccttatggttctaaatcagatatttggtccttgggatgttgtatatatgaaatgacagcgcataagcctgcattcaaagcatttgatatacaggcattgattaacaagattaataagtccatagtggctccactgccaacaaaatattctagctcgtttcgaggtcttgttaaaagtatgctgcggaaaaatccagagctgaggcccagagcttcagagctgcttgggcacccacatcttcaaccttatgttcttaaggtccatctcaaaattaacagccccagacgaagcacattgccagttcactggccagaatccaactacatgaagaaaactagatttttggtgccagaagatgatcctgtttccatctatagggataagcgacattctttcaccaatgatcggactctaaatcctagtgtatctggagctgatcaagattctgtatgttctactctggagatagattgtactcctgaccatttgaatcaaaggttagcagaactacgtattggagatagccatcaagtgaagtcaatccagaagcctgttgtttccagaacttctagcattgttaagactccaaaattcgcttcctcaaaggtctcagccaccaacaagaaatcaatgaaatcctcaaagaattgtaagacgcttcctctttcacaaaataccacaaaatctgctaatactaatcgcagagcatcattcccactgccaacaaggggtggtaatcggcagcctccttgcaggtccgtcagtttgcttagtcacgtgtcttcaccagatatctcagtcaattctccacggattgataagatggctgaattcccattaacttcatatgaagattctttgttccctatcaataaaacatcatcctctgcacgaggttcctcaggcttcccatctcatagcaaccattcaactgtgatagacaaatgcacggtagaggtatatggtagagcctctaacaagcctggtagtatggatgcgtggcagggaatcaagcagagcgtgttaaaggagattgatgaggataaaagtggttcctcagatcaaaatgcaactgcaggtgcttcaagccacacctcttctgacttgcgccgtcgacaatttgacccgtcatcattccaacaaagagctgaagctttagaaggcttgcttgaatttagtgcaagattgctacagcaggcaaggtatgatgaacttggggttctgttgaaaccatttgggcctggaaaggtttcccctagggaaactgctatttggttgagtaagagcttcaaagagaacactttcaacccagaagaatccatgtaa

SEQ ID NO: 1170 - DNA, 972 bp, Glycine Max
atggagccacagtgtagaatcaagaaggatgccactgaattgatagggaataccccaatggtatatctgaacaacattgtggatgggtgtgtagcccgtattgctgctaaattggagtacatgcaagcgtgctgtagtgtcaaagataggattgctttgagcatgattgaagatgctgagaaaaaaggccttattacacctggaaagactgttctggttgagtatacaagtggtaacaccggcataggattggcattcatagcagcattgaggggttataaacttcaggtgactatgccgtcttacgtgagtcttgagagaaaaattatactgcgagcctttggagctgaggtatatcttacagaccctgccaaaggaattgatggggttattcagaaggcagaagaactaatagccaagacgcctgatagttttatgctcaaccaatttgaaaatcctgcaaatccaaatattcattacgagacaacgggccctgagatttggagggactcgggagagaaaattgatgctttggtttcaggaataggaactggggggtcaatagcaggagctggaagattcctcagggagaaaaacccggatattaagctgtatggtgtggagccagctgaaagtccagttttgaatggaggacagccaggtaagcacctgattcaaggaattggtgctggtatcattcccaaagttctggatgtaaatctcctagatgaagttattcaggtttcaagtgaagaggctatagaaactgctaagctgcttgccttgaaagaaggtttgctgatgggaatttcatcaggagctgctgcagcagcggcaataaaggtggggaagagaccagaaaatgcaggaaagctcattgttgtgattttccccagttttggagaacgttacttatcttcaccactgtttgaatccattaggaaagaagctgaacaaatgacatttgactaa

SEQ ID NO: 1171 - DNA, 972 bp, Glycine Max; identical to SEQ ID NO: 1170

SEQ ID NO: 1172 - DNA, 942 bp, Glycine Max
atggagccacagtgtagaatcaagaaggatgccactgaattgatagggaataccccaatggtatatctgaacaacattgtggatgggtgtgtagcccgtattgctgctaaattggagtacatgcaagcgtgctgtagtgtcaaagataggattgctttgagcatgattgaagatgctgagaaaaaaggccttattacacctggaaagactgttctggttgagtatacaagtggtaacaccggcataggattggcattcatagcagcattgaggggttataaacttcaggtgactatgccgtcttacgtgagtcttgagagaaaaattatactgcgagcctttggagctgaggtatatcttacagaccctgccaaaggaattgatggggttattcagaaggcagaagaactaatagccaagacgcctgatagttttatgctcaaccaatttgaaaatcctgcaaatccaaatattcattacgagacaacgggccctgagatttggagggactcgggagagaaaattgatgctttggtttcaggaataggaactggggggtcaatagcaggagctggaagattcctcagggagaaaaacccggatattaagctgtatggtgtggagccagctgaaagtccagttttgaatggaggacagccaggtaagcacctgattcaaggaattggtgctggtatcattcccaaagttctggatgtaaatctcctagatgaagttattcaggtttcaagtgaagaggctatagaaactgctaagctgcttgccttgaaagaaggtttgctgtctttatcagatgggaatttcatcaggagctgctgcagcagcggcaataaaggtggggaagagaccagaaaatgcaggaaagctcattgttgtgattttccccagttttggagaacgttacttatcttcaccactgtttga

SEQ ID NO: 1173 - DNA, 888 bp, Glycine Max
atggagccacagtgtgcaatcaagaaagatgtcactgaattaataggtaataccccaatggtatacctgaacaacatagtggagggatgtgtggcccgcattgctgctaagttagagtccatgcaaccctgcttcagtatcaaagataggacagcatttagcatgatcaaagatgctgaggataaaggcctcattacaccgggaaagagtgttcttgttgaggcaacaagtggcaacacgggcattggaatggcattcgtagcaacattaaaggggtataaagttatagtggctatgccagcttctgtgagtcttgagagaaaaattgtacttggagccttcggagctgaggtctatctcaccgaccctaccaaaggaaccaatgcagttcttaggaaggccgaggagatagtgaataacacgcccgggagttatatgctccgccagattgataatcctgctaatccaaaaattcattacgagaccactgggcctgagatttggagagactcgggagggaaagttgatgctttggttgcaggggtaggaacagggggtaccataacgggtgctggcagattcctcaaggagagaaaccccaatgtcaagctgtacggcgtagaaccagttgaaagtgcagtcctcagtggaggaccgccaggtgatcaccaaatccaaggaattggtaatggtctcattccaagtgtactggatgttaatctactagatgaagttattcagatttcaagtgaagaagctatagaaactgctaggcttcttgctttaaaagaagatgggaatttcatcaggagccgcagctgcagctgccataaaattggggaaaaaaccagaaaatgctggaaaactaatcgttgtggtatttcctag

SEQ ID NO: 1174 - DNA, 1632 bp, Glycine Max
atggagccaccgaatcagaagtcttttgagagagtggtttcccagaaagccttgcaaatgggaaactcatttccttgccaaatttgtgtggtgggatttctctgcggtgtatgccttacctctctgttcttggctgctctcacatcctttggctcctttcagtttggtcccattttgttttcaaccatcggagctcttccctcccaaccatacatggttacacgttcggactgccactttaagtttaaggaaactgagagattaggggattctaagagcagcagagagcgaaataacgatgagagagtctcattgctttattcagcttggagttctgtgttgaatgaacctacaagtggtggtaaagagcacttgcagaaacatggaattagtgggtccagtttgcctaatgccccacatttggaaaactgcaaggtgaaaacgcatctatatgattatcttgataagcgtaaaggatatgagattgcagggtccgatgaagaaaactatcccttgactagaaaagttcagcgtgacatatggatgcatcagcatcctttgaactgcagcagcccggatgtcaagttccttgttactgactgggagagattacctggatttggaattggggctcagattgctggcatgtgtggacttcttggtattgcaatcaacgaaggaagagtccttgtcactaactattacaacagagctgaccatgggagttgcaaagggtcttcccggtctagttggagttgttacttctttcctgaaacctccctagaatgtcggcaacgtgcatttgaactcatgaaaagtgaagaagcgtggagtaagggaattgtgaccacaaaagaaaattatacaacaaagcatatatgggctggacctactccaaggaaatgggggcttccatggaattatttgcaacctacaactgatataaatgggactctgttagcttctcatagaaaaatggatagacggtggtggagagcacaggcagtacgctacttaatgaggttcccaaccgaatacacatgcaatttaatgaacgaggcccgccacgctagctttggaaaattagctgcaaaaatggtccttgaaagtcttgctggggattggccaaaggaaagtagtgccaggccaaggcctgatgatattgatgaatacgtgtggtccaatcacaagccatgggtccctaggcctcttctgtgtatgcatgtaaggatgggagacaaagcatgtgaaatgaaggtagttggatttgaagaatacatgcagcttgcggataggactcggagacacttccctcaccttaataacatttggctgtcaaccgagatgcaggaagtcattgacaagaccagagaatattctcattggaacttttactatacaaaggtaagacggcaagctaggattaacatgtcaatggctgtctacgaagccagtctgggtagggagaccagcacaaattatccactggttaatttcttgatggctgctgactcagatttttacgttggggcattgggttcttcctggtcctttcttatagatggaatgagaaatactgggggaaaggtaatggctgggtacttgagtgtcaataaagacagattttggtag

SEQ ID NO: 1175 - DNA, 1773 bp, Glycine Max
atggagccaccgaatcagaagtcttttgagagagtggtttcccagaaagccttgcaaatgggaaactcatttccttgccaaatttgtgtggtgggatttctctgcggtgtatgccttacctctctgttcttggctgctctcacatcctttggctcctttcagtttggtcccattttgttttcaaccatgtcaatggctaattcatcagggtattctacttttcctaacgatatcaacatggttacacgttcggactgccactttaagtttaaggaaactgagagattaggggattctaagagcagcagagagcgaaataacgatgagagagtctcattgctttattcagcttggagttctgtgttgaatgaacctacaagtggtggtaaagagcacttgcagaaacatggaattagtgggtccagtttgcctaatgccccacatttggaaaactgcaaggtgaaaacgcatctatatgattatcttgataagcgtaaaggatatgaggttttcccgccatggacaacttggaagggatctttgcagacattccctgtggcggcattcaatgagcagattcaaaatcttaggcacgaggctgtatctgagggggcttatccaccatgggtgtggtccgatgaagaaaactatcccttgactagaaaagttcagcgtgacatatggatgcatcagcatcctttgaactgcagcagcccggatgtcaagttccttgttactgactgggagagattacctggatttggaattggggctcagattgctggcatgtgtggacttcttggtattgcaatcaacgaaggaagagtccttgtcactaactattacaacagagctgaccatgggagttgcaaagggtcttcccggtctagttggagttgttacttctttcctgaaacctccctagaatgtcggcaacgtgcatttgaactcatgaaaagtgaagaagcgtggagtaagggaattgtgaccacaaaagaaaattatacaacaaagcatatatgggctggacctactccaaggaaatgggggcttccatggaattatttgcaacctacaactgatataaatgggactctgttagcttctcatagaaaaatggatagacggtggtggagagcacaggcagtacgctacttaatgaggttcccaaccgaatacacatgcaatttaatgaacgaggcccgccacgctagctttggaaaattagctgcaaaaatggtccttgaaagtcttgctggggattggccaaaggaaagtagtgccaggccaaggcctgatgatattgatgaatacgtgtggtccaatcacaagccatgggtccctaggcctcttctgtgtatgcatgtaaggatgggagacaaagcatgtgaaatgaaggtagttggatttgaagaatacatgcagcttgcggataggactcggagacacttccctcaccttaataacatttggctgtcaaccgagatgcaggaagtcattgacaagaccagagaatattctcattggaacttttactatacaaaggtaagacggcaagctaggattaacatgtcaatggctgtctacgaagccagtctgggtagggagaccagcacaaattatccactggttaatttcttgatggctgctgactcagatttttacgttggggcattgggttcttcctggtcctttcttatagatggaatgagaaatactgggggaaaggtaatggctgggtacttgagtgtcaataaagacagattttggtag

SEQ ID NO: 1176 - DNA, 1305 bp, Glycine Max
atggagcgtttagagaacgtgatttcagacacaatcctctacgatccctccaacatagggttaggttccttggtggacactctcctctccgacttggaccaaaccatgtcgttaccctcacactaccatctctcatcagaccttcccgatttcgccaccaccgtggaagaacactccgggatacgactcattcacacgctgatgacgtgtgcggattccctgcaacgtggccacttctcattcgctgcctccctcatccagaacatgcaaggcttgttggcgcacgtcaacaccaactgcggcatcggaaaagtcgccgcctgcttcatcgacgccttgcgccgccgcatctccaacaagtttccagcatcatccgcttacgagaacgacgttctctaccacaactactacgaggcgtgtccttacttgaagttcgcgcacttcaccgcgaaccaggcgatcttggaggccttcaacggccacgattgcgtccacgtcatcgacttcaacctcatgcaggggctccagtggccagcgctgatacaggcgctggcgctccggcccggaggaccgccgctgctgaggctcaccggcatcgggcccccctcggcggaaaaccgcgacaacctccgcgaaatcgggctgagactcgccgagctggcgcgctccgtgaacgtgcggtttgcgttccgcggcgtggcggcgtggcggctggaggacgtgaagccgtggatgttacaggtgagtccgaacgaagcagtagcggtgaactcgatcatgcagctgcaccggctgacggcggtgaagtccgccgttgaagaggttctgggatggatccggattctgaaccctaaaatcgtgacggttgtggaacaagaagccaaccacaacggggaagggtttttggagcggttcacggaggctttgcattactattccagcgttttcgactcgctcgacgcgtgtccggtcgaaccggacaaggctgctttggcggagatgtatctgcagagggagatatgcaacgtggtgtgctgcgagggaccggcgcggctggagcgccacgagccgctcgctaagtggagggatcggctggggaaagccggcttcagagccttgcatttgggtttcaacgcctacaagcaagccagcatgttgctcactctcttctcagctgagggtttctgcgtccaagagaatcaaggctctttgactctgggttggcatagccgccccctaattgcagcttcggcttggcaagccgcgcctctgggagacgacgaaacgctgcgttttgagcattga

SEQ ID NO: 1177 - DNA, 321 bp, Glycine Max
atggaggaagtgattggacccagattgtactgttgctctaattgtagaaaccatgttgcccttcatgacgatgtgatttcaaaggcctttcaggggaaaagtggacgggcttttctgtttactcgtgcaatgaacgttacaataggaccaaaagaagacagggagctcatgacgggtctccacactgttgctgatgtctactgttctgactgccatgaggtgcttggttggaagtatcagagagcctatgaggaatcacagaagtacaaggagggcaaatatgtacttgaaaaggctaaatttgtcagggaaaacttctag

SEQ ID NO: 1178 - DNA, 405 bp, Glycine Max
atggaggagcaccagaaggctgggaagctgcagggaaaggaagaggtgcggtaccgcggcgtgcggcggcggccgtggggaaagtacgcggcggagataagggatccatcgaagcaagggtcaaggctgtggttggggacatttgacactgctgaagaagctgctagagcttatgaccgtgcagcttttaacctaaggggccatcttgcgattctcaattttcctagtgagtactattctcagataaggggttcaccaccatatccacctcatttagcaacaccatcttcctcttctggtgcacaacagaggcctgtttttgagattccgtgtttggatgataaggtgttggaggatcttcttggtcagtcagaggaacacaagaagaaaaacaagggagattaa

SEQ ID NO: 1179 - DNA, 723 bp, Glycine Max
atggaggaggaaacagagaggttctcctgctccaagcttctcattccaaaaggagaacccattttcgtgaaggccacttggtttcccacccactttcacctcgccgtcaccgacggcatcaccgcctggcactgccacccatcggcggaggaagtgaagcagcgtgctgctcagtgggacctcccagtttcagagtacctgaacttgtctgaacgctatttggggcttcaacaacctggctctgtctatgcatttgatgatgctggtgatagccataagaggttgtcatggacgtttgagaaggaaggaatgactctgctttggagatggaaatgcttgctgtctcctgattctaagaaaagtaatgtcgaaatattggactttctcatgggttcaaacataaatctaagtgacaaagttgtcacagaaaatgaattgtttgagaagatgaaagtggaagctgagaagtgcttaacccagagtgaaagaattgccaatgagaggctggaatttgaatctgaaatctatgcaaagtttctgggggtgttaaattctaaaaagtcaaaactgagagtgcttcgagataagctgtcaaagcaagagaattctgagaaatctcctgaagaggaagacacagacaaaactgagagttttgacgaagaaaatgattttgaaagaagtgatgaagatcctcaaaaggatattactagttcttcaaaggaa

SEQ ID NO: 1180 - DNA, 1938 bp, Glycine Max
atggaggatatatcgaaatacgcgcacagtcctgcacacgtggcagtggcgaggcgcgaccacgccgcgttgcgccgtctcgtatccaccatccctcggctggcgaaagccggcgaggtcaacacagaagccgaatctctcgccgcggagctcaaagccgacgaggtttcggcggtgatcgaccggcgcgacgttccgggaagagaaacccctctccacctcgcggtgcgcctcagggaccccgtctccgccgagattctaatgtgcggcggcgccgactggagcctccagaacgagcatggctggagcgcgctccaggaagccgtgtgcacccgagaggaagccatcgccgtcatcatcgcgcgccactaccagcctctggcgtgggcgaaatggtgccgcaggctcccccgcattgtcgcctccgccgcacgaatccgcgacttctacatggagatttctttccatttcgagagctccgtcattcccttcattggtcgcattgcgccttccgacacttaccgcatttggaagcgcggctctaacctccgcgccgacatgacccttgccggattcgacggcttccgcatacagcgttcggaccaaacttttttgttcctcggagagggttatgcctccgagaatgggaatttgaacttcccaccgggttctttgcttgcgcttgctcataaggagaaggaggttacgaatgctttggagggagctggtactcagccgactgaagctgaggttaatcatgaggtttctttgatgtctcagactaatatgtataggcctgggattgatgttactcaggcggagcttgttccgcatttgaattggcggcggcaggagaagacggagatggtggggaattggaaggctatggtttatgacatgcttcatgtgatggtgagtgtgaagtcgaggagggttcccggggcgatgaccgatgaggagcttttcgctgtggatgatggggagagtatggtgaatcgagagaacaatgatgagtatgatgatgtgttgactgctgaggagaagatgcagttggattccgcgcttcggatggggaattctgatggtatttgtcaggatggggagcctgggtttgatgggcatgagaatggttcagcggcttcgaattgtgaagccaatggtggtggggttaaagagaagaagggatggtttggttggaacaagaaaaacatcaagggtggtgacgagcctggggatttgaagactgccaagaagttttcgggtgatcagcagaagccgcaacctgagtttgtgaaggaagatcctggggaaacaaagaagggaaaggataaaaaccttagaaggaaaaagaagaaaggaggaattaatgagtctaagaatgagagtgagtacaagaagggcttgagacctgttttgtggttgacaccggactttcctttgagaacagatgagcttttgcctctgcttgacatcttagcaaacaaggttaaggctattaggagactcagagaacttttgacaactaaacttcctcttggaacctttcctgttaaggtagctatccctatagtccctaccataagggtccttgtcacttttacaaaatttgaagagcttcagccagcagaggagttttcaactccactctccagcccagcatacttccaggatgctaaatccaaggaatcggaaggatctacgtcatggatttcatggatgaaaggaagtcatggtacacagtccattgactctgatagtcatagatttaaggatgaaatcgaccctttcaatatacctttggactacaaatgggtagatgccaatgagaggaaacgccgtatgaaggcaaagagagccaaaaatatgaaacataagaagcagactgctaaaggaggagatggagtgcaactagggagtgaagatgtggaagaatactaa

SEQ ID NO: 1181 - DNA, 993 bp, Glycine Max
atggagggaagagagaattttggtgttgtggtgggtgatgaggccccagagagcttccatgtggctcctagaattgagaacaacttggacttttcaagggccaccgtgccggcgccggcgccggcgacggaggggaagaagaagagagggaggccgaggaagtatgggccggatgggaagccggcgttgggggcggtgacagcgctttcgccgatgccgatttcttcgtcgattccgttgaccggcgagttctctgcttggaagagtggtagagggaggcctgttgaatctatcaagaagtcatcgtttaagtttgaggttgaaagccctggaccagttgagggaatagcatactcagttggtgccaatttcacaccacatgtgctcacagtaaatgctggcgaggatgtcactatgaaaattatgaccttctctcaacaaggatcacgtgctatatgcattctctcagcaactgggacaatttcaaatgttactcttcgtcaaccgtcttcttgtgggggtactttaacgtatgagggactgtttgagattctttccttgtctggttcctttatgccaactgagaatggagttacaagaagtagatctggtgggatgagtgtctctttggctggtccagatggtcgagtaatggggggcggacttgctggtttgttggtagctgctggtccagtgcaggttgtggtggccagttttcttcctggtcaccagttggagcataaaaccaaaaagcaaagggtggagcatgtatcaactattagcccttcacctgttaatcttatcactagtgaggaaataaaagtaagttttggtggagtaaagcctattatgacccctgctgcttttcaagaagagaatattgcttcttttaacaatgttcaagactctaggaactcatctgctgatgacaaagatcctttgcctgaaaaggagtctaacctaagccaatcaaatgctgaggctgcatgctaa

SEQ ID NO: 1182 - DNA, 609 bp, Glycine Max
atggaggggactgttttcactcctgcacttgaaggaattaagcttgtaaaatcagagcaaggagaaattttgacccagcctttcttggatgcttgcaagcatatactgcctgttatagacaagtttggagctgctatggcccttgttaaatctgacatcggtggtaacatatcgagattggaatctaagtattcctccaatccaaccaaattcaactacctgtacagtttggtacaagtagaggttgaaactaaaacggctaagtcatcatccagttgtaccaatggacttctttggcttacaagagcaatggatttcttagtggcattattccaaaacttaattgagcatgcagattggtcaatgtcacaagcctgtacagattcctataacaagactctaaagaagtggcatggctggcttgcaagttcaagcttcactgtagcaatgaagcttgctcctgataggaaaaaattcatggaggtgatacaaggcactggtgatatcagtgctgatatacagaaattttgtactgacttttctcctatctttgaagagaatcacaagtttctggctcgttgtggcttggatgatatgaaggcgtcatga

SEQ ID NO: 1183 - DNA, 609 bp, Glycine Max; identical to SEQ ID NO: 1182

SEQ ID NO: 1184 - DNA, 2751 bp, Glycine Max
atggagtatatcagcactcagtttggagatgcactttacagaaggtggattttcggagatagaggggacaaaataggatcaagatcaagacctgttgcatttccaagctttagcccacccgctaacctttttacagttattgccaggactgtgtctttgtggaggtctttggacgagaatttgaagacaagccaaagatatttagctctaatgagtgcgcttttcagtgatattggaagcgcggacgaaggcctgaaccagagacagaaagtgtgggtgaatcaattaaaactcgtggctcggaagggagagtctcttgttgctgcgtatccaaaggatgggtttcccttttccagtggatatgaagacaatcacaattctcccgattccatttgctaccgggataccacagagctcgattgggaactggatttaatcactggcgaaaagcaattgatggatgcactgttacttgatgtaaaacggattggatatgaagacctagatggaagatacaaaatctgggtgaaccaaatcaaaggtattgcccgtgaaacgaaagctgtcattgatgagagcggtggccgtgaattggatcaagtagaaaagcacattatggttttgatggcccagttactttcggatgagaaatttcgctgcattacttcaatagttggaattaaaggcacgggtaagacaaaactagccaaaatgatacttagaaacgaagctgtcattaatcattttgattatagaatctttgtgcctccaagttatgcaacagttgaacagattaaagaatacatagccaagaaggctgcagaaattattaagggagacaaacaaaacgcactcgcaaccttggcgagtaaaaaacatctcatagttattgatggcatagaaactcctcatgtcttggataccttgatagagatcatacctgacatgttaacagcaagcagatttcttcttaccactcacaatgcaaatgtagcccaacaagcaggtatgagatcctttgttcaccctttacagttactagacgatgaaaacagttggactctgttcacaacagatttgaaggtgaacattcccctagaatcaaaactgtccgagactgggaaaaaaattgtggctaaatgtggtggcctgccattggaaataagaaaaacgaggagtttgctttctggcaaagatgtgacacaagaggactggaaagatttgacagaagaggagtggccaagcgtgcgtcaaaacccttggtctgacacacttaacacgatcaacatcaacttaccttcacatctgaggcgatgcttattttattttgagctattccctgctaattttgggattgctgcaagaagattagttgctttgtgggttgcagagggtctagtgcatcatggggaagaccaagagccaccagagcaagttgcagaaaggtatttaaaagagttgatagatctgaacttggttcaaattgccaagagcaagcccaatggcactgtcaaaacatgtcgtctccctcatgctttgcacgatttgttgttgagaaagcctgaagatgctagatttcctcaagtatataccagcaaagagttgattgcaaaccaaaaatatcccgaaatacgcgaggtggctgatcgtcttgatgaaaatcataactggcaccaacatattcatggtaacattaccaatgattcacctcaagtgggaacctactacaagggtgttcactccttcctgtcctttgattttcgagaaggaagtagaccaggccaagaattatgtaactttctgaacctgtgtatttcaagcaactgtcttctactattgcgggtgcttgatcttgaaggcgtttacaagcccaagttgcccgaaagcattgaaagacttactcggttgaggtatcttggcttaagatggacttatttagagtcacttccatcatctataagcagcttgctgcaactccagactcttgatctgaaacatacttacatacacactctaaccagctccatctggaacatgaaactgagacatctcttcttgagtgagacttaccggaccagatttccatccaaaccaaaaggtacaggtaattctctatctgacgtccaaacaatgtggggtcttttcgtagatgaagagactccggtgaagggtggtctggaccaattggtcaatatcacaaaactgggaatagcatgccaatcaatgtcactacagcaagaggtaatggaatcacaacttgatgcagtagctgactggatttctttgaaaaaacacaataatctcactgacatgtatttgctgggaagcttgacaaacgcatctgttctgttccccgaaagccttgttgagcttaccctgtcacattccaaactagagaacgacccaatgaaaattttgaaagatcttccaaaccttcgatcattgtctttgcttgcagaatcctacgagggggaaaaaatgatctgcaaatctaaaagttttcctcagctttatgtcttgaaagtttggaatttgaagcaattaaagaattggttgataaagcaacaagcactcccctctctcagacaactggaaatccgatcatgtcctggcttgacaaatcttccttttggactgtggcatgttaaaagtctccttgagttgacactgacaaacatgtcaaaggaaatcaatattggcatatatcgccttccggacaattgtaaagtccgcagagataattctcagtag

SEQ ID NO: 1185 - DNA, 558 bp, Glycine Max
atggagtcatcagaggaccccatcatccaagtcaaagatgaacaactcatggtttcaccattatccggtgaaaacccagttcacagaactgcttatttcatcaaaccttgcgtggaagactcggcaactcttcctcattccatgttctcttctggaagaacagccactgtcaattcggaccacgcgaagttgcttgaagtaagatacaaagggtggcattacccaagtgcagaatggaatacatgggtccaacaaatgcaacacaagtatgaatgtgtgtggatgaaagctgggatagaccaggcaatcaaagcttcaacttttcaaatccgtaggaatgatgagttgatcattgagcttgcacaaagatggtgttctaagaccaacacgtttgtgtttccttggggagaagcaacgataacattggaggatatgaaagtttgttggggttactctgttatgggagctcctatttctagccctcttgtgagtggtgaggaaagggaaatagaacaattcactatttatcctttcttgaatcaaagaaatttttattga

SEQ ID NO: 1186 - DNA, 1014 bp, Glycine Max
atggagtcgacggaatcttcatacgtctcttctcccgagggaccaaggaagcacgctgcatcgcctcctccgaaaccgccttcgctagattctgaggagaagccaacatatattaggtttctagtatcaaactctgctgctggttcggttattggaaagggcggttcaactatcactgattttcagtcacaatccggagcacgaatccagttgtcacgtaatcatgaattctttcctggaactactgataggattatcatggtatctggtgcaataaatgaaatacaaagggctgtagaacttatcctttctaagttgctcagtgagcttcatagtgaggatgacaatgatgctgagccaaagacaaaagtgagactcgttgttcctaatggttcatgtggtggaataattggcaagggaggtgttaccattaggtcattcattgaagattctcaggctggcattaagatatctcctcaagataataattactatggacagaatgataggctagtgatgctgacaggaacttttgatgaacagatgcgtgcaattgaattaattgtttcaaagttagctgaagatcctcattatgcacagtccatgaattctccgttttcatatcctggtgtttacttctcgggttatcaaggtgttccatacacatacgtgcttccatctgttgcaccaccggcatacaatgcagtgaattacagacccaatggtactgctggaggaaagctccagaacagcaaggaggagcggagtaactcattgaccatgggtgttgcagatgagcatatcggattggttgttggtcgtggtggaaggaatattatggaaattagtcaggttagtggggcaaggataaagatatcagatagaggtgattacatatctggaacaaccgacaggaaagttaccataacaggatcccagagagcaatacgtacagctgaatctatgatattgcagaaggttgcttatgctactgagaggggggtgatggagtag

SEQ ID NO: 1187 - DNA, 4530 bp, Glycine Max
atggagtcgatcgcgacgtcggagactgtgacctgcaacactggcagggaagaggaggtgctagggttgagggcaagcacacatcgcgttgtcgctaccaagagccaacgacaccgagaccactgtaaccaccacaatggcgacatcgaaggaagccaactagggcaacgacaatggggaagtaaatggaactgcaacaacgacgacgacgcaaaaccacctagagttgaagcgaagatgaggattatgattaagggcggtgtttggaaaaacaccgaagatgaaatcctgaaagcggctgttatgaaatatggtaagaaccagtgggctcgaatctcttcgctccttgttcgcaaatctgccaagcaatgcaaagctcgctggtatgagtggctcgatccctccataaaaaagactgagtggacgagagaagaggatgagaagctacttcatcttgctaagcttatgcccactcaatggaggacaattgctccaattgttggccgtaccccttcccagtgtcttgagcggtacgagaagctccttgatgcagcctgtgtgaaggatgagaactatgagcccggtgatgatcctcggaaattgcgtcctggggagattgatccaaaccctgagtcaaaacctgcacgcccagatcctgttgatatggatgaagatgaaaaggagatgctttctgaagcacgagcccggttggccaacacaaaaggaaagaaagcaaaaaggaaagctagggagaaacagcttgaggaagccaggaggcttgcttctttacaaaagaagagagaattgaaggctgctggaattgatattaggcagcggaagagaaaaaggaaaggaatagattacaatgcagaaattccatttgaaaaaaggcctcctccagggttttttgatgttacagatgaagatagaccagtggaacagccccagttccctactacaattgaagaacttgaagggaaaaggagggttgatgttgaggcacaattaagaaagcaggacattgcaaaaaataaaattgcacaaaggcaagatgccccatctgccatattgcatgccaacaagctgaatgacccagaaacagtaagaaagaggtcaaaattgatgcttccaccccctcagatttcagatcaggaattggatgaaattgccaagttgggttatgctagtgaccttgcaggaagtcaggaacttgctgaaggtagtggtgcaacacgggctcttctggctgattatgcacagacacctggccaaggaatgactccgttgcgaacccctcaaagaacaccggctggtaaaggtgatgctatcatgatggaagctgaaaatctggccaggctgagagagtctcaaacaccattgttaggaggagagaacccggagttgcatccttcagattttaatggcgtcactcctaagaaaaaagagattcagactccaaatccaatgctgactccttctgcaactcctggaggtgcaggtctcactcctagaattggcatgacaccaacaagagatggtttttcttttagcatgacaccaaagggaactcctcttagggatgcactacatattaatgaggacatgaatatgcatgacagcactaaacttgagctacagagacaggctgatatgagaagaagtttgcgttctggtttaggaagccttccacagcccaaaaatgagtaccagatagtgatgcaacctgttccagaagacgccgaagagcctgaggagaagattgaagaggacatgtctgatagaatagctagagaaaaagcggaagaagaggcaaggcagcaggcattgcttagaaagcgatcaaaagtccttcaacgggaacttcctaggcctcctacagcatcattggagcttataagaaattccttgatgagaactgacgtggacaagagttcctttgttccaccaacctctattgagcaagctgacgagatgattagacgggagcttctaagtttactggagcatgacaatgctaagtatccacttgatgagaaagtgattaaggagaagaagaaaggagccaagcgtgctgtaaatgggtctgctgtccctgtgatagaagattttgaggaagatgaaatgaaagaggctgataagttgataaaggaagaggccctgtatctttgtgcagcaatgggtcatgaagatgaacccctcgatgaatttattgaagcacacagaacctgtctcaatgatcttatgtactttcctacccgtaatgcatatggtctctctagtgttgctggaaacatggaaaagctaacagctttgcagaatgagtttgagaatgtgagaagcaaattggatgatgataaggagaagacggtacggcttgagaagaaggtgatggttctcacacaaggctatgagtttcctgaaattctctttctcttagattcttttatggtatcacaaagctacttttcgatcctcagttttttcttcacggcttccgcttctaacaatcctcctcctcctcctccaccaccgccgatgaacaatgcagttccggtgaatgcagatgctgctatgccggttgctgccacttcatcttgcacatctggcattgccttcactacctgctcacaaatccacaaattccaccgtgatatgcatctctggcggatcgcaatgctggaaatgtctcatctgagtttctgctttgggaacaacaggatcaactctttctatcgtggcttcaatccacaatttctagcgaagttcttcctagacccatcggttaccttgattgattcgctttcatctatcggagaatttgttccggcttatgaacatgttgatatcattcttgatggactaccgtatgaatttgagtcactggttacgcttattagttgtaggtttgagcctctcacaatcgatgaagtcaaaactcttcttcttgctcaggagactcacgttgaaaagtcttgcaagaaagcaattgcttccatcaatctcattgaaatttctcaacctaattttaaccccaattcctcactgactcgacctacactaactacaatggaggtaattgtttcctcaacaatggtcatggcggtggccacaatttctcttgtggtggccgtggtggtggttgcggctatggcgatggccgtgggattcgtggtggtctctaaagaggtccttcttcaagggttggttggtgctgatggcctttaccaattccctaatctgcttcagtcatctagacagcaactcaagtctcggttcactgtcaataccatttcatctgatgtttcagaacctgtctttagagcatcttcttcaaattctgttcccaattctgttctgactttttgttcacattgttgcattggtaaatcccatggacttccctcctccccttctcttagtgtctattccactcctttggaacttatctatactgatttgtggggtccttctcccgttgtgtccagcaatggttacagatattattttcaaactatggttaaaactcaatttaacctacctattaaagctgttcagtctgattggggaggtgaatataggcctttctctaagtatcttacagatcttgctaactcaacatcttctgctactgcgtcacaaacagctgcagctgcaacaccagtcttatcaacatctagttcttctcctttgccacaaggaaatcctgacttacctattatttcaccagcaacagaatcatctgttccttcaaatgcatcatccaatcttgaggccacttctgctgccactgcttctgtacctcatcctagactccatcctactcttcttttggctcattctgagcctaagtccacaaaaactgctccttccaatcctacttggtttgcagcaatgaggactgagtatgatgctttgatgaaaaatggtacatggactcttactgatctaccttcatctagggctccaattggctgcaaatgggtgtttagggtgaaggataatcctgatggcactatcagcaagtacaaaggaagacttgtagcaaagggatttcatcagaaacttggttatggttacaatgagattttttctcctgtaatcaaaccagtaactgtcagaattcttttgtttcttgccattactcacaagtggagtcttcaacagttagatgtcaacaatgcctttttaaatggcatccttgaagaggatatttacatgtctcagcctcctggttttgaaaacagcaacaagcaacttgtgtgcaagctgcacagagccatctatggcttaaaacaagcccctagagcttggtttgacaaacttaagactactctccttcaatacaatttcaggtcaagcaaatgtgatccttccttattcatctacactgaatcctgcactgtgatctatatgttggtatatgttgatgacataattgtcacaggcaacaatcctactttcattaaatccttggttactaaacttaattctgagttttctctaagagtgcgtttggatagaaaattttaa

SEQ ID NO: 1188 - DNA, 1377 bp, Glycine Max
atggagttcactgaatcttacaagcaaacgggtccctgttgtttctctcccaacgctcgcttcattgccgttgctgttgattatcgtctcgtcattcgggagaccgtttctttcaaggttgtgcagttgttttcatgcttagacaagattagctatattgaatgggcccttgattctgaatatattctttgcggtctctacaaaaagccgatgatacaggcttggtcactgacccagccagaatggacatgcaagatagatgaaggacctgctggaattgcatatgcgaggtggagcccagatagccgccacatactcaccacatcagatttccagttgcgtttaattgtttggtcattgttaaatacagcttgtgtgcatttacagtggccaaagcatccttccaaaggagtttctttcacaagagatgggaaatttgcagcaatatgcacaaggcgtgattgcaaggactatataaatctgttatcttgtcacacatgggaaatcatgggcaattttgcagtcgacactctagacttggctgatatcgaatggtcacctgatgatagtgctatagtgatatgggattcaccacttgattacaaggttctaatatattctccagacggaaggtgccttttcaagtatcaagcatatgaaagtggattaggagttaaaagtgtgtcctggtctccttgtggtcagtttctggctgtgggcagctatgaccagatgctgcgggtcctgaatcacctaacttggaagacatttgcagagctaatgcacccatctacagtccgtggtccttgttatgctgctgttttcaaagaagtagatgagccactacaacttgatatgtctgaactatgtttgagcaatgatttttcccaagggcatgatgattctcctgaagaaccatttagagtcaggtatgaggttatggaagttcctatcaatttaccattccaaaagcctcctgctgagaaacctaaccccaaacaaggaattggtattttgtcatggagcaatgatagccaatacatatgtactcgtaatgatagtatgcccacagtactttggatatgggatattcgacatcttgagcttgctgcaatcttagtgcataaggatcctatcagagcagcagcttgggacccggcatgcacacgccttgttctttgcaccggaagcactcacttgtatatgtggaccccatctggtgcctattgtgttcatgttcctctaccgcagtttactataacagatctgaaatggaattctgatggcagttgtctacttcttaaggacaaggagtcattctgctgtgctgctgtacccttgttgccagaatctagtgagtacagctctgatgattga

SEQ ID NO: 1189 - DNA, 1662 bp, Glycine Max
atggagttcgttgcaagctctgtgaacgcttctttttctcttcgttgctctcacaatacccctttccctgccatctccattcctccggttctctttccatttctcacttcttccctttatgttctcatcactttcaccactttttctaacccgtttcccgttttcgtccccacgttctgtttggtgtcacagtggaagtgtttttcgttaagggtaatagaatctcggtttccattggcacatagaaggaagaaaggtcttggttctagaaatagggattctgggaaagaattttcaattggggtgtgtggctattttccatcaagtgggggtttcactgccaaaaggaggaaatgtaatagtctcctaagactgaaggattgttcagaaaacataagacaacatgcttctattttgtttgtgcggctggttactggagtgatgttggtcatggctgtttctttggcttctagtgagccatcctgggccctgtctgaagagaatctcctctttctggaggcatggagaacaattgaccgagcgtacattgataaaagttttaatggacagagttggtttaggtatagagaagatgcactacgcaatgaaccaatgaacaatcgagatgagacatatacagcaataagaaagatgcttgccacattggatgatccattcactagatttttggagcctgaaaagttcagaagtttgaggtctggaactaaaggcgctctaactggagtggggttatcaataggctaccctaccaaagctgacatgcaacctggtggacttgttgtcatttcagcttctccaggaggtcctgcatatagagctggtgtttcgtctggagatgttatcctggctattgatgatacaaacacagaaaacatgggactatatgatgcagctgaacgtctacagggaccggaaggaagctctatagctttgaccattcgtagtggttcggacataaaacacctggatttgacgcgagagaaagtttcattgaatccagtgaagtcaagattgtgcaagctacctgcttcaggaaatgattccccgacaattggttatatcaaactaacatctttcaaccaaaaggcatctagtgctatcaaagaagcaatcaatacattaaggagtgataatgttaatgcatttgttttggatcttagagataatagtggtggtcttttcccagaaggaattgagattgccaaaatttggttggacaaaggggtgattgtgtatatttgtgatagtcgtggtgttcgagatatacttgatacagatggaagtagtgcactagcaacttcagaacccctggttgtactggtaaacaagggaactgcaagtgcaagcgaaatattagctggtgcattgaaagataataaacgagccgtattgtttggagagccaacatttggaaaagggaagatccaatcagtttttgagctctctgatggctctggattggttgttactgttgctcgctacgagacacctgcacatacagatattgacaaggttggtgtcattcctgaccatcctctaccaatatcatttcccaaggatgaggatgcattttgcaattgcctccaggatcctgcgtcttcttgctacgtcaataggatccagcttttttcaaaatcatga

SEQ ID NO: 1190 - DNA, 1443 bp, Glycine Max
atggagttcgttgcaagctctgtgaacgcttctttttctcttcgttgctctcacaatacccctttccctgccatctccattcctccggttctctttccatttctcacttcttccctttatgttctcatcactttcaccactttttctaacccgtttcccgttttcgtccccacgttctgtttggtgtcacagtggaagtgtttttcgttaagggtaatagaatctcggtttccattggcacatagaaggaagaaaggtcttggttctagaaatagggattctgggaaagaattttcaattggggtgtgtggctattttccatcaagtgggggtttcactgccaaaaggaggaaatgtaatagtctcctaagactgaaggattgttcagaaaacataagacaacatgcttctattttgtttgtgcggctggttactggagtgatgttggtcatggctgtttctttggcttctagtgagccatcctgggccctgtctgaagagaatctcctctttctggaggcatggagaacaattgaccgagcgtacattgataaaagttttaatggacagagttggtttaggtatagagaagatgcactacgcaatgaaccaatgaacaatcgagatgagacatatacagcaataagaaagatgcttgccacattggatgatccattcactagatttttggagcctgaaaagttcagaagtttgaggtctggaactaaaggcgctctaactggagtggggttatcaataggctaccctaccaaagctgacatgcaacctggtggacttgttgtcatttcagcttctccaggaggtcctgcatatagagctggtgtttcgtctggagatgttatcctggctattgatgatacaaacacagaaaacatgggactatatgatgcagctgaacgtctacagggaccggaaggaagctctatagctttgaccattcgtagtggttcggacataaaacacctggatttgacgcgagagaaagtttcattgaatccagtgaagtcaagattgtgcaagctacctgcttcaggaaatgattccccgacaattggttatatcaaactaacatctttcaaccaaaaggcatctagtgctatcaaagaagcaatcaatacattaaggagtgataatgttaatgcatttgttttggatcttagagataatagtggtggtcttttcccagaaggaattgagattgccaaaatttggttggacaaaggggtgattgtgtatatttgtgatagtcgtggtgttcgagatatacttgatacagatggaagtagtgcactagcaacttcagaacccctggttgtactggtaaacaagggaactgcaagtgcaagcgaaatattagctggtgcattgaaagataataaacgagccgtattgtttggagagccaacatttggaaaagggtag

SEQ ID NO: 1191 - DNA, 357 bp, Glycine Max
atggagtttgttaatcgaatagtggacatagctaccagagctgtaaacagcaacgcagtgatcaatgtttgtctgcttgcgtcgtttgcaacactcggcgtaagatctatgaatcagcaaaagaccattgaagctctacaggatgagaaggagtctcttaccaaatccaacaagtccattagaaagacattgtgggactggaaacagcagctttatgctgaagcctccgctgattctgcagtggttcctctggctaggctcaaagcaatctatggcgaagccccgcctcctccacgtgccacgctcggcgagacatttccaaagaagaaaatcctaaaagaatgtcttagatcataa

SEQ ID NO: 1192 - DNA, 1836 bp, Glycine Max
atggataatactggctactctcagttgtcttctccatctacaaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaaggttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtgctttctgcatgttatgtagctatccctcctcagttatagactataaagtagaaaatttgatcttgtcttacttctgtaatgttgctaattgccagcatataatggttcataatgctgctcttatagtagatcatcatagtggtgataaccatcctgctcattatggagatgaaatgaccaacaaacaggtcacatttcaaacatctactaattggagttctggcaaccctccttatacaaccactgttgatgatcccagttcttcatattctccttatttaccaccagttcttgaagaaccttcttcttcattttctgaggctgcagatgaagatccattgccggctatagagggtcttcaaatttcaggagaagcctttcctggaagggaacttcaagcatgtggatactccatcaatggcactactagttgtaattttgagtggattcgacatttggaagatggttcctttaattatattgatggggcaaagcaaccaacctaccttgtcaacgccgatgatgttggtacattacttgccattgaagtccaacctctggataacaggaagcgcaagggagaacctgtgaaggtttttgccaatgataataaaaagattgcttgtgatcctgaaatgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgttatgattccatatggacatacttcagagtttattataattggttccagtggtgatgaacaccttttaaagacagatttcagtggtgctagagacactattgtgctcactttgagattattcatcctgaggaggaaaaagaaaaaaaagagagatatgaagtttagccactcattgctaatgatgaactctactgttacttttgtagaaattagaaataactggcattga

SEQ ID NO: 1193 - DNA, 1854 bp, Glycine Max
atggataatactggctactctcagttgtcttctccatctacaaggtcagtctctccaagcaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaaggttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtgctttctgcatgttatgtagctatccctcctcagttatagactataaagtagaaaatttgatcttgtcttacttctgtaatgttgctaattgccagcatataatggttcataatgctgctcttatagtagatcatcatagtggtgataaccatcctgctcattatggagatgaaatgaccaacaaacaggtcacatttcaaacatctactaattggagttctggcaaccctccttatacaaccactgttgatgatcccagttcttcatattctccttatttaccaccagttcttgaagaaccttcttcttcattttctgaggctgcagatgaagatccattgccggctatagagggtcttcaaatttcaggagaagcctttcctggaagggaacttcaagcatgtggatactccatcaatggcactactagttgtaattttgagtggattcgacatttggaagatggttcctttaattatattgatggggcaaagcaaccaacctaccttgtcaacgccgatgatgttggtacattacttgccattgaagtccaacctctggataacaggaagcgcaagggagaacctgtgaaggtttttgccaatgataataaaaagattgcttgtgatcctgaaatgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgttatgattccatatggacatacttcagagtttattataattggttccagtggtgatgaacaccttttaaagacagatttcagtggtgctagagacactattgtgctcactttgagattattcatcctgaggaggaaaaagaaaaaaaagagagatatgaagtttagccactcattgctaatgatgaactctactgttacttttgtagaaattagaaataactggcattga

SEQ ID NO: 1194 - DNA, 792 bp, Glycine Max
atggataatcaagggcatggacatgggcagaatccatctatggggattgttggaaatggacctcaacttccttatggttctaatccataccaggcaagccatataacaggttcacctggaatggttgttgcatcacctggaaccattcaatccactggtcaaccagccgcaactcagctaggacaacatcaacttgcttatcagcaacaacagcagcagctgcagcagcggctccaagccttttgggcaaaccaatatcaagaaattaagaaggtgaccgatttcaagaaccacagcctccccttggcgaggatcaagaagattatgaaggctgatgaggatgtcagaatgatatcagccgaggcgccggtcatatttgcgagggcatgtgaaatgttcatactggagttaaccttgcggtcttggaatcacactgaagagaacaaaaggagaacacttcaaaagaatgatattgcagcagccatcacaagaactgatatctttgatttcttggttgacattgtgcctagggaggacttgaaagatgaagtgcttgcatcaatgccaagaggaactgtgcctgttactgggcctgctgaggcacttccatattgctatattccacctcaacatgcacagcaagttggagctgctggtgtcatgatgggtaataagcctgtgatggacccgtatgctcaacagtctcatccctacaacatggcaccacaaatgtggccacaactactaccaccaccaccaccagagcaacaacagtcatctccagatcagtag

SEQ ID NO: 1195 - DNA, 1338 bp, Glycine Max
atggatacctctccgaaaatacgtttgtgtggtctgaaggaagtagtgagtggcagcccttgtcctcggtttctgacctgtgggctcaaattaaccggcagggacctgattcttcaactactgtgtctgctcctgatgttgatgagtttgaaagatggcaaaaggagattcaggaggtggaggcacaggtggaaggttcggaatttggatccttatctggcaatgttggtggtactggggcaggagaagattctgagagaccttcgacgccacctgagggtgaagaaggatttactgatgatgatggaactgtatataagtgggataggagtcttagagcttgggttccccagcactaagccttatggggttgaagagatgaccttcttggaagaagaggaagtttttccaacaatacctaattctgatgcctctgaaaagtttgaagatagtccaaaattgagtgtttctgtgcctcccttaaaggaagaagaaaataataccaatgtgatatcaggtggaaaaaggatgctttcagatcaacaaacagacaagaaggaagctaataaaccccctgatagttggtttgaattaaagattaatacgcatgtttatgtcactgggttgcctgaggatgttaccactgatgaaattgtggaggtattttccaaatgtggaattataaaggaggaccccgaaaccaaaagacctcgtgtgaagctctatgttgataaagagacaggaaggaaaaagggagatgctctggttacatatcttaaggaaccttctgtggctttggcaattcaaattttggatggagcacctcttcgccctggtggcaagattcctatgtctgtcagccaggctaaatttgagcagaaaggagacaagtttgtatccaagcaagtagacggtaaaaagaaaaagaaattgaaaaaggtggaagacaaaatgcttggatggggtggtcgcgatgatgcaaaagtttcaattccagcaactgttatccttcgttatatgttcgctccagctgaaatgagggctgatgaaaatctgcatttagaactagaagaagatgttaaagaggagtgtacaaagcttggtcctgtggattcagtcaagatatgtgagaatcatcctcagggagttgttttggtaagattcaaggataggaaggatgcccaaaagtgcatagaattgatgaacggacgatggtttggtggtagacagatacatgccagtgaagatgatggttcggttaaccatgccttagtccgggatctggaagaagatgtcattcggctggagcagtttggtgctgaacttgaaggtgactga

SEQ ID NO: 1196 - DNA, 330 bp, Glycine Max
atggatactaaaaagtcaaccaaggatactaatggctgcattaacaagcctatggctgtgactgtgactctgacagtggcttctttagagggcagaaaggttgaagatcatagcaatagagaagatgagagtgattccaattctttgttgccagtgcgaaaaggaggaattgcacggaaatcagataagacttataggaaaaggaaagtgcagtggaacgataggataggaaacaagcttgttgaggttttggaatacgagccaagtgatgttagtgactcagaggatgaggatgacggcggcgatccttgtatctgttcaattatgtag

SEQ ID NO: 1197 - DNA, 912 bp, Glycine Max
atggatagggtgttctcagtggacgatatctccgatcacttctggcagccgcctatccctgtctccgccgcccaaacttcctcccagatgagccgcagcgcctccgagtgggccttccaacgcttcctccaggaagcttccgcctccgcaccctctcctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgacgttgaaacattaagaacaaaggtaaagctctactttatacttaaacctactggctctttctaa

SEQ ID NO: 1198 - DNA, 1212 bp, Glycine Max
atggatagggtgttctcagtggacgatatctccgatcacttctggcagccgcctatccctgtctccgccgcccaaacttcctcccagatgagccgcagcgcctccgagtgggccttccaacgcttcctccaggaagcttccgcctccgcaccctctcctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgacgttgaaacattaagaacaaaggtgaagatggccgaagagaccgtcaaaagaattactggattgaacccattgcttcatgccatgtctgatatatcatcactgggcctgccatcatttgatggaagaagcccttcagacacttcagctgatgcagctgttcctgtgcaagatgatccacatcatcacttctatcaacccacatctactaatcctattcccagtcatgatccgatagtcaacaatggattggggggcatttcttcaattgaaaatgtgcagcagaatgctgcagtagtgctaggtgggaacaagatgggtcaaacagcatccctgcagcgggtggctagcttggaacatctatag

SEQ ID NO: 1199 - DNA, 1632 bp, Glycine Max
atggataggtgctggtttaataagttcaagccaaaggataaaacaccatcttcaaaaaacaaggaaacaggcattgcaaaagggtcaaaacccccaacaaatgatgaagcaccttccaatgtgaccaaacagaaggttgcagctgcaaagcagtacatagaaaaccactataagaaacagatgcaggacttgcaggagagaaaggaacgacgtaatatgctagaaaaaaagttggctgatgctgaagtttctgaggaagagcagaacaatttgcttaaatattttgagaaaaaggagagggaatacatgcgccttaagaggcataaaatgggggctgatgattttgagcccctgactatgatagggaagggtgcatttggagaggtcagagtctgccgagagaaagcaaccggtcatgtatatgctatgaagaaacttaagaaatcagagatgcttcgcagaggccaggttgaacatgtaaaagctgagaggaatctacttgcagaagttgatagcaattgcattgtaaagctttattattcctttcaagatgaagagtacttatatctcataatggagtatctacctggtggtgatatgatgacgttgctcatgcggaaggatatactgacagaaaatgaggccaggttctatgttggggagactgtcctagctatagagtcaattcataaacataattatattcatagagatatcaagcctgacaacttgctgctagatagaaatggtcacatgaaattatcagactttggattatgtaaaccactagactgcagtaatcttcaggaaaaggacttctctattggaagcaacagaagtggagcccttcagagcgatgggcgtcctgtggctcctaaaagaagccaacaggagcaactgcagcattggcagaaaaataggcgaatgctagcctattctacagtcggaacacctgactatattgcccccgaagttcttctgaagaaaggatatggcatggaatgtgattggtggtccctgggagcgataatgtatgaaatgttagtggggtatccgcccttttattcagatgaaccaatgttgacttgtagaaagatagtaaattggagaaattatttaaaatttccagaagaagttaaaatttcggcagaagcaaaggatcttattagtagactcctatgtaatgtggatcagaggcttggaaccaaaggggctgatgaaataaaggcgcacccatggtttaaaggtattgaatgggacaaattgtaccaaattaaagctgcttttattcctgaggttaatgatgaattagatactcaaaattttgagaagtttgaagaggctgacaaccaaactcaaccttcctcaaaatcaggcccatggagaaagatgctgtcatctaaagatgtcaactttgttggttacacatataagaactatgaaatcgtgaatgatgatcaactacctgaaattgctgaattgaagaagaagagcacaaaacctaagcgaccatctattaagaccctatttgatgatgaatcagctacagctgccaatcaacctacccaagggagcttcttaaaactgttacctactcaaccagaagttcctgagaagagtgaatctcaatga

SEQ ID NO: 1200 - DNA, 1398 bp, Glycine Max
atggataggtgctggtttaataagttcaagccaaaggataaaacaccatcttcaaaaaacaaggaaacaggcattgcaaaagggtcaaaacccccaacaaatgatgaagcaccttccaatgtgaccaaacagaaggttgcagctgcaaagcagtacatagaaaaccactataagaaacagatgcaggacttgcaggagagaaaggaacgacgtaatatgctagaaaaaaagttggctgatgctgaagtttctgaggaagagcagaacaatttgcttaaatattttgagaaaaaggagagggaatacatgcgccttaagaggcataaaatgggggctgatgattttgagcccctgactatgatagggaagggtgcatttggagaggtcagagtctgccgagagaaagcaaccggtcatgtatatgctatgaagaaacttaagaaatcagagatgcttcgcagaggccaggttgaacatgtaaaagctgagaggaatctacttgcagaagttgatagcaattgcattgtaaagctttattattcctttcaagatgaagagtacttatatctcataatggagtatctacctggtggtgatatgatgacgttgctcatgcggaaggatatactgacagaaaatgaggccaggttctatgttggggagactgtcctagctatagagtcaattcataaacataattatattcatagagatatcaagcctgacaacttgctgctagatagaaatggtcacatgaaattatcagactttggattatgtaaaccactagactgcagtaatcttcaggaaaaggacttctctattggaagcaacagaagtggagcccttcagagcgatgggcgtcctgtggctcctaaaagaagccaacaggagcaactgcagcattggcagaaaaataggcgaatgctagcctattctacagtcggaacacctgactatattgcccccgaagttcttctgaagaaaggatatggcatggaatgtgattggtggtccctgggagcgataatgtatgaaatgttagtggggtatccgcccttttattcagatgaaccaatgttgacttgtagaaagatagtaaattggagaaattatttaaaatttccagaagaagttaaaatttcggcagaagcaaaggatcttattagtagactcctatgtaatgtggatcagaggcttggaaccaaaggggctgatgaaataaaggcgcacccatggtttaaaggtattgaatgggacaaattgtaccaaattaaagctgcttttattcctgaggttaatgatgaattagatactcaaaattttgagaagtttgaagaggctgacaaccaaactcaaccttcctcaaaatcaggcccatggagaaagctgaattga

SEQ ID NO: 1201 - DNA, 900 bp, Glycine Max
atggatagtgacggcctgcaccccctccaaaagcctgcaaaagcctgccctaactcgctagtcatggtggcaacttccacctgcaggcaactcgccactacgagtggcgtttttcatgccacgtggcttcgcacagcaaactcgccattgacaataacggtttgctatagaacccatgcaaagtacgtagaaaacaacccccatgtaatatttttcaaaaggaccccatttgggaaaatattttgtaaaagcaccccatctggggaaatttgcctcatgttcctctttacaagatttggtgaaaaaacccttacccgttatgagcgagttttgcgaagccttagtgagtgttcaaaacgtgatagtgagacatttctgaatgaggatcaaatcaaagaactagccactgggttagaactcattggcttacctttcattttggttttgaatttcccatccaatctctctgccaaagctgagttggaaagagcattaacaaaagggtttttggaaagagtgaagaataggggagtggtgcacactggttggtttcagcagcagcttgcactgaagcactcaagtttggggtgctatgtatgccatggtggctttagttctgtgatagaagctttgattaatgagtgtcaactggtgctgttgcctttcaagggtgaccagtttttcaattctaagctcatagccaatgatttaaaggcgggcgtagaggtgaataggggtgatgaaggtgggttctttcacaaagaggatataatagatgcaataaaaactatcatgatggaggataacaaagagcaagggaagcaaacaagagaaagccacatgcaatggagcatgtttttatcaaatcaggaaattcagaacaaattcatcacagatatg

SEQ ID NO: 1202 - DNA, 1572 bp, Glycine Max
atggatcaagacagttctattgggaaagttttcaagttcacacatgttctggctgcctccttcgccggtttagttgccgccgccgccgcctcaagctaccggcgggcaccgtccacggtggtgggagagcagaagaaggttattcccgagctacgtaggacggaatctgggcgtctcggggagatcgaaaagttctcccactatgttgcaaggcaaatggggtttgaagatgctgatgaggttccagagctatgcatattggcccaagagtatttgaaaaaatccaaagggtgcgatgaaagcatctttgaatatatttccagtggcaatgtggagaacactgattctctatatgcgaaattagttgaggagttagagagatgcatcctcagttatttagcatttcactggaaccaagctacatctgtcattagtcaggttttgggtgtggagtctcagcagaaaaaaaagctgaagggaattctattggcagctacaagggaacagaggtttgatagagtaaccaagaatctgaaagtgacaagagtgatctctactttggtggaagagatgaaagcaataaatggtgactcgcaatgtacagaagtgatggtgcccatggcccacagtgagaggagtccagtcctgctgttcatggggggtggcatgggagctggaaagagcactgttcttaaagacattcttaaagaatcattttggtcaggagcagcttcaaatgctgtggtggttgaggcagatgctttcaaggagagtgacgtcatatatagagcccttagctccagaggtcaccatgatgacatgctccaaactgctgaattggtgcatcaatcttccactgatgctgcatcatctctgctggtgacagctctaaatgagggtcgagatgtgatcatggatggtaccttatcatgggaaccatttgtggagcaaactattgctatggcaagaaatgttcacaaacacaggtaccgaatgggggtagggtataaagtagctgaagatgggacaattactgaaaattactgggagcaagtaaatgatgcagaagagcatcaatcagaggaaatttctaatggagaagcacacacccaaaagccttacagaattgagctagttggtgtggtttgtgatggctatcttgctgttgttagaggcattaggagagctattatgacagggagggcagtgagagtgaattcacaactgaaatctcacaaaagatttgctaatgcatttccaagatattgcaaacttgttgataatgccagactctattgcacaaatgctgttggtggtccaccaaagcttatagggcggaaggatggtgatcacaatctactagtggatcgtgaagagatcaagtgcttggaaacgttaggcagtttgaatgctggagctgattccatctacgaacttcacaaagaacccagccccataatggaacctggttctgtttggaatgatatagttatgtcaccttcaaggccaagtgatcaaaaagaattgaaggaatctattcagaaaatagagaaatccatccgaaaaatgtaa

SEQ ID NO: 1203 - DNA, 639 bp, Glycine Max
atggatcaatactcagcctcagtagaggagcgagatatcgtttgttgtttcttaattttcccaaaaattggagaagatctaagtagaacaaatcatccggtaaggaacctacgcgttaaaggacattcagcccaatcagagtcacatcaatcagatagttgtaggtcacaatccttatgcaacaaaacaccctatccagattccctttcagcctgttccatagttcaaacctctttcaaaccaaaggcacttgttcttcttgtcaccaaagatgtttctgcctcagaaggctatgtctctcattcacctctaaaccagtccgttgtggctctgctgattgcttacttttcgggaaacacgaatgaggaagtggtgtggagcatcattggtgcgaattcaatggtgcagtttaatgacgtaatttgcttgggttttggggatgctggatcagacccaagtgcagaccaagttggagctgtggtgggtggttttcacctaatgacttcaatcacaattggagcaaatcagttggagaacaacatgctacaatttgatttagcaacctcaaggcttggcttctgctcgctcttcttggagcacactgactgtgctaactttaactttacctcttctgcttag

SEQ ID NO: 1204 - DNA, 1371 bp, Glycine Max
atggatcatgttattggtggaaaattcaagcttgggaggaagattgggagtggatcgtttggagagctttacttaggtgttaatgtgcaaagtggggaggaagtggctgtgaagctggaatctgtgaagaccaagcacccacagcttcactatgaatcaaaactatatatgcttcttcaagggggaactggtataccccatctaaaatggttcggagttgagggtgactacaatgtcatggttattgatctccttgggccaagtcttgaagacttgtttaactattgcaatagaaaattatccctgaaaacagttctgatgctggcagatcagctaataaacagagttgaatacatgcactcccggggttttctgcatcgcgatataaagcctgacaactttttaatgggtttaggccgcaaggcaaatcaggtatacataattgattatggcctggcaaaaaagtatcgggatcttcaaactcataagcatataccatacagggaaaacaaaaatctcactggaactgctcggtatgcaagtgttaatactcatttgggagttgaacaaagcagaagagatgatctagaatctctcggatatttgctcatgtattttttgagaggaagtctcccatggcaaggcttgagagctggcactaaaaagcaaaaatatgacaagataagtgagaagaagatgcttactccaatagaggtcttatgcaagtcatatccattggagtttacatcatacttccactactgccgaacgttgcggtttgaagataagcctgattattcttatcttaagagactatttcgggacctattcatccgagaaggttatcagtttgattatgtatttgattggactatgctgaagtatcctcaaattggatccagttctagagcccgaccaagtgggaaaccagtcataaaccccggacaatcaggagagagaatagaacggccttcagggggtttctcaggtgctgttgaggcatttgcaaggaggaatggctctggacttgttctgcaaagtgagcattctaggcataggtcttcagatgatgtgccatcttccaaagacgtgcaagctgattctgagaggcctcgcagctcttctcgtaatggcagttcttcaaaaaagcctgtcttgtcaagcagccggccaagctcttctggtgagccaagtgaaagccgtactagccgactggtcttaagcagtggccgactatcaacaactcagagacttcaacctggttttgaatccaaaacatctttatctcgggcttcggcaacaagaggtggtcgtgatgatacactcaggagctttgaactcctgtcacttggttcaggaaaaaggaaatga

SEQ ID NO: 1205 - DNA, 3303 bp, Glycine Max
atggatccatcatcgtcaccactccgccaaaacgacgtcgcttccttcgaccgccaaacttcttctagaatatacttgcactcctcctcttccgacgacgacgtttcgccctcccactctatccaatccaccaaccgccgtctcgattacatgctccagttcctcgaccggaagctctcctccgaccacgcccaccgccgccactcatccggctcccgcgccgcgcaactgccggagttcgtcgcgaagggcggcggcgctggcatcttccgcctccctgctcgcggcgcggtgcacccggcgcggccgccgagccttgaactgcggccgcacccgctgcgagagactcagattggacgtttcctgaggaacattgtttccaccgagtcgcagctatgggcggcttcggagtgcggggtaagattctggaacttcaaggatctgtacgcgtcgtggtgcggcgtaggagaagaagaaggagtggttgcgaggaacggcgacgaggagagtgcgccgtttcgagagtcggtgtggacctcaccaacgttgtgtttggttgcggatgaggggaacaggttggtttggagtggacataaggatgggaagattaggtgctggaagatggatgatgatgacgatgataacaacaacaacaactgcgattggagcaatcggtttacggaaagcttgtcttggcatgctcaccgtggacctgttctttcccttaccttcacctcttacggggatctgtggtcgggttcagaaggaggaggtataaaaatatggcctttggaggctgttgaaaaatctattcatcttacaaaggaggaaaggcacagtgctgccatatttgtggagaggtcctatgttgacttgaggagccagctatctacaaatggcttcagtaacatgctaacttcagatgtaaagtacttagtatctgataattcgagagcaaaggtgtggagtgctggctatttttcatttgctttgtgggatgctcgtacaagagagctactgaaagttttcaattcagatggacagattgagaatcggttggatgtgtcctcaattcaagacttttcagtggagcttatttcaagttcaaggaaagacaaaacacaaagttccattgggttctttcagcgttcacgtaatgccataatgggggcagcagatgctgttcgtcgagttgcagcaaagggaggctttggggatgataaccggagaactgaagcactagtggtaacaatagatggaatgatttggacagggtgtacaagtggcttactggtgcaatgggatggaaatggcaatcgcatacaagattttctctaccattcatcttccattcagtgtttttgtacttttggcatgcaaatttgggtaggctatgtgtctggcactgtccaggtattggacctcaagggtagtctgattgggggatgggtggctcatggcagtccaattgtaaaaatgacagttggcgctggttatgtatttgcattggctaaccatggtggcattcgtggatggaacatcacctccccaggacctcttgatagcatattgcgttcagaattgggtggcaaagaatttttatatactaaaatagaaaatataaaaatattgagtggtacctggaatgttggacaaggaaaagcatctctagattcccttacttcatggctaggttctgtggcctcagatgttagccttgttgttgttgggttgcaagaggttgaaatgggtgctggatttcttgcaatgtctgcagctaaagaaacggtaggattggagggaagttctgttgggcagtggtggctggatatgatagacaaaacattagatgaaggttcaacatttgaacgtattggatccaggcaacttgctggcttggtcattgctgtgtgggttaaaaccaacattagatttcatgttggggatgtcgaagtggcagcagttccatgtggctttggacgtgctattggcaataagggagctgttggtttgagaattagagtgtatgatcggataatgtgctttgttaattgtcactttgctgcacatttagatgcagttggtcgtcgcaacgcagattttgatcatgtataccgaacaatgtccttcagtcggccaacaaacctcttaaatactacagctgctggcacttcatcttctgttccaacgtttcgtggtacaaattctgcagaagggatgcccgagttatctgaggcagacatggttgtgtttcttggtgattttaattatcgacttgatgacatttcttatgacgaagcaagagattttgtttctcaaagatgctttgattggcttagagaaagggaccaacttcgagcagaaatggaagctgggaatgtcttccaaggaatgcgtgaagcaattataacatttcctcccacatacaagtttgaacggcaccaagttggtttggcagggtatgattctggggaaaagaaacgcatccctgcttggtgtgacagaattttgtatcgtgatagctgcacttctttgttgtctgattgcagtttagagtgtcccattgtctcctcagtattacagtatgaagcttgcatggatgtcacagatagtgaccacaagcctgtccgctgcatattttctatagatattgctcgagtagatgaaccaatccggaggcaggagtttggagagattcttgagtcaaatgagaaaattaaatatcttctgaaagaactatgcaagattcctgaaactatcattagtacaaacaacataattcttcaaaaccaggacacattaattttgcgtattacaaataaatgtgcagaaggcaatgctttgtttgaaataatttgtgaaggtcagtctactgttacaggggatcagaaggctactaaccatcagttgagaggttcctttggcttcccaaggtggcttgaggtgagtcctgcaactggtataataagaccagatcaaattgttgaagtatcagtgcatcatgaggaatttcagactctggaagagtttgttgatggcgttgtacaaaattcttggtgcgaagactccagagacaaggaagctattttggttgttaaggtgcatggcaattacactatccagccaagaaatcaccgagtccgtgttcaccactgttattcatccaagaaaaaacctatgattgactctcaaccagatagctccaggcatatccaaggaactgtactacaccgatctgatttccaaccattcagcagttcctgtgatgtggttgaccagctacagaaattgcatagcccttga

SEQ ID NO: 1206 - DNA, 1374 bp, Glycine Max
atggatctccttcaccaatactcagacggcgacgatcccgactccccctctgaaaaccctagctcccctccgcgcctcctcccgggacgctccgccgcgcccaacgtcgacgacaccatgctggccctcaccgtcgcctcctcctcctcggccctctcgcggcccatcgaccctacccagcacctggtgggcttcaacccctcctacgaccagctctgggcccccatccagggcccggcccaccccttcgccaaggacggcatcgcccagggcatgcgcaaccacaagctcggcttcgtcgaggacgcctccatcgaacccttcctcttcgacgagcagtacaacaccttccacaagttcggctacgccgccgaccccgccgccaacaacttcgtcggcgacctcgacgcgctacgcgacaacaacgccgtctccgtctacaacatcccccgccacgagcataagaaacgccgcattgaggccaagcagaagaagaaatcagaggaagacgacgacggcgacgtcaacgaggagatcgaaaacccggcctcggaggcgtggataatgaagaacaagaagagcccttgggcagggaagaaggaagggttgcaaggagaattgactgaagaacagcagaagtatgcggaggagtatgcgaagaagaaaggggaagagaagagtggtttgggaggggagaaagttgaggttgttaaagataagagcacctttcatgggaaagaggagagggattaccaaggggtttctgctattaggtttttccccaagtatggccacttgattctctctgccggcatggataccaaggttaagatttgggatgttttcaactctggcaagtgtatgaggacctacatgggacactcgaaagccgttagggatatttgtttcagcaatgatgggaccaagtttttgagtgctgggtatgacaagaatattaagtattgggataccgagacggggcaggtgatatcgacatttgccaccggcaaaattccttacgttgtgaagcttaatccggatgaggataagcagaatgttttgttggctggaatgagtgataagaagattgttcagtgggatatgaataccggccagataactcaggagaggtttgttacttccagtgatgataagtcactcagggtatgggaattcggtattcctgtggttataaagtatattagtgaaccccacatgcactccatgccttccatttcgcttcaccccaatgccaattggcttgctgcgcagagcttggataaccagatacttatttatagcactagggagaagtttcaacttaacaagaggaagagatttggtggacatattgtggctggatatgcatgtcag

SEQ ID NO: 1207 - DNA, 444 bp, Glycine Max
atggatgaagaagggtcgagggggagggctaaggaggatgccggagatgtccggtaccggggggttcggaggcggccgtgggggaagttcgcggcggagattcgagactccacgaggcagggtcagagggtgtggctggggactttcaacactgcggaggaagcggccagagcctatgatagagctgcttatgccatgagaggtccatttgcaatccttaactttcctgatgagtaccctatgactgctggtggtgccactaatgctgccacttattcctctgctgcttcatcatcatcctcagcctcttcttctaggcatgccaatgtggaagctagaggaagaagtgagcaaggaagggaagtgtttgagtttgagtacttggatgacaggttgttggaggagcttcttgattgtgaggacaaaaagaaaaggggaccctga

SEQ ID NO: 1208 - DNA, 453 bp, Glycine Max
atggatggtatagttcagctggagaggcaacttgttgattatactgcttctctatttcatgagggctttctagatgaccaatttaaccagcttcagcaacttcaagatgaaagtaacccagattttgtggttgaagtggtgactctcttttttgaagacgcggataggcttcttaatgagctcacaaaagcactaggccagccaagcattgattttaaaaggttggatgctcatgttcaccagttgaagggtagcagctccagcattggagctcagagaattcacagggtctgcatttccttccgaaacacttgcgaggagcaaaacgttgaaggctgccttaaaaacttgcaacaagtgaaacacgagtattccttggtgaaaagcaagcttgaaactctcttcaggatggagcaacagattttggccgcaggtggatcggtttctaggtag

SEQ ID NO: 1209 - DNA, 2607 bp, Glycine Max
atggatggtgaaagagaaaccctagaggagcctatagaaaaggagggatctttggttggggatgggaaggacctaaaggtgggggttttgggttctgatttgtgcatagaaggtgttgtttgcactcgtgagcgtgatgctgagctgaatggtgatgtgggttttgatggatcaaaagaggagggtaaaggtgtggatccttcaggtggagaagctgctgaggctcttggtgaggattctcaagttttgagatccttagaaagtaagagcgtgaatgagattgctgagttagatggaaatgaagctaccttgaaaacattggatgagcagaagaacattgatgacaaggaggtcaataagttagtggagaaagaagcaattagtgatgttattcaggctgagccagatgttacgcaaagcattaaagaacatgctggggatcttggtgaaggttctcaagttgtgaggtccttagaaggtaagagtgagaatgagactgctgagttggatggaaatgatgtcaccttgaaaacattggatgagcagaagaacattgatattcaggttgagtcggatattagtcaaagcattgaagggcaagctggcattgctgagcaggttggttcacaaggagagcaggaaattgaaggtgaaaaacttgatgatgctaaacagcgaaaaccaacacatggaagagttgcaaagcatgtgtcaaataaaagttcaggaaacattcttcaagcaattttcgtgtatgatatggtttggggtaaggtgaaaagccatccgtggtggccagggcagatatttgatccctcggattcgtctgtggaggcaaagaagcatttaaaaaaggaccgccatttggttgcgtattttggggatagaacatttgcttggaatgagtcatctcagctaaagctctttaggactcatttctctaatgttgtaaagcagagcaattcagatgcatttcagaatgcagtagattgtgctttggatgaagtcgggagatgtgcagaatttgggttagcatgttcctgcatacctaaagatacttatgacgagattaagctccaaactgttcaaaacactgggattcgagaagaactaagtttcacacgcagagtggatgaatctttaaatgctagttccttttcacctgagaacattttggaatacttgaaaactctatccgagtttccaactggtggctttgatcgattggagcttttaattgctaaggctcagttgcttgctttctatcgtttgaagggttactcttgcttgcctgagttgcaatattgtggagttgtggataatgacactgatgccttcttaattaaggacttaattaagggctctgataaaagtcaaactggtgctggaaatttgaagacagcaaatggctcctgtctcaaacgcaaacataatttgaaagatgatttatatccagaaaagaagaaaataattttgtcagaagcagcaggtgggactccagattcttcacttggtaattatcagccaggtgatgccactgataatctgatttctcctgcctcttccaagaaaaggaagactattgatcactgtgctggtgtttcagggatgaaagataggagaaaaacaatttcccttgccaaagtttcaaataccataaatcaatcatttaagattggtgaacgtattctaagggttgctaatcaacttactggaccaccctcctctatgttgaagtgttctggagacaggactcaaatggaagatggaagtgctgatggttttccagggaatggatctgatgtcttctcccctaatcctgagaagactcagaagtcaagcttcactgttccaacggaatattcatctctagatgatttgctacatttacttcagtgggtagcacatgaacccctgggagattatagttccctgaatgttatagtgagcttcttctctgatttcaggaattcaataatcgtggccaatgattctggaaaagaaaattttcctacaaagaaagttggtgctaaaaggaataaacgacctgtgggtggatcacctgaaacatttgaatttgatgatctgagtcatacacattggactgacatgggcatccagagtggttctgaaaaacagcagtcacagagaagcagcagaagagactatcaacatgcccctgctgagccagaaaaaccttttatagtttatactcgtaggtcctattccaggaaacaatgttctgacagcaatcatgttgcagttcctgaaaagcattctggttgtgcagatgagaattccccagttgagcttgttttaaactttgctgagctggattctgttccctcagaaatgcgcctaaataagatttttaggcgatttggacctctaaatgaatctgaaacagaagttgatagagggagcagccgggctagagtggtttttaagaagtgtgttgatgcagaggttgctttcagtagtgctaaaaagttcaacatatttggatcagttcttgtaaattacaagcttaaccatactccaagtacattatccaaagcttcatctcttgccacaactcaagaccaggagaacggaaatgcatcttga

SEQ ID NO: 1210 - DNA, 1623 bp, Glycine Max
atggatgtggaggaaactgagaagttggtgtctttggacccagatttgttgctgcttccggaggtgtctccttttgcactgaaatcgagtccttacgttgttgaggagctattcacacagtggctttcgcttccagatacttgtcgcctggttaagtcattgcttgctgatgcaaaggcaggagctcgtttgagtgcacttgagaactcaacaaatacaaatgctctgtcaatcaactctctaccttccttgtttcctgctgggagtacaccaccactttcaccacgcagctcatctggttccccacgtaccacaaaacagagaaatagtccttcattaggatctccactaaaattagccagtgaacctgtaagggagagggaggtcattccgcagttctacttcaaaaatggccgtccacctccaagtgaaatgaaagagcatttcatttatcaaattgatagtagattttatggtcatttggatggtctacaattacatgaatttaagtctgttacaaaagagctctgcaaacttccctcatttttctccactgctcttttcaaaaagattgatgtcaattttactggatccataacaagggatcaatttatagactattggattcggggcaatatgttagctatggatttacccacacaaatatataccatactgaagcaaccatatcgaacataccttgtacaggatgatttcaaacctgtcctgagggaactattgtctactcatcctggattggagtttttgcaaaccacgcctgaatttcaggaaagatatgctgagactgtcatacacagaatattttactacatgaatagatcaggaaatggccgacttacactgagggaattgaaacgtgggaacctaattgatgcaatactacatgtagatgaggaagaggatattaacaaagtactgaggtacttctcatatgagcatttttatgtcatttactgcaaattttgggagctcgacacagatcatgactttttcattgatagagagaaccttattaaatatgggaaccattctcttacctatcggattgttgatagaattttttcccaggttccaaggaaatttaccagtaaaattgaagggaagatgaactatgaagattttgtttattttatacttgccgaggaagataagtcatccgaacctagtctcgaatactggttcaaatgcattgatttggatggaaatggagtgctgacacctaatgaaatgcagttcttttatgaggagcagttgcatcggatggagtgcatggcccaagagcctgtgctgtttgaagatatattgtgtcagattgtggatatgattggaccagagaatgagggatatatcacattacgagatgttaaaggcagtaaactttctggaaatgttttcaatattcttttcaatctcaacaagtttattactttcgagactcgtgatccatttctcatacgtcaggaacgtgaggatccaaatttgacagagtgggatcgttttgcacatagagagtatattaggctttccatggaagaagatggtgaagatatgtcaaatgccagtggagatgtctgggaagaatcacttgaggcccctttctga

SEQ ID NO: 1211 - DNA, 1623 bp, Glycine Max; identical to SEQ ID NO: 1210

SEQ ID NO: 1212 - DNA, 1770 bp, Glycine Max
atggattaccttaagtccgcgcttccttctcaaataatgtcagaacgaggctccaatctggttgttatcaacccaggttctgcaaatgttaggattggcttggcttcacaggacaccccttttaatattcctcattgcattgctcgccataccaaacaaattcctaactttactgttatagatcagatgcttaatagtatggttacaacaacacagctcatcgaaagggaaaaagcttatgattttattgcaccattgttgaagataccgtttttggatgaaggtcccggtaactctttcccccgtaagatgggacgtgttgatggacacaatcctcatatcaggaaggatttgccgttgacctggactaatgtctatgaggaggccactaattcatctgtatcattagagacttcaagtaaagatgagactggtcagtttttggatccaaaagaaggtacacattcaaaggaacctaatgcaagtgaaagaaaattcaaagagttcatttgtggtgaggaagcattaagaatatccccaactgaaccatattgtttttgccatccaattcgcagaggacatttgaacatttcacaatattattccatgcagcaggtacttgaagatctacatactatttgggactggattttaatagagaaactgcacattcctcacaatgaaagaaatatgtattctgctgttcttgtgatgccagaaacatttgacaatcgtgaaataaaagaaattctatctttagtactacaagaactccgctttggctcagcagtggtacaccaggaaggtcttgcagcagtttttggaaatggattatcaacagcatgtgttgtgaatattggtgcccaggtgacatcacttatatgcattgaggatggaggtgctctaccttcaaccggaaagactttgccttttggtggtgaggatatatcaagggcttttctctggacccaaagacactaccagacttggtcaccagttcattcagatgtttttgcaaaacctatagatctgctaatgttaaatcaactgaaagagacatattgtgaagtcaaggagggggaacttgatgctgttgcagtagttcattcctatgcggaaaaagtgccagctgtgtctcacaagacaaggctttctgctcttaatgttcctcctatgggattgttctatccaacacttttaactcctgatgtgtatcctcctccgccccgtacttggtttcacgactatgaggatatgcttgaagatacatggcatattgacttttcgcggaggtctgacatgccagatactttctatcccaatgttaatggaggattaccaatgtgggaaagctatccagttttttcaactaagccaaaaaaagaagagaaagttggccttgcagaggctattactaactgcattctctcaactggtcgcatagacatccagagaaaattattttgtagcatacaattgactggtggggtggctttgacaagtggcttagttgcagcagtagaagaaagagttttacatgccattcctccaaatgaagcaattgatactgtggaggttctacaatcaaggacaaatccgacgtttgtgtcttggaagggcggggcgattcttggtgttcttgatttaggcagggatgcatggataagtcgggaggactggattcacaatggggtccatgttggaagtaacaaaaaatacaaggattcatattatcttcaagctcaagctatgtgttatatgaattcttga

SEQ ID NO: 1213 - DNA, 645 bp, Glycine Max
atggattcaccttcctccttcttcaactcaccctcttccgatttctcctccgaatcttcctctccggaagcgttctcgtgggaagggtaccttcccttcaacgagaacgacccggaggagatgcttttgtacggcatgattgccggcgccaccaccgtggatcactccttcgagaggacgagctcggaggagagtgaggcggcccggaagaagaagtcgtacagaggtgtgcggcggcggccgtgggggaagttcgcggcggagataagggactccacgcgtcacgggatgagggtgtggctgggaacattcgacagcgccgaagccgcggctctggcttacgaccaagccgcgttctccatgcgcggttcggcggcgattctcaacttccccgtggagatcgtcagagagtcgcttaaggagatgaactatgcaaatgattccaacaacgaagaagggtgctcccctgttgtggctctgaagaggaaacactccttgagaaggaaaattagcgtcaagaagaacaacaacagcaaactacaaagtagtaccgtagacaatgctgtcgtgtttgaagaccttggtcctgattacttggaacagttgctgatgtcctctgatcatcatattcccaccaccttctga

SEQ ID NO: 1214 - DNA, 1431 bp, Glycine Max
atggattcggatcaaggcaagcttttcatcggtgggatttcatgggatacgacggaggacaagctcaaggagcatttcggtaactacggcgacgttttgagcacttccgtcatgcgggagaagaacactgggaagccaaggggctttggtttcgtcgtttttgcggatcctaacattctagatagggttttggaagacaaacatgtcatagacggcagaacggttgatgccaaaaaggccttctcaagagaggatcaacaaatttctgtcacttccagaggtggaaattccaattctggcatgaattctgaaaatggaggaaacatcaggactaaaaagatatttgttggagggttgcctcccaccctgactgaagaaaaatttcgtctgtactttgagtcttatggacatgtaactgatgtagtagtcatgtatgaccagaatactgggcgtccacggggatttgggtttatttcatttgatactgaggaggcagttgatagggttttgcacaaatcatttcatgatttaaatggtaaacaagttgaggtaaagcgtgcacttcccaaggatgccaatcctggtgcaagtggccgtatgatgggtggtgctggaggtggtggtgctggaattggtgggtatcaaggttatggggcatctggtggcagccaaaatgcatatgatggtcgtatggattctagtaggtatatgcagcctcaaagcgctgcaggtggattccctccttacggttcttctgcctatagtgctcctgggtatggttatggtccggctaataatggcattggttatggtgcatatggaagttatggtagtgccactgctgggtatggtggacctgctggtgcaacatatgggaatcctaatgtccctaatgctgcttatgctggtggtccacctggtggcccaagaagttcatggcctgctcaggctccttctggttatggatctatgggttatgggaacactgctgcttggggtgctcctagtggtggtgctggatctggtggtggcggtcctggttcagcaactgcaggtcagtcccctggtggagctgctggatatgggaatcaaggttatggatatggtgggtatgctggatatggtggaagtgatagttcttatgggaattcaagtgcatatggtactgttggtggacgtactgggagtggtccaaacagtaatgctagtgctcctggtgggactgaactaacaagtagtggtggcagtggcaactatatgggtggtggctatggggatgcaaatggaaattcaggttatggaaatgcagcttggagatctgaacaaactcatgcatctggaaattatgggactcctcagggaaatggtgggcaagttggttatggtggtggctatggtggtgctcagtctcgacaagcccaacagcagtaa

SEQ ID NO: 1215 - DNA, 1113 bp, Glycine Max
atggattctaagaatgttgttgcttttcaagttgtcacattttgtatatgcttggctgtggcaaattcagttgactttggttacccagcagttttcaactttggtgattcaaactcagacacaggtgaactggctgcaggaatgggatttctagttgtcccgccttatggacaaaattacttcgaaaccccatctggattccactatattgggcccaaggatcataagcgtacccctcttcaatcggacggtcctaagcccctcaagtgtcaaagccaaaaagacgggggcgctttggattcgatgaaatttccattcttaaatgcctacatggattcagtgggtttgccaaattttcagcatggatgcaactttgcagcagcaggttcaactatccttccagccactgccacatccatcagctcgtttggatttgaggttcaggtatttcagtttctgagattcagagctcagtctcttcaatttcttcaagtttcaggaaagaaatttgatcagtacgtcccaactgaagactattttgagaagggattatacatgtttgacataggccagaacgatcttgatgtgcatttttattcaaattatttcctaaaagtttctttacttccaaaaaactgtatgacagcggggctaggaatttctggatacataacacgggtccactcggatgcttgcctcagggccagtatccagatgcaaatgttacacgttgatgtttttaccataaaatcaaacctcattgcaaactattctaaatatggtgagattttggatgatgattgtttcctagagattttgatgtttatttttatagattttaaattcctcatatcatattgtgatatggccttggcatcgtgtgattatttgttggggcaaacattgaactttgacagtcaagcttcatgcgggctagcaaagatcttggatggaaccacaataacagcaaaaggttgcaatgacagcagtgtgtatgtaatctgggacgggactcattacattgaggctgcaaatcaatatgtggcatcacaaattctcacaggaaactactccaacactcttttgggaggcaaattgcccttccttctctag

SEQ ID NO: 1216 - DNA, 681 bp, Glycine Max
atggattgttacttgcattgccttcatcgtcctcttggtgggtgttgtggtggcaacatcagtccgaaggctattcggattgtcaatcatatatcaaagcagaccaagcaacaacatccttctccagagaaggatcaaacaagaacctcactgtcgtcatgtcacccgccttggcatacccatcaatcatggtgacatcccatgaaacaccttacaagcatcagcaatatccctgcatttcctatacatgttgatcaaaatggtgcccttgtagagatcatggtcaatgctgcacagaaacgcgaaaccatgaagcaattttccctcccttaccttgcatgcaccagaataggccttaatgacaaaagggtaggtgaagctataggggagttccccatgtgccttcatgcgagcgaagacggagagggtgtgggaaaagagattcttttggcagtgggatttgacgagagtgttccagaggaaggtgggaagggcgagaacgtggtagaagatggaaaaggcataggagaaagtggagaggagggtgtgggcgcaggaaatgaagagggaaacgaggaagtggtcttgctcgagggcgtgatggatgacgcacgcttgcatttgtttcaggtgctcacttttcttgctggctttgaggagggtggtgatgcttgcagctga

SEQ ID NO: 1217 - DNA, 573 bp, Glycine Max
atggatttgattcctaaccctaatgctaaccccaagcaacctgcgttttgcctaaaatggccatggaatgatgcaaaccataactctaactctaaccctagtccctgcaattttgagggtccatggctattcaagtcactccaaaacgttggcttaatcgctttcaattttgcgagctctttttcgagtcggaagaagaaaacgagtccagcggcagcgtcgtcgtcggaggcagagcagagagcgtttgcgtcggctctggccagcgggaaggaggcgactttggtggagttctactcccccaagtgtaggctctgcaattccttgctcaaatttgtctccgaagtcgaaaccaggaactctaattggctcaacattgtcatggctgatgctgagaaccccaattggctacctgagctccttaattatgatgttagctatgttccttgctttgtgcttcttgacaacaatggaaaggcccttgcaaagactggtgtcccaaatagtcgtttacatgttattgcaggactctcccatcttctcaaaatgaagcgtcctcaacaaaattattga

SEQ ID NO: 1218 - DNA, 1941 bp, Glycine Max
atggcaaaagctacttccggaaccgtcaatcctcacagccgtaccggagttcgtatcgtcgtcgccggagaccagggcaccggaaaatctagcctcattataaccgccgccgccgataactttccggtgaatgtgctgccggtcttgcctcccacgcggttgcctgaagatctgtatccggatcgcgtgcctatcaccatcatcgacacttcttcccgtgctgaggatagcgataaagttgctgaagaattgcagcgggctgacacagttgtccttacttatgcatgtgatcggcctgagacacttgaaaatcttagtatattttggcttccacatcttcgcaaactagaggtgaaagttccagttatagtagttggttgtaagcttgatttgagagatgagaatcagcaggtgagcctagaacaggttatgtcaccaattatgcaacagttccgcgagattgaaacttgcattgagtgttcagcatctaggcatattcaggtccctgaagttttctactatgcacaaaaggctgttcttcatccaacagctccattatttgatcaagagtcacaaactctaaagcctcgatgcgtgcgagccttgaagcggatttttatcctttgtgatcatgacagagatggtgccctcagtgatgctgagctgaatgattttcaggttaaatgtttcaatgctcctttgcaaccatctgaaattgtgggtgtaaagaaggttgtacaagaaaaattgtctgaaggggtgaatgaacgtggacttactttgactggattcctatttcttcatgcccttttcatagaaaaagggcgtcttgagacaacatggactgtgctcaggaagtttggatataatgatgatatcaagcttgctgatgatctaattccacctataaaatgtgctcctgatcagagtgtggagctgacaaatgaagcagttgagtttttgagggcaatttttgatgcgtttgatggtgatggggatgggatgttgcgacctcgtgaacttgaagaattattttctactgccccggaaagtccttggactggaattccatatgaggatgctgcagaaaaaaatgcctttggaggactatcactagaagcatttttgtcagagtgggcacttatgacacttctaaacccaacttttagtgtggagaatctgatatacattggttatcctggtgattcatcatctgctattcgtgtgactaggaggcgacgtttggatcgtaagaagcagcattcagacagaaatgttttgcagtgctttgtttttgggcctaggaaggctggaaaatctgcattattgaattcttttattggaaggccatattctgaaagttacaatccaaccactgaagatcgttatgctgtaaatgtagttgatatttctatggaaaacagaaaatatctagtactgagagagattcctgaagatggagttaggaagctcctatccaataaggagtctttggcctcatgtgacattgcagtttttgttcatgacaggtctgatgaatcctcatggagaacatcgtccgaactcttggttgaaattgctagccatggagaagataccggctttgaggtgccttgcctgatagttgcagctaaagatgatctggattcatttccaatggctatacaagagtcaactagggttagtcaagatatgggagttgaggctcctatacctatcagtgtgaaattaggagatttcaacagtctgttccgtaaaattgtaacggctgctgagcatcctcatttaagcattccagaaactgaagctggaagaagccgcaagcagtaccacaggcttattaatcgatctcttatggctgtttcagttggagctgcagtggtcgtagttgggctggcagcttatagggtatatgctgcaaggaagaatgcgtctggttaa

SEQ ID NO: 1219 - DNA, 1941 bp, Glycine Max; identical to SEQ ID NO: 1218

SEQ ID NO: 1220 - DNA, 1161 bp, Glycine Max
atggcaacaggatcaaagtttttggacaatgcaattataagaggttctcattctctcactgcctccaaccatgttcctgtattaagaggtggggtaaactcatcaatagcatcacctcatgaaaagcttcttttatgttcaaattctgtttccatgaaagaggaggcacctttagccacttggattagtcatatccctgcaaaattcaatggccatgaagacatcaagaatggcaaagagaaaaaccaatccaattctatcttcccagtctcagacataaaaaacagttccattcctctaaatcttttggaaactctcccaccattaaccatagcgccatgttttgatgatccagtggcttccctagcatcttcttctgccagaccaaaatttccaaacttgactttgtttttgccggaaccctccatggtgtactcatcaatatcatcctcaaatataaaaggtggtgaagtcatgtcagctacttcagacccctcatatcatgtgtctcagtttggccaaaaccagcatcaagcaggtagtggggatgcacacaaaatgaacaacaacctaacaaattcgcggtccaagtctttcaacgagaattggttgagtgccactaggactcagcctttgaagtatggtggaagaggcaagctgtttaaaggtgtgaggcagagacactgggggaaatgggtagctgagattagattaccaagaaacaggacaagggtttggctagggactttcgactccgccgaagatgctgccatcgcatatgacacagcagcatacatactaagaggagaatatgctcagttgaacttcccagatctcaagcatgtaattcaggcaaattctctgaatggaaccactgctgcacttgtggaggcaaaactacaagcaatatcacaaggtggttcttctcataggaagccaactaattcaccgccagggtcaagcaataagcacaatgatgagaatggaaaattgaaaagtataagtggcaaagattcatccataagggttggagctgaggtaactgagagaagcaaaagcaaacaccatgagacatcagatgtggaaggtgttcagttaagtagaatgccctccttagacatggacatcatttgggatgaactttttatctctaattcatga

SEQ ID NO: 1221 - DNA, 1800 bp, Glycine Max
atggcaacagtgtcttatgcggtgtcaggaagcgcgtgccagagccaccgtggcgcgtcgagaacagaggccaaagtgaattattcggctcagggattgagatccttgaacaagctgcacgtgcgaaccacccgtgcggccaaaaccaaaaccttgctgtctgcgaaaagtaacaagagtgggcgtgagggagttttggggaggattgagtgtgggatgaacttgatctttgtggggactgaggtggcaccttggagcaaaactggggggcttggtgatgttcttggaggacttccaccagctttggctggaaatggacaccgtgtcatgacagtgtcaccgcgttacgaccaatacaaggatgcatgggacactagtgtgacggtggaggtcaaaattggagatagaatagaaactgtccgtttctttcactgctataagcgaggagtggatcgtgtttttgtggaccacccatgtttccttgagaaggtatggggcaagactgggtcaaaactctatggccctagtgctggagtagattatgaagacaaccaacttagattcagcttgttatgccaggcagcacttgaggcaccaagggttttgaacttaaacagcagcaaatatttctcaggaccatatggcgaagatgtaatttttattgccaatgattggcacactgcccttcttccatgctacttgaaatcaatgtaccagaccaaggggatttacaaaaacgcaaaggttgcatattgtattcataacatagcctaccagggtaggcattcctttgcagacttctctcttctcaatttacctaacaaattcaagagctcttttgactttactgatgggcatgttaagcctgtcaagggaaggaaacttaactggatgaaggctgcaatattagaatcagaccgagtactcactgtaagtccatactatgcccaggaacttgttaccggagaggaaagaggtgtagaactggacaacgtaattcgttcacgtggcatcactggtatcgtgaatggcatggataatagggagtggagtccaaaaactgataagttcattgatctacactatgatgcaacaactgtcaccgaagcaaaatcactgctgaaagaggcacttcaagcagaggttggcttgcctgttgacaggaatatccctctgataggtttcattggtaggcttgaagagcagaaaggttcagatattcttgtggaagctattccaaagttcattgaccagaatgttcagattatgattcttggaacaggtaaaaagataatggagaagcaaattgagcaactagagaaaatctatcctgacaaggccagaggagtagcaaaatttaacggtcccttggctcacaagattattgctggagctgactttatagtgatcccaagtagatttgaaccctgtggtcttgttcagttgcatgccatgccatatggaacggtgcccattgtttcctccactggtggacttgttgacaccgttcaagaagggtatactggattccacatgggagcattcaacgttgaatgtgaagctgttgatccagttgatgtggaaaagttagcaactactgtaaagagagcccttggaacctatggtaccccagccatgacacagatgatccagaactgcatgtcccaagacttttcatggaagggaccagccaaacattgggaaaaggtgctgttgagcctagaggttgctggcagtgaacctggaattgatggtgatgagattgctcctcttgcaaaggaaaacgttgccactccttga

SEQ ID NO: 1222 - DNA, 738 bp, Glycine Max
atggcaactagacttcagtttgagaataattgtgaagttggagtcttctcaaaacttaccaatgcctattgtttggttgctattggaggttccgaaaacttctacagtgcatttgaggctgagttagcagatgttatccctgtggtcaagacctccattggtggcactcgtattgttggtcgtctttgtgttggaaacaagaacgggcttctcttgccccataccatcacagaccaagagcttcaacatttgagaaacagtctacctgatcaagttgttgttcagcgtatagaagaaagattatccgctctgggaaattgtatagcatgtaatgaccatgtggccctcacacacactgatcttgacaaggaaactgaggagatgattgcagatgttctgggagtagaagttttcaggcagacagttgccggtaatattcttgtgggcagttactgtgtattctccaacagaggtggtttggtccaccctcatacttccatcgaagacttggatgaactttctacacttcttcaggttcctttggttgccgggactgtcaatcgtggtagcgaagtaatagctgctgggatgacggtaaatgattggacagcattttgtggttcagacaccacagcaacagagctctctgtgattgagagtgttttcaagctgagagaagcccaacccagcgccattgtcgatgagatgaggaaatcactcattgatacttatgtctaa

SEQ ID NO: 1223 - DNA, 738 bp, Glycine Max; identical to SEQ ID NO: 1222

SEQ ID NO: 1224 - DNA, 765 bp, Glycine Max
atggcaactcgaagatatgagtttggaaggatgaatgaggctagccacccagactccatcagagctgccttggttgaattcctctccacttgcatctttgtctttgctggagaaggctctgcccttgctttgcgacaaatttacaaggaaccagggtcatcagcgggtgagttagtggtaattgcactagctcatgcctttgctctatttgctgctatttctgctagcatgcacgtgtctggtggacacgtcaaccctgccgtcacctttggtgctcttcttggtggaaggatctccgtccttagagccctttactattgggtggctcaacttctcggttctatagtggctgctctcttgttgaggcttgtcactaacaacatgagaccacaggggttcagtgtgtcaatcgggcttggagcgttccacggtcttatacttgagattgctctgacgtttggtctgatgtacacagtgtatgctactgctattgatcctaaaaggggcagcatcggctcaattgcacccttagccattgcattcgttgttggggcaaacatcctcgctggtgggccgtttgatggggcatgcatgaaccctgctcgggcttttgggcctgccatggtgggttggagatggcactaccactggatcttctgggtgggcccattgattggggcagccctcgcagcactcctgtatgaatacgttatggtcccaattgagcctcctcatcatcaacctttagctggtgtagattactag

SEQ ID NO: 1225 - DNA, 714 bp, Glycine Max
atggcaagagtcatttcctcttcctgcgcacgcctcgcaatgcgcctcttctccaccaccaccacagccaccgcgttcgccgtcactttacccaaaccctcatcactctccctctcatcgcgtcgattcctcttccctctatcccatgccatcgtccctccctccacccgcgtcgccggaatccggtgccgcgttaaccgcgccggagactcggcgtactcaccgctgaactcggggtcgtcgtcttcgtcgttcagcgaccgcccccccacggagatggcgccgctcttccccggctgcgactacaaccactggctcatcgtcatggagaatcccggtggtgagggcgccaacaagcagcagatgatcgattgctacatccaaaccctagccaaggttctcggcagtgaggaggaagctaagaagaagatttacaatgtttcctgtgagaggtactttggattcggctgcgagattgatgaagaaacttctaataagctcgaagggttgcctggtgttctgtttgtgctgccggattcgtatgttgatcctgagaacaaggactatggtgctgaattatttgtgaatggagagatcgtccagagatcacctgaaagacagagaagggtggaaccacagccacaaaggcatcaggacagaccacgatacaatgatagaacaaggtatgtccggcgcagagaaaacatgcagtga

SEQ ID NO: 1226 - DNA, 600 bp, Glycine Max
atggcaagagtcatttcctcttcctgcgcacgcctcgcaatgcgcctcttctccaccaccaccacagccaccgcgttcgccgtcactttacccaaaccctcatcactctccctctcatcgcgtcgattcctcttccctctatcccatgccatcgtccctccctccacccgcgtcgccggaatccggtgccgcgttaaccgcgccggagactcggcgtactcaccgctgaactcggggtcgtcgtcttcgtcgttcagcgaccgcccccccacggagatggcgccgctcttccccggctgcgactacaaccactggctcatcgtcatggagaatcccggtggtgagggcgccaacaagcagcagatgatcgattgctacatccaaaccctagccaaggttctcggcagtgaggaggaagctaagaagaagatttacaatgtttcctgtgagaggtactttggattcggctgcgagattgatgaagaaacttctaataagctcgaagggttgcctggtgttctgtttgtgctgccggattcgtatgttgatcctgagaacaaggactatggtggtgagggtttaacgctttgtgtttgttag

SEQ ID NO: 1227 - DNA, 864 bp, Glycine Max
atggcaatgcctgtgaatgatgatacaatgattgaggatgaaacagaagatcagagtgaaaaaatgtcgtcatctgaatcagaacaggaagaagatgtgagattagctgaaccatctaaaaatgcagtatataacagagatgctctattagataaacttggagacatcagttggccagcgaatgtggaatggatacacaaactctctattgatgttgatcaagagcaagaagtagatgtcaatgatgacttggcacgagaacttgcgttttacacacaggcattggagggaactaaggaagcatttgagaaacttcagtcaatgggtctccctttcctgagacctgcagactattatgcagaaatggtaaagacagatggccacatggaaaaggtgaaaggtcggctattatcagagaagcgaaagatggaagaggctgatgagagaagaaaggctagggaggccaagagattggccaaagagattcaggctcagaaattaaaagaaagggctaagcagaaaaaggaggacattgaatctgttaagaaatggaggaagcagaggcaacaaagtgggtatgctgacaatgggaaagatgcagatatgggttttgactttgaggatggaaaagtatttgagaggtcaaataagaaaaggccaggggtgtctccaggggatcgttcaggagggaaggcaaagcaagcctttggtaaaggaaagaaacagaagataagagatggtaagaattccaaatttggttttggaggcaagaagggaatgaaaaagcagaatactgctgacaccaccaatgattttggtaaatttaataagggtgctgttgctggaaataagagaaagaggtaa

SEQ ID NO: 1228 - DNA, 864 bp, Glycine Max; identical to SEQ ID NO: 1227

SEQ ID NO: 1229 - DNA, 501 bp, Glycine Max
atggcacactacaacgtggttttgaagagtattgaggttgatacagatattctacagcttccctcagatatatttgattctgtaaatgggaagggtacagtaatagatagtggaacaaccttggcttatcttcctgccatagtttatgatgaactgattcaaaaggttttggcccggcagcctggactgaaattatatcttgttgagcaacaatttcgttgttttctgtatactggaaatgttgatcgtggatttccagttgtcaagcttcattttaaggattctctttctctgacagtttatcctcatgactacctgttccagtttaaagatggtatctggtgtattggctggcagagaagtgtagcacaaacaaagaatggaaaggacatgacccttcttggagatttggtgctatctaacaaactagtgatatatgatcttgaaaatatggtcattggatggactgactacaattcattgtggtgttgtgttttttag

SEQ ID NO: 1230 - DNA, 621 bp, Glycine Max
atggcacactacaacgtggttttgaagagtattgaggttgatacagatattctacagcttccctcagatatatttgattctgtaaatgggaagggtacagtaatagatagtggaacaaccttggcttatcttcctgccatagtttatgatgaactgattcaaaaggttttggcccggcagcctggactgaaattatatcttgttgagcaacaatttcgttgttttctgtatactggaaatgttgatcgtggatttccagttgtcaagcttcattttaaggattctctttctctgacagtttatcctcatgactacctgttccagtttaaagatggtatctggtgtattggctggcagagaagtgtagcacaaacaaagaatggaaaggacatgacccttcttggagatttggtgctatctaacaaactagtgatatatgatcttgaaaatatggtcattggatggactgactacaattgctcttccagcattaaagtgaaggatgaagcgactggaatagtacatacagtggttgcacacaatatttcttcagcttctaccttatttattggaagaatattgactttctttttgttgctaactgccatgctaaacaattaa

SEQ ID NO: 1231 - DNA, 473 bp, Glycine Max
atggcacatgtgaagttacatgaattttggtatagtcccttcactttgagggtaaaatggaccttaaagctgaagggtatatcctatgagaatatagaggaagatcgattcaatatgaagaaagaccgctacaataagagtcttcaacttcttgaatacaacccagtatacaggaaaactccagtgcttgtccataatggaaaacccctatgtgagtccatgcttattgttgaatacattgatgagatttggccacataattcattgcttcctgctgatacctatgagagagctctggcacggttttggattaaatatgccgatgaaattcataccatcaataatgatgaagaacgagaaaagagtatagagaagatatgggagcatctaagggttgttgagaatcagtgttttggtgatcagaagaaattttttgggggagacattattaacattgtggagatagattttgg

SEQ ID NO: 1232 - DNA, 1563 bp, Glycine Max
atggcaccaccatcctctcctccgctcgtcgacaattccgatgccgagcgccgccttcgcgaagcggaggagcgcctccgcgacgccatcgaggagctccagcgccggcagcgccgcgccgccgctcacgcccagcagcaccgccacgtggactcgctgccttgcgatcacggccccgacgagtcctgcgtggctcacgccattggcaacctctgccagaccttcctcctctcctacggcgtcagagtcggcattggcatactcctccgcgccttcaagcttgttcgaggccaatcctactcctctctcctcgatctcaagcaacttgtttcagaaaaagatctgatagtaagggaagaagcatgccgcattggtcttctttttggtggtttcactggatcttatcatgctcttagatgcttgttgcggaaattgagaaagaaagagacaccggctaatgcagttttagcaggttctatagctggtttctcgattatggcattgaatgattcaaataggagacgtacactggctttatacctgttggctaggctagcccagtgtgcttataattctgcaaaatctaaaaacaagtttcacctttgggggagtcattggagacatggagattcattgctgtttgcccttgcttgtgcacaggttatgtatgcctttgtaatgcgtcctgagagcttgccaaaatcctatcaagacttcattcaaaagaccgggccagttgcagagcctgtatacaaggctgtaagggatagctgtagaggtcatccagttgatgttgcgtcactgcatgcttatttatctcgtgtaggaagatctgactatgtaaagttggaagaatttccctccattattccatgttccattattcatccagcaacaaattcatgcttagctcatcaaggaaatgcaacatcattaacgtttaagaaaacatttccgctttacttctctttgacctttgtgccttttgttgttctgcacctacagaagttcactgatgctcctttccgcactttctggcttgccattaaaggtgctgttcgctcgacaacctttttatccgcttttgttggaatctttcagggagtcatatgttcacatagaaaagttttttcaagagatcacaagcttgtatattggatagcaggtggaatagctgccctatctgtgctattggagaaaaaagctaggcgtggtgagctagctttatatgttcttcccagagcagtagattcattgtggtatatcttggtgaacaggcaccttcttccaaatatcaggaatgctgaggttttcttgttttctctgtgtatggggggaatcatgtattacctggaacacgaaccagaaaccatggccccatttcttcgaggcttgatccgtcgcttccttgccagcagaatcagcaatccaagcccacctaatcggactgcttcctacacatacctgcaagctcttgatggcataacgaaaccaacattacaggagaagagggatactgaatcttccgaaaagtacaaccttgaatctattcctgggctttaa

SEQ ID NO: 1233 - DNA, 1830 bp, Glycine Max
atggcacggatgggcccagggttccgattccaccccaccgacgaagagctggtggtgttctacctgaagcgcaagatgaccggaaacctctcccgctacgaccacatcgccgttgtcgacgtctacaagctcgagccctgggaccttccccctctgtcgaagctgaagacgaaggacttggaatggtacttcttcagcgcgctggaccgcaagtacggaaacgggtcgaggacgaaccgcgccaccgataggggctactggaagaccaccggaaaagaccgccccgtcacccacggcgaccgcaccgtcggaatgaagaagacgctcgtttaccacagcggccgggccccacacgggcgccgcaccaattgggtcatgcacgagtacaagatgctcgacgaggaattggcacgtgccggcacagtgccggatgtgtttgtggtgtgtaggattttcgagaagagtggttctgggccgaagaatggggcaaaatatggtgctcccttagatgagaaggagtgggatgttgaggatgagcaggaggaggaggaggaggagaatgagcagaaggacgtggctcccttgctggttcctcataacgcggtggctcctcctcctcccttgctaattttgatgatgaggttttcaatgctggggcctatgttgaaaccaacgaccttgacatggtgtgtattcattctattgtattgtaattgtatcccaaatgatatatcggtaaatagttggatttatgtatttctcatcgttcatgaatatgtagtcctaccactggagcttaattggaatgatataattgggagtgatacttttccatcactgaactttcatcatggggagtgtagtagccatgctgagtattccaaagtattcatcaaggatcaggagccatcagcaggcacttttggaatttctcggcctgaaaatgactggcctcttgatatgactgagcaacatggcgtggatacaaattcagtgaacaacagagacaatggtgagctgatcaatattggcaatcatctgaattttaatgatgcatcaaatgatatgaatctggatctgttctgggatgccaacgagaatcttccgactgatggatcattcttggaatacaatgatattgcaattgggaatgggagtagatctactgaggctgatcctcctgcgaatgacattctagacgagtatcttacactccctgatgatgatatttacaagtatatatcttttgattctcctcagattcaagagagtgaaaattttattcccaaccaaggatcacctttcactcggcagaatgtggagggagaaactgctgataaagctgtggttagtaatcataattctgaatcacaaaccagaaatgaggcttcttcagtgcagaatacacatgaggcaaagtttgcaccaggaagtacaaatccacttgttaagcaggcctatggttggttagccggcatccctgctgcgcctgcacatgctatggagtttcctgctaaggagattgctcttgggcttcatcctgtagctcagtcttcccatccagctcatataactacaggtatgatcagcataacagacattactttaagaggcaatgcgatggattggacgatgggcaaaaatggagggtttagcactgtaatatccactgggttttgtcaaccggatgttaattcggatgctttgatacctgtttctggcaagactgcatttgtgttgtcgcatggctggattttcctgactggtttctctgttcttattctttcactgagttgcaagatcggaagcatcatgtatactggtaaatga

SEQ ID NO: 1234 - DNA, 987 bp, Glycine Max
atggcactagaggcagtggtatttccacaatcacaagacccttttggtggtagtggttacggatcagtgaataataaggacttctacaactgcaccttgttggctgctacttcacccaactcatggggggactatgagcaacacatcaacatcaacaaagaagaagaacaaggtggtgcttctatctccacttttcaaccagagagtaattacccttatggaaattggaccagctcctcctcatctatgttaccccacttcaacaatgaacttcaagaaaccactactactgaccccagtaacaccttagatagcttaaacactcgtcccaagaggcgcagagccaaaagcagaaagaacaaagaagaaattgagaaccaaagaatgactcacattgctgtggaacgcaatagaagaaagcagatgaatgagtatctttctgttcttcgctctcttatgccagactcttatatccaaaggggtgatcaagcttctataattggaggtgctattaactttgtcaaagagcttgagcagaggatgcattttcttggtgctcagaaagaaggagaggggaaatctgaggctggtggtgcaacaaacatgcccttttctgagttcttcacctttcctcagtattcaactagtggtggtggtggttgctctgataattctgcagccgtaggtgaagacgtgggtgaggttaagtgtggcattgctgacatagaagtgaccatggtggaaagccatgcaaatctcaaaataagatccaagaagcgccccaagcagctcttgaagttggtttctggtttgcataccatgcgcctcacaatcttgcacctaaatgttactaccaccggtgaagttgttctctactctcttagtgttaaggtagaagatgattgcaagttgggatcagttgatgatatagctgcagctgtgtaccagatgctagataaaattcagcaagaggcaatgttgaattaa

SEQ ID NO: 1235 - DNA, 3042 bp, Glycine Max
atggcagaatcgcgcccccctaagcgccccaaaatctctaggggggatgatgattatatgccgggaaatattcttgagattgagctttgtaatttcatgacatttgattacttaaaatgcaaacctgggcctcggttgaatcttgtaattgggcccaatggttctggtaaaagttcgcttgtatgtgctattgctcttggcctctgtggagagccccagttgcttgggcgtgctacgagtattggggcatatgtgaagcggggagaagaatctggctacattaagatcaccttgagaggggaccataaagtggaacacattaccattatgcgtaaaattaatactaataacaagtctgaatggttgctcaatggaaatgtggtgcctaaaaaggatgtggctgaaaccattcaaaggtttaatatacaagtcaataatttgactcaatttttaccgcaagacagggtctgtgagtttgcaaagttaactcctgttcaacttctggaagagaccgaaaaggctgttggtgatccacagcttccagagcaacatcgagcattagttgataaaagtcgtgcattgaagcatattgagttgtctctggagaaaaatgaaggaactttaaaacagttgaaggaacggaatgctgaattagagacggatgttgaacgtgttcgtcaaagagacgaacttcttgccaaggctgaagcaatgaaaaagaaattgccatggctgaggtatgatatgaagcaggcagaataccgggaagctaaggagcgtgagaatgatgccgcaaaggcattggaggaagctgcagagttattaaatgatcttaaagaacccattatgaaacaaaaagaagagaaggctgcattatatgcaaaatgcaaaaaggttagcaaccatgcaagtgagaatgcaaagaagcgaaccgaacttatggaggaggagaacaaattggatgtagaattaaaaggaaaatacaaagaaatggaagagttgaggaggcaggaagaaactcgacaacaaaaacttgtaaaagctagggaggaagttgctattgctgaacttgaacttgagaatctacccctttatgtacctcctaaggatgagcttgtgaggttgattgaaatgaataataaaagtacaaagtgtttgcatgcattgcaaagatcaggggctgaaaaaatttttgaagcttataaatgggtccaagatcatcggcatgaattcaataaggaggtttacggcccagttttattagaggtgaatgtctcaaataaggatcatgctgcatatctagagggtcaagtggctcattacacttggaagtccttcataacacaagattctggtgatcgagatcttttggcgaaacacctacggttctttgatgtaaatgttctaaattatactggcggtgatggtccccaaagagagccttttgaaatttctgaagataagcgtgctcttggcatctactcccggctggatcaaatttttgatgctcctattgctgtgaaggaggttttgattagccagtttaatctagattattcatatattggatccgaaaaatctgatcagaatgctggtgaggtccggaaattgggaatcctagatttttggacacctgagaatcactaccattggtccaagtctagatatgcaaattatgaatctgcagtcgttaatcaagtgcaacgcccacaacttttattgaataatttgaatgttggtgaaattgagaagctgagttccgagcaaagggagcttgaagaaattgttgctaatttggaggaaagtgttaaaaggtttcacgacgaagaaagaagcttactgaatcaatctgctaatcttcgtaaacagtgggaggacattagtattacagtacagaatgagcaaaagaaacgtcaagcaatcattagccgtattgatcaaaagaaaaagttcttgaaactgatggaggaacgggatgatctagatactgagatagcaaagcttgttgatcaggctacaaaatataacattcggcgtttccataatgcaatggaaattaaggatcttcttgttgaagctgtgagttacagacggatttttattgaacaacgtatggctttcattgaatttgatgcaaagattgtagaaatggaggccaatctgaagcagcatgagaaatttgccctgcaagcatcattgcactttgataactgtaagaaagaatctgagaattgtagacaggatcttacagattccttgaagtatgctaaatcaattgctcggcttacacctgagctaaagaaggaatttcttgagatgcctactacaattgaggacctggaagcagctatccaagataccacttctgaagccaattcaatcctttttgtcaatcataacatattggaacaatatgaagatcgccaacaacagatagaagatcttgcagcgaaactggaagcagacaaaaaggaatctacacggtgtttggctgaattaaataacattaagggaaaatggcttccaacattgagaaaccttgtggcaaagataaatgaaacattcagttttaatttccaagagatggctgttgctggagaagtttcactagatgaacgtgatatggactttgatcaatttggaatacttataaaagttaaattcagagaaaatggacagcttcaaaatctcagtgctcaccatcaatctggcggggaacgctcagtttcaactattgtttatcttgtttcccttcaagatcttacaaactgcccatttagagtcgttgatgagatcaaccaagggatggacccaataaatgaaaggaagatgttccagcaattagtgagagcagcaagcaagccaaatacaccccagtgtttccttcttaccccgaaattgttaccagatctgcaatatagtgaggcatgcagtatattgaatgtgatgaatggcccttggattgagcaaccctcaaaggtctggactgctggtgatcgatggagtatcatcacgggacttgttggagacacccattgttaa

SEQ ID NO: 1236 - DNA, 1200 bp, Glycine Max
atggcagacgatctgtttgaaggattgccccctccttcctcaaacactcttcttcctcgtcaacaacaacaactccaaccacaaccaattgttgttgctaccaacatcaacgacactgaatcctctgcagttccggctccaaagccaatcctcaaaagtgccctcaagcgccccaaccctactcaacctgacacccaagctgcagcacctaagaaaagcttgaagttcaaaacctcgacagatgcttctgaagcacaagttattgaggctatgcagaagatatcttcacacatcaagaaccctgcaaagttcagcaaggctgcaaagcttgctatacagctgattcaggcaggaagtgtaaagtcagaaattagtgattatttttttgccatattagaagctgcaatgtcatcatccattacttgtacagatccttcagttcgagcagattatcattctctgttctccgtagctcaaaacaccaaagaacacctcaataagaagcaaaagaatcaactggcaacttggacaattaatgctgtggtggcaaatgatttatatacagatgatagctttgtgttttctaaagcagctgggcaaatcaaggaagctatatctaatcttcctgttgcaacagaagaggaggacgcagaggaagctaagtctctgaaagatagcacagttatagtggatgaaggtggtaagacacctgccacagataatgataatgatggggaggaagctcaagctgacccatttggacttgatgctctgattcctaattccacaaagaaaggtgaaaaattaaaggcaaagaatgaggcagctgtgaaaataagggaggatgaggaagaaaccaatagattcctcaagtcaaaaagagaagtcctgataacttgtttagaaattgctgctcggcgttataaaacaccctggtgtcaaactgtaattgatattttagtgaagcatgcctttgataatgtggcaagatttacagctcgccagagggatgctgttgggaaattgtgggcttcaatacgggagcaacaaactcgtcggaagcaagggaagtcagttaatggaaaacttgatgtgaatgcttttgaatggcttcaacaaaaatatgctggtgaaaagattagcattcgtcattctgttggagctagcggagaccgtcgtgcccagcaatggcttggttaa

SEQ ID NO: 1237 - DNA, 3408 bp, Glycine Max
atggcagagcagcaaagtagccgaatcagcgtctttttcagtgcttcgaagccccttcttcctagaaaaaggccttctgattcctctccccttcaccctcaccgaatcaagagtgccggtgatgttgcttcggtttctgttgcgaagagagttcctcttgcggaagtgccgctgaataggctcaatgcaattgggagtgttcatggtccgtcgcctgatgcaattcacagcagtttcagtgcaaggactgtgtctgttcctgcagttggttctgcggatgagaacctgtgtcgatctctttttgaaactccaaggagagaacctgaaggctctaaacctaaacagctggattgtttttcaacgactggtctccttgacgacgattttgatgactcttttttggagcaaattgacattctgtgtgagcagaaatctgcagagcagcaggcggatcgtagcagtgacgagaaactttcgagcaagagtaatgttgttggtgatgttaatctgagttcagaatctggtactgtttctgagggtataggaaacggtcacctgcttagctctgggattgagctagatagtagagaagaggaagtggattcaagctggcgagatttactcaatagcaccatgcctgaggaatatttgaaatacttaaagtctttaaatgacaggcaaagagaagcagcttgcactgatatttcaacccctttaatgattgtagctggtccaggaagtggcaagggcattagtccatcaaacattcttgcaatgacatttactacagcagctgcttctgaaatgagagaacgtataggagctatagctgggaaggcaacagctaaagaacttactatcagtacttttcattcattttccttgcagctttgtcgttcacatggagaaaagttaggtcgtacatctgaattcttaatatatggacaggggcaacagcgaaatgcaattattgaggccatccgattattagaaattggaaagaagccttccaccatgtctctcagctacaaacgagcaacatgggtggtgatgttggcattgcagtgttcactcgggaatagtcaaagggccagtgcacatccatcccgtgtgggcgctggggctgcaaatcgtggtggggtgttaggatccaattgccaggccaaagcttcgggaagaacttctgcagaatatcgcaaaatgggcaacgaaattggagccgcaattcttaagaattacaacaacatattaaaatcttgtaatgctctggattatcatgacttgatcagctgttctgtgaagctacttagtgattttcctgaagttttcaaagaatgtcaggattcatggaaagctattgttatagatgagttccaagatactagtgccatgcaatacaagtttctaaagatgcttgcatctcatcataaaataacaattgttggtgatgatgatcagtctatttacagtttcaatggagctgacatttctggatttatttcctttcgcaatgattttccaaactacaaagagattaggcttaacaaaaactaccgatccacacgttgcattgttgaggccgcatcttctcttattcaaaataattccaagcgatgtcagttgaagaatgttcttactgataactcttctggatccaagatagttatgaaggagtgtcacaatgaggatgcacaatgcgcatttgttgttgacaaaatcatagaaatttcatcaaattattctgcagctaactgttgttatggcaacattgcaattctctaccgtaggcagatatcaggtaaagccttccaaatggctttccgtgataggaaaataccatttaacattcatggtgtggctttttacagaaaaaaggtagtcagaactatcatggccatgcttcgaacagcactgcctggttgtgatgatgggtcatatagtcgtgtcttcaaggctttaatgcctttggagaaagataaaaaaaagaggataattgaccatatcaacaaaatatcaacaattagaagatgtagcttcttgtcagctgcctctgacatctttagtgcaaagatttctggtacctttaaaaggagtgagcttacccatggaaggaagattttaatgacactagagatgatatcaaaacttattcagagggaaaaatcgatctcagctatcatatcttctgtggcaaacatgatacccgagaaataccttcttgagcaacgagcagtcgttgatgttgatggagggacattgctgaatgaagactatgacatcagatctgttcttcaatacctgttagatgacgtctctgagtttctatccactaaattagttgaagtaaaagaggaaagggaaatatctgaagataagggctgcatttttgttctaaaagcattcattgattatttacttgagcgtgagaaagaaaattttggtgctcggaggaaggacaatgaaaactctgtgacgttgactaccattcatcaggcaaaaggtttagagtgggatgttgtcttcatagttaaggcaaatgactctgagatccctctattacatgatttcaagggcaccgtaaaggacactgcagccttacttgaggaagaaagacgattattatatgttgcaatgactcgtgctcgggagaagctttttattcttcatgttatgatggactcaaactggcagatgcttcaaccttcaagatttttgaaagaaatccctcgtcatcttacagaagttcagaagtgctctcaacaacctcacttatacttgagaagagatgcagtctactttaatttacactccctaactaatcgggatttcatagtgtcctatgcattgctagcattttttcctttgaaacaatctgaagcagatgtgatccctatgcctcatgaaatacttgataatcattctagtgagacttccaatgagcttgcacaatttgcagaggcaaacaatagaaatgatttcttaagaagatttagtgttgagaacaggtctattgtttcccatttattccatcagtgggccaaaaagaaagcatttcaagatccaaagagattgcttgacaaggttagttttgtaattgatgaacgcctcagacagaagagaaacaaaaacaaggatttgttgaatacattaaaatcttgtttaagctgtgatgaagcatttcagtatgctcaatatgttttgagatgggagcagattcctgctgataaacgtgctcatcttatgagagaaaaacaggaacatttcctgaaattaaagattgagaatgcaatgggttcggcaacaccaactgacaagcagatttcatatttgaaaaaactgggttgcaccgcaatccctacctcccgcctccatgcatctcatcttattgagcaattcaaatcattgtaa

SEQ ID NO: 1238 - DNA, 453 bp, Glycine Max
atggcagatatcctgagtgaagaacagattgttgattttaaagaggcctttggcttgtttgacaaagatggggatggttgcattactgtggaagaacttgccactgttattcggtcgttggatcagaaccccaccgaagaagagctccaagatatgataagcgaagtggatgcagatggcaacggaaccattgaattcgatgagttcttgagcttgatggccaagaaagtgaaagacaccgatgcagaggaggagctcaaagaggctttcaaggtttttgacaaagatcaaaatggctacatatcagctagtgagttgagacacgtaatgatcaatctaggagaaaaactaaccgatgaggaggtggagcagatgattaaagaagcagatttggatggtgatggccaagttaactatgatgaattcgtcaagatgatgatgaccgttcgatga

SEQ ID NO: 1239 - DNA, 1554 bp, Glycine Max
atggcagatcaaaccccgggttcaggaaccgtttctgttgaagcttcttcacaagaaagaaggaaacttccaaactttctcttgtctgtgagacttaagtatgtgaagcttggttaccactacttgatctccaatgctatgtaccttttgctcataccccttcttggtgtagcttctgcttatctatcaacaatctcttaccaagatgttgttcagctatgggaaaatctcaagttcaatctcctctcagtgactctatgttccagtcttatagtattccttgtcaccttttactttatgagccgtccaaggggtgtttacttggtggattttgcgtgttacaagccagagccagagtgcacttgcacgagggagattttcatgaacaggtctgtggaaactggtgtgttttcagaggagaacttggcctttcagaagaagatacttgagaggtctggtttggggcaaaagacttacttgcccccagcaatattgagtgtcccttcaaacccttgtatggctgaagcaaggaaagaagctgagcaagtgatgtttggagccattgaccagcttctggagaaaactggggtcaaggctaaggatattgggattttggtagtgaattgcagcttgttcaatcccacaccttctctctctgcaatgattgtgaaccactacaagctaagagggaatatccaaagttataatcttggtggcatgggttgcagtgctggactaatctctatagaccttgccaaacagctcctccaggttcatccaaactcttatgccttagtggtgagcatggagaacatcactctcaactggtattttggcaacaacagatcaatgctagtctcaaattgtctattcagaatgggtggagctgcagtcctcctctccaacaagtcttctgatcgcagaagagccaaataccaactgatccatacagttcgtactcacaagggtgcagatgacaaatcatatggttgtgtcttccaagaagaagatgagaagaaaacaattggtgtggcactctcaaaggacttaatggctgttgcaggagaagccctcaagaccaacatcacaacacttggcccattagtccttcccatgtcagagcagcttcttttttttgcaactttggtggctagaaaagtgtttaagatgaaaataaagccatacatccctgactttaagctagcttttgagcacttttgcatccatgctggaggaagagcagtgttggatgagttggagaagaatctagagctctctgattggcacatggagccttcaagaatgacactaaacaggttcggcaatacttctagcagttccttgtggtatgaattggcctacactgaagctaaaggaaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcccaaagtggcaaccattggttcctaa

SEQ ID NO: 1240 - DNA, 753 bp, Glycine Max
atggcagatcatcagagactgaggatccaccctatggagggggaagcaccaccaccacccccaacaactccattggtacctccaggctcgtcaaaatcagaaaagcgtatccctttacaccatcctccacaactacgtgctatgccagcagcataccctacagcacacaaaagaagctgctgctgcaagtgcatatgttggataataaccttgcttgttctcctcctcattatcttggctgcaagtgttggaatcctctacctagtcttcaaaccaaagcttcctgattactcagttgacaccctcaggataagtgatctgaggcttaactttgacatgagcctctatgcaaggtttgatgtgaagatcacagcaaccaacccaaacaagaagattggcatatactataaaaagggtggaaggttgagtgtgtggtacacaaacacaaggctttgtgaaggttcactgccacagttctaccaaggtcatgagaacaaaacaatgctcaatgtgtccttgagtggtcaagtgcagtctggaagcaccttaatgaatgcactgcagcagcaacagcagacagggcgcattccattggatctcaaggtgcatgcaccaatagccatcaaacttgggaggttgaagcttatgaaggtgagagtcttgggagaatgccttttggtggtggatagcttgtcatctaataatctcataagcatcaaggctagcaactgcaagttcagattgaaactttga

SEQ ID NO: 1241 - DNA, 1611 bp, Glycine Max
atggcaggaggacaactaggagtgcttaatgcactcgatgtggcaaaaacacaatggtaccacttcactgctattgtgatagctggaatgggattcttcactgatgcctatgatcttttctgcatttcccttgtgaccaagttgttggggaggttatattacacagacataacgaacccgaagcctggtgttcttcctcctaatgtgcaagctgctgtgactggtgttgctctatgtggcactttagccggccaacttttctttggatggcttggtgacaagttgggaaggaaaagggtttatggcttaactcttatgcttatggttgtgtgttccgttgcctcagggctctcttttggagacacccccaagggtgtcatggccacactttgtttcttcaggttctggcttggctttgggattggtggtgactaccctctatcagctacaatcatgtctgaatatgccaacaaaaagactcgaggggcattcattgctgcagtgtttgcaatgcagggttttggaatcctggctggtggaatagttgccttgattgtgtcatctgcatatgaccacaaatatgatcttcctagttacaaagacaatccagcaggttcgaaggtggattcgcttgattacgtttggcgtatcattttgatgtttggtgcagtcccagcagggcttacctactattggcgaatgaaaatgccagagacggctcgttacacggcccttgtagccaagaatgcaaaacaagctgcttcagacatgtctaaggtgttacaagttgaggttgaagctgaagaggataagttgcagcacatggttgagagtgaacaccaaaagtatggcttgttcagcaaggaattcgccaaacgccacgggctgcacttggttggaaccacagttacttggttcttgttggacattgccttctacagccagaaccttttccaaaaggacattttcagtgccattggatggatccctcctgcacaagacatgaatgcaatccatgaagtttataggattgcaagagcacaaacactgatagcattgtgcagcaccgtgccagggtactggtttacagtggcctttatcgatatcatgggccgtttcgccatccaattgatgggtttcttcttcatgacagtcttcatgtttgctcttgctataccttacaatcattggaagaaccacaacaatattggctttgttgttatgtactcattcacattcttcttctccaactttggtccaaatgccaccacatttgttgtgccagcagagattttcccagcaaggctaagatctacttgtcatggaatctcagctgctgcaggaaaggcaggagctattgttggtgcatttgggttcttgtatgctgcacaaagtacgaaccccgataaagttgatcatggttacccaactggtattggggttaaaaactccctcattgtgcttggtgtgatcaacttctttggaatggtattcaccttgttagtgccagaatcaaagggaaaatcactggaagagttgagtggggagaatgaagatgatggtgctgaggctatagagatggcagggtctgctaggacggttccagtttaa

SEQ ID NO: 1242 - DNA, 999 bp, Glycine Max
atggcaggtaatagtggttcagaggggttgggcgatgatttcttcgaacagatcttagcagtgcctgaagccggcacagtgggaatgttgcaattggggtccacaactggtgctttcagaggagcttctgggttaatgcctctgggcttgaatttggaacaagctgccttcctaagacaccaagttaacgttgacgacgacgttgttcatgttaatgttgatgatgccaccatccaccaacatcacctcactctccataacaacaacaactcctcatcaccctcttccactgcaccaatcaccgatagggattctatgcatatgaggggtttattttccgcgtttggacaactgcatactcctatccgccccacgctgccattgcctccaccacctcgtcagccacaactccacctccaccatcataaccaacagtttcagggccaggcagctgcagctccagcgtcaatggctgctatgccacaaccacctgggatccgccctcgtgtgagagcaagaagagggcaagctacagatcctcacagtattgctgagcggttgcgtcgtgaaagaatcgctgaaagaatgaaggcattgcaggaattagttcccagcatcaataagacggacagagcggcgatgcttgatgaaattgtggactatgtgaagttccttaggcttcaggttaaggtcctgagcatgagtagactgggtggagctggtgctgttgctcagcttgtggctgatgttcccctttctgcagtggagggggatcaggacatagaaggtggagccaatgagcaagcctgggacaagtggtccaatgatggcacagaacaacaggtggctaagcttatggaagaagatgtgggagcagctatgcaatttcttcagtccaaggcactttgtatcatgcccatacctctagcctcagccatttttcgtatgcctcaatcagaagcatcaacaggcatcaagcctgaatctaacagtcactga

SEQ ID NO: 1243 - DNA, 996 bp, Glycine Max
atggcaggtaatagtggttcagaggggttgggcgatgatttcttcgaacagatcttagcagtgcctgaagccggcacagtgggaatgttgcaattggggtccacaactggtgctttcagaggagcttctgggttaatgcctctgggcttgaatttggaacaagctgccttcctaagacaccaagttaacgttgacgacgacgttgttcatgttaatgttgatgatgccaccatccaccaacatcacctcactctccataacaacaacaactcctcatcaccctcttccactgcaccaatcaccgatagggattctatgcatatgaggggtttattttccgcgtttggacaactgcatactcctatccgccccacgctgccattgcctccaccacctcgtcagccacaactccacctccaccatcataaccaatttcagggccaggcagctgcagctccagcgtcaatggctgctatgccacaaccacctgggatccgccctcgtgtgagagcaagaagagggcaagctacagatcctcacagtattgctgagcggttgcgtcgtgaaagaatcgctgaaagaatgaaggcattgcaggaattagttcccagcatcaataagacggacagagcggcgatgcttgatgaaattgtggactatgtgaagttccttaggcttcaggttaaggtcctgagcatgagtagactgggtggagctggtgctgttgctcagcttgtggctgatgttcccctttctgcagtggagggggatcaggacatagaaggtggagccaatgagcaagcctgggacaagtggtccaatgatggcacagaacaacaggtggctaagcttatggaagaagatgtgggagcagctatgcaatttcttcagtccaaggcactttgtatcatgcccatacctctagcctcagccatttttcgtatgcctcaatcagaagcatcaacaggcatcaagcctgaatctaacagtcactga

SEQ ID NO: 1244 - DNA, 120 bp, Glycine Max
atggcagtacatgaacacgcacacggtcccaaaagaataaaaagcagagagcaaaagtgggaatatagaatatcagccgcgacaagcaagcgtaaaaccacagtatctttggcatcttaa

SEQ ID NO: 1245 - DNA, 429 bp, Glycine Max
atggcatcatcatttgtgggtactttattacccaaccacttcacacaaaccaaacactcagctgttcctgcaagtagatcaggtgctccaagaaggaggagagtgcacttagcaacaacaagagcagagaccatgactactgtcatagaaaaactgggcattaagattgagaggaaccctcctgagtccaagctcactcaactgggtgttaggcaatggcccaaatggggttgccctccaagtaagttcccatggacatatgaagccaaagagacttgctatcttctggaaggaaaagtgaaggtctttcctagtgggtcgaatgagtcagttgaaattgctgctggtgacttggttgtgtttcccaaagggatgagttgcacttgggatgtgtctgttggtgttgacaagcactataattttgaataa

SEQ ID NO: 1246 - DNA, 339 bp, Glycine Max
atggcatcgacatcaacaccagggtcatcttcagaactaactatcacagttgaacacaatccttccaaatcacgattatcagagctgggtataaattggtggcccaaatggggttgtcctcctgggaaattcatgctcaaattcgatgcccaagagacgtgttatttgctcagagggaaagtgaaggtttacccaaaaggttcgtctgagtttgtacaatttggtgcgggggaccttgtcaccatacccaagggacttagttgcacgtgggacgtatccattgcagtggacaagcattacaagttcgagtcttcttccactacaccatcccccgaatga

SEQ ID NO: 1247 - DNA, 1608 bp, Glycine Max
atggcattcaactcttcacctttcatcacttgcaagaaagacttgggtttctttgcttttccttcaccatcctccataattgggaagagacagaaatgcaagaaaacatcatcaaataagattgtttctgttgtgtcatcccccaagaacaaacgcagcccttctgcaactggctcagttgtgttcactttcttccctaccaaaattccgatgactgcgacagagaagattctggcaagagctgccgagaaatgtgaggtgaggccaggggagaacgcttgggcaaatgttgatgttttgatgatcaatgatatcacttgtccaggtatttctggaatcttcaagaaagagtttggcaacactgcaaaggtttgggaccgtgaaaagattgtggttatccctgatcattacatattcacaaatgatgaacgcgcacaccgcaatgtggatattgctagagatttttgtgttgagcaagatatcaagtacttttatgatattcaagatcgcagtaacttcagggctaatccagattataaaggtgtttgtcacgttgctctagcacaggaaggtcattgcagacctggagaggtcttgtttggtactgattctcacaccacatcagctggagcatttggccagtttgccacaggagttggtaacactgatgcagcttttgtattagggacagggaagatcttactcaaggcaaataaaccaacactatcattttgcttctacattttagtgcctccaacattaagatttgtactggatggtgaaaagcccagctatttgcttgcgaaggatctaattttaaatatcattggtgaaatatctgtgtctggtgcaacatataaaacgatggagtttgttgggacaacaattgaaagtttaagtatggaagaaaggatgacactgtgcaacatggttatagaagctggagggaaaaacggtattgttgctgctgatagaaccacatacaaataccttgaggataagacgtctgcaccatatgagccagtttctagtgatgagaatgcaaggcaaggtataagttttataatggtcaaatggtttctagcccaatatagatttgatgtatcaaatatggaaccattggttgcaaagccacattcccccgataatcgtgctttggcaagagaatgcaacaatgtgaaaattgacagagtatacattggatcctgcactggtgggaagactgaagattttatggctgcagcaaaagttttcttagcggggggaaaaaccgtcaaagttcctacttttcttgtgcctgctacacaaaaggtttggatggacttatacacacttgaggtacctgactcaggtggcaagacttgttcgatgatttttgaagaagctggctgtgatcctcctgctagtcctagttgtgctgcatgtatgggtggtccaagagacacatatggacgtttaaatgaaccccaggtctgtgtctcaacaacaaatcgaaatttccctggtcggatggggcacatggaaggccagatatatcttgcttccccctatactgctgcagcatctgcactaactggtttcgtaactgatcccagggagttcttgtag

SEQ ID NO: 1248 - DNA, 753 bp, Glycine Max
atggcattgaaggacacatttttcatatcacatggatcatcaacaatttccatagatgattcaattccagcatgggagttcttgacatcgtggaaggaggtgcttcctcagagattctcttccattcttgtcatttctggtcactgggataccgatgttcccactgtcaatgttgttgatcacaacaagaccatctatgactactatggtttccccaaagtcatgtacaagaaaactaaagtatccagcacccggggggctccacacgtggcaaagagggtgaaggaactactagaagcatcgggcttcagtaaagtggatgaggatagaaaaggtgggcatgatcatggtgcatgggtgcctctgatgttgatagatggtacttaccactacaacttgggaaaggtattggctcctcttaaggatcaggatgttcttataattaggtcagggagtgctctccataacttgagagcaattgggcctcgcaatagccctactgctccatgggctctggcatttgattcctggttaaaaaactctcttattgaaggaagatacgaggaagtaaataaattcgatgagaaggccccatatgcaaaactggctcatccctggcctgatcacttcttcccattgcatgtggctatgggggctgctggtgaaaactcaaaggccaaaattgtccatcatagttgggatgctggttctatttcttgtgcctcttttggttttacagcagctactagttga

SEQ ID NO: 1249 - DNA, 1695 bp, Glycine Max
atggccaaaaagaaagtgtccgaatctctggaccccatggctgccccaaccgatgactcctcctcagctctgcagattcagaacctcaaaaacctcaacgccctccttctcaaggagaccacccaacgccgccaccagattcactctctccagtccgccctccaccgctccgccgtcacattcgacaccaacctcgccttccacctccaaaacgccgtcgtttccgtcttcttcaagaaccagctccaggaaatgaacctccgcttcgacaccctgctcggagatagggacttcgaggtttccgctctcaagcaccagctcagcgacctcgtcgcgcgtctcgagaacgaaacgactgctctcgccgaggatcgtgacgggctcgttcgcgagacgaagcggctggaggcgagcgtcgaccgagagaggaagcttcgggaggaagcggagaaggttaggtcggaaggcgaagagtttttgtctcggaaacagagagacattgcggaactggaaactgagcgagatttggcggttaagagttctcaggagtcgcgtactgcgattggaacgttgaaggaggcgtttgaagcggtgactagggagaagagtgagattcaaagccgaaacagtgctctagagacgaaaatcggttatctggaaactgagttgaagcaactcaacgattatacgcggaaggaagaggagattacgcgtgcgaagattctcgaactggaagggaaccttggcattgccatgcagaaggaagaggagatgaaaatggagataagtgctcttctgaaggagaagaaggaggtggaaatgaatgttgaaatgttaacagaggaaaaagatggtgttcgtgaggctctgagtgtggttcagaaggagttggaggataagcagcgcgagcttgatgaagctgttaaggggaggaatgagattgaggaggtcaaggtcaatctcgagaataaaattgttgagttgcgagggaaagtgaacgagttgaaagagtctggtaaaaagtttgaagaggaaaacaaacagtcgctttcgcaggttaagcgttatgaaaatgctgttgatgaagctgtgcttgagaaggatagcatcaagaaggcatttgacgaggagaagaagaaagtggtgaagttagagctgcttattgcaaaaacgaaggaagtggctgcgaaaagtgatgctgagttgggacaagtgagaagtgaaagaaacaagctagttgagaaggaaaaggaactggaaggcaatgtgagtgttttgagggaagaaaatgaagcattgcagggtatgctcgcgaaggcgcgaaaggagtccaaggatttgaatgccaaggttgaagtttggtgcagcaattcaaacaaagcactgtcattgttgaagactactgctgctgcacttgtgtgtcaacacaaggaaaggggtggtgatgaagtggtggcggcggcggccgatgagaatcctgtggaagaaattcagccgtatgctcaagaactggatgcaataaagaaggctttcaaaactaaggatgagatggtagatgacatgaagcaacaacttgtttcactcaacaagtctgtggctgaggcacacaagagtaagagcttgtggactgtgatatcctctgcaactacaatttttgctgctgtcttagctgcttatgttgctagaggacgctga

SEQ ID NO: 1250 - DNA, 2766 bp, Glycine Max
atggccaagaccacgctggattcgggatggcttgcagctaggtccaccgaggttcatttcacaggcactcaactcaccaccacgcaccctccctctgcctccacccaaccatggatggaagctatcgtccctggaactgttctggctaccttggtgaagaacaaagcggtgcctgatccgtttcgtggactaggaaatgaggcgatcctggatattgctgactctggaagagactattacaccttctggttctttacaacctttcagtgtaagctgtcaggcaatcagcactgtgatctgaatttccgaggaatcaattaccgtgctgatgtctatttaaatgggcaccagatggtcctcccaaaaggaatgtttcggagacattctcttgatgtcaccaatattattcattctgatggtagtaacctgcttgctgttcttgttcaccctcccgatcatcctgggagcattcctcctcaggggggacaaggtggtgatcacgagattggaaaggatgtggccacacaatatgttcaaggttgggattggatggctcctataagagataggaatactggaatatgggatgaggtttccatttctattactgggccagtaaaaataatcgatccccacttggtgtcatcattttttgacaattataagagagtatatctacatgcctcaactgagttggaaaacaggagctcctcgactgctgagtgctcattgagtatccatgcgacaacagaacttgaggggagtattcacttagtagagcagcttcaaactcaaaatctttcaattcctgcaagatcacgggtgcaatatacatttcctgagctctttttctacaagccaaatttatggtggccaaacggaatggggaagcaatctttgtacaatgttattattaacattgatatcaaaggatatggtgagtctgattcatggaaccatcactttggattccgcaaaattgaaagccatattgatggtgcaacaggtggaaggttgttcaaagtcaatggagaaccaatttttatacgagggggtaactggatactgtctgatgggctactgcgactttcaaagaagcgatacgaaacagatatcaagtttcatgcagatatgaattttaacatgattcgatgctggggtggtggactcactgaaaggccagagttttatcattattgtgattattatggtcttttggtatggcaagagttctggattactggggatgttgatggacgcggtatcccagtatcaaatccaaatggaccattggaccatgaccttttcttgttttgtgctagagacacggtcaagcttcttagaaatcatcctagtcttgccctctgggtgggtggaaatgaacaaactccaccagatgatataaatgttgccctgaaaaatgatctgaaacttcatccttattttgaacatggagaagaaaaagaaaaacctgtaggtgatttgtccccaaggttgggggatcctagccaatatcttgatggcacacgaatttacatacaaggatcattatgggatgggtttgcagatgggaagggggacttcactgatggaccttatgaaattcaaaatcccgaagatttctttacagatagtttttataattatggattcaatcccgaggttggttctgtgggaatgccagttgctgccaccataagagcaacaatgccttcagaaggatggcaaataccactgtttaacaaactttcccatggttatgtagaagaagttccaaaccccatatggaaataccataaatacattccatattcaaatccaaccaagaaggttcatgatcaaattcagctttatggtgatgtaaaagatcttgatgatttttgtttgaaggctcaactagttaactacatacaatatagagctcttctggagggatggacttcgcacatgtggaaaaaatatacaggagtattgatttggaagacacaaaatccttggactggtctgagaggtcaattttatgatcatcttcttgaccaaacagcaggtttctatggctgtcgatgcgcagcagagccaattcatgtacagcttaatctggctacatattttatagaggttgtcaatactacatcagaagaattgtctagtgtagctatggaagtttcagtgtgggacctcgaaggcacacgtccacactacaaagttcatgaaaatctcactgcactgccaaaaaaagtaacacctattgttgagatgaagtattcgaagtcaaaaaatcctaggccagtttactttcttcttctcaaactctacaacatgtcagataatacaattttatctagaaatttttattggttgcatcttgctggcggagattacatgctattagagccatataggaagaagaaagtacctctcaagataacatccgaggttttcattgaaggatccacttatatacttcgaatgcatcatgaagttggttggtttaagaggatacacaaatgctttgctgggaaaagtgatgatataggtgtcgctttctttcttcatttttcagttcatgcttcaaataaggaccacaaggaaggggaagacacgagaattctccctgttcattactcagataactatttttcagttgtgccaggagagaccatgactattaaaatatcttttgaggtccctcctggtgtctctcctcgagttactctgcatggctggaattaccagggacaaaccatccatgaagctctttactga

SEQ ID NO: 1251 - DNA, 411 bp, Glycine Max
atggccaagggagagaagaaaccggcggagaagaagcccgcggagaaggctccggcggagaaaacaaaagccgagaagaagatcccaaaggaacccgcctcgggcgagaagaagaagaagaagagaaacaagaagagcgtggagacgtacaagatctacatattcaaggtgctgaagcaagtgcaccctgacatcgggatctccagcaaagccatggggatcatgaacagcttcatcaacgacatcttcgagaagctcgctcaggaatcttccaggctcgcgcgctacaacaagaagcctaccatcacctctcgcgagatccagaccgccgttcgtcttgttctccccggcgagctcgccaagcacgctgtctccgaaggcaccaaggctgtcacaaagttcactagctaa

SEQ ID NO: 1252 - DNA, 78 bp, Glycine Max
atggccaagtgtgaccctcgccacggcaagtacatggcgtgttgtttgatgtatcgcggcgatgtcgtgccgaaggat

SEQ ID NO: 1253 - DNA, 600 bp, Glycine Max
atggccacagcagaagaaatttcaactttgaaactgttgcgccaatatctcttgggggatatttcagacccttttctcaccaatctcattccagtaaaacttgaagacccctcatcaggacttgatatgggttcaaacttctcagaacaaagcagcttctgcaagtttctggagtgctttgattttgaagcagaagtggtaggtctcacttctcatcataaggtccaaagctccattgcaacaagtccaccccagaatttcaattttccagaagaaccaatggtgtcaatgaaaaaggaagcaacatgttatgcaacaaggcattacagaggagtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcataaagccgtgttgaatttccctctagaggctggaatgtctcatccagagcccaacagcagtggcaggaaaaggagaagagagtacacaacagctgccacaagttcaaggcatgttatgtcatga

SEQ ID NO: 1254 - DNA, 1374 bp, Glycine Max
atggccacgcactttccatttcccctctccgctgctcaggttgggacttactttgtggggcagtactaccatgttcttgagaccaaccccgagttggtgtatcagttctattctgatgccagcacaatggtacgcatcgatggcaacgccagagacactgcaactgcaatgctgcaaatccatgcgcttgttatgtcactcagttttattggaattgaaatcaagacagcacaatctctggaatcttggagtggtggagttcttgtcatggtttctggttctgtgcaacttaagggctacaatgtgaggaggcaatttatgcagacgttcttccttgcaccccaagaaaagggcttcttcgtgctcaatgatgtttttcactttgtggaagaggagccagttcatcatcaccaacctgtatttttagctcaaagcaatcttgattcaaaattgaatgctcctagcacaattaacaaaccaggcaaggactttgttgctacgaatgaggtcaaagaaaatggcgcagtcaacaattatggattttcacatcaacaaatgctacgagtccatgattctgaacatattcaggaggatgttgttgctgaagaatcacatggttcatttcaacctactgtggatgctgtgcaagaacatgtaccttctgctgaagaatctcctgaggagccccaaaaacatacttatgcttccatattacgggttgctaaaggacaagctacaccatctgtagcttctcagccatctcagaagaatttgacttctttagactgggatcatgctccactgactaatagtcagcagactacgtcatttgaaaggtctgaaactgttgtagtggaggaggctcccacaacagaagatgaagatgaaatcaaatctgtttatgtgagaaacttgtctcctactgtgtctgcttctgaaattgaagaggaattcaagaattttggcaggattcagcctgatggtgtagtcataagaagtcgcaaggatgtcggagtttgttatgcatttgttgaatttgaagatatgatgggggttcataatgcagtcaaggcaggatctgttgaggtagcaggaagacacgtatacattgaagagcggagaccaaacagtaacatcccttcacgaggaggaaggaggggtagaggtaggagtagctatcaattatcagaggcacaaagaggacgttttggtccaaggagcttttgcaggggaagtggccaagatggaggtgaatgggagtataacaaacccaaaggaaacggtttctatagacaaagtacccgtcaagagaggggatattcttcagggtatcaagggccaagaaatggtcagaaccctgccgaatcagcataa

SEQ ID NO: 1255 - DNA, 933 bp, Glycine Max
atggccacggctttcttgcttgtgagctactacatctttgtgatcaagtgctgcctcaattggcaccgaattgatgttctaagacgtttctctccatctagaaggcgtgaagatccaccaccaacatactcaccaggcacagatactcgtggactagatgaggcactgatccggttaatcccagtgattcaatacaaagcacaaggggataatagagacttagaagagagaagattctgtgaatgtgctgtttgcttgaatgagtttcaagaagatgagaagctcaggattataccaaattgctgccatgtgtttcacattgattgcatagatgtttggcttcagagcaatgccaattgccctctttgtagaacaaccatttccttgacaagcagattccacattgatcagcttctcaacctaaggccttcttcttcttatcctcatgatcaaaccccacctagggaaaacctcattggtggtgatgaagattttgttgtgattgaattgggtagtgatcatgatagaagccaaaatttgcaagaaagaggcaatgctttggagttaccaacatgtcctattagtccttcttcaccaaggaagctattggaacatagaaatgtgcagaagaagaaaacaatgaaactgcagaaagtgacaagcatgggggatgagtgtattgatattagagccaaagatgaccagttctcagtgcaaccaataaggaggtctttctccatggactcatcaggggatagacagttctatttagcagttcaagaagctctgaggcatcagaacaggcaagtcaatgaggtcaactccattgaaggttgcagtggtagtggtagtagagccaagaggtcattcttttcctttggacatggaagtagatccaggagttctgtgcaacctgtttctttggacccctaa

SEQ ID NO: 1256 - DNA, 636 bp, Glycine Max
atggccacgttgatgggtaaagcgccacgaattctatacaccacccaacacttggtgaacaattctgttacgcttccgacaaactttgctgcaatggctactcactctgctgcgacggagaggacttacaaagaatcattcgattccgctgcaaacaagcgctacgctgatcacataattcctcatattctgcatctgtatggatcatctgcaacctctcgcgactttgaaatctatgccgcaaatgcttcatttgaggatccacttatgtgtgcccacggggtgaaacagatcaaatcagcattctatactcttcccaaggtatttaagaagtcaaagatagtggaatacagtatcaaagaaaatatggtttcaccaggaaaaggagagatattaattgacaataagcaatactacaaattcttggggaaggatataaatatggtatcactaatcaagttgtatattgaggagggtaaagttgttcgccatgaggactggtgggacaaaaaaccaatttcaaatagagaaacggcgaagctgccactgcttggtcgaatagcagaaatgactcgcaggggatcaatgctggcaacacatgtgcttatgagatttgggaaggacccaaatgtgtga

SEQ ID NO: 1257 - DNA, 1422 bp, Glycine Max
atggccctcgaaacgctcctcgtgaaggtcaaaaccgccatatcaaacagcatcgactcggtcccgccgaagctcctgaagaagaagccttctttcaaagcgaagcaaaacgtcggcgttttggcgttcgagatcggcggcgtgatgtcgaagctcctccacctctggcactcgctctccgacgcaaccatcgtgcgcgtccgaaacgacgccgtgaacctcgagggcgttcggaagatcatctccaacgacgagtcgttcctcctcggactcgcctgcgccgagttctccgagtcgctccgagtcgccgctaactcggtgacgcggctcagcgcgcgctgcgaggattccgccctgcgctccttccacctggccttcctcgagttcgcggactcgggccgcgacccgaacgggtgggccctctccggcccaaaagaaaccgattcgaagctcaagaaaatggagcgttacgtgacgttcacggcaacactctaccgcgaaatggaggagctcacggttcttgaaaactccttaagaaaagccctgaatcacgctgacggcaacagcgttgggagcaaagatcagcagaagctctacgagcttcagcagaagatcttttggcagaagcaagaggtgaaggatctaaaagaaagatctttatggagcagaagcttcgacaatgttgttgtactcctcgtaaggttcagcttcaccgttttagcaaggattaaggttgtcttcggaatcggtcaccacatgccttgtctgtctcgtactttgtcggcttccgccactgtttatccgtctgatcaaaaccctaatgggttcgtttatgagtcattggaagaagaagactcgaagcttgaagaagaggccgtgaatgggttttttgaggcaaactcgaagcttttgagaccacccgagagcacgctgggtgctgcgggtttggctttgcattacgcgaatctgatcatagtgatggagaagatgataaagtcaccgcacttggtgggtgtggatgcgagggatgatttgtatgggatgttgccgaggagcataaggtggggtttgaggggaaggttgagaggggtggggttttgtgcgagtgatcctctgctcgctggtgagtggagagatgcgttagggagaatattggggtggttgtcacctttggcacataacatgatcaagtggcaaagtgagagaagctttgagcaacacaatttggtgcccaagaccaatgtgttgttgttgcagactttgtttttcgctaacaaggacaagactgaggctgccatcactgaacttcttgtggggttgaactatatttggaggtttgagagggaaatgactgctaaggctttgtttgaatgcgccaattctaatgggctattgttaaagttgaacaaatccagtcaatga

SEQ ID NO: 1258 - DNA, 879 bp, Glycine Max
atggccgaggtctttctaacatcactgtcagctatggtggctgagaccacaactttccccatagacttgatcaagaccaggctccaactccatggtgagtcactttcctcgagtcatcccactagtgcatttagagtaggcttgggcattattcgtgaacaaggtgctcttggcctttacagtggcttgtcgccagcaatttttagacacatgttctacacgcctattcgaattgttgggtatgagaacctgagaaatgtggtttctgctgataatgcttcgatctctattgttggcaaggctgtagttggtggaatctctggtgttgtggctcaggttatagccagcccagctgatcttgtcaaggtgaggatgcaagctgatggccaaagggtgagtcaaggtcttcaaccctggtattcggggccatttgacgctctaaacaaaattgtttgtgctgaaggatttcaaggtctgtggaagggtgtttttcctaatatccaaagagccttcttagtgaacatgggagaattagcctgttatgaccatgctaaacaatttgttattagaagtaggatagctgatgataatgtttatgcccacactttggcttccatcatatcaggtctggcagcaacttctttaagttgtccagctgatgttgtgaagactagaatgatgaaccaggctgctaagaaggaaaggaaagtcttatataatagctcttatgattgcttggtaaagacagttaaagttgaaggaataagagcattgtggaaaggattcttccccacatgggcaaggcttggcccatggcaatttgtgttctgggtttcctatgagaagttcaggacatttgcagggctctcttctttctaa

SEQ ID NO: 1259 - DNA, 1009 bp, Glycine Max
atggcctacttaatgctaagtggtgctgaaagtacaaagctcactagtggtagtggcttagctccatctgggttaggctcaattggtcttaactttcacaagaggtgtttcttcaagaagagtgttgtgtcctatggtatcaaatgcgtggtacccagatgcagcatctcatcattgagtcctgcttctcaacctggattcaaggagggattttggttctacaggtttttggctactattgtgtatgatcatgtcataaacccttgccactggactgaagacatgagagatgaggcattggaacctgttgatatctatgaccgtaaaatgagagtggtggatgttgagggaggaactgcattcaccactcttggtatagtgaagcatgtggatgctaaaaatgttacaattattgaccagtcccctcaccagctggccaaggccaccaagaacaagaaggaacccttgaaagaatgcaagataattgagggtgatgcggaagatcttccatttccaactgattgtgctgatagatatatttctgctggaagtattgaatactggcctgacccacagcgtggcattaaggaagcatacagagtgctgaaaataggaggcaaagcatgtatcataggtcctgtatacccaactttttggttatctagattctttgcagacatgtggatggtcttccccaaagaggaagagtatattgaatggtttaaaaaggccggtttcaaagatatcaagttgaaaaggattggtccaaaatggtatcgtggtgtaacacgacatggtctcatcatgggttgctctgtgactggaatcaagcctttatctggggactctcccctcaagcttggtcctaaggcagaggatgtaatgaaaccagtaaatccagttgcttctctcgcggatccttcttggtacaattgcagctacttactatgtactagtttcaatttacatgtggatcaaggacaaaattgttccaaagggcttgcccatc

SEQ ID NO: 1260 - DNA, 804 bp, Glycine Max
atggcgaaccggtggtggaccgggtcggtgggtctggagaactctggcgactcaatgaaaaaaccggatctggggttttccatgaacgagagtgcggtgacggggaaccatacaggagaagaagaggagaaagagaacagcgacgagcccagagagggagcgatcgacgtctccaccacgcgccgccctaggggccgtccaccgggctccaaaaacaagccgaaaccgccgatatttgtcaccagagacagccctaacgcgctgcgaagccacgtcatggagatcgccgccggagccgacatcgccgactgcgtggcgcagttcgctcggaggctccagcgcggcgtctccattctcagcggcagtggcaccgtcgtcaacgtcactatccgccagcccacggcgccaggcgccgtcatggcgctccacggccggtttgatatcctctccctcacaggctcctttctccccggaccgtcccctcccggcgccaccgggctcaccatctacctcgccggaggccaggggcatgtcgtcggcggcggggtggtgggcccgctcttggcggcgggtccagttttgttaatggcggctacgttttccaatgctacgtacgaaagattgcctctagaggatgatgatcaggaacacggcggcggcggaggctctccgccgggaattaccggcggtcccggcgaggcctcgtcgtcgatttcggtttataacaataatgttcctcctaatttaggtctttcgaatgggcaacatctgaaccatgaagcttattcttcttctccttggtga

SEQ ID NO: 1261 - DNA, 1731 bp, Glycine Max
atggcgacagtttcaagcgaattcctgtcgcattgcctcccacttggtaccaactcgaagcgcgcgtggcttccaaatccaagcaacaccgtgatcacctgcagaatcccacttctaaatgaagacaaccccagcaagcgaagactgaacaacaacaacaacaacaagggacacacgagggtcacttcctccgacacaagaccccaacaacaacattacgattttcgagacacccatcacatgaaagccctcaacaggctttgcaaaacgggcaagtacaccgaagccctctattttcttgagcaaatggtgaagaggggttacaagcccgatgtcattctctgcaccaaactcatcaagggcttgttcacttccaagagaacagagaaagcggtgcgggtcatggagattctggaacagtacggtgaccctgattcttttgcttacaatgcagtgataagcgggttctgcaggagcgataggtttgatgctgccaatagggtgattctgagaatgaagtatcgaggcttctcccctgatgttgttacctacaacattctcattgggagtctttgtgcaagggggaagcttgatttggctttgaaggttatggatcagttgctggaagataattgcaaccctactgtgattacttatactatcttgatagaagcgactattatacacggcagcattgatgatgcaatgaggcttctggatgagatgatgtcaagagggcttcagcctgacatgtacacttacaatgtcattgtgaggggcatgtgcaaacgcgggttggtggatcgagcgtttgagtttgtttccaatttgaacacgacgccaagcttgaacctctacaacttgctgctcaagggtcttttgaatgagggcagatgggaagctggggagaggttgatgtccgatatgattgtgaagggttgcgagccgaacattgtgacctacagtgttttgattagttcgctgtgtcgcgatgggaaagctggggaggctgtggatgtgttgagggttatgaaggagaaggggttgaaccctgatgcttattgctatgatccgttgatttctgctttctgcaaagaggggaaagttgatttggctatagggttcgtggacgatatgatatctgctgggtggttgccggatattgtcaactacaacacaatcatggggtctttgtgtaagaagggaagagctgatgaggcattgaacatcttcaagaagcttgaggaagtgggttgtccgccaaatgcaagttcttataacacaatgttcggtgcgctgtggagtagtggggacaaaattagagcattgacgatgattttggagatgttgagcaacggtgttgatcctgataggatcacgtataattcactgatatcaagtttgtgcagagatggaatggtggatgaggccattgggttgttggtggacatggaaaggaccgagtggcaacctacggttattagttacaacattgttcttcttggattgtgcaaagcacacagaatcgtagatgccattgaggtgctggctgtcatggttgacaatggatgtcagccaaatgaaactacttacacgttgttggtggaaggggttggttatgctggatggcgaagttatgcagtggagctagctaaatcccttgttagtatgaatgctatttctcaagatttattcagacgtttacagaaacaaaaccatttccgtgcctga

SEQ ID NO: 1262 - DNA, 399 bp, Glycine Max
atggcgaccgtagctgctgctcctgctttaactgcaaacgattcccacaaaaagtacagaattcaggtttccaacactaagaaacctcttttcttttacgtcaatctcgccaagaggtacatacagcagcacgatgaggttgagctttctgctcttggaatggctatagctaccgttgtcacaatttcggagattttgaagaacaatggacttgccactgagaagaaagtattgacatctacagttggcatgaaagatgagaacaaaggtcgtctggtacagaaggcaaagattgaaattgtgctggggaaatctgacaagtttgacaatctgatgtctcctcctgcaccaactgaatcagaagcagcagctgctgatgatgatcatgacaaaaagtga

SEQ ID NO: 1263 - DNA, 3651 bp, Glycine Max
atggcgacggaagagaaagagaagggatacgaagggggagcaggagggaagtttcggaaacgccccttccgcagcaggtcccaaacgacgccgtacgaccgccccccaacgtcactgagaaaccctaactggaagaacaacggttggttgtcgaagctggtggatcccgctcagaggctcatcacttacagcgctcactctctcttctcctcgctcttccgcaagcgccttccaccaccttcttcagtgcaagcttcacttgaattaatgtcacttttaaacggaacgggaagcgaggaacaatcatcctcaggaagatgccacctttgtaattctgttactgttacaaacaattcctctggcacgcagcaaggacctgttggaggaagtgatgctcaaattaattgttctgacgggggtggattaactgaacttgagaaactattaaagcagaagactttcaccaggcatgttttatctgagattgatcatttgacagcacttatgcgttcaagaactgtcaatgcacctgtcagggaagaggagaaggggacagaaatggtcccctcagaaccaatgttgctgagtggacaaaaggaatatcccaaaacacctgcactagaaaatgggactaaaaatggtcttgttgtaaccccacatgttgcttcaagttttcctgttgaggatgttgcttcacctgcagagcttgcaaagtcttacatggggagcaggcctaccaaggtatcctcttcaattttaggcatgcaaactcttgcactcagggaggatccaactcttgtaaacagtgaaaacgttgctctgaaatcccctattatgtccattgtgccaagggctactagacatgctgcagttcatgaaaatggttttgtgaccgcaagatctcgtggcagatctgtgatatataatatggctcgaacaccgtatgccagaatttatccaacatccactctcaagggtggggggcgtgctgttgaaggtgagccatcgtcttcaagtcagtttgcattggatcatgatgtgcattctggatctaaactagggtctgtaaaacatagaagttcagtattggataatgatataggatctgttggtcctgtacggcgaattcgtcagaagtctaatcttctatattctataggctcatgctcacctatttctggtagctcttcatctgttgctaggggcggaatggttaaggatgctgctcagcaacccttttcgagcttcccctctttaccctcaaaatccagtgaagtggcttcaaaaatactgcatcaacttgataagttggtttctccaaaagaaaaatcatctgaattaaggctaccaattgtgaatgataattcaccaacaaagttgtcgccttccatgttacgtggacaggctcttagaagcatggaaatggtggattcatcaaaattgctggacagtgtacatggtaataaaatagatggcccatttggaaatttgtcaactagtgctcagaatcagaagtcaaattctcagagagataagattgaaaatgctgcagatgctacaaagccaaggaatcaagtcttatctagtgcaaaatctggggattcttttatgataaaatctgtttctggccctccacaaaagaagagggcattccatatgagtgcacacgaggattgtctggatctggatgatgatgcttatccaaatggagctgtcgcttctttttctcctgttcagaaagaaatgacaaactccactgctgtgatggagaaaactacttctggtactgaagcaattgcagaggagaatccatcagcattatctgtaacaatgccacctaaaagttctacaatagatggtgaggctcatgttgggactgccgatgagtctaggccatttacatcagctacacaaacaagttttggttttatcaagcctgcttcaccaaatggatcaattgttaaaccttcctttacttttgggaataaagtggtttcgtcgacggagtttatggctcctggtgctccatcaatggagataaccaaatctggtccaatatttggattggaaaaagttgtttcattaagggagcctgttgctgatggtccattggttgactttggctccaataaaaatgttaacaaggttccatcaatgccatttactgctgcatcatcagttggtggtgaatccccttttctaaaatttggtgtttcttctgactcaaatctgggaagttcaattggctctactattgttactggtgtgactgattctatgccaaaagttcgtgaatctgataatggcaatactgagactaataaagatactggatcttctgttagggcatcagaactagctatttcatctgctccatcaacattcccttcattttcttcttttccacctcctgtatcaaatatactcagtagttcatcatctgctgccccaagcagtggcgttagtgccgctggaaattctactagcatgggagctatcacacctgccacaattgcatcaagtaatagcagttcctccacagtggtggcatcctcatcttcagcaacttcctttttcaaatttggatcctctcctgtccgatcagtaggtttacctgtgtcatcttctggtggttcagaaccaccagaaattaaaagcaggcaggatgcaggaaccggtggtcttagcagcactgcctttggtagctcatctgcagggagtggtatttttggcttcagctcttcagcaatgacaactgtaaatagcagccagtctcagagttctgccgttggtgctagcagtggttctgtgcttggtgcccaggcttcatttaccagtgggtttgcaacttctactcagacccagtctgtttcatttggttcatctgcatcttcctcatcttttggattgtccgggaacacacctttttcaagcagttcttcatttccttcgtccagccctgcagcaagtgcagcttttctttctgggaattcgttgtttccttcttcaagtcctgccacatcttttggacttggcacctctgcttcctctttggctgtcaactctgttagctccaatagtggtccaagttctactttatttggatctagttggcagcccagcaagtctccatttggttccacatttagtacatcattgtcatctgggtttttgttcggaacatccactgcttctgttacttctgccagttcaccctcaatgtttttatcaacctccagtgcatcaattcctcaattctcattcactccggcagcagcagcctctacctccacacaacctgcttttgtaagtcctaatcctgccttcacattcggttcagctactgttaataatggtcagatgagtatggaggacagtatggctgaggatacaggtcaagcaactccacctgcgacttctgtatatagtcagcaacctgccccagttcaatcaaattttgtatttggagcatcaactccatcaggaggcagtcctttccagtttggtagtcaacagaatattgctccacagaacccttctccttttcaggcttctggcagtctaggagggagtttctcattgggcacaggtggaggtgacaaatctgctagaagaattgtgaaagttaaacataaaccacgcaagaagtag

SEQ ID NO: 1264 - DNA, 414 bp, Glycine Max
atggcggacaaggcagtcaccatccgaaccagaaagttcatgacaaacaggcttctctccagaaagcaattcatcgttgatgtccttcatccagggagggctaatgtttccaaggctgaactgaaggagaaattgggcagaatgtatgacgtgaaagacactaacactgtatttgtcttcaagtttcgaactcattttggtggtggcaagtccactgggtttggtttgatctatgattcagttgagaatgccaagaagtacgagcctaagtacaggcttatcaggaatggacttgatactaaagtagagaaatcaaggaagcaaatgaaggagagaaagaatagagctaagaagattcgtggagttaagaagacaaaggcttccgatgctgccaaggctggaaaaaagaaatga

SEQ ID NO: 1265 - DNA, 417 bp, Glycine Max
atggcggacaaggcagtcaccatccgaaccagaaagttcatgacaaacaggcttctctccagaaagcaattcatcgttgatgtccttcatccagggagggctaatgtttccaaggctgaactgaaggagaaattgggcagaatgtatgacgtgaaagacactaacactgtatttgtcttcaagtttcgaactcattttggtggtggcaagtccactgggtttggtttgatctatgattcagttgagaatgccaagaagtacgagcctaagtacaggcttatcaggaatggacttgatactaaagtagagaaatcaaggaagcaaatgaaggagagaaagaatagagctaagaagattcgtggagttaagaaggtaatgcaattctgtattgttgactattgtttacagcttatataa

SEQ ID NO: 1266 - DNA, 2676 bp, Glycine Max
atggcggaggaggaggaagacgacgagagcttcggcgagttcacgttcgcgtcgtttccgagtcaaccaacctcaaacgacaccaatcccctcgacgacgacgattggggcgacttcatgaaccattccaaccggatcaacggacccttcgactcgttcgggcttcccacggatcccacgaacaaacacgtgaacgacgacaaaggcgttgccgttcaggccgaggcagcgaaaaatcccaagggagctattccgctttcgatcttcggcgaggaagagggagaagaagaggagaaacccgcttctgccaatgttttctccaacggcggcggtggtgcggtgaaaaggggatccggttcgaacgggtctgttggaatcagtgatttgatttccagtttgtataatcagcagcgccctcaggtggattctcacaacaacggatcggtttcggtatccaatgttgctgctcccaatccgacgtactcgaacggaagcaaattaaattcggatgaggatgaggatggatgggaattcaagtctgcggaatgggaaactggaaccaagagccaggatgttaaggctgaaacaccaaagcatgataatggtgctcttgatgttggtactgtgttggattcatccaatgggattttagacaaagctggcagatggcacgtggagtttgagttcagtccacattctgcatcgcaagatcatgttaacccacaaccaagtccagaaagtgaatcaaatgacattggaactgggtttgccatgttcagtcaaaattttggggagtttagttcagggtcagggccaaatcaaaatttggtgagttgtttttacataatttcctcattttgtgttacattgttcattcagattattgaggaatgtccattaacacaatctgattgtggatttgtggtattaggaaaatctaatcaacctgatggatggaactttggatttaatttcaattctagttctgtgggtgaagacaatcatagttcagattcatatttcaaaaccaaaaacaatcaggatgataacaacagaaacaatgcttccccaactaatataaatgttgattcacatgtcaatttctttgaatcagagagtgatgttacaaaacatgagaagcccctaacaagctcagagaatcgtagggaagccatgcctctgtcaatttttggtgatgagacaccagatactgataaacatcctgtgactcaagatttatctccctatacaccaacatccccaataaggaacagcttcaacagccctggttccaacttttctatcaatgacatatggaatttatataatcaagctgaaaaccaaagttctcctaatatgacaccaaaagcaagtgaaaatcagattcatgcctcccctgaagtattgggctccagtttggttaccagtaatgataatttagatgatgacttctgggactataaggatgctgcaactgaaacaagatttaccaatgaatctgcacagaaaacttcttcaccacaagtcaatgagaatgtgttgcagtcttccccaacatttttaaattctgatttgaccaacggtgatgatgattttgtggatgattcatgggtgtttaaggatgctatctctggaacaataagtcaagatcacacaccttctctcgatcacagagatttaccacagttatcaacaaaactagagcaggttgattatgcagagttttatagcaaagtgaaggatgaattgtgcaattatgttctgttccatcttcagaatctcaagaaaactcaaaatgttgctgctctttcgggtgaagatgccaaagcaaaagctcttctggaggaaattcaggaattctccaagatactgcatcaggataatatgagcatccccaatgaatatctctctgaggattattgcccaagaaatgtctgctttaatgaacttcttgaagttttgaaggaacctaagttccaaccttttgagtcagaataccaactagcatcaaggttgttgatggccgagaaggatattaaatgtgttatggaacttttgaaagatacagtatcaacattaagaattctcaagctgggatcaacagaagaacaatctaattatcttaccatatggtccaaaatagcctttgtttgttctcaagagctgaaacatggtgcttatgtttggaagcaagctgtactacagaatacccatgaccagatattatctagcccgaaaggtgttcagtttatccttgcactcggagaaatttatagagtggcagaaattattggaacttcagccaaacttcacaaaccttggatgttatcaggtgccacagatcacaaaagtttgtgtgcccttttgaacgaatgttatggcatatggttggcttcaggacttgaagaagctattttgagtatatcaaattggaataattttgagccagatggcatttcaagggaattagttgaatccatcaagtatattcacgagcttgatgaacatgcacttcagagctttgtcatctctggagaacaaactacttgccagttgtcagccttgccagctggtttcataccaggattaaatttggttgcatggaatgggaagcattacatcgtcaagctagcaaacttgtgggtcaatctaataagctcagatccacccaagtga

SEQ ID NO: 1267 - DNA, 2628 bp, Glycine Max
atggcggaggaggaggaagacgacgagagcttcggcgagttcacgttcgcgtcgtttccgagtcaaccaacctcaaacgacaccaatcccctcgacgacgacgattggggcgacttcatgaaccattccaaccggatcaacggacccttcgactcgttcgggcttcccacggatcccacgaacaaacacgtgaacgacgacaaaggcgttgccgttcaggccgaggcagcgaaaaatcccaagggagctattccgctttcgatcttcggcgaggaagagggagaagaagaggagaaacccgcttctgccaatgttttctccaacggcggcggtggtgcggtgaaaaggggatccggttcgaacgggtctgttggaatcagtgatttgatttccagtttgtataatcagcagcgccctcaggtggattctcacaacaacggatcggtttcggtatccaatgttgctgctcccaatccgacgtactcgaacggaagcaaattaaattcggatgaggatgaggatggatgggaattcaagtctgcggaatgggaaactggaaccaagagccaggatgttaaggctgaaacaccaaagcatgataatggtgctcttgatgttggtactgtgttggattcatccaatgggattttagacaaagctggcagatggcacgtggagtttgagttcagtccacattctgcatcgcaagatcatgttaacccacaaccaagtccagaaagtgaatcaaatgacattggaactgggtttgccatgttcagtcaaaattttggggagtttagttcagggtcagggccaaatcaaaatttggtgagttgtttttacataatttcctcattttgtgttacattgttcattcagattattgaggaatgtccattaacacaatctgattgtggatttgtggtattaggaaaatctaatcaacctgatggatggaactttggatttaatttcaattctagttctgtgggtgaagacaatcatagttcagattcatatttcaaaaccaaaaacaatcaggatgataacaacagaaacaatgcttccccaactaatataaatgttgattcacatgtcaatttctttgaatcagagagtgatgttacaaaacatgagaagcccctaacaagctcagagaatcgtagggaagccatgcctctgtcaatttttggtgatgagacaccagatactgataaacatcctgtgactcaagatttatctccctatacaccaacatccccaataaggaacagcttcaacagccctggttccaacttttctatcaatgacatatggaatttatataatcaagctgaaaaccaaagttctcctaatatgacaccaaaagcaagtgaaaatcagattcatgcctcccctgaagtattgggctccagtttggttaccagtaatgataatttagatgatgacttctgggactataaggatgctgcaactgaaacaagatttaccaatgaatctgcacagaaaacttcttcaccacaagtcaatgagaatgtgttgcagtcttccccaacatttttaaattctgatttgaccaacggtgatgatgattttgtggatgattcatgggtgtttaaggatgctatctctggaacaataagtcaagatcacacaccttctctcgatcacagagatttaccacagttatcaacaaaactagagcaggttgattatgcagagttttatagcaaagtgaaggatgaattgtgcaattatgttctgttccatcttcagaatctcaagaaaactcaaaatgttgctgctctttcgggtgaagatgccaaagcaaaagctcttctggaggaaattcaggaattctccaagatactgcatcaggataatatgagcatccccaatgaatatctctctgaggattattgcccaagaaatgtctgctttaatgaacttcttgaagttttgaaggaacctaagttccaaccttttgagtcagaataccaactagcatcaaggttgttgatggccgagaaggatattaaatgtgttatggaacttttgaaagatacagtatcaacattaagaattctcaagctgggatcaacagaagaacaatctaattatcttaccatatggtccaaaatagcctttgtttgttctcaagagctgaaacatggtgcttatgtttggaagcaagctgtactacagaatacccatgaccagatattatctagcccgaaaggtgttcagtttatccttgcactcggagaaatttatagagtggcagaaattattggaacttcagccaaacttcacaaaccttggatgttatcaggtgccacagatcacaaaagtttgtgtgcccttttgaacgaatgttatggcatatggttggcttcaggacttgaagaagctattttgagtatatcaaattggaataattttgagccagatggcatttcaagggaattagttgaatccatcaagtatattcacgagcttgatgaacatgcacttcagagctttgtcatctctggagaacaaactacttgccagttgtcagccttgccagctggtttcataccaggtatgtgcactataatcttgactgtcttcaaatgtaagcgataa

SEQ ID NO: 1268 - DNA, 555 bp, Glycine Max
atggcggattcttcaagcaactcaaaggatcaccacaacacccgcgtctaccacccttaccaggacctcaacgtccccattcagaagctctacaacctccccaccgcgccggagcacctcttccccgaagaagccgccaggacccaccgctcctggggtgacaacctccagtactacaccggctccggctacctcgccggcgccataaccggcgccgccaggggcaccgtccagggcctccgcgaggccgagtccgccgactccctcaaaatccgactcaaccgagtactcaactcggggggcctcgcgggtcgcagactcggcaactcgctcggcgtggtgggcctcatcttcgccggcctcgagagtgggatgacccacttaaggggcaccgatgacctcgtcaacagcgccgtcgccggactcggcaccggagctctctatagggccgccgccggaccccaatccgccgctattgccggtgcgataggtgggatcgccgccgccgcagcggtcgccgggaagcaagctttgaaaagatacgtgccgatctag

SEQ ID NO: 1269 - DNA, 213 bp, Glycine Max
atggcgtccgagtgcaaaggtaagagctcatggcctgagttggttggagtggaaggaacggtggcggtggctacaattgagagggagaatcctttggtggatgctaacactgtgcttaaaggatccatcgtcaccgctgattttcgatgtgatagggttcgggtttgggtcaccaaacatggaattgtttatcaggctccaagaattggataa

SEQ ID NO: 1270 - DNA, 2100 bp, Glycine Max
atggctaccaagcattcactaatgtctctctttcacagaacttcatcacagggtgagcacaacccgttaaacatgtccgatgagcagatattggaccaaatttactcaacccatgtccacagtcacacaaagtttgatgtagactctcttttcattcttgttgagaacacccttaggcgttcaactctcattgttgacaatgttgttcagggttccaaagcaagcttggagcaggtagaagacaagattccccaagccaacttcaattctccactctataccctgaagcaaatttattccgagatgtcatgcaagcctccaggagaggaaatagctcatataactacaatggccatacttgtcaagctctcaaactatgagtgggatgcaaaagcagtgctgacactggcggcttttgcaatggaatatggcgagttctggctgctagctcagcatcaaccaacagaccctattgccaaatctgtggctgttctgaagggagttccagtgctcacaagacctgcagcagtgcaaaagcatcgccaagccatcactgagctcaacaatctggtcaaaacaacgttgctagtcattgagttaatctttgagttggagaagcttacaacttttgacacaaaggatgtgcctgctttgttgcccgcaatagaacaaattcctgttgatgtctactgggctatcatcaccattgtggctattgttactcagattgattacctcactactgagtcagggaacaagcaagacctgtcccactatggtcaaaagatcaacatcatacttagcaaactgaggaagcaaatcatgctgtgcagacaacagattgaagttgcatttaaaattaaaattcaattgaaaagacatatgaagttgcaaacaacatgcttaagtagattatttgtctttttcttttcagaggaggcagagtatcaccacaggctcaggaaattttttcaaacgcctactgaaattatggaagtgtttaagtttctagtttattcgaaggatgctccacagctactgtttgatggtgccgctaagaccacggtcgaaatcactgagctcaagaagaagcatgtttacttgctgatttccactctagacatcacggaggaagagatttcagtactccgaccagtttatgattctattaaagctaatgatcagtataagattgtgtggattcccattgtagaagaatggaccgaaaagctgcacaagaaatttgagtttttgaaaagcaagatgccttggtatgtggtgcagcattctggacccatagcagggtacaaatacatcaaggaggaatggcacttcaaaaagaagcctatggttgtggtgttgaatcctcaaggaaaagtgcagcatgcaaacgcattccatctcattcatgtttatggaatgaaggccttcccctttactattgcggatcaagagagaattgatagagaaattcactggattggttctgtagtcggggattctcacccccacataagcacatggattagagagcaaaagtacattctcatatatggaggcagtgacaaagagtggatccatcagttcacaaagcatgcaactgcctttgcaaacgacgccgctctgaaggatgcaaagattcatattgagttgttctgtgttgaaaaggaagataaaagcttcctgaggcggttttggagtggcatagaaagcttgtttgtgaccaaggctcacaacacagttgatgcagtgactcaagaagtgcaaaagatgctctcttacaagaatgaaactgggtgggctgtcctatgcaaagggtcatctgtggtgatgagtggtcatggaaccacaatcttgaagacagtggcagagtttgagaaatggaaagagtttgtggtgaaaaaggggtttgagccctctttcaaagagcaccatgaaaggattaggcgcacccatcatcgctgcatacaccttgaaattcctaatgctgctgggaagttaccagagaccatacgatgcccagagtgtggtaggataatggagattttcatcagttataaatgcaaccacagtgataatacttcaattgcttcaaactag

SEQ ID NO: 1271 - DNA, 1080 bp, Glycine Max
atggctagctcttcagttttcacgtcttacattgttttgagtctagtgatggcactagcaattagcggtttcaatttcaaaggggcagaggcagcacgtgccttctttgtgtttggtgattctctcgttgacaatggcaacaacaactacttagccaccacagctagagcagacgctccaccttatggcattgattatccaactcgcagacccactggccgtcaagaacttgggtcagagtccacgttgccatatttaagtcctgagctcaacggggaaagattgctcgtgggtgccaactttgcttctgctggcattggaatcctcaatgacactggagtccaatttgtaaacatcattagaatcacaagacaactggaatacttccaagaataccaacaaagggtgagtgccctcgtcggagatgagaaaacaaaggaattagtaaatggagcactagtcctcatcacctgtggaggtaacgattttgtgaacaactactacttggtgcctaactctgctagatcccgccaattcgctttgccagattatgtcacgtatgtgatctctgagtacaagaaggttctgcggaggctatatgatcttggagcacgtagggtgttggtgacaggaactggtccactgggttgtgttccagcggaattagccctgcgtggcagaaatggagaatgctcagaggagctgcagcgtgcctctgccttgtacaacccacaacttgttgagatgatcaaacaactcaataaggaagttggttcagatgtcttcgttgcagccaacacacaactcatgcacgatgatttcgtcactaatcctcaagcatatggatttattacgtcaaaagtagcatgttgcggtcaaggaccctttaatggtcttggactatgcacggtagtgtccaacttatgtccaaaccgtcacgaattcgcgttttgggatccattccatccatcggaaaaagccaacaggttgatcgttcagcagattatgtcaggaacctcaaagtacatgcacccaatgaatctcagcactattttggccttggattccaagaaatactaa

SEQ ID NO: 1272 - DNA, 1504 bp, Glycine Max
atggctagggatcagttgcaagtgcttaatgcactcgatgttgccaagacacaatggtaccatttcacagcaattgtgattgctggaatgggtttcttcactgatgcatatgatcttttttgcatctcccttgtcaccaaattgcttggccgcatatactactttgaaggccacgacaagcctggctctctgccatcaaatgtttctgctgccatcaatggtgttgcattctgtggaacccttgcaggccagcttttctttggctggctcggtgacaaaatgggaaggaaacgtgtctacgggatgacccttatgctcatggtgatatgctcaattgcttctggtctttcttttggcaaagaccctaaagctgttatggctactctttgcttcttccgtttctggcttggatttggcattggtggtgactaccctctttcagccactatcatgtctgagtatgccaacaggaagactcgtggggcattcatagctgctgtttttgccatgcaaggttttggaattttggctggtggcacggtggcaattgtagtttcatctgctttcaaggccctgtaccctgctccagcattccaggttaacccagttttgtccacagtgccacaagctgattatgtttggaggataatcttgatgtttggtgcactcccagctctgctcacatactattggcgaatgaaaatgcctgagactgcaaggtacactgccttggttgccaagaatgccaagcaggcagctgcagatatgtcaaaggtgctgcaagttgagatagaagctgaacaggagaaagttgagcaattggacacaagaagagggaatgaatttggcttgttcacaaaacagttccttcgccgccatggacttcaccttgttggaacagccactacttggttcctgttggacattgcgtattatagtcagaatcttttccagaaagacattttcagtacaattggttggattcctgaagcaaaaaccatgaatgccgttgaagaggttttcaaaattgctagagcacagaccctcatagccctttgcagtaccgtacctggttactggttcacagtggcactcattgataagatgggaaggtttacaattcagttgatgggctttttcttcatgacagtgttcatgtttgccttagctattccataccaccactggaccatgaagggcaaccaaattgggtttgttgtgctgtactcattgaccttcttctttgccaattttggtccaaatgccaccacattcgtcgtgccggcagagattttccctgcaaggctaaggtctacatgccatggcatatcagctgcagcagggaaagcaggggcaatggtaggggcttttggctacctgtatgctcagaatgccattgggctgagaaatacacttatagttttgggtgtgattaacttcttggggatgctgtttacattcttggttcctgaatctaaaggaaaatccctggaggagatgtctg

SEQ ID NO: 1273 - DNA, 1002 bp, Glycine Max
atggctcacggtgcttacagcaagcggcgcgtgagcgcaacgcgtcgatccaactccaagcctctgggcatcgccaagaagcccaagcccaagcccaagccctccgtttccctcaaaaaccagattcgatcccttgagcgcatgctccgcaagaatctgcctcccgaggtgcgagacgcgcaggaacagaagttggaggcgctgaagaagcagcaggagattcacactcgcctcgccgccgaacgcaagatattcttacgcgaccgaaagatcaagttcttcgagaggaggaaaatcgaaagacgaatcagacgcctcgagaaactgcaccgtgcttcttcttcctcttcttccgctgcccagccttaccctgaccagctttccgctctcaaaaaggatcttcaatatgtcatgtactttccgaagaatgagaaatatgtgcctttgtttaccggcggtgatgattcggagatagttgaccggagaaacgggctgcgcaaacagattgaagataggttggttgcagctgctgcaagtggcaaggatttagaagagactggcagtgaggatgatggtcttttggatctgagtgatgatgatttttttcttgccgggagttctagtgacgaagcagatgcggatgatgaatggacagacaaaagtgcaagagagcaggcttctagtgcttctgggaaaggtgtgtctggcatgtccagtgacgaaaaaaatcagaggcagatttctgctagagctttgatgcctcctcctcgtccttcaaacatgaagttgtcaagatttgggtcttcttctggccataattcatctgcgcagagatctgagatttccacatcgagcaacacatcaaatagcaaaagcagctcagacttcaaagtaagaccctcaagatcagggactggtcatggtagtagtctaagctccaactctgatgctcacaagcctcggaggaagagaagacctaagaagaaaaagaagcaggtgtag

SEQ ID NO: 1274 - DNA, 996 bp, Glycine Max
atggctcacggtgcttacagcaagcggcgcgtgagcgcaacgcgtcgatccaactccaagcctctgggcatcgccaagaagcccaagcccaagcccaagccctccgtttccctcaaaaaccagattcgatcccttgagcgcatgctccgcaagaatctgcctcccgaggtgcgagacgcgcaggaacagaagttggaggcgctgaagaagcagcaggagattcacactcgcctcgccgccgaacgcaagatattcttacgcgaccgaaagatcaagttcttcgagaggaggaaaatcgaaagacgaatcagacgcctcgagaaactgcaccgtgcttcttcttcctcttcttccgctgcccagccttaccctgaccagctttccgctctcaaaaaggatcttcaatatgtcatgtactttccgaagaatgagaaatatgtgcctttgtttaccggcggtgatgattcggagatagttgaccggagaaacgggctgcgcaaacagattgaagataggttggttgcagctgctgcaagtggcaaggatttagaagagactggcagtgaggatgatggtcttttggatctgagtgatgatgatttttttcttgccgggagttctagtgacgaagcagatgcggatgatgaatggacagacaaaagtgcaagagagcaggcttctagtgcttctgggaaaggtgtgtctggcatgtccagtgacgaaaaaaatcagatttctgctagagctttgatgcctcctcctcgtccttcaaacatgaagttgtcaagatttgggtcttcttctggccataattcatctgcgcagagatctgagatttccacatcgagcaacacatcaaatagcaaaagcagctcagacttcaaagtaagaccctcaagatcagggactggtcatggtagtagtctaagctccaactctgatgctcacaagcctcggaggaagagaagacctaagaagaaaaagaagcaggtgtag

SEQ ID NO: 1275 - DNA, 1044 bp, Glycine Max
atggctcagtatggttacgcataccgaagcgctcaaatatccacctacaatactagcaatgcgaggaatattgaaacaggtgcaaagccatttgctccctacgtccccaaatttaataacggtcatggttactcagaggggcacgttaccaagaaaaaaacaattccagttgctagcaggccttatgttagaacaattgttacaacaccttattatgaccatccacgtaaatttgatgacttgaccaatgaagctagccgcagtccacctgattggccaaaaccttcttataatggctatgctgactacggaaccaacaagccatttcaaggtaaaattaagaattatgatgaccatgatcctgtcaagaaggacaactatcatcatggttatgacggctatggggactacaacaacaaagatgagcccaagcccaaacccactgccagtcctgtttataatagtggatatggtggcgactacaacaacagagaagggcccaagcccaagcccaagcccacaggtattcccgtttataaaaatggatatggtagtggaagtgcaagtccaactcgacgtgacaactatgatcatcacaatgattatggcaactaccacaacaagcacggtggtccgaaacccacttcagattggactgattcgccaagaaaagggatccaactaactaaggcaacgaataatattgacgaggccatgaagttgttaatgaaagaagctgcaatgctcaatgggaatggaagtgggaatgaacttgtctacaacggatcagggcccaagccgcccacgccgccaccaccagcaagcacatatgacaggagcatgaacctggtgaatgaaactgataggctaaaaaatattgtgaccggtggcggtgctgcacctcatcaaactcaaccccgcccctccgtgccgatgaaggaggagacaaacttcaaccttgcacccatgcgacaacgcttcaattttgacggggctatggtgtcatcaatcataaggaagctgagaagaagtttaatggcgtga

SEQ ID NO: 1276 - DNA, 2168 bp, Glycine Max
atggctcccaccccttcttcgaaacaaaaccaccccactcaattgaagactccacagtccaagcaccgtctcaacttcaatggcctcaaatcagcaccttctccgaaccctaattctgttgcaaacaaggaacccccacctgaacacccaattgaagtcattgccagaatccgtgactacccagatcgaaaggacaagcctttgtccgttcttcaaaccaattccaactctagttccattcgggttcgtgccgattttgggtaccgggacttcacccttgatggggtatccgtgtctgaggaggaggacttggatgtgttctataagaagtttgttgagtcaaggatccatggggttaagctgggggacaagtgcaccatcatgatgtatgggccaactggttctgggaagagtcacaccatgttcgggtcgtcgaagcaggcagggattgtgtataggtctctgagggacattcttggagatggggatagtgcagatggagattctgggggtgggttggggacttttgttcaagtcactgttttggagatttacaatgaggagatttatgatctcttgtccaccaatggaggaggtgggggaggaggatttggatttggctggcctaaggggggtagtgcttcaaaggtgaaacttgaagtgatggggaaaaaggcaaagaatgcaacctatatatctggaaatgaagcagggaagatctcaaaagaaattcagaaagtggagaagcgaaggattgttaaaagcacactttgtaatgacagaagttccagaagtcactgcatggtaatccttgatgttccaactgtgggagggcggctaatgcttgtagacatggcaggatcagaaaatattgaacaagccggtcaaactggatttgaggccaaaatgcagactgcaaaaatcaatcaaggaaatatagcgctgaagagagtggtggagtccattgcaaatggcgattcacatgtgccttttagggacagcaaacttaccatgcttctgcaggattcctttgaagatgataagtcaaaaattctaatgatactatgtgcaagtcctgatcctaaggagatacacaagacaatctctacacttgaatatggggcaaaagcaaaatgcatagtccgtggacctcatactccagtcaaggatgatgaatcttcttcagctgtcattttgggatcaagaattgctgcaatggatgaatttatcttgaagctacaaatggaaaccaagcaaagagagaaagaacggaacgaagcccacaaaaagcttttgaagaaagaagaagaaattgctgcgttaagagctaagctggacatggcagaaggcaaaggaactcctccaagcgaggaggaaattaacctgaaggtaaatgaacgaacccggcttctgagacaagagttggaaaagaagttggaagagtgccaaagaatgactaatgaatttgttgaattggagaggaagagaatggaagagaggatactgcagcagcaggaggaagttgaaactctgagaaggagactggaagagattgagttgcagctgtgttcaaagcaagggtgttgtgtggaaaatgagtcaaaagacatggagtcgagtgggtttatgagaaggttattgcgtgtttacaaaagtgaggatgatcctggaatggtgaagtcaatggatttggacatggatgatcaagaaccccttggccacgaggtaaatatcgttggtggagttatgagcaggagtgattacaatgttaagcaggacttatcaaatcaaccttgtccgaatgctttgactggtgtaaaagaagatgctcatgttttttcaccaaactttggccaaagggtgtgccttagtacagtatatgaggaagaaggagaaggagatgaagacaaaggggaagatgaggaagtggagaaaggagtgatagaggaaaagagggtatgtagtgttgacaagcctagtgctgcaggttccttgggaaccttaaacctgtctaacacaagtccaaacaaagaggaattttgtttcaaggtaagttcagtggataatgactctagactcctgagaattcaaaatatattcactctgtgtggcaaccaaagagagctctcccagcacattggaaccccagtacaacctacaaaaaagag

SEQ ID NO: 1277 - DNA, 618 bp, Glycine Max
atggctccgaaacgacgtcctaagaaaggcgagtcgcgaatggacgcagcactcgacgccatgaaaccctacggcttccccaacagactcgtccgaacaaccgttaacagtctcctcaaagtttacggtggcaacggtggctggttcttcatcgaagaatccgcgtactctctgctgatcgagacgcttcttgaaaaacaagccaattcttcacctcagcaccaaggatatagtgcctttaagtcttgcaatcccaagattttgtttattttaccttccattaaggatgctgaattttcttactcaagacttatcccaccttctcatgatcgtaactcattcgaaataaaaggaacgggcaaggcccctgtgcgttacaaaactgtggaaaataaacctcctgagcttaaaagtactcaaaacaataccattcctgagtttcagccagtaaaaaaattggctttggccgaaaatcatgtatcaaagtccccacaacttgggacgggacttagtgacaaaaggtataaaccttgctatggctggatatctaatgatgacgaggaggaagaagagctaatagagctacctctagctccgtggttaagtggggtaaattag

SEQ ID NO: 1278 - DNA, 2010 bp, Glycine Max
atggctcctcatccaagagtcattaaggcttataatgctatgagatccttaggaatttctgatgaagaggtgaaaccggtgttgaaaaatttgttacaattgtatgatagaaactgggaacttattgaagaagacaattatcgtactcttatagatgcatactttgagttaaaggaagctaagagcgtcgaatggtgcaacgtagaactgcatccaccagttaggggagcagtcgtcgctgcctatcatgcggtggaggtgcttgccggcacggagggtctgaccatgccttacgttgtggtcaagtatgatggtcaaacagaaggtaagagaaaggctccaatcagttatcttaatgggagaaagccaaaacaggaactgcacttggtagatggagatgaccaggtttcatcaactgacaactccagtcaagggttgtctgtagaagactcggaaataactcccaacgcatttaaacagaaaatcattaaatcttctcaaacctccattgtacatatgaagcccacgagcagttcacaagcattgcagagaatgtcgagtgaggtagaaaggatctcaactttaccttgcatgcctgctagagatagaaaattgcatcgtgggaaggcatcagctgcagggcattgtgaagatccaattgatgaaccaagcaatcctcgtgtccagaggaaaaatatatcaaatgatcatcaacagaaggagctgatgataccaagaactgagaaacttaagttacatcttggacctgtttcaacgagttacaatggctcagctaatgcttcaaatggaaattgttgtgccaaatctctatcagctctgtatcagaatgtgcccaagaaagatgctacctcagcatgcaataatagtaaaagaactcagaagggtagtattgacattgcctcttcacctttgggagaaattaaaatttctttaaactgcgaagctgctttgggacaaccaaacttccgtattcctgatttggatgctatcatgaaatccattgaggagaaatacctgaaggctcacaagatagtcgagcctcaatcatctatggttaagctattagatgatttatgtggaatttacttgaagctgggcttgagtttaaatcgaaacgggtcaactcccaagtctgcaaattcacgcaatgtggcatgtctgccactgcaagctgttactgaagatgacaagaattcctttcactttctcgatgacataacaaaaggttccgagaatgttaaaatatcactgttggatgaaactggaagtgaggacgtgcctcagtttaattacataccctataatgtaatatatcaagatgctaacgtcaatatttcacttgctcgtattgcggatgagggttgctgtgctgattgtgctggcgactgtctttccttatcacttccatgtgcatgttctcaagaaacaggtggagagtttgcttacactccacgaggcttgttgaaagaaatatttttaaaagattgcatgtctatgaaattggaacctctagatcatcattttgtgtattgccaagaatgcccagtggagaggtccaggaatgacatcatggccgaaccatgcaaggggcatctggttaggaagtttatcaaggaatgctggaggaaatgtggttgtgacatgcagtgtggaaatcgggtagtgcaacggggtttaagatgtaaattgcaggtgtttttgactcgagaaggaaagggatggggcatcagaactctagaagatttgcccaagggatgttttgtatgtgaatatgcaggggaaatattaaccaatacagaattatatgaaaggattatgcagaaaagcggcaatgacagacatacatatcctgtaacccttgatgcagattggggctcggaaggggtgttaaaggatgaggaggcactatgcttagatgcaacatataatggaaatgttgcaaggtttatcaatcatagaaatgtgaatgcatacgaggaattgacatgg

SEQ ID NO: 1279 - DNA, 1188 bp, Glycine Max
atggctcggggggatgggagcgtcgtccctacggacccgcagacaatggcggttgtgaagaagaagacgcagtcttcgaggagttggattctgtttgacgccacagggcaaggctccttgctcgacgtcgacaaatatgccatcatgcatagggttcatattcatgcgcgtgatctcagaatccttgatcccttgctctcttacccctccaccattctcggtcgtgagaaggccattgttcttaacttggagcatattaaggcaattatcaccgctgaagaggtattgctgagagatccaacagatgaaaatgtgatccctgttgttgaggaactgcaaaggcggttgcctcaattgagtgccaccggtcttcaacagcaaggagatggtaaagagtatcttggtggccaaaatgatgctgaagccgctgaagaagatgagtcaccctttgaattccgggccctggaggttgctttagaagccatttgtagttttcttgctgcacgtacaacagaattggagatggctgcttatcctgcattagatgaacttacttccaagattagtagtcgtaatttggacagagttcgtaaactgaagagtgcaatgacaaggctgactgctagggttcaaaaggtcagagatgagcttgaacaattgctggatgatgatgatgatatggctgacctgtacctgtcaagaaaggctggttcagcatcaccagttagtggatcaggtgctgcaaattggtttgctgcctcccccaccataggatcaaagatatctagagcaagtagagcaagtttagcaacagttcgtttagatgaaaatgatgtggaagagcttgaaatgttacttgaggcttatttcagtgaaatcgaccacacattgaacaaattaaccacactgcgagagtacattgatgatactgaagattatattaatattcaacttgacaaccatcgtaatcagctgattcagttagagctctttcttagctctggaactgtttgtctatctttctactctttggtggcggctatatttggcatgaatatcccatatacttggaacgaaaaccatggttacatgttcaaatgggtagttattgtctcgggagtattttctgctgtgatgtttctcatgattacagcctatgctcgcaaaaaggggttagtaggatcgtga

SEQ ID NO: 1280 - DNA, 963 bp, Glycine Max
atggctcggggggatgggagcgtcgtccctacggacccgcagacaatggcggttgtgaagaagaagacgcagtcttcgaggagttggattctgtttgacgccacagggcaaggctccttgctcgacgtcgacaaatatgccatcatgcatagggttcatattcatgcgcgtgatctcagaatccttgatcccttgctctcttacccctccaccattctcggtcgtgagaaggccattgttcttaacttggagcatattaaggcaattatcaccgctgaagaggtattgctgagagatccaacagatgaaaatgtgatccctgttgttgaggaactgcaaaggcggttgcctcaattgagtgccaccggtcttcaacagcaaggagatggtaaagagtatcttggtggccaaaatgatgctgaagccgctgaagaagatgagtcaccctttgaattccgggccctggaggttgctttagaagccatttgtagttttcttgctgcacgtacaacagaattggagatggctgcttatcctgcattagatgaacttacttccaagattagtagtcgtaatttggacagagttcgtaaactgaagagtgcaatgacaaggctgactgctagggttcaaaaggtcagagatgagcttgaacaattgctggatgatgatgatgatatggctgacctgtacctgtcaagaaaggctggttcagcatcaccagttagtggatcaggtgctgcaaattggtttgctgcctcccccaccataggatcaaagatatctagagcaagtagagcaagtttagcaacagttcgtttagatgaaaatgatgtggaagagcttgaaatgttacttgaggcttatttcagtgaaatcgaccacacattgaacaaattaaccacactgcgagagtacattgatgatactgaagattatattaatattcaagtaagtagctag

SEQ ID NO: 1281 - DNA, 1389 bp, Glycine Max
atggctcgtggcaacgaagtggtgaaagaagtagaatggagaatcaaggtagaagaagatgagacactgcagaaaacagttttgtgcaagtttgtgaagaaagcatgggaattgggggtgaatgaccctagaaaattcatccattgcttgaaagtaggcattgcactttcagcagtttcgctcttctactattggaagcctttgtatgatggagttggaggaaatgctatgtgggctgtcatgactgtggttgtagtttttgagtacacagccggtgcaacgatatgtaaaactgttaacagaatgtttggaacttcccttgctggatttctaggcattggtgtacattgggtagctagtagggcaggagagcaatgggaacccgtaattgttggagtctctctctttcttttagcatctgcagcaacattctccagattcatccccaccttaaaggctcgttttgattatggtattttgatattcatcctcacattcagcttggtgtcagtatcgggttatcgggtagatgaattgttggtcatggcacagtacagaatatgcacgattataattggcagcatattgtgcataattattagcgtgatcattcgtcccatctgggctggtttcgaactctttgttttagtcacagggaacctcgacaaactggccaactccttgcaatgttgtgtggctcagtacttcggtggtagtgaagcctcagaagatagtgatgagatgtctgataaaaaattgctaggctacaagtgtgtgctaagttccaaagcaacagaagaaactatggcaaattttgctagatgggaacctgcccatggccgcttcaacttccgccacccgtggaggcaatatgttaaaattggagcatcaatgcgtagttgtgcttcctgtttagatgctcttattggatgcataaattcagacaaccaggcttcggatgacatgaagaagaatatgagcagcatctccatgaaactgggcgcaaactgtgcgagtgtcataagagagctagcaactacaataaggaaaatggcaaaatcatctaaacttgatattctggttacagatatgaatagtgctgcacaagagcttcgaagtttattaaattcttatccaaacttggttaacgcaccttcacataatgccaaaattagtacacaaacagaaacagcttcacctgatgatcaggctgcaaaaatagaaatcccacttatggaaatcattcaagttgtaactgtagcttctttgctcattgaaattgtggctcgtgtggaaggcattgtggaaaatgttgaagaactatcagttttggctaatttccaagcagaaatgtgtgtcaaatccaaacaacatacatctgacagcaag

SEQ ID NO: 1282 - DNA, 444 bp, Glycine Max
atggctgagcttcactaccaacaacaacaccaataccctcaccgataccctaatgatccatacgaacaacaaactagctactccactcaggtcgtcaaggcggccaccgccgtcaccgcgggcggctccctcttgatcctcgcctcgttgatccttgccggcaccatcatcgccctcaccatcgtcacaccaccgctcgtcatcttcagtccggttctcgtccccgcggtgatcaccgtcgcgctgctgagcctggggttccttgcctccggcgggttcggtgtggcggcgatcacggtgctggcgtggatctacaggtacgtcaccgggaagtacccacctggcgcggatcagttggacagcgcgcctcacaagatcatggacaaggcgcgtgagatcaaggactatggacagcagcaaatcagtggggtgcaggcttcttaa

SEQ ID NO: 1283 - DNA, 582 bp, Glycine Max
atggctgcaccaccgacgaagtacacccaccacaccaaactactcataccccccggccccgaagaagatccacccaaacacccctatccaaaactcctcagaataaccgtcacagacaccgacgcaaccgactcctccagcgacgaagaacaaaccaacttttccacgcgccaccgacacagaaagctcatcaacgagatttctatcgccagagcttcagacactcggcgcggccagaaattccgcggagtgagacagaggcctctgggaaaatggtccgcggagatacgagacccgtcgcaacgcggtgttcggttatggttgggtacctacaacactgcagaggaagctgctttggtctacgacaacgcggccattaagctgcgtggaccccacgcactcaccaatttcatcacgcctctgttgaacgaggatactcacaacaaattcctcttttctcccacttccgtgcttcacgtgtcggagaataaggtcaaagtccgaggttgttcgccggtgccggacagtgtgttgttctgcgatgatgattggtctagtgagtttctcactgcttctgagtga

SEQ ID NO: 1284 - DNA, 1317 bp, Glycine Max
atggctgcctcagttaaactcttatttttgtcctttctctcgttgttcatctctttctccatagctcaaacctctttcagaccaaaggcacttgttcttcctgtaaccaaagatgtttctgcctcagttcctcagtatgtcacacaaatcaaacaaagaaccccacttgtggcagtgaaactaactgttgatcttggtggtggctacttgtgggtgaattgtgaaaagggctatgtctcatccacctctagaccagcccgttgtggctctgctcagtgctcgcttttcgggttatatggttgcagtactgaggacaaaatttgtggccgttctccaagcaacactgtgactggtgtctccacatatggtgacattcatgcagatgttgttgctgtcaattccactgatggaaacaatcctactaaggtggtttctgtgcctaaattcctcttcatatgtggatcaaatgttgtccaaaaaggccttgctagtggtgtcacaggtatggctggtcttggcagaactaaagtttctcttccttctcaatttgcctcagctttcagctttcatagaaaatttgccatttgcttgagttcttctactatgacaaatggtgtaatgttctttggtgatggcccttacaattttggttatttgaactcggatctctccaaggttctaactttcacccctctcatttcaaaccctgttagcactgctccaagttatttccaaggggagccctcagtggaatactttattggggtgaaatctattaaagtctcagacaaaaatgtagcattgaacacaaccctgttgtctatcgatagaaatggcattggagggactaagattagtactgttaatccatatactgtcatggagaccacaatttacaaagctgtgtctgaggtctttgtaaaagaggtgggagcccctacagttgcacctgtggctccatttgggacttgctttgcaaccaaagacattgggtctacaagaatgggtccagctgttcctggcatagatctagtgttgcagaatgatgtggtgtggaccatcattggtgccaattcaatggtgtatgttaatgatgtaatttgcttgggttttgtggatgctggatcaagcccaagcgtggcccaagttggatttgtggcgggtggttctcatccaaggacttcaatcacaattggagcacatcaattggagaacaacttgctacaatttgatttggcaacctcaaggcttggcttccgctctatctttttcgatcacagcaactgtgccaactttaactttacctcttctgcttag

SEQ ID NO: 1285 - DNA, 3426 bp, Glycine Max
atggctgggactgtgagtgaggagtctggagtgggaaagtccgtggagggtatttcaaatgggcagcgttgtcaatctggggaagcattggcagagtggcggtcttctgagcaggtggagaatggtatcgcgtccacttcgcccccttactgggacactgatgatgaagatgatggaccaaaacctttggcattatatggaagatatacgtggaagatagaaaagttttctcaaattaccaaaagggaacttcgcagtagtgcatttgaggttggcggttacaaatggtacattttaatctatccacaaggctgtgatgtttgcaatcatctctcgctgtttctgtgtgtagctaatcatgacaaacttcttccaggatggagtcattttgcacaatttacaatagctgtggtcaataaagatccaaagaaatcaaaatattctgatacattgcatcgattttggaagaaggagcatgactgggggtggaaaaagtttatggaactgtctaaggtgtatgatggatttgttgactcttcagacaatctaataataaaagctcaagttcaagtcataagggaaaaatcagacaggcctttccgttgccttgattgccagtataggagggaacttgttagagtatatttgacaaatgtagagcaaatttgtcggcgttttgtggaggagagaagaagcaagcttggaaagttgatagaggataaagctaggtggtcaagcttctttactttctggcgagaagttgatcaaacttccaggcgccgcatgtctagggagaagacagatgtaattttgaaagtagttgtaaaacacttctttatagagaaagaagtcacttctactttggtaatggattccttgtatagtggattgaaggctcttgagggccagaccaagagtaaaaaaggtagggtgaaattgttggatgctgaagaaataccagcaccaattgttcatgtcgagaaagatatgtttgtactggtggatgatgttttactgctacttgaaagggctgcaatagaaccactgcctcctaaagatgagaagtgtcctcaaaaccgtacgaaggatggaaattctggagaggatttcaataaagattctgtagagcgtgatgaaaggcgcctaacagaattgggccgtaggactttggaaatatttgtccttgcccatatattctgtaataaaattgagattgcctatcaggaagctgttgctctgaaaagacaagaagaactcatccgtgaagaagaagctgcatggcaagctgaaagtgatcaaaaagcaaaacgtgggggtgagagggaaaagaagtccaagaaaaaacaggccaaacaaaaacgtaacaaccaaaaaggaaaggataaagagagggaggagaggactgctgtgtctgtaactgacaagaaccaaaacaatgctgttgatgagaaaaatgattctagcatggaggaggctcaagctgtgtctgaaaagcctgatcccatggaagatgtttctgacgtgtccgactctgtagatggagttgctgaaacgcttcagcttgattcagaagacagagatgctagtcctgttaattgggatactgatgcatcagaagttaatcctccaactgaggctagatacaatggcataggtagtgtttcaaccatacaaaatggaacgtctgagaaaaggagcagttcagtgatagatgatagttcttcaacatgttctactgattctttgccgtcagtagtcatgaatgacccccacaagggaaactgcttttcaaattataaagtccaaaagtcacctagcagaggtaagaaccaaggcaaaacatcatctaatgtgggtagattgacgattgaaatagatagtctgccatctggttctgcagcagatgctggggatattaacgatgagtctggaaatggtaagattggcaaatctgagtctgaggttgctgtaatctccttacaggatcggttgaaattcttgaataatttttacctttttttttcaccattgaagaggagcaaggataaacaaattggtgatgtttctacattcctatcttgtttacagattaatcatgggaaaaaagataaagagaagatatcagctgtgccatcctcgcctattagtcctcccagaaagttgtccccctctgttcaagtgaagttagaacacaaaactagttctactgtagatcctgttcatgtcaggaaaacatcttcaagtggctcccaacagactgataaagatccatcttcaccttttacttctgcatcaccagttccagttgtgtccaaaactgagatccaaaagacttcaactgcaagattaactgaaagatctgtggcacaagtgcctatgatgtcaagaccttcaagtgctcctttagttcctggtcccaggccaactgctccggttgtctctatggttcaaacttctcccctacttgcacactcagtgagtgcaactcggttgggtcctgatccctcaccagctactcatagtcatgttcctcaatcctacagaaatgcgatgatggggaaccctgtggcctcaactgctgctagtctgacccattccagctcctcaagttcaggagtgatcccatcacctggctattctcaaccatcttccttcgtgtcgtcaatgtttttatcccggagctctgacagattggacactagtgctggtcagtcttgtgttccttttaccatgattacacgggatgttttacagaatggtacccagtggattgagagttctcaaagggaatcaagtagaagcatgcactatgatcaaccctctgggctttatgaggttcaaaatcatgacttgtacaggccactacacagtagatcattgggcaatatgtcaactgcattctcagcctgcacatctgggcgtcagaaccaagggttgttggtggatgagttcccacaccttgatatcataaatgacctgcttgatgatgaacatggtattgggaagacggccaaggcaagttcagcattccagtctttgaatagtggaccacagttgctgaatcgacagttcacttttcctggggacctgggtgcggatgatgatttgggatcttcaaccagttcttgcaggttggagcgatcacggagtttccagcatgaccatagattgcaaggagggtatggcttgtctggtgggcattatcattcactgagggattatattccaccggttagtggtgtgcctggcgtcaatgggcaggtcgatgggttgattccaaaccaatggcaggtggctggttctgatctgttgtatttaggtatgagaaacacagagaatgatagttatggatactacccagattactcaaatatagcatgtggtgtcaatggttatactgttttcaggccatcaagtggtccttag

SEQ ID NO: 1286 - DNA, 393 bp, Glycine Max
atggcttatgtggatgaggatggtacttctggctctggtgaagatgtgcatatgttggatggacataagcgtcaccctgttgttgtgccgtctggttcccgtggccggaagcaaagccgcaaggctaacggcgatgccatcgtggatgccatgctggagattgctgctgcttcaaagatgagggccactgccattttgaagaacgaggataggttctccataagcaagtgcattaaggtgttggatgagttacaaggtgttgatgagcggctctactttcttgctttggatttgtttgagaacaactcgtgtgcctgtgagattttcatctctctcaagggtgagaagaggttgccatggttgcagtgcaagttgagtgtttcctctggttga

SEQ ID NO: 1287 - DNA, 1065 bp, Glycine Max
atggcttcaatgaataaccaaaaagaaattgagctctttgagggccaatctcttctgtacatgcagctatatgggcacctaagacctatgtgtcttaagtgggctgttcaactaggtattccagacataatacagaaccatgccaaacccatttctctttctgacttggtctctactcttcaaattccaccagctaacgctgcttttgtgcagcggttcatgcgcttcttggcacacaatggaatctttgagatccatgagagccaagaagatcatgaactaacatatgctctaacccctgcatcaaagcttcttgtcaatagtagtgatcattgtctatctccaatggttctagcgtttaccgatccacttcggaacgttaaataccatcacttgggggaatggattcgtggggaggacccctcagtatttgagacagcccacggaacaagcgcttggggacttcttgagaaaaatcctgaatattttagtctcttcaatgaggctatggcaagtgattcccgaatagtagacttggcactcaaaaattgcacttcagtttttgaggggctagattccatggtggatgttggtggtggaactggaaccacggccagaattatctgtgacgcatttcctaagttgaaatgtgttgtgcttgaccttcctcatgttgtagagaacttgacagggaccaataatttgagttttgttggtggtgacatgttcaactctatccctcaagctgatgcagtgctactaaagtgggttttacataattggaccgacgaaaattgcataaagatcctgcaaaagtgtagagattctatttcaagcaaaggcaacagtggaaaagtgattatcatagatgccgtaataaatgagaagctagatgacccggatatgacacaaacaaagcttagtttggacattattatgttgacgatgaatggaagagagagaacggaaaaagaatggaaacaactcttcatcgaagcaggattcaaacactacaaaatatttcccatctttggttttagatctctgattgaggtctatccttga

SEQ ID NO: 1288 - DNA, 1521 bp, Glycine Max
atggcttccaggcgtttgagggcattcaagcggtggatgaagtcgaaggggctcgaatggagcgatgcactggagtttgtggacaccccagaagaaggagttgaagtgagagcattgtgccagttgaaggaaggtgatgttgtggccaagatgccaaaggaagcttgcctcaccacaaagaccagtggggcacgtaagatcattgaagaggctggtttggatggtcatttggggcttgcatttgctatcatgtatgagagaagcttggatggggactctccttttgctggctaccttcaactcttgcctcaccaagagtgtgtgccaattgtttggaccctcgatgaagtaaacgagcttttgtgtggtactgagcttcatcagacagtgcaagaagacaaggctctgatttatgatgactggaaagagaatattctacccctattggatttagcacctttaaaactaaatccaaagttctttggcgtagaacaatactttgcagcaaaaagtcttatatcttcacgatcttttgagattgatgattaccatggttttggcatggttcccttggcagatctattcaatcataaaacaggtgccgaggatgtgcatttcactgctatgtcctctaatgatgagtctgatactgatgttgatggctgtaacgatgatgagggcattgtcaaggaagaaacattggctcaaaattcctctatagatatgaccgtgttaaataatgggaactgcaatgttagtgactcggatagttcttcagttagtgatggtgatacttctatgctggagatgattatgataaaagatgtcagcagtggaactgaggtatttaatacttatgggctattgggtaatgctgctttgcttcatagatatggatttactgagcaagataattcctatgatattgtaaacatagatatggaactggtacttcaatggtgtacttctgtgttttctgaccgccacagtagagcaagagtttccctttggagaaagttaggctattctgcatgtggcagccaaaactctgaatattttgagatctcatttgatggagaaccacagattgaactcctcgttttattgcacatcatgttattaccagataatgcctaccataagttagacctatcggttgctggaaattgtgatgaatcaagtggaaccacctttctgaatggtaatatctttcctagtaaagcatttaatatgagcaagaaatccttgctgcctaaaaaagtttgtgatgtcctgtcgtcacttgctgatatgagggagagtctctatggcttgaaatcaattgaagatgatattgaggcattgggaaggtgtagtttagttagagagagaaagctgtatcattctttgatgctgcgcatcaatgaaaggaagatcctccagaggctcagaaattatgcttcacagccatttaaaaataaaatcactaaccatagttctccgaggaagaagttgaaaagaacaacaaagaaaacgagttga

SEQ ID NO: 1289 - DNA, 798 bp, Glycine Max
atggcttccctgaacctccttccccaccctccacttttctcttctttccttcacagaccacactgcaacacccatcttcttctcacaccaaaaccttctcaacgaaggccttctcttgtggtcaaatctactgtgggtgtggctgatccttctccatcttcttcttcctacgctggggatacctctgattccatctcttctttgaagctcaatctgctgagtgctgtttctgggctaaatagaggccttgctgcaagcgaagacgatcttcgaaaggcagatgatgctgctaaggaacttgaagctgctggaggacttgtggatctctcgcttggtcttgacaatttgcaaggaagatggaaactcatttatagcagcgcattttcgtctcgaacccttggtggaagccgtcctggtcctcccataggaagactccttcctattactcttggacaggtttttcaacgaattgacatcttgagcaaagattttgataacatagtggagcttcaactaggtgctccgtggcccctaccaccccttgaagcgactgccacattagctcacaaatttgaactcataggatcttcaaagataaagatagtatttgagaaaaccactgtgaagacagctgggaatttgtcacagttgccaccattggaggtgcctcggattcccgatgcattgaggcctccatctaatacgggaagcggtgaatttgaagttacatatcttgactcggatactcgcatcacaagaggagacagaggcgagctaagggtctttgtgattgcttga

SEQ ID NO: 1290 - DNA, 867 bp, Glycine Max
atggcttccctggcggcttccaccgcagctatgtcagaaatgcttggaaaccccgtgagcctgagaggcgccaccaggtctgctccatcaccgtctacacctgttactttcaagaccgttgcgcttttctccaagaagaaggcagcaccacctcctccaaagaaaaagcctgctgctgtatcccccgccaatgaggaactcgccaagtggtatggtcctgacagaaggatcttcttgcctgagggtctcttggaccgatcagagatccccgagtacttgaccggagaagtgcctggagattatggttatgacccgtttggtcttagcaagaagccagaggacttcgccaaataccaggcgtttgagttgattcatgccagatgggcaatgcttggtgctgctggattcatcattcctgaggcctttaacaaatacggagctaactgtggtcctgaggctgtttggttcaagaccggagctttgcttcttgatgggggtacgttgaactacttcgggaaacccatccccatcaatcttattgttgctgttgttgctgagatagttcttgtgggtggtgctgagtactacagaataattaatggcctggatttggaagacaagcttcatccaggtggtccatttgacccattgggcctagcaaaggatccagaccaagctgcacttctaaaggtgaaggaaattaagaatggtaggcttgcaatgtttgcaatgcttggtttctacttccaagcttatgtcactggagaaggtccagttgagaacttagcaaaacatctcagtgacccttttggtaataacctgctcactgtgattgctggctccgttgagagggctccaactctgtaa

SEQ ID NO: 1291 - DNA, 882 bp, Glycine Max
atggcttccggtgaacagaaattccctcctcaacaacaacaaacacagcctgggaaggagcatgctatgactccagtaccccaattcactagccctgactacaagccttcaaataaacttcaagggaagattgcattagtcactgggggtgattctgggattggacgagcggtgtgtaacttgtttgccttagaaggtgctaccgtggccttcacgtatgtgaaggggcatgaggacaaggacgcgagggacacattggaaatgatcaagagagcaaagacttcggatgccaaggatccaatggcaataccatctgatttgggttacgatgagaactgcaagagggtggttgatgaggtcgtgagtgcttatggtcgtattgacattctggtcaacaatgcagctgagcagtacgagtgtggaaccgtggaggacatagacgagcctaggcttgagagggtctttcgtacaaatatcttctcctatttcttcatggcgaggcatgccttgaagcacatgaaggaaggaagcagcattatcaacacgacatcagtgaatgcatacaagggacatgcgaaactattggactacacgtccaccaagggggcaattgtggcctatacaaggggtcttgcccttcagctggtgagtaagggaattcgggttaatggggtggctccagggcccatttggacccctttgataccagcctctttcaaggaggaagaaacggcccaatttggagcgcaggtcccaatgaagagagctggtcaacctattgaggttgctccttcctatgtttttcttgcttccaaccaatgctcctcttacataactggacaagtccttcaccccaatggtggaaccgttgtgaatggttaa

SEQ ID NO: 1292 - DNA, 537 bp, Glycine Max
atggcttccttactacagaaagctttcggctctgaaatctcttcgtttatataccgcctttttatctatcaaaatcataacaaaggcattcctaggaacttcaagatgccaaagaagggtcgaccactttccttgcagaccgtagagctgaaagtaaggatgtgctgcactggctgcgagagagttgttaaaaacgccatttacaaactcaaaggcattgattcagtggaggtggacttagagatggaaagggtgagggtaggtgggtatgttgacaggaacaaggtgcttaaggctgtgaggagggccgggaagagggcagaattctggccttaccctaatcctccactttacttcacaagtgctgaccattacttcaaggacaccacccatgagttcaaagaaagctacaactactatagacatggctacaacctcccagagaggcacggcaccatgcatgtgtctcaccgtggagatgacaatgttagcaacatgttcaatgatgataatgtcaatgcctgccatatcatgtaa

SEQ ID NO: 1293 - DNA, 360 bp, Glycine Max
atggcttcgaaaatgtgtgtttttgtggcacttaatgttgttgtgttctttgcagttgtatctggatttattactgctacaactactctctcgtccgatgtggggtgtcctcgtaacgtgctcaaactaggtgtgtgctcaagtattctaaatgggtggatgaattttacgacaggtctacccccagagacacaatgttgctccgcaatcgcagacctttatggcttagaagttgcagtgtgcctttgcactgccctgaaagcaaacattatgggtatcaacctcggtattcccatttcctttaccaagcttatcaacacttgcgataagaaagttccaaatggtttcatatgtggctga

SEQ ID NO: 1294 - DNA, 1023 bp, Glycine Max
atggcttcttcaagcataacctgcaacttccatccttcaatatcctttccaatctcagccactcgtttttccatatctttttcgcaccctctactttgcacctacaatggcctttcccttcacccttcaagctccagcttcagagtttttgccaagtttgagaaattccaaagccaaccttcccaattccaagagcctgacccttcactctcaccagtagaaaatacagaaacttctgttgaggatggggaggaggatgacagttgcttgccttcagacttggagggtgcagtgcggcaatcaagtgaggccgcggccatatttgtatcttcaggagggataagagccatagttgaacttttaatcccccaactgcaatttttggatgacgaaggcgcgcaggtggaactctgggaattgtcaaggatttttttggatacactcattgaaaaaactaaattccagagagttaaagccatatttccagatgctggtgcagcagcccttctgaaatatcggtggaaagatgctctatttagatttgcaagcttaagtgaccggaagcctgtagaaagtgacgatgaggttgtggttatgattgttcctgattatcagatgttagagtatgtagagagaattgcatccaatctctcaaatattccagaacctacgcccctcatcatgtggaatccacgcctaattagtgaggatgttggagttggatttaatgtccgaaagttaagacgtgtctttctaagcacttttacaactgtctatttcatgcgacctatgccatttggagcaatctttaggtgttatcctggattgtggaaagtgttcagtgacgacaaggaaaggccagatagatatttgcttgccaaggaattcgaaatccgtcctgatgctgaagacatcgagcttctatttgccgatgaagaacagaagtctgagcaagggcaaggtttgcttgacaaagcagcaggcatattctcttcaattagccggatgatgaagtctatataa

SEQ ID NO: 1295 - DNA, 672 bp, Glycine Max
atggcttgctggtctgcagaaaatgccacgaaggcctacctcagcactttgaaaatgggtcaaaagtgcaaagagccagatgtagcagagtttatatcagcactagctgcaggaaacaatgcacaacttatggttgtggcatgtggtggtgcagcagactccaccacactagcattggttactgctgctcaccaaactggtggccaagtcatttgtattgtccctggccatgaagagctaagagcctccaaaatcgccttgggaagaatggcttctcatcaagttcaattcatggttggagaagctcaagaagtgcttttagagcactatgatcaggcagcagattttgtgctcattgactgcaaccttgagaaccatgaagagatccttagagcagttcaagagggtaggaagcaaaatgggacagtggttgtggggtacaatgcatttagctgcagaaagtcttgcttggcatgtggctcaaaaacacagcttctgcctataggaggtggtttgcttgtgacaagatttggtgtgagtgaaacgagtccaaaatatggaagcagaatgggaaaggccaaaagccgttgggttgtgaaggtagacaaatgcacaggcgaggaacatgtgttcagggtcagatttcctcaaaggaaagtggtccaagcttaa

SEQ ID NO: 1296 - DNA, 600 bp, Glycine Max
atggctttataccgattcgcttacttttcttctcctccttcctccatttttcgtttcccgaaatacccttcgaaacacgttaaattctctttgctgccactctcattcgcaacgatggaagctcctccagaaggttatcgcaggaacgttggtatctgtctcatgagcaatcacaaaaagattttcgcggcttcgaggctcgacattcccaattcttggcaaatgcctcagggtggtattgatgaaggtgaggatccaagaaatgcagccatcagggaattaagagaagagacaggagttaattctgcagaagtgattgctgaggtaccatattggttaacttatgacttcccaccaaaagtaagggagaaattaaatattcagtggggatctgattggaagggtcaggcacagaaatggtttctttttaagttcactggacaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccatatttccaataa

SEQ ID NO: 1297 - DNA, 447 bp, Glycine Max
atggctttcagagtaggaggagcgggagggggaaatgcctcttctggcatgggtgttgctgagcatagtgtaaacaccttcctggaattgcagaggaagaaagttcatcgctatgtgatttttaaaattgatgagaaaaagaaagaggttatcgttgaaaaaactggaggccctgctgagagctatgatgatttcactgcatccttgcctgaaaatgattgccgatacgctgtctttgactttgattttgtgacatctgagaactgccaaaagagcaaaatcttttttattgcatggtctccttcagtggcccgcattcgcccgaagatgctatatgcaacatccaaggacaggttcagaagggagctgcagggcatccattatgagattcaggcaacagacccaacagagatggatcttgaagtcctcagagaacgtgcaaactga

SEQ ID NO: 1298 - DNA, 981 bp, Glycine Max
atggctttcccaattctcttccttctcttcatttcccttcccttctcctccgcaaagctcaacgtcgattactacaaaaacacatgcccagacttcgaaaaaatcgttagggaaaacgtcttcaccaaacaaagcgctagcgtggccacagcaccgggtctccttcgcctcttcttccacgattgcatcaccgatggctgcgacgcttccctcctcataacttccaatgcatacaaccctcatgcagaacgtgatgcggacctcaacctttctctctccggtgatgccttcgacatcatagttaaaatcaaaaacgcattagaacttgcatgccctggtgttgtgtcgtgttccgacatcgtggcacaggccacaagagaccttgttaagatggtcggtggtcctttttaccccgtgaggctggggagaaaggatagcactgaatcagatgctgcgagagtgagtgcaagccttccaacaccaagcatgaccatggaccagatcattgagaagtttacctcaaagggtttcactgttaaggagatggtggctttgactggggcacacaccattgggttcacacactgcaaggagttcatccacaggatctacaacttcagcaagacctctgatgctgaccctatgatgcaccctaagctggtccaagggttgaggtccgtgtgccagaactacaccaaggactcctcaatggctgcattcaatgatgttaggtcaccagggaagtttgacaatgcctactaccagaatgtcatcaagggtttggggttgttgacctctgattccattcttgctgttgaccctaggacaaagcctcttgtggagctctatgcaaatgaccagcaagctttcttcaaggactttgctgatgccatggagaaactttctgtgtttagagtcaaaactggcgacaaaggagaggtgaggaacaggtgtgaccaattcaacagtattcctgcctaa

SEQ ID NO: 1299 - DNA, 681 bp, Glycine Max
atggctttttataatgaagaagagaagactgaagactacctcttcaagattgttttaattggtgattcagctgtagggaaatcaaatttacttgcacgatttgccagagatgagttttatcctaattcaaagtcaactataggagtagagtttcaaactcagaagatggatattaatgggaaggaagttaaagcacagatatgggacactgctgggcaggagaggttcagagctgttacatctgcatattataggggtgcagttggagctcttctggtgtatgatatcagtcggcgccaaacgtttgatagcataggccgatggcttaatgaacttcacactcactctgacatgaacgttgtgacaatacttgttgggaacaagtcagatcttaaagatgcaagggaggtggctaccgcggaaggcaaggccttagctgaggcacagggtttgttcttcatggagacatcagctcttgattcatcaaatgtagcagctgcttttgaaactgttgtaaaggagatttacaacatcctaagtcggaaggttatgatgtctcaagagctcaacaaacaggatgttacccgaattgaaaatggaaagactgttgtactacaaggggaaggggaaggggacggagaagcagatgcccagtctaaaaaaagatgttgttcatcttag

SEQ ID NO: 1300 - DNA, 675 bp, Glycine Max
atgggaaagtacatgaagaaagcgaagccgaaaggagaactcgcgctcgtcgaatccaccaccagcaacaccaccacctcctacatgggggtccgaacccgcgccaaaaccctagcgcttcagaaatcgcacgcgcagcagcacgagctcgccgccacctccgactcctacctccagctccggagccgtcgcctccagaagcctccgattttggtccactctccgaagcgccctaagcacccgaaccctaaatccccaatccccgaacctcccaggctcggactcgcttcggagcgcgacgctaccctcaaccacaacaaggacaatactttgcatgagaatgccgagcctcaggaagcgtcgttcggggaaaatgttttggattttgaaggtagagagagaagcactagggaatccacaccttgcagtttgataagggactcggatactgtcaggactccgggttcaactaccaggcctacttgttcagctgaagcttatcgaagaacagagcatgcagctagaaggcaaatcccaacctcccgtgaaatggatgaattctttgctgaaattgaagaggctcagcaaaaaaaattcattgagaagtacaactttgatcctgtgaatgagaagccgctctcagggcgctatgaatgggaaaagttgaaaccctag

SEQ ID NO: 1301 - DNA, 882 bp, Glycine Max
atgggaactatttttcctcctcactctctctctccactcctcaacatcaaaccttcaccctcaagaattctcttggctccctctccgcaacccaagtcaaattctctcttttgctcgaaacccattgtttctagtctcagaaagaaccaaactttatctcctaaaccttcatcaggcacaagctggttggctcatgctcaacaaggcctagcagctttggctatctccttggcactcaactttagcccagttttgttcaatggcaatgcactggcatctgagtttgatgtacttaacgagggtccacccaaagattcttatgtgtttgatgatgcaggagtgcttagtagggtaaccaggtccgatttgaagcagttgttgtctgatttggaatcaaggaagaacttccggatcaattttataactgttcgaaagctcacgagcaaagctgatgcatttgagtatgctgaccaagtcttggagcgttggtacccttctgtagaagaagggaacaagaagggtattgtggtgcttgtcacgagtcagaaagaaggagcagtcactggtggcccggcttttgttgaagctgtgggggaaaagatccttgatgctaccgtctcagagaaccttcctgtattggctacggatgagaagtacaatgaagctatttttagcactgctaaacggctagctgctgccattgatgggcttccagatcctggtgggccaacagttaaagacaacaaacgtgagtctaatttcaaaaccaaggaagagacagaagagaagcgtggacaattcactcttgtagttggaggtttgttggtcattgcattcgttgttcctatggcacagtactatgcctatgtatccaaaaaataa

SEQ ID NO: 1302 - DNA, 1131 bp, Glycine Max
atgggaagtgctggaggaactgactatggtgcatacacttatgagaatcttgagagagagccttactggccatcagagaagcttaagatttccatcactggtgctgggggttttatcgcgtcacacatagctcggcgcctcaagacagaggggcattacattattgcttctgattggaagaaaaatgagcacatgactgaggacatgttctgtgatgaattccatcttgttgatctcagggtcatgaataactgcctcaaggttacagagggggttgatcatgttttcaatcttgccgcagacatgggtgggatgggttttattcagtctaaccactctgtcattatgtacaacaacacaatgattagcttcaacatgattgaggctgccaggattaacggcattaagaggtttttttatgcctctagtgcttgtatctaccctgaattcaaacagttggaaactaatgttagcttgaaggagtctgatgcatggccagctgagccacaagatgcatatgggctagagaagcttgcaacagaggaattatgcaagcactataacaaggattttggaattgagtgccgcattgggaggttccacaacatatacggtccttttgggacatggaaaggtggaagggagaaggctcctgctgctttttgtcgtaaagttatcacttcctctgatagatttgagatgtggggggatggattgcaaacacgatcatttaccttcattgatgaatgtgttgaaggggtgctcagattgactaaatctgatttccgagagccagtaaatattggaagcgatgagatggtcagcatgaatgagatggctgagatcattcttggctttgagaacaagaatattcctattcaccacattcctggccccgagggtgtccgaggtcgtaattcagacaatacacttataaaagaaaaacttggttgggctccaactatgaggttgaaggatggactgaggatcacatacttctggattaaggagcagatcgagaaggagaaggctcaaggtattgatatatcagtgtatgggtcttccaaagtggtgcagactcaagccccagttcaactaggctcacttcgagcagcagatggcaaagaatga

SEQ ID NO: 1303 - DNA, 990 bp, Glycine Max
atgggaagtgctggaggaactgactatggtgcatacacttatgagaatcttgagagagagccttactggccatcagagaagcttaagatttccatcactggtgctgggggttttatcgcgtcacacatagctcggcgcctcaagacagaggggcattacattattgcttctgattggaagaaaaatgagcacatgactgaggacatgttctgtgatgaattccatcttgttgatctcagggtcatgaataactgcctcaaggttacagagggggttgatcatgttttcaatcttgccgcagacatgggtgggatgggttttattcagtctaaccactctgtcattatgtacaacaacacaatgattagcttcaacatgattgaggctgccaggattaacggcattaagaggtttttttatgcctctagtgcttgtatctaccctgaattcaaacagttggaaactaatgttagcttgaaggagtctgatgcatggccagctgagccacaagatgcatatgggctagagaagcttgcaacagaggaattatgcaagcactataacaaggattttggaattgagtgccgcattgggaggttccacaacatatacggtccttttgggacatggaaaggtggaagggagaaggctcctgctgctttttgtcgtaaagttatcacttcctctgatagatttgagatgtggggggatggattgcaaacacgatcatttaccttcattgatgaatgtgttgaaggggtgctcagattgactaaatctgatttccgagagccagtaaatattggaagcgatgagatggtcagcatgaatgagatggctgagatcattcttggctttgagaacaagaatattcctattcaccacattcctggccccgagggtgtccgaggtcgtaattcagacaatacacttataaaagaaaaacttggttgggctccaactatgaggttgaaggtaataatatcatga

SEQ ID NO: 1304 - DNA, 819 bp, Glycine Max
atgggaagtgctggaggaactgactatggtgcatacacttatgagaatcttgagagagagccttactggccatcagagaagcttaagatttccatcactggtgctgggggttttatcgcgtcacacatagctcggcgcctcaagacagaggggcattacattattgcttctgattggaagaaaaatgagcacatgactgaggacatgttctgtgatgaattccatcttgttgatctcagggtcatgaataactgcctcaaggttacagagggggttgatcatgttttcaatcttgccgcagacatgggtgggatgggttttattcagtctaaccactctgtcattatgtacaacaacacaatgattagcttcaacatgattgaggctgccaggattaacggcattaagaggtttttttatgcctctagtgcttgtatctaccctgaattcaaacagttggaaactaatgttagcttgaaggagtctgatgcatggccagctgagccacaagatgcatatgggctagagaagcttgcaacagaggaattatgcaagcactataacaaggattttggaattgagtgccgcattgggaggttccacaacatatacggtccttttgggacatggaaaggtggaagggagaaggctcctgctgctttttgtcgtaaagttatcacttcctctgatagatttgagatgtggggggatggattgcaaacacgatcatttaccttcattgatgaatgtgttgaaggggtgctcaggtatgtcttggctgatttgtggctaatagctaaatttttttgttctttctag

SEQ ID NO: 1305 - DNA, 1947 bp, Glycine Max
atgggaattgcagtgggaggggttgatttgctgagtgaaaaagcggcgatgatgagagagtgtctgcagaagagtgaaaccatcacagacaacgtcgtcaccattctcggttcattcgaccaccgtctctccgccctcgaaaccgccatgcgtccaactcagattagaactcactctattaggaaggctcatgagaatattgataggacttcgaaggttgcggaggttatattggctcacttcgatcaatatcgtcaggcagaggcaaaaatacttaaagggccacatgaagacttggaaaactatcttgaagcaatagataagttgagaagcaacattcagttttttggtagtaagaagggtttcaagagtagtgatggcattgtcgtgcatgctaataatttgctagctaaggctatttcaaagctagaagatgagtttaggcagttattattatcttacagcaaacctgtggaacctgagcgcctctttgactgccttccaaactcaatgcgaccttcatcacctggccatgagggtgatcctagtggcaagaatcaccattctgagtctcacaacaataatgctgaggctgttgtatacacacctcctgctcttataccaccaagatttttgccactgctacatgatttagctcagcaaatggttgaagctggtcaccaacaacagttactcaaaatatacagggatgcccgttctaatgtattggaagagagcctccaaaaacttggagtggagaaactcaacaaagatgatgttcaaaagctgcagtgggagattttggaagccaaaattggaaactggattcatttcatgcgtatagcagtgaaattgttgtttgctggtgagaggaaagtttgtgatcagatatttgaaggctttgattcactcagtgaacagtgctttgcggaggtgactacaaacagtgtctctatgctactcagttttggagaagcaattgccaaaagcaagagatccccggaaaaattatttgtacttttggacatgtatgaaataatgcaagaacttcattcagagattgaaactctttttaaaggcaaagcttgctctgcaataagagaagctgcaactagtttgacaaaacgtcttgcacaaacagctcaggagacctttggagattttgaagaggcagttgagaaagatgctacaaagactgcagtaacagatggaactgtccatcctctaacaagctatgtaattaactatgtgaagtttttatttgactaccaatccaccttgaagcaactttttcaggaatttgaaggtggtgatgattcttcacagctagcatctgtaactgtgcgaataatgcaagctttgcaaaccaatttagatgggaaatcaaagcagtataaagaccttgcgttgacacatctttttctcatgaacaatattcattatattgtcagatcggttcggaggtctgaagccaaggatttgctgggggatgattgggtacaacgacataggaggattgtgcagcagcatgcaaatcaatacaaaagaaatgcttgggcaaagattcttcagtgcctatctattcagggccttacctcatcaggtggtgggagtggtactgctggtggtgacagtggaactggaagcagtagtggtgcttcaagagcaattgtgaaagacaggtttaaggcattcaatattatgtttgaggaactccatcagaaacaatcgcaatggacagttccagactccgagttgcgagaatctcttaggctagcagttgctgaagtcttgttgcctgcctatagatcgtttgtcaaacgatttgggcctctagtggagagtggaaagaatcctcagaagtacatcaaatactcagcagaagatctagaccgaatgttgggtgaattttttgaaggaaaaaacatgagtgaaaccaagcggtaa

SEQ ID NO: 1306 - DNA, 888 bp, Glycine Max
atgggaccaagcaaacatcatatgttagcaactgtggcaaatccttggtggacgggtcagggagggttatctggggttgaccacccaggaacccattcacctggcctaggcaaacgcccctcagaccttggaatcagcgaaaacagtggtgggcacaatagagaagaagatgaagacaatagagatgaaccaaaagagggtgcagttgaggttggaacccgcagaccaagaggaagacctcctggatccaaaaacaagccaaaaccacccattttcgtgacaagggacagcccaaataccctgaggagccacgtgatggaggtaactggaggagctgatgttgcagaaagtgtagcccaattcgcaaggaggcgtcagcgtggggtttgtgtgctcagcgggagtggctcagtggccaatgttactcttagacagccttctgctcctggtgctgtggtggcacttcatggaaggttcgagattctgtccctaaccgggactttcctacctggtcctgctcctccaggatccacaggactcaccgtgtatctgacgggaggacagggccagatagtgggagggagtgtggttggatctctagttgcagcaggaccagtgatggtcattgctgcaacttttgctaatgcaacatatgagagacttccacttgatgaggatgatgaggggcccagttcagcggcgggggcgcaaggtggaggatcgtcgccacccccaccgcttggaattggaagcagtgggggtggacagttgcagggtgggatgccagatccatcatctatgcctttgtataatcttccaccaaatggaggagtggggcaggtagggcatgaagctcttgcttgggctcatggacgagcacctttctga

SEQ ID NO: 1307 - DNA, 483 bp, Glycine Max
atgggagacagaatggaaaggcttgtcattcttcctttctcttttggttgtgtctctgaggccagtattgttgtaggtagtcctcatccaagaagatcaagatcagacactgattcaccaactgcagcaacaaaaggaccaaaaggtgacaaggatatttcagagagtttgtctggtgaaagcatgaggaacttgctgaggtttcatgaggatgtccagaaatctaaaacattccttagcttcaataggctgttgaagggtttcaagaacattcctcagttgtttgtgaataaagaggaggagttggaagaggtggaaatggacatggaaatagggtgcccaacaaatgtgcagcatgtgacacacattggttgggatggttttgccgcaacagaaactgtaacatcttctgactccttgcgtctccctttacagcactgcgagttttcaaacttgaaaccaaaacctggaacatcatcttga

SEQ ID NO: 1308 - DNA, 1293 bp, Glycine Max
atgggagacgtagcagataaattggcgtatttccaagcgataaccggtttagaagatccggagctctgcacagaaatcctggctgcccacaattgggacctggaactcgctatctctactttcacctcttcctcaaaccctaacaaccctccaccgcctcccgctctggcttggaaactcatcaccctacccgtttccgtcatctccgccagtctaggcttagtttccgccgctatcggcttgggcctatgggccgcggggggcgtcctctcctattccctcggcctcgtgggcctgggctcgccctcggccccattggtttccgtcacggccgccgcttccgaggcgatggatttcgtggccgctttcgagagggactacggctccggtgggcccaatttcgtgggcgagggcttcatggacgctcttcagcgatccaggaactcgttcaagcttctcttcgtttacttgcattcccccgatcaccccgacacgccgtcgttctgccagaggacgctctgctctgagaccattgcgccgtttgtgaacgagaatttcgtgtgctggggtggcagcattcgcgccagcgaagggtttaagatgagtaacagcttaaaggcttctcgcttccccttctgcgctctcgtcatggccgccaccaatcagaggatcgcgctccttcaacaggttgaaggtccaaaatccagtgaggagctgctggtgacactgcagagagtgcttgaagaaagctcccccgtccttgctgcggctaggcttgatgcagaagaaagaagaaataatatgcgcttaagggaggagcaagatgctgcatacagggctgcacttgaagctgatcaagctagggaacgacagagaagagaagaagaagaacatcttgcatgggaagctgctgaagccgagagaaagcacaaggaagaggaggcggctcgtgaaagagcagcacaagaagctgcagagaaacaagctgcattggctaaaatacgtcaagagaaagcccaatctcttggtgaagaacctgaaaaaggacctaatgttacacaggttttggtacggtttccaactggtgaacgcaaggaaaggaggttctacagcacagcgacaattcagtctttgtatgactatgttgactcacttggatgtttagaagccgagagttacagcctggtctccaattttcctcggactgtttatggacaagagaagttgacattgtcattgaaggaagctggattgcatcctcaggccagcctgtttgtggagctcagttcatga

SEQ ID NO: 1309 - DNA, 954 bp, Glycine Max
atgggagtagaagatacagatatttgtatcatcaaggagccagatcatgttgtagtctattcagatggcatttcccatgattcaggtcatgaagctggaagtgatcatcacaatattacagagtcttatgaacaaatcaatgagactactgaacatcatagttcagaggagagtgcaaaggaatatgaggtgaaggaatgtacaacagaaatttctgttaaggtctctgatgtctctaatgttaaaaaatgtgaggataagttaacctcagattctgagggtgtcctcagtgagaaaagttttaaatctcacaaaacaaggtgtaaacataagccacgagataccgggaagaatggatcaagacctcctgttacaggcagtgcccaaatcaggcccacagttccacaaccgttttccctagcaactgagaagcgtgcttcgatcgcaactcgtcctgcttttgaagaagacaacaagggcagtaacgagagaaaatctttgaacaaaaaaaatgtgctatctcccaatctgtttaaacagaatcagttgaaatctcctgtagtttcaagaatgccattgcaacctgataacaagaagcatcctgatgatgatgattcttgttcagttgcttcaataactgcagcttctgtgagatcaatcaagtccaggacaactgttgcttctgctcccgtgtttcggtctactcaacgtgcagaaaaacggaaggagctgggtcggcgaaagagcaacaatggtgcagttaatttatctgaaggtgacaaggagaaaggagctggaatcaggagaaagcatcacacaccgaagaccaacaactatggtgataagagtgatgtaaatggcttatctgaccccaaaaacaagaccaagcatattgaaggaattaatgcaaccgaggtaactggacaagcaaacttggagattggcagccagtga

SEQ ID NO: 1310 - DNA, 1167 bp, Glycine Max
atgggagtagaagatacagatatttgtatcatcaaggagccagatcatgttgtagtctattcagatggcatttcccatgattcaggtcatgaagctggaagtgatcatcacaatattacagagtcttatgaacaaatcaatgagactactgaacatcatagttcagaggagagtgcaaaggaatatgaggtgaaggaatgtacaacagaaatttctgttaaggtctctgatgtctctaatgttaaaaaatgtgaggataagttaacctcagattctgagggtgtcctcagtgagaaaagttttaaatctcacaaaacaaggtgtaaacataagccacgagataccgggaagaatggatcaagacctcctgttacaggcagtgcccaaatcaggcccacagttccacaaccgttttccctagcaactgagaagcgtgcttcgatcgcaactcgtcctgcttttgaagaagacaacaagggcagtaacgagagaaaatctttgaacaaaaaaaatgtgctatctcccaatctgtttaaacagaatcagttgaaatctcctgtagtttcaagaatgccattgcaacctgataacaagaagcatcctgatgatgatgattcttgttcagttgcttcaataactgcagcttctgtgagatcaatcaagtccaggacaactgttgcttctgctcccgtgtttcggtctactcaacgtgcagaaaaacggaaggagttttattcaaaattagaggaaaagcagcaagcaatggaagctgagaagaatcaaagtgaagctaggaccaaggaagagatggaggaagctatcaagcagctaaggaagagtctaacttttaaagcaagccctatgccaagcttttaccatgaagggcctcctcctaaggttgaattgaagaagcttccagccacgcgagcaaaatctccaaagctgggtcggcgaaagagcaacaatggtgcagttaatttatctgaaggtgacaaggagaaaggagctggaatcaggagaaagcatcacacaccgaagaccaacaactatggtgataagagtgatgtaaatggcttatctgaccccaaaaacaagaccaagcatattgaaggaattaatgcaaccgaggtaactggacaagcaaacttggagattggcagccagtga

SEQ ID NO: 1311 - DNA, 1167 bp, Glycine Max; identical to SEQ ID NO: 1310

SEQ ID NO: 1312 - DNA, 1167 bp, Glycine Max; identical to SEQ ID NO: 1310

SEQ ID NO: 1313 - DNA, 2799 bp, Glycine Max
atgggagtgccagcgttttaccggtggctcgccgaccggtacccgctctccatcgccgatgtcgtcgaggaagaccccgccgtcggcgacgacggcgttccgtttccaatcgacgcgtctaaacctaatcccaacggcatggagttcgacaacttgtacttggacatgaacggcatcattcacccttgttttcaccctgacggcaagccggcacctgctacctacgatgatgtgttcaaatcaatatttgattaccttgaccatctctatacgttggttcgtccaaggaagcttctctaccttgcaattgatggtgttgcaccaagagccaaaatgaatcagcagcgttctcggcgcttccgagctgcaaaggatgcagctgaggctgaagctgaagaggaaaggctgaggaaagaatttcagagtgagggaaaagttttgtcttctaaagacaagcctgagacttcagactcaaatgtcattacccctggaactcaatttatggtagcactgtcagtatctctccagtattatatacagactagattgaaccacaaccctagctggcggaataccaaggttatactgtctgattcaaatgcacctggtgaaggagaacataaaataatggaatacatccggttacaacgcaaccttcctggtttcaatccaaatactcgtcattgtttgtatgggttggatgctgatttgattatgctctccttagctacacatgaggttcacttctcaatattgagggaggtagttactttacctggtcaacaggataagtgttttttgtgcggccaagctggccattttgcagctgattgtcaagctgaggattttgatactcctgatgatagcccaattcacaagaagaaatatcagtttcttaacatctgggtgctgcgtgaatatttgcaatttgaattggagatacccaaccctccttttgagattgactttgaacgagtagtggacgattttgtatttctatgcttctttgttggcaatgattttcttccgcacatgccaacattagagatcagggagggggctataaatttattgatgcatatatatagaaaggaatttactgccataggtggttatcttactgatgcgggcgaggttttcttagatagagtgcaacgatttatccagtttgttactgttcacgaagatcaaatctttcagaaacgagttcgcattcagctggctgccgaaaataatgaagagatgagagctagggcaagaggagaaatgcctggagaaccacgagcctcgcttttggataaggttaaattaggggagcctggatacaaggaaagatattatgttgaaaagtttggtgtatcaaatctcgaggagattgataaaattaagaaagatattgtcttgaaatatgtggaaggcctttgttgggtttgccggtattattaccagggtgtttgctcatggaaatggtactacccatatcattatgctccatttgcttctgattttaaagatctacctgatctggaaataaatttcttcccaggagagccatttaaaccatttgatcagctcatgggcaccctacctgcttcaagttcaagtgcactgcctaagaaatatagggatttgatgagtgatccttcatcacctatttttcacttctaccctgctgattttgagattgatatgaatggaaaacgatttgcatggcagggtgttgccaagctgccatttattgatgagaagaaattgcttgctgccacaagaaggattgaagatacattaacggaggaagaacaacttcggaatagtgtgatgcttgatttgctatatgtcaatcgtgcacataatttggctgcacatatcttatcatattaccatgtttgtagtcaattacccccacatgaaagatgtgttcagccaattgacacaaatgctagcagtggcgggatgaacggatatctttggttatgtgaaagaaatgttttcagctctgttatatcttctcccatcagtggattgcaagacattgaatataaccaagtcttaaatattacatttcttaaccctcgtagacacgatcatatcccaaaacctccagatggtgtagtaatacccaaaaaggtattaaaagccattgatattaaaccttttcctgtgctatggcatgaggacaatattggtcaaagacagcaagcaagagaaaggctacaagtacccggagcaatagctggatctcaactgggagaagcagctcatcgacttgtcaaaaataccctcaacattaaatcaaataatacctcccatggattgctggagcaacctcctgtccatcatacaatgaacaggcatcgatcagctggatatggaaaatattacggtgagaatacaagtggttattatggacaatataatcaccatggcatcactagacctaaatatggtggacagaatgacagacagaatttgaagatacaagataggttacataatcaagaacagtttcacaatacgaaaagtgagtttgttgcgttaacaatggaggaaggagagaggcctaggtcatcgaggcttccaaattccagaccagttaccaatttacaaccccggtttatgcagaacatggatccttcaataccacctccaaagtggatgactagaacaccacctatgaatggcatgcatactaggcatcaagaagctgcattggggccagcaactcatgataagcaaaccaagaaggtttaccaagttaaaacacgacagccagatacaccagaatatgggaagcaatag

SEQ ID NO: 1314 - DNA, 2796 bp, Glycine Max
atgggagtgccagcgttttaccggtggctcgccgaccggtacccgctctccatcgccgatgtcgtcgaggaagaccccgccgtcggcgacgacggcgttccgtttccaatcgacgcgtctaaacctaatcccaacggcatggagttcgacaacttgtacttggacatgaacggcatcattcacccttgttttcaccctgacggcaagccggcacctgctacctacgatgatgtgttcaaatcaatatttgattaccttgaccatctctatacgttggttcgtccaaggaagcttctctaccttgcaattgatggtgttgcaccaagagccaaaatgaatcagcagcgttctcggcgcttccgagctgcaaaggatgcagctgaggctgaagctgaagaggaaaggctgaggaaagaatttcagagtgagggaaaagttttgtcttctaaagacaagcctgagacttcagactcaaatgtcattacccctggaactcaatttatggtagcactgtcagtatctctccagtattatatacagactagattgaaccacaaccctagctggcggaataccaaggttatactgtctgattcaaatgcacctggtgaaggagaacataaaataatggaatacatccggttacaacgcaaccttcctggtttcaatccaaatactcgtcattgtttgtatgggttggatgctgatttgattatgctctccttagctacacatgaggttcacttctcaatattgagggaggtagttactttacctggtcaacaggataagtgttttttgtgcggccaagctggccattttgcagctgattgtcaagctgaggattttgatactcctgatgatagcccaattcacaagaagaaatatcagtttcttaacatctgggtgctgcgtgaatatttgcaatttgaattggagatacccaaccctccttttgagattgactttgaacgagtagtggacgattttgtatttctatgcttctttgttggcaatgattttcttccgcacatgccaacattagagatcagggagggggctataaatttattgatgcatatatatagaaaggaatttactgccataggtggttatcttactgatgcgggcgaggttttcttagatagagtgcaacgatttatccagtttgttactgttcacgaagatcaaatctttcagaaacgagttcgcattcagctggctgccgaaaataatgaagagatgagagctagggcaagaggagaaatgcctggagaaccacgagcctcgcttttggataaggttaaattaggggagcctggatacaaggaaagatattatgttgaaaagtttggtgtatcaaatctcgaggagattgataaaattaagaaagatattgtcttgaaatatgtggaaggcctttgttgggtttgccggtattattaccagggtgtttgctcatggaaatggtactacccatatcattatgctccatttgcttctgattttaaagatctacctgatctggaaataaatttcttcccaggagagccatttaaaccatttgatcagctcatgggcaccctacctgcttcaagttcaagtgcactgcctaagaaatatagggatttgatgagtgatccttcatcacctatttttcacttctaccctgctgattttgagattgatatgaatggaaaacgatttgcatggcagggtgttgccaagctgccatttattgatgagaagaaattgcttgctgccacaagaaggattgaagatacattaacggaggaagaacaacttcggaatagtgtgatgcttgatttgctatatgtcaatcgtgcacataatttggctgcacatatcttatcatattaccatgtttgtagtcaattacccccacatgaaagatgtgttcagccaattgacacaaatgctagtggcgggatgaacggatatctttggttatgtgaaagaaatgttttcagctctgttatatcttctcccatcagtggattgcaagacattgaatataaccaagtcttaaatattacatttcttaaccctcgtagacacgatcatatcccaaaacctccagatggtgtagtaatacccaaaaaggtattaaaagccattgatattaaaccttttcctgtgctatggcatgaggacaatattggtcaaagacagcaagcaagagaaaggctacaagtacccggagcaatagctggatctcaactgggagaagcagctcatcgacttgtcaaaaataccctcaacattaaatcaaataatacctcccatggattgctggagcaacctcctgtccatcatacaatgaacaggcatcgatcagctggatatggaaaatattacggtgagaatacaagtggttattatggacaatataatcaccatggcatcactagacctaaatatggtggacagaatgacagacagaatttgaagatacaagataggttacataatcaagaacagtttcacaatacgaaaagtgagtttgttgcgttaacaatggaggaaggagagaggcctaggtcatcgaggcttccaaattccagaccagttaccaatttacaaccccggtttatgcagaacatggatccttcaataccacctccaaagtggatgactagaacaccacctatgaatggcatgcatactaggcatcaagaagctgcattggggccagcaactcatgataagcaaaccaagaaggtttaccaagttaaaacacgacagccagatacaccagaatatgggaagcaatag

SEQ ID NO: 1315 - DNA, 798 bp, Glycine Max
atgggattctatcttaatctcaaacgcaacgcgttccggctaaaacggtttctgctaggacatgaaggcagaaaaagaaaatacaaacagccaaaaaagccttcatggatgaggccaatggcatatggttatcaagtggtggagcataacatggccagagatggttctgatgattcagttgtggcacagagagaggaaatggatcaaacagaattatggtattttggaatctttgacgcactaattggagacaaagttaccaagtacatgcagtcttatttctttgacaagaagcttcaagagactcatataaggagaaaaagcaaggaagctctaaagagagcttaccttggtgtaagagcaacgatccgagaggaacacaaattagaggagacatgcagaatgggttcagcatctgttatgttgatcaacggagaaaaacttgtggtagccaacatgggagattacagaactgttgtctgcagagatggcatagctcatcagacaactggcacaaaccaacgatcaacgaaaatacattggtctcgcagactctttgcaggtgcaaagcattctagaggttctgctcttgtcattagaagtgaaaggatcgattctgatactgagtttttgatattagcaagcactggcatatgggaggtgatgcaaaaccaagaggccgtgaatctgatcagtcacatagaggatccacaagaagcagctgaatgcttggcaaaggaagctctaattaggatgagcaaaagcagcatctcatgcttaatcattcgctttgattga

SEQ ID NO: 1316 - DNA, 1062 bp, Glycine Max
atgggcgagtcaagcgactctgtctccattgacattgatttgattcctttaggaggaaaggaatgcacggtgaaaacaagtaaaggctccatgtctgtgcttgtttgtggggatcgagaaaaacccgctctaataacctacccagacgtggctctcaattatgtctcttgtttccagggtctgttgttctgcccagaggcagcttctttgttgcttcataacttctgcatttatcacattgatgctccgggacatgagttgggggctgatgtcatttcttcagatgaaccattgctctgcgtggatgaccttgctgaccagattgcagaagtgcttgatttctttgggctaagggaggttctgtgcttgggtgtaacagctggtgcttatgtcctcactctattagctatgaaatacaaagaacgagtgcttggattgattcttgtttcacctatttgcaaatctccttcatggactgaatggctttacaacaaggtcttaatgaatttattatacttctatggtatgtgcggtgtactgaaggaatgtcttctgcagcgttacttcagcaaagaacttaggtgcagtgttcagggagcagaatcagatataatactaacttgccgaaggcttttggatgaaaggcaaggtttgaatgtcatgcgatttctccaagcaattaatgcacggcacgacctcactgagggtctgaaggacttgcaatgtaaaacacttatatttgcaggtgagagtagtccattccatgctgaatctgtgtacatgagctcaaaaatgaaccacaaaatctgcgcacttgttgaggttcaggcttgtggctcattagttacagaagagcacccaaattccatgataacaccacttgagcgtttcttaatgggttttggctaccacagacaaacacatgctgcttcctcatcaagcaacggttcaaatccagcaagccccactagccattcatgcatagcaccagaactcctctccccagagagtttaggaattaagctcaagcccatcagaacccgtgttgatgttcaaatctaa

SEQ ID NO: 1317 - DNA, 1278 bp, Glycine Max
atgggctgcttcgtgtccactccaaaggattctggtggaaatagaaggaggccagggagtattggggaggtttctgtgtatgttcctggtctaagaattcctaaacctgttgattttgcacagtcacttggtgattacttgtccaaaaatatagtggaacgcctgtctgctctaagaactcgtatagttgtaatggctggccaagaaggtcctacaattacaagaacaaaaaggaaaagtgccacccaacatggaggttcaacactggctgatcttcagcaggctcttgaagactacttgcttgtacttttgggattagttgaaaatggaagccatttacaatacaaagtacaatttgcttgggtgaatcaagaggatgaagcagaggaaacaaccatgtctaatgcttggtatgaagtgttgtcggttttgcacttgatggcaatgctattgctgtcacagtctgatttattacttcttcctagaacatccactgatggtcatcagccaaaagtatcagaagaaagcagacgggcttctgttgatatcttcttaaaggcagctgggtatcttgactgtgctgtaaggcatgttcttccacagttgcctggcgaactcaggagaaatttaccagtagatcttgcagaaggagttcttcgagcactctgtctacaagcattgggacagggtgtagatattcaacttggaatggcaattgatagtaccaaagccactcttgcagtgaagcgtagacttgcatgtgagatggtgaaatattggcaacaggctcaagataatattatgaaccttccattagcaaatggatggggtgaaaagcattgtctttttgtgaaatggaagtatattgaagcgaaggctgcagcatattattatcatggattgattcttgatgagggaaacacggagaaatctcaagggatggctgtagctgctttacaagcagcggatgagtatttcaaagaaagtaagaagttgtgtgaagcattcaatgcagcacctccattgtcaagaaatccaccactttgggggactatgaaatatctttacgagaaaattcctaaggatacctcaagcaaggtgcgaataaaccgtgatctgtactcctatgagagaatcatggagacagcaccaacattgcctgattttgccttggctttgaaaccagatgaatatcagcttcctcaggtggatccctcttggagaacagaaaatgtgaaagggggacaaagtggtgccaccaaccatgtcaatggatga

SEQ ID NO: 1318 - DNA, 2184 bp, Glycine Max
atggggaacgggagcagaagctactcggcgaaccggagcgactacaagcttctagaagaagtcggttacggcgccagcgccaccgtctaccgtgcaatctacctcccctacaacgaggaggtcgccgtcaagtgcctggatctggatcgctgcaatataaatctggacgacatacgtagggaggcgcagacgatgagcctgatagagcaccccaacgtggtgagggcctactgctccttcgtggtggagcggagcctgtgggtggtgatggcattcatggcgcagggctcctgcctgcacctcatgaaggctgcttatcccgagggattcgaagaggccgccatcggatctatcctcaaggagactctcaaggcgttggagtatctccaccgacacggccacattcaccgtgacgttaaggccgggaatattctcctcgacgataacggccaggtcaagctcgccgacttcggcgtctccgcttgcatgttcgacaccggcgaccgccagcgctccagaaacaccttcgtcggaactccctgctggatagcgccggaggtgctgcaacctggaaccggttacaatttcaaggcggatatttggtcgtttgggattactgcgttggagttggctcatggtcacgcgcctttctccaagtatcctcccatgaaggttcttttgatgaccattcagaatgctcctccggggcttgattatgatcgtgatagaaagttctccaagtctttcaaggaaatggttgctatgtgcctggtaaaagatcaaacaaagaggccatccgtggagaagttgctcaaacactccttcttcaaacaggctaagccaccggagctttctgtaaagaaattatttgctgatttaccgcctctgtggaaccgtgtaaaatccctccagcataaagatgcagctcagctagcactaaagaaaatgccttctgcagaacaagaagctatatctcaaagtgaatatcatcgaggagttagtgcatggaacttcgatattgatgatttgaaagcacaagcggcattggacggtgatgatattgcagagatgagggaagaagatgaaaacaaattcttcagctcttacaaggttgggtcaactgttctaagctttcttttccttaaaaataatctattaaaatctttgttgtttaattcaaataacttgcaacaatatgagttcacatcacaagtaggtagtaacgacataccacagtgtgagaaaagaaatggatcagttgctgaagcaacaccatctactttagagaatgatgtgggaacaagcaaagttaaaactcaatcagtgaaacttggtaaaacccaaagtggacccctgatgccaggcttagtgcttggtcattcttcatctgaaagagggcgtacatttgaaaggtttgagaatgaaaaccagttagcgggtgagaaaagtaatcgtgatatacgacgagctccaagctttagtggtccattaatgcttccaaaccgagcttcagcaaatagtttatcagctccaatcaaatcttctggaggattcagagattccttggatgataagtctaaggctaatctagtgcaaattaaaggacgattttcagtgacatcagaaaatttagatctggtgaaggatattcctgtaagttcagtttcgcgccgatcttcacagggatcaccaatgaggaaatctgcgagtgttggtgattggatggtggattacaaacaaatgccaattggtcagtcctccaatgattctgccaatatcaatattcctgcatcacttttagtgcctcatcttcacaatctttttcagcagacatctattcaacaggatcttataatgaatctgttgaatagcttgcaaactgccgaggcaattgatacttctcagaacgggaagttaccaccattacctcgcaattcagagaacaacggaagtgccgatacagcagtttcagagagggaacagctgctgctgggcaaaatttcagaactccaatcccggatgattaatttgaccgacgaactgacttatgagaagttaagatatgtgcaggtaagtttctgtacaagcttttatatttcattatccgtgcaggattttgcttctgctattttattttcttgcttggattacatacatgttacgtccaacttggaatccatttaa

SEQ ID NO: 1319 - DNA, 2136 bp, Glycine Max
atggggaacgggagcagaagctactcggcgaaccggagcgactacaagcttctagaagaagtcggttacggcgccagcgccaccgtctaccgtgcaatctacctcccctacaacgaggaggtcgccgtcaagtgcctggatctggatcgctgcaatataaatctggacgacatacgtagggaggcgcagacgatgagcctgatagagcaccccaacgtggtgagggcctactgctccttcgtggtggagcggagcctgtgggtggtgatggcattcatggcgcagggctcctgcctgcacctcatgaaggctgcttatcccgagggattcgaagaggccgccatcggatctatcctcaaggagactctcaaggcgttggagtatctccaccgacacggccacattcaccgtgacgttaaggccgggaatattctcctcgacgataacggccaggtcaagctcgccgacttcggcgtctccgcttgcatgttcgacaccggcgaccgccagcgctccagaaacaccttcgtcggaactccctgctggatagcgccggaggtgctgcaacctggaaccggttacaatttcaaggcggatatttggtcgtttgggattactgcgttggagttggctcatggtcacgcgcctttctccaagtatcctcccatgaaggttcttttgatgaccattcagaatgctcctccggggcttgattatgatcgtgatagaaagttctccaagtctttcaaggaaatggttgctatgtgcctggtaaaagatcaaacaaagaggccatccgtggagaagttgctcaaacactccttcttcaaacaggctaagccaccggagctttctgtaaagaaattatttgctgatttaccgcctctgtggaaccgtgtaaaatccctccagcataaagatgcagctcagctagcactaaagaaaatgccttctgcagaacaagaagctatatctcaaagtgaatatcatcgaggagttagtgcatggaacttcgatattgatgatttgaaagcacaagcggcattggacggtgatgatattgcagagatgagggaagaagatgaaaacaaattcttcagctcttacaaggttgggtcaactgttctaagctttcttttccttaaaaataatctattaaaatctttgttgtttaattcaaataacttgcaacaatatgagttcacatcacaagtaggtagtaacgacataccacagtgtgagaaaagaaatggatcagttgctgaagcaacaccatctactttagagaatgatgtgggaacaagcaaagttaaaactcaatcagtgaaacttggtaaaacccaaagtggacccctgatgccaggcttagtgcttggtcattcttcatctgaaagagggcgtacatttgaaaggtttgagaatgaaaaccagttagcgggtgagaaaagtaatcgtgatatacgacgagctccaagctttagtggtccattaatgcttccaaaccgagcttcagcaaatagtttatcagctccaatcaaatcttctggaggattcagagattccttggatgataagtctaaggctaatctagtgcaaattaaaggacgattttcagtgacatcagaaaatttagatctggtgaaggatattcctgtaagttcagtttcgcgccgatcttcacagggatcaccaatgaggaaatctgcgagtgttggtgattggatggtggattacaaacaaatgccaattggtcagtcctccaatgattctgccaatatcaatattcctgcatcacttttagtgcctcatcttcacaatctttttcagcagacatctattcaacaggatcttataatgaatctgttgaatagcttgcaaactgccgaggcaattgatacttctcagaacgggaagttaccaccattacctcgcaattcagagaacaacggaagtgccgatacagcagtttcagagagggaacagctgctgctgggcaaaatttcagaactccaatcccggatgattaatttgaccgacgaactgacttatgagaagttaagatatgtgcagttgcaacaacagctaactggtctctacagccaggaacaaaatggggaaagagaggaatttgcatga

SEQ ID NO: 1320 - DNA, 3519 bp, Glycine Max
atggggactgagcttatgagaatatgtgttaaagaagataatgatgattttccatcagttccaccaggttttgagtcatatacatctttctcattgaagaaggtagaaaacaatgaaaaacaagatgataaaaatatgaccagttgttcggcctctactagtgcttctgaatcaccatcaactcaggcggaaaatgatgttcaagttggtgatactgcaaaggttcctagatcccttcgacgaagaccatggattaattatggacaatatgagaacatttcagatgaagaccctgactgtgagcggcatgatcaaaatttctcctcaagaccttgtcttcctcgaggagtcatccgtggatgtccagattgcagtaattgccaaaaggagtttcaagatactttgaaatatatatcaagcattcgctccaaggctgagccatatggaatttgtcgcattgttccgccatcttcttggaaacccccttgtcctctcaaggaaaaaagtatatgggagggttctaaattttctacccgtgttcagaggattgacaaacttcagaatcgtgattcaatgagaaagatgtcaaagattcaaactaatatgaagaggaaaaggagaagatgcacaaggatgggggtggataatagcactagaacaggacctaatgcaggattttgtgaagttgaaaggtttgggtttgaacctggtccagaatttaccctggaaacatttcagagatatgcagaagattttcagctcaaatacttcagaaaaaatgagaatgtatctcatttgggtgctaatacaacaattttaaatggtacctcagagccttccgtagagaacattgaaggtgaatattggcggatggtcgagagtcctactgaagaaattgaggtgctttatggagctgatctggaaactgggatttttgggagtggtttccctagcaaatctagtcaagtaggttctgcttcacatgaacagtacataaaatctggctggaatttaaataactttgcaaggctacctggctctctgctctcttatgaaagcagtgatatatctggtgttctagtgccatggttgtatgtaggaatgtgcttttcctccttttgttggcatgtggaagatcatcatttatattcattgaattacttgcattggggagctccaaaaatgtggtatggtgtccctggaaaagatgcctgcaaattggaagaggccatgcgaaagcatttaccagagctttttgaagaacagcctgacttgcttcataagctggtcactcagctttctccatctatccttaagtctaaaggagtaccagtttataggtgtatccaaaaccctggggactttgttctgacatttcctagagcctaccactctgggttcaactgcggcttcaactgtgctgaggctgttaatgtagctcctgttgactggctgccccatgggcatattgctatagagctgtaccaggagcaggggcgcaagacttctatatcacatgataagctgttgcttggggctgcaagggaagcagtacaagcccaatgggagcttgatttgctgaagaagaatactttggataatctacgatggaaggatgtctgtggaaaggatggccttttggcaaaagcactcaagatgcgtgtcgagatggagcgagcaagaagggaatttctctgcagtccttcacaggcattaaaaatggagagtacttttgatgctacaaatgaaagggagtgcaacatttgcttttttgatttacacctatctgctgctggttgtcgctgttccccagatagatatgcttgcttggatcatgcaaagcagttttgttcatgctcttgggattccaaatttttcctctttcggtatgatattagtgaactaaatattcttgtggaggcattggaaggaaaattaagtgcaatatacagatgggcaaaatcagatcttgggctggcgttatcttcttttgtgtcagcaagcaaggaaacaatacataaggaattgaaatcgtattcatccaatttatctcattcttccagggccactgtgcataaagagatggctttgcatccattaaataaatatattgacaattctcaattgattgatgtccctacagagaatcaagcaaatagcaaagatcagagctattttcaacagaggaaatcggttgaatctatttcatctttgagatccatgaaggaattgctaacatttaaaagctcacaacctacatctgaggcggctaatcataagatctgtgttaataaagaagaatcggttatatgcagatcaaatatgagaacccctgctcaacatggaggtgaaaaaagttcacttaacagacataataacagtattatacttcttagtgacgatgaagatgatgaaaagatgtccggttcaaatagaaggaaggaactttcttcgatgcttacatgtcctagagataagacaagtccatgtaatgatatagaaaatacaaagttgaccatttctgtgtcagattctgctgtgataggtgaaaaggatgctattacattgccccaatctattagaaatattccagctccttcaaaagtagaggccagtgattattgtttggaaagtttggaggtttgtcctctgaacccacaactttctggcattaaggttaagactgaagataatcatgaaaaccttggaggatgtgccacttctaatgtagcagacaatgcaagagctgttaatgggaacatttcttgtgctccaaacaattaccgtcagaaaggtcctcggattgcaaaggttgtccggcgcatcaactgcaatgttgaaccattagaatttggagtagtgctttctggaaagtcttggtgcagtagtcaggctatatttccaaagggatttagaagccgtgttagatacataaatgtcttagatccatccagtatgtgttactatatttcagaaatagttgatgctggacgtggttggcctctatttatggtttccttggaaaattgtgcaagtgaggtcttcattcatatgtcagctgcaagatgctgggaactgatcagagagaaagtgaatcaagaaattgcaaagcaacataagctgggaagaaagggtcttcctcctttacagcctcctggcagccttgatggctttgaaatgtttgggttttcttcaccagcaatagtgcaggctattgaggcgctggatcgaactagattatgtaatgaatattgggactcacggccctactctcgtcctcagggacagatttctcaatcaagccaaaccaatgtcaatggtggaaatggtcaaggggttctcttgaataagcacatgcccgttgaagttgttgcagtgctaaggagcctatttaaaaagtctaatgcagaagaattgaacttattgtacagcattcttagtaacaataggccagaggctgacaggaacctagttgcgcaacttctcaatgaagagattcacaaatcacaaccgccctag

SEQ ID NO: 1321 - DNA, 1119 bp, Glycine Max
atggggagagaagttacaggaatgcaagttgtggacaagaagccaaatggtgttataccagcttcaaatggtagttctaatgataaagtatgtttttctcctaaaatggaagcagctaaggttcaggcaaaggatcacaaggtaaatgaatgtaccaaaactaactcttttgaggagaaaagccatgagaagatggatggtttgagtgccaaaacaacaaactgtaatactgacttgcctgaggaggagattgagatttctgaagtgcagaaaatgggtgacagtaaaaagttaagctcaccatctgcaagaaaagagcatactagtcaccttgttacacatccatctgatctggttactgaaaagcatggttcccacatacagattgttgatgctgaagctgatgcaactggtctgaacttatcaccaaacactataaacatgctctcacctatctcatcaaagaattcacagccaaactctcctttttcatcaagtaagcctttgcaacatgataagaagaactatgatgatgaagataattggtctatcacctcctctgctatgtctatgcgcacagctagatcaaaggtaactcatggctcagcccctacatttagatgctccgaacgcgcagagaaacgtagggagttttatctgaagttggaggagaaacaccgagctcttcgagaagagaaaaaccagtatgaggcaaggctaaaggaagagcaagaagcagccatcaagcagttgagaaagaacttggtaattaaagcaaatccagtaccaagtttttactatgaagggcctccccctaagaccgaactaaagaagctgccactgacacggccgaaatcaccaaagctaagtcggagaaggagctttggcgatactgtgaactcgtctcctgaagcttgtagtcgagcccgtcacagcactggaggtgtaggtcacgtcaagggtggttccaatgccccttttcctcacaaaaacaacattcgacgcaacagcaatggtgtttgcaaacccaaagaacgaactaaagcggataaggaaacaaaaacggctcctcctaagatcaccaaccacgcaaatgcagacatttcagttcaatcatga

SEQ ID NO: 1322 - DNA, 1320 bp, Glycine Max
atggggcaagggcaatccaaagacgagttgctctaccagcaagtcagttatgggaacgccgaaggaatcaaaacccttcacagagaaggtgcaggcctagagtggagggacaaagatgcgaaaacccccttgattgttgcttgtatgaatcctcagctttataatgttgccaaaactttgatagaacttggagccaatgtcaatgcatttcgtcctggtcgtcatggtgggactccattgcatcatgcagctaaaagggactttgatagtattgttaacttacttcttttgcatggagccaatcctttagtcttgaatgatgattgtctaactgctcttgaggttgccagggccaaaggacacagcaatgttgttcgtacaattgagagtcatctatgcttgttctccggttggttgcgcgagtttcatggtcctgggtttctagaagtagtagctcctcagttggtatcaaagaaagtttgggtggttgttttaccagttggctcccgtactcttgccaaaccttacaagttggagcttgccatatattctaggttgcaggatgcacaaccacatactgttattggactgtggaacgccgatttacaagaaccaaagcttcaccagtctgatccgtcagtgacagttgttaatcacactactagtactctcttatactgtgctctttctccttgctctttctcctttcctggaataaatattaagaggcaattgaagaaaacacgcattaaacttgggcctgcaagtgagaatgacaagcaacaacttacatggttttctaatgcttgcaaaggaattccacaggcaagtcctgcattcttgcaaaacaatgtgcctacaggtccacccacagcaccaccagatgcagaagacacagagttggctatggccatcagtgcatcccttcagtctgccatgcaggagagaccaccctttcctgatacacagccaagctttgatgcaagctcttcaagcagtgcagtgaacacagacaatcatgtgatagtgagttggtacaagaagctaacccggatggcaatactcagcacctccaaagctgtcccagttgatatggcatctccagatgctgagaagcttcttaaagaaggagaaaaaagtgccggtggaagtagttcatcatgcgtgatatgtttagatgctccagcagaaggggcatgcataccctgtggccatgttgctggatgcatgtcttgcttgaacgaggtgaaatcaaagaaatggggttgccctgtatgtcgagctaagatagatcaagtcataaagctatatcatgtttga

SEQ ID NO: 1323 - DNA, 552 bp, Glycine Max
atgggggcaatgatatctaggttctggtttttgttattccctgcaaaggagtataaaattgttgtagttgggttggataatgcgggaaagaccacaaccctttataaattgcacttgggtgaggttgtcacaaccaaccctactgtaggaagcaacgtggaagagctcgtctacaaaaatatacgatttgaggtctgggatcttggcggacaagaaagactgaggacatcatgggcaacatattaccgaggaacgcatgctgttattgcggtgattgacagcagtgatagagccaggatctctatcataaaggatgaactttttaggttgctggggcatgaagatttacaacattctgtcattcttgtctttgctaataaacaagatatcaaggatgctatgactcctgctgagatcactgatgcactatcccttcacagcatcaaggatcatgattggcatatacaagcttgctgtgccctatcaggagaagggttgtatgatggtcttggatggattgcccagcgagtaactggcaaagccccaacatga

SEQ ID NO: 1324 - DNA, 552 bp, Glycine Max
atgggggcaatgatgtcgagattctggttcatgttattccctgcaaaagagtataagattgttgttgttggattggataacgctggaaaaaccactaccctttataaattgcatctgggtgaggttgtaactaccaaccctactgttggtagcaacgtcgaagagctcgtctacaagaatatacgatttgaggtctgggatcttggtggacaagaaagattgaggacatcatgggcaacatattaccgaggaacgcatgctgttattgtggtgatagacagcagtgatagagccaggatctctatcataaaggatgaactttttaggttgttggggcatgaagatttacaacattctgttattcttgtcttcgctaataaacaagatatcaaggatgctatgactcctgctgagatcactgatgcactatcccttcacagcatcaaggatcatgattggcatatacaagcttgctgtgccctatcaggagaagggttgtatgatggtcttggatggattgctcagcgagtaactggcaaagccccaacatga

SEQ ID NO: 1325 - DNA, 552 bp, Glycine Max; identical to SEQ ID NO: 1324

SEQ ID NO: 1326 - DNA, 552 bp, Glycine Max; identical to SEQ ID NO: 1324

SEQ ID NO: 1327 - DNA, 3186 bp, Glycine Max
atggggtatttgtatctcttgctgatttcatatttgtctgccttgttgtatgctgcttctgcattgaactctgatgggttggctttgttgtccctcttgagggactggactattgtgcctagtgacataaactccacatggaagttgtctgattccactccgtgctcatcttgggcaggagtgcattgtgataatgccaataatgtggtttctctaaacctcactaacttatcatataatgatctatttggaaaaattcccccagaattagacaactgtaccatgcttgagtacttggacctttctgtaaacaactttagtggaggaatacctcagagcttcaaaaacttgcaaaatttgaagcatatagacctttcatctaatccgctgaatggtgaaattcctgaacccttgtttgacatttatcacctggaagaagtgtatcttagcaacaacagtttgactggttcaatttcctcaagtgttgggaatatcactaagcttgtcacactggatctttcttataatcagctgtcagggacaattcccatgtccattggaaattgtagtaacttagagaatctatatttggaaaggaatcaattagagggagttattcctgagagtctaaataatctcaaaaatcttcaggagttatttctcaattataataaccttggaggcactgttcaattgggaactggaaattgcaaaaagttgtctagtttaagtctttcttacaataacttcagtgggggtataccatcaagcttggggaattgtagcggtctaatggagttttatgctgcacggagtaacttagttggcagtataccatcaaccttgggcctcatgcccaacctttctcttctaatcattccagagaacctattgtctgggaaaatacctccacagattggtaattgcaaagcactggaagagttgcgtttgaattccaatgaacttgagggagaaattcccagtgaattgggaaacttgagtaaattacgcgaccttagattgtatgaaaaccttttgacaggagaaattccacttggcatatggaaaattcaaagccttgagcagatctatctgtacattaataacctttcgggggagctaccttttgagatgacagagctcaaacatcttaagaatatctccttgtttaacaaccagttctccggagtcatacctcaaagtttaggaatcaatagcagtttggtggtgttagacttcatgtataataatttcactggtacccttccaccaaatctttgttttggaaagcaactggtgaagctgaatatgggtgtcaatcaattttatggtaacatacctccagatgtgggaaggtgtacaactcttacaagggtgagacttgaagaaaatcatttcactgggtctcttcctgatttttatattaatccaaatctctcttacatgagcatcaacaacaacaatatcagtggagcaattccatcaagtttgggaaaatgcacaaatctctctcttttaaatttgtccatgaacagcttgacgggtcttgtaccttcagagcttggaaaccttgagaatctccagactttggatctttctcacaataacttggaaggtcctttgccacatcagctgtcaaactgtgccaaaatgatcaagtttgatgtcagattcaattccttgaatggttcggttccatcaagttttcggagctggacaacattaacagctttaattctctcagagaatcattttaatggtggtatcccagctttcttgtcagaatttaaaaagctcaacgagttacaacttggtggaaacatgtttggaggaaacattcctagatcaatcggagagctggtgaatttgatatatgaactaaatctaagtgctactgggctgataggtgagcttcctagggagattggaaacctgaagagtctgctaagcctggatctatcttggaacaatttgacaggaagtatacaagttcttgatgggctcagttcattatctgaattcaacatctcatataattcttttgaaggtcctgtgccacaacagctaacaacattaccaaactcttctttatcatttttgggcaatcctggcctgtgtggctcgaatttcactgagagcagctatttaaagccttgtgacacaaattcaaaaaagtcaaaaaagctcagtaaagttgcaactgtgatgatagcacttggatctgcaatatttgttgttctgctgctgtggttagtatatatattctttatcagaaaaattaagcaagaagccataatcattaaggaagatgattctccaacccttcttaacgaagtgatggaagctacagaaaatctaaatgatgagtatattattggcagaggagctcaaggagttgtttataaagcagcaataggtccagacaaaacattggctataaagaagtttgtattttctcatgaagggaaaagctcaagcatgaccagagaaattcaaacccttggaaagattaggcatcgaaatttagtcaaattggaagggtgctggttgagagaaaactatggtctaattgcatacaaatacatgccaaatggaagcctacatgatgctttgcatgagaagaatccaccatactccttagaatggattgttcggaataacatagcacttggaattgctcacggattgacttatctccattatgactgtgatcctgtcatagtgcacagagatatcaaaacaagcaacatacttctagattcagaaatggagcctcatattgcagattttggtattgctaaacttatagatcagccttctacctcaacacagttatcatctgttgctggtacacttggttatatagcaccagagaatgcttatacaacaacaaagggtaaggaatctgatgtatacagttatggggtagttttgctggagctgatatccagaaagaagccattggatgcatcatttatggaaggaacggatatagttaattgggcaagatctgtctgggaggaaacgggagttgttgatgaaattgttgatccagagctggctgatgaaatttcaaattctgaagtgatgaaacaagttaccaaggtgcttttggtggctttgagatgcactgaaaaggatccacgtaagagacctacgatgagggatgttatcaggcatttgtag

SEQ ID NO: 1328 - DNA, 753 bp, Glycine Max
atggggtggggtgtgatagaagaggagggatggaggaagggaccttggacttctgaggaggacagattgctcattctgtatgtcaagttccatggtgagggcagatggaactctgctgctaggcttgcaggactgaaaagaaatgggaagagctgcagattgagatgggtgaattacctgaggccagacctcaagaagggtcaaataacaccacaagaagaaagcataattcaagagctgcatgctaggtggggaaacaggtggtcaacaattgcaagaagcttgccaggaagaactgacaatgagataaagaattattggaggactcacttcaagaaaaagatgaaaactccatctgatgctgctgagaaggcgagaatccactcctcgaggagacagcattttcagcagcaacaacagcagttgaagcagcagcagcaacaattccaattcaacttggacatgaaagggatcataaacttgcttgaggaaaatgaccatagagtgccttctatatctcaagaggcacaagaaatggccagcatgtacccaaacacttcagaacaccagggctacttctactcaatgttcaatgtcaatgacaatgacaataatgtctctgcacctgagtcctcaaatgaagaaattctatgggatggactgtggaacttggacgatgttctttgcaatttcaatgcagctagtgccacaagcaaagccagtttacataatttagtttctcctttctgttaa

SEQ ID NO: 1329 - DNA, 1743 bp, Glycine Max
atggggtgtgtgattagccgagaagtgtcatcgggaatagtctacgaggtgaaggaggacaagagttcgagtgttgagtccaacaagaaagttgatcaagtgtccacaggcagagttgaggagaacgcggtagaggcacagaatggtgagaaggagaaggaagagaatggtggtggtgatgatcaggttcggcggctgaagggtgaaagaaaaagatcaaagccaaatccaaggctaagtaatccaacaaagcatttgcagggggagcaattagcagctggctggccagcttggctaacagcagtgtgtggggaagtgcttagtgggtggattccgcgtaaggctgacacctttgagaaaattgataagattggtcaaggaacttatagtaatgtatacaaagctaaagacacattgacaggtaagattgttgcactgaagaaggttcgatttgacaatttggaacctgagagtgtaaaattcatggccagagagattcttattttgcgaagattggatcatcccaatgttataaagctagaaggtttagttacatctagaatgtccttgagtttgtacttggtgtttgattacatggtgcatgatttagctggacttgctgcaagccctgacatcaagtttacagagcctcaggttaaatgttacatgcatcaactgctatcaggacttgagcactgtcatagtcaaaacatacttcaccgtgatattaaaggatcaaaccttcttattgacaatgaaggaatacttaaaattgctgactttggacttgcatctttctttgatccaaatcgccggcaacccatgactaatcgtgtggttaccctttggtaccgacctcttgagttgcttcttggtgccacagaatatggtgcggccattgacctttggagtgttggttgcattttaggagagttattggcagggaagcctattttgcctggtcgtacggaggtggaacaactgcataagatatacaaactttgtggttcgccttctgatgagtattggaagaagtcaaagatgcctaatgctaccttgtttaaacctcgagaaccatacaagagatgcataagagagacatttaaagattttccaccttcagcgctgccccttattgacactcttcttgcaattgatcctgcagaacggaagagtgccacaaatgctctaagaagtgagttctttaccacagaaccttatgcttgtgatccttctagtcttccaaaatatcccccaaccaaggaaatggatgctaaacgacgggatgatgaaacaaggagatcaagagttgctggcaaagcacacgttgatggtgcaaagaagcatcgtactcgtgatcgcgctgtaaaagctgctcctgctcgtgaaggcaatgctgagcttcaatccaacattgatagaaggcgtttaatcactcatgcaaatgctaagagcaagagtgaaaagttacctccaccacatgaagatggacagcttggctttcctttgggatcttctaatcatattgatccagatattgttccttctgatgtttctttgggttcaacctcttacaccttttcaaaggaaccattcgaagcttggtcaggtcccattggtaatactgctagcattagtgtcacaaagcggaagaaacacactgcaggtgatgcattggatttatcaaaaccatataaaggtgccctcaaggataaggttaaaggaaagaaatacgtagcttag

SEQ ID NO: 1330 - DNA, 474 bp, Glycine Max
atggggttctcctcctttctgggtcgcgtcctctttgcttccctcttcatcctctcagcatggcagatgtttaatgaatttgatgacactggtggacccattgcaaaggagttgattcccaagttcactgttctgaagagaaatttatcctccaaactgggggtaaagacaccagatattaatgtgcggtcagtcattgcctctatcatatttctaaagggggttggaggaattctattcgtgcttggcagtacatttggatcttatcttctgctcttgtatctggggctttctactccaattctatatgatttttacaactatagatctaataaccctgaatactatttactgctgaatgatttcattcagagcacagcactttgtggtgcattgctattttttatagagatgaagtactcgattaccagaagacaaatcaggaagaagaccccaaaagcaaagacaatttag

SEQ ID NO: 1331 - DNA, 894 bp, Glycine Max
atggggtttcccagaaaatcactattccttcttctgttcctgattctcttcacaaaccttgctgaatctgcttctgactacaccaccttggtctacaagggttgctccaaggaaacattcacagatccaaatggggtatactcacaagccctttcatcactctttggctcattggtctcacaatccaccaaagccaagttctttaaggccactgcagggagtggccaatcctccatgactgggctcttccaatgcagagatgacctctccaactccgactgctacaactgcgtgagcaggctcccggtcctgtccgacaagctctgcggcaagaccaccgccgccagaatccagctcctgggttgctacatgctgtacgaggttgtagggttcacgcaaatctcggggatgcagattttgtacaagacctgtgggggaaccaacgctgctgggagagggtttgaggagaggagggacactgctttctctgtgatggagaatggggtggtcactggccatggcttctatgccaccagctaccagtctttgtatgtgatggggcaatgtgagggagatgttggtgattctgattgtggggagtgtgtcaaaagtgctgtccagagggctcaggttgaatgtggaagctccatttcaggccaggtctatttgcacaagtgtttcattagttatagttattaccctaatggggttccaggaagacactcttcttcagcttcatcatcttccaattcctattcttcttcttcttcttcttctgggcaaaatacagggaagacagtggctataatagtaggaggggcagctggagtggcgtttttggtcatatgcttgatgtttgctaggagtttgaagaagaaacgtgatgattattga

SEQ ID NO: 1332 - DNA, 1905 bp, Glycine Max
atgggtagcaacaggactattgtttggtttagaagggaccttagaattgaggacaatcctgcattagctgctgctgcaaaggagggttctgtactccctgtgtatatatggtgccctaaagaggaaggacagttttatccaggaagagtgtcaaggtggtggctgaagcagtctcttgctcacttggatcaatcactgaagtctcttggatccagacttgtgctcatcaaaacccacagtactgtcacggctctcgtggagtgcgtaaaggccattcaagcaacaaaagtagtgtttaaccatctgtatgatccggtttcacttgtccgtgatcacaacatcaaagaaaaactagtggaacaaggcatatcagtccaaagctacaatggagatctgttgtatgagccatgggaagtatatagcgagagtggacgtgcctttactacctttaatgccttttggaagaaatgcttgcacatgcaaatggatattgtttcagttgttcctccatggcaattaattccagctgaaggaaaagttgaggaatgtccactggaggagcttggtcttgaaaatgaatcagaaaaaccaagcaatgcattactaggacgggcatggtcgccgggttggagaaatgctgacaaggctttaacagaattcgtggagcagcatctactagactactccaagaaaaggctgaaggttggtggagactccacctcactcttgtccccatatcttcattttggagaattgagtgtgaggaaagtttttcaagtgacacgtatgaagcaaatattatggacaaatgaaggcaacagtgctggtgaagagagtgtaaatcttttcctcagggccattggacttagggagtactcacgctatctttgtttcaactttcctttcacccatgagaaagcacttctgggacacttaaagttttttccttggaatcctgatgctgatatctttaagaattggagacaaggtaggactggctttcctttggttgatgcaggaatgagagaactttgggcaactggctggattcacaacagaataagagtaatagtttccagttttgctgtgaaaatgttgcttctaccctggaaatggggaatgaaatatttctgggacacacttcttgatgctgaccttgaaagtgatatcttgggttggcagtatatctcaggaggcttaccagatggccatgagcttgagcgcttggacaatccggagattcaaggggttaaatttgatccagaaggtgaatatgtgagacaatggctacctgagttggcaagaatgccaactgagtggatccatcatccttgggatgcaccgcttactgttcttagagcagcaggagttgagctgggtcaaaattatccaaagccaataattgatatagatttggccagagaaagactcactgaagctatattcaagatgtgggagtctgaagcagcagcaaaagctgcaggctctgaaccaagggatgaagttgttgtagacaactctaactctcttgaaaatttggacactcgaaaagttgtcgttctgggaaaggctccatgttctactatttcagctaatgatcaaaaggtgccagcacttcaggattccaagaatgaaccgcctacgcggaagaggccaaaacatatggtagaggaggggcagaaccaggataactctcaaaatcataacaaagatactggcatgtcaagcattgaccaagacatttgctccacagctgattcttcatcatgtaagaagcagtgtgccagtacaagctcatattcattttcagttccacagcagtgctcctcatcttctaatctgaagtggccatggcaagatcagactgacatggagcagagttcaagcaaagatggagctatgtga

SEQ ID NO: 1333 - DNA, 459 bp, Glycine Max
atgggtagcgaagaggattcgattgagcaaagcgttgcatcccgtcgcgaaagactgctagctctcagagccgctcaggagttgtccagtgctgccgaacctgaacccaaggacaacaacgacgatgataatgaagaagatcaagaacctcaagaaatgaagttccgtaactacgttcctcacgacaaaaaccttcaggaagggaagcttgccccagcggttctcccaaagttcgaagaccctgtggatgccgtgcctccacccgagcctgaggccgcggaggatccgtttctgaacattgctccgaagaaacctaattgggaccttcggagagacgtgcagaagaagcttgataagctcgagaagcgaactcagaaggctctctatcaactcatggtggaacaagagaagcaaaatcaattgactgaaggagatgatacaaatggcacagcagagtag

SEQ ID NO: 1334 - DNA, 738 bp, Glycine Max
atgggtagcttattcctagggcaaataaaaaagcagacatcaactttcctacaagaaaagtacaaatctgctaggatggcgtttactgatgtttctgaagcagaaatgctggctgaggaagcaacaaataaggatgattgctgccctcatgccaaaactatgactagaattgcggaggcatcatttgacgtagatgaatattggaggattgttgatgttcttcacaaaaggtttaactggggatcaagaatgctaaaactatcagagcaaatactcaagcttttacaggatgaagaagctctcatagaagcacgtttgaaggctctcaaaataacaaatgaaatacaaggctttggaagttcactcaactctccaacttcatcatcaccatcaccttgctctttatcatctgaagcatcacaaggatcttcttgtttctattcactttctactacaagtacccctacttacatatttgattccaatgatcagctaaacaaacatcactcaccctccatagcaaatgatggtgaagagaataatattttgattgattctgatgaggatgaagacatggaaaaaccaagagggtttgtaagtgaaatttgctcaaagattattggtggtagtcccataaaaggagataatcgtgaaaagattgaatttagatgcctctctgatgtggggagcaaggtgacccaaaagaaatttgatcgccaatattcaatttggttttaa

SEQ ID NO: 1335 - DNA, 1329 bp, Glycine Max
atgggtattattatcgggagaaagagaaggtgctcctgttcaactcctcgtgaggaccatcatcttctccttctcactttctttgttgccatacttctacaaagggctgtggttgaatcttctacgctaaattacacgaggcataggcataccagtacccttagacttgaaaggattagtaagcacttgaacaagatcaataagcctccggtgctcaccatagagagtccagatggagatcttatagattgtgttcacaaaagaaaacaactggctttagatcacccccttttaaagaatcacaagatccagaaaatgccaacggagatgccaaaagggatgaaagtgatgagagttgaggatgatatggaaaaggtgagagtgagagagaaggcatggcaaatgtggcacctaaatgggacacggtgtcctaagggaacggttccaatacggcgtagcacagtgcatgacgtgatgagagcaaagtctttgtatgactttgggaagaaacgctcacgagttgattccctctctcgccgcaacgatgcacccgatattctcagcggcaatggccatgagcatgcgatcgcatatacgggatcatcgcaagagatgtacggggcaaaggccacaattaacgtatgggatccatcaattcaagtaatcaacgagtttagtctatcgcaactttggatcctttcaggatccttcgatggcaccgatcttaatagcatcgaagctggatggcaggtcagtccggagctctatggtgacagcagaccaagattgttcacttattggacgagtgactcgtaccgggcaaccggatgttacaaccttctttgtgctggctttattcaaaccaatagcagaatagccattggagctgccatttctcctgtctcttcttatgatggcaaccaatatgacatcacaatcctcatttggaaggatccaaaagtggggaattggtggatgagttttggtgacaacacattggtagggtattggcccgcagagctattcacacacttagcagaccacgccacgatggtggagtggggaggagaggttgtgaactcacgaaccaacggccaacacacctttacccaaatgggctctgggcacttcgcagaagatggtttcggaaaagcaagctacttccggaaccttcagactgtagacacggataacaatctgagttctgtgcagggcatctcaaccttagccgaaaatacaaactgttacgacattaagagctactacagcaacgaatggggcacctacttctactacggtgggcctgggaacaatccacagtgcccatga

SEQ ID NO: 1336 - DNA, 3039 bp, Glycine Max
atgggtcaccacacccgccgcgagtcctacccctccgccacctcctcccggttggactacaacctccacagccagcgccccctcgactacgccgctgcgctctcgtggcccttcgggaagctcaacggcctcgacgccgaccatgtcagggagacagcctacgaggtattcttcacgtcgtgcaggtcctcgcccggctttgggggccaccacgccctcacgttttattccaatcacgagaatggtggcgagggggggaagcagaaccaggtggtgacgaagccgacgagcagggtgaagaagatgttgggcttgaagatgttgaagaggagtccttccaggagattggccaccagtgccggctcatccaccccctcctctcctgtcggtgcacccggcagccctctgtcgcgcactgtgccgccgtttaggccgcggcggcccatgaccgccgcggagatcatgaggcagcagatgagggtgacggagcacgatgataataggttgaggaaaaccctcttgaggacccatgttggccaaatgggaaggcgagcagaaactattatcctccccttggaactgatacgccacctaaagccctcagaattcagtgattcccatgagtatcatatgtggcaaaagcggcaactcaaagtccttgaagcagggctcctcctctacccatcaatccctctagaacagactaacacatttgccatgcgcctcagggacatcgtaaatagtggtgagtccaaacctattgacaccggcaaaaacgcagacataatgaggaccctttgcaattctgtggtttccttgtcatggagaagccacaatggcattcccactgatgtttgccactgggctgatggattccctttcaacattcacctctacacctctcttcttcaatccatttttgatgtcagggatgaaacactagtgctagatgaggttgatgagctacttgagctgataaagaaaacatggtctacactgggaatcaccttgccaattcacaatgtgtgcttcacctgggtgctgtttaagcagtacgtgagcactggccagatagaacctgaccttctttgtgcctcacatgccatgttgaatgaggtggcaatcgatgctatgagagaaaaggaatctttgtattttaagatgctgtcgtcagtgctgaactcaatacagggttgggcagagaagagattgcttaattaccatgactatttccaaagagggaatgctggtcaaatcgaaaaccttcttcctgtggtgttgacagcctcaaagattttaggtgaagatctgacactcacaggtggagaaaggggagagaaaggaggcataaccgtagtggattcatcaagtgaccgaattgatagttatattcgttcttccatgaaaaatgcatttgataaggtattggaggcagcgaatgccaagtctgctgaatttgaaagaaagaaagaattgagtgaagttcttctccaactggctcaggagactgaagccttggtgatgaaggaaagacatcattttagtccaattctaaagaaatggcattcaatagcaggtgcagttgcagcaatggtgctgcatacatgctttggtaaaatgctgaagcagtacgtaagggaattgacttcactgacaaccgaatcagttcaggtgttgcagaaggctggaaagctagaaaaagtaattgtccaaatgatggttgaagactctagtgagtgtgaggatggtggcaaaacattaatcagagagatggttccctatgatgttgattcagtcatattgagtcttctgggaaaatggatagatgaatcattgcacaaaggcaaagagtgtttgcagagggcaaaagaaactgaaacatggaatccaaagtccaaatcagaattacatgcacaatcagctgcggagctaatgaaattggccgcgacaactgtggaagaattcttccaagttccaatagccattacagaagatttagttcaagatctggctgatggattggaaaacctcttccaggactacatgaagtttgttgcttcatgtggttcaaaacaaagttacattcccatgcttcccccacttaccagatgcaacagtgattcaagattcacgaagctgtggaagagagctgctccatgcaatgctggttttgatgctcatatacaacatattaatggaagacacgaaggtcataatcctcggccatcaactagccgtggaactcaacgcctctatgttcgtctcaacaccttgcactatcttgttactcaaattcattctcttgagaaaacactctctatgaactccggagttgttccttcaaaccgccttcggtttgcaagcaaccgcaagagttgttgttcatactttgaaacagtgaacttgtccattcttggagcctgccaacatgtctcagaagttgctgcataccgtcttacatttcacgactcaagctctgtgttgtatgacagcctctatgttggtggtgtgggtagaggtgagataagagctgcattgagaatcctcaagcagaatctcacactaatgactacaattctcacagatagagctcaaccattggcaatgaaggaagtgatgaaggcctcatacgatgcattccttatggttttgcttgctggtggaagctcgcgggtgtttcaccggtatgaccacgagatcatccgagaggacttcgagaatttgaagatagttttcagcaacagtgtggaagggttgatagcagagaatgtggtgaatggagaggctgcagtggtggagggagtgattgcattgatgggtcaaagtagtgaacaattgatggaagatttcagcattatgagctgtgagtcaagtgggataggtttgatgagtaatggatacaagctgccaatgcctcctactacaggaaagtggaacagatcagaccccaacacaatattgagggtgttgtgctatagaaaagaccgcgcagcaaatctgttcttgaagagaacattccagttagcaaagaggagataa

SEQ ID NO: 1337 - DNA, 1440 bp, Glycine Max
atgggtcgcgaaactatgtgcctttcaaccccaccaccaaccactgccaccaccacagtgaacccagtgccgccaccgccaccagcaccacctacctctcttgctccaggcttcaggttccacccaactgatgaggagcttgttatttattacctcaagcgcaaggtttctggcaaaagcttccgatttgatgccatatctgaggttgacatatacaggagcgaaccctgggacctagcagacaagtcaaggttgaagactagggaccaggagtggtattttttcagtgcattggacaagaaatatgggaatggtgggaggatgaacagggctaccagcaaagggtactggaaagccactgggaatgatcgaccggtgaggcatgaccaaaggaccgtggggctgaagaaaacgttggtgtttcatagtggcagagctcctgatgggaagaggactaactgggtcatgcatgagtacaggcttgttgaagaggagcttgagagggctgggactggatcctgtcagcctcagaaggatgcgtatgttttgtgtagagtgtttcacaaaaataacataggacctccaaatgggcaacggtatgcgcccttcattgaagaagagtgggatgacgcatcaggaatggttccaggggcagaccatgtggataaccgctcttttgcccaccaaccacgtgttgaaggcaatggtgatgttgtcatcgaagttctgatatgttgccaatcgcaagtagagctactggtgcatgtaagccacaagctgccatcttgtcttttgttcatgatcgcgctgccacaaaatcaacaacccattgacactcaatctttcaacaaagctccatttgatgtgaacaagcttcctatagaaactcaaaatcttctagctgatgataataattgtaagcacatggatgactacccttcacctcaaacagataatccaaagcctttctctcaaatatacaaacgaaggcgtcataacttgaactccaacaactctaatgtttctggagattcagtccgaaccagccaggatccgtgctcctctacaataactaccgctgcaactgcactcccaaccgcaactgttgctggcacagccaccaacactgcaccgaaaaaacattttctgtctgcactggtggagttttccctgctagaatcccttgaatcaaaggacaaccttgcttcaattaaggcaccggattttgacactgaaaatctcgagtcatccatgcctccaagttgcgcaaagttcatcaagcaaatgcagagtgagatgcagaagctttcagttgaaaaggagacgataaggtttgagatgatgagcgcacaagcgatgattaacattctccagtctcgcatcgacgttctcagcaaagaaaatgaggatttgaagaggatggtggcccaaaatccatag

SEQ ID NO: 1338 - DNA, 384 bp, Glycine Max
atgggtgaaatttggtggtcccttttggggtcggcgatccccgtggtggtggctgggcaagcgtttcgcctgaagaaacggcgtgcagaggagcagaggctgcagagtggtcgtgggagggaaaggaattccgatgaaatcttcgtgtgtgaaagggtctgcacttcaaagaggatgctcaagaagcttggttccttctccaaggaccccattcctgatacctgcgtcaccgtttgcggcgtttccgatgtagatgcatgtgctgatgcctgtgcccgcactgtgtgtatcaaccaacatcaagtccctaattggaacgacatttgcctcaggaggtgccagagtgaatgcctcaaactctcttctcagagtcggtcctcgtag

SEQ ID NO: 1339 - DNA, 384 bp, Glycine Max; identical to SEQ ID NO: 1338

SEQ ID NO: 1340 - DNA, 384 bp, Glycine Max; identical to SEQ ID NO: 1338

SEQ ID NO: 1341 - DNA, 438 bp, Glycine Max
atgggtgctttcactgagaagcaagaggctttggtgagtagctcattcgaagcattcaaggcaaacattcctcaatacagcgttgtgttctacacttcgatactggagaaagcacccgcagcaaaggacttgttctcgtttctatctaatggagtagatcctagtaatcctaagctcacgggccatgctgaaaagctttttggattggtgcgtgactcagctggtcaacttaaagcaaatggaacagtagtggctgatgccgcacttggttctatccatgcccaaaaagcaatcactgatcctcagttcgtggtggttaaagaagcactgctgaaaacaataaaggaggcagttggggacaaatggagtgatgaattgagcagtgcttgggaagtagcctatgatgaattggcagcagctattaagaaggcattttag

SEQ ID NO: 1342 - DNA, 1398 bp, Glycine Max
atgggtgtgacacagttgaaccccacttgctcaaaacctcgtcttcactcatctcagctctcttttctatcaaggactcttcctagacatcgccactgcacttttgcgccacttcatagaactcaacaagctaggatttcctgttctgttgcaccaaatgaagtgcaggtgccaactgtgaaaacccaggatcccaagagtaagcctgagtgctatggtgtcttctgccttacctatgatttgagggctgaagaagagacaagatcctggaagaaattaattaacattgcagtctcaggtgctgctggaatgattgcaaaccatctacttttcaagcttgcatctggtgaagtttttggtcctgatcaacctattgctctcaaattattgggatcagaaaggtcaatccaagctcttgaagctttggttataagacactctgcaaccatgatctgtcactttttctttttttgtcttaactacaccttcaatagaaatttgagtataactttacatgaatatgacttgtctggtcagagtaggtgttgcaatggaactggaggactctttgtttcctttgttgagggaggtcaatgcagaatgggctttgctaataggtgcaagcctcgaggacctggaatggaacgagcagacttgttagacataaatgggcagatttatgcagcgcagggaagagctttaaatgccgttgcatcccgcaatgtcaaagttatagtagtgggaaacccttgcaatacaaatgcattaatatgcttgaagaatgctcctaacattcctgcaaaaaattttcatgctttaactcgtttagatgagaacagagcaaaatgtcagctagccctcaaggcaggtgtcttctatgataaagtgtcaaatgtgacaatatggggcaaccactcaactactcaggtccctgacttcttaaatgctagaattgatggtttgccagtcaaagaggtggttaaggatcataagtggttggaggaagagttcactgaaaaggttcaaaagagaggtggtgcgcttattcaaaaatggggaagatcatcagctgcatcaacttctgtgtcaattgttgatgccataagatctttagtaactcctactcccgagggtgattggttttcttctggtgtatatagcaatggaaatccttatggaatagctgaaggtattgttttcagtatgccatgccgatcaaagggtgatggtgattatgaacttgtcaaggatgtcatatttgatgactacctccggcagcgaatagctaagacggaagccgagttgttggccgagaagagatgtgtggctcacctaacaggcgagggaattgctgtttgtgatctacctggtgataccatgctcccaggagaaatgtaa

SEQ ID NO: 1343 - DNA, 1359 bp, Glycine Max
atgggtgtgatgggcaaggcaagatccgttgcggcaatgggtgggagaatattgaacgaggcagtgagcttcgttgctttctgtgttctggaccttgtcgattttctgttatgttttgttttcaaagctgtggacttgtgggttgaggcagagttgagaccctgctattgctcctccgcgaaggaagcaatcacgagcagtgggaagatcttggtttctgagcaaggtggagaatccaagatcgtttctcttcttagctcaaccaagcttcagttggaggacatctctgacaccctctactctcgaccctctttggtctcggaggtctcgaggttaaccatcaatgagctcaagaggttcaagctggaggaccccgttttgcagtccaagagaggcaccaactcgcgctgttccacgttcactgtcaacaccaccattgtagaaatgcttcagggaaaaattgcaaggcaccttactcatcccattcctagatggtccgactgtgattgcaaactatgcacaagttggatctcctcttcttcctctcctcataacgataacaccaatgccaaagccactctctttctgaagtcccaatgccccaccacagatgaagcgggagaggatgtggtgttcatacatgggttcatttcatcgtcattattttggagcgagacagtgttcccgaacttgtcgaagtcgtgttaccgattatttgcggttgatctacttgggtttgggaggagtccaaagccgaactcgtcgctgtacacattaagagagcatttagagatgatagagaggtcggtgttggaggcccataaagttaagtcctttcacattgtggcacattcccttggttgcattctcgcacttgcccttgccgtcaaacaccctcaatccgtcaagtccctcaccttgcttgctccacccttctatccggtgccaaagggtgaaacacaggctactcagtatgttatgagaaaggttgctccaaggcgcgtgtggccacccatggcctttggagcgtccttggcatgctggtacgaacacataactagggtgatttgcttcctcatttgcaagaaccaccgtctctgggaatttctcgccaaactcatcactcggaacagggtcaggacgttcttgcttgaagggttcttttgccacactcacaatgcggcatggcataccctaaacaacattatatgtggaaccgcagggaaaattggatcttatttggacgctgtgagagaaaaccgtgactgtaaagtgaccatatttcatgggcaaccacctggaaggcagctccgggggggcaaaaaacgaattttcccgggcgcacggttggagatttga

SEQ ID NO: 1344 - DNA, 1065 bp, Glycine Max
atgggttcaatgaataaccaaaatgcaatggagctctttgagggtcaagctcttttgtacatgcagctacaaggccacctaagaactacgtgtcttaagtgggctgtccaacttggtattccagacataatacagaaccattccaaacccattactctttctaacttagtctctactctccaaattccaccatctaaggcttgttttgtgcagcggttcatgcgctttttggcacacaatggaatatttgatatccatgagagacaagaagatcatgaaccaacatatgctctcacctctgcttcaaagcttcttgtcagtggcagtgatcactgtttatctccaatggttctgttgaaaactgatcaacttctgacgagtacattccatcagttgggggaatggactcgtggggaggacgccacattatatgagacagccttcggaacaaacatttgggaattttttgagaaaacacctgcatattttagtctcttcaatgaggctatggcaagtgattcccttatggtagacttggcactcaaaaattgcacttcagtttttgaggggctcgattccatggtggatgttggtggtggaactggaaccacagccagaattatctgtgacgcatttcctaagttgaaatgtgttgtgttcgaccttcctcacgttgtagcaaacttgctaggaaccaatcatttaagttttattggtggtgacatgttcaactctatccctcaagctgatgcagtgctactaaagtggattttacataactggaatgatgaaaattgcataaagatcctggaaaagtgtagagattctatttcaagcaaaggcaacaaaggaaaagtgatcatcatagatgcagtaataaatgaaaagctagacgacccggatgtgactcaagcaaagcttggtttggatataattatgtctgctatgaatgggaaagagcgaagtgaaaaagaatggaaacaagtgttcatggaagcaggattcaaacactacaaaatatttcccatctttggtttcagatctctgattgagctttatgcttaa

SEQ ID NO: 1345 - DNA, 609 bp, Glycine Max
atgggttcctccaagttattgggtactatggccatgcttttcgttgtgctgctacccatggctgccaaaggggataatattactgatttccttgataaggtttgtgaagaagtggaatgtgggaagggaagctgcgtagtaaacacaagttacccattaaacttcgtttgtgaatgcgattctggctggaagcgaacccaagatgacgatgataaatatgccgctagctttcttccatgtgtcattcccgaatgtagcttgaactatggttgtcagccagcaccaccgccagttccagagaagagttttccacataacttctcagcttttgatacttgctactgggcgtactgtggggaaggtacatgcaccaagaacaggacacatacacacagatgcgaatgtcaacccaattactataatcttctcaacatctcagtttttccttgttacagtgaatgtactcttggatctgattgttcgagactcggaataaaagttgcaaattcatccactgatagtggcagtcaagatagctcagcctcaatcttcacaggaaagttccattggatcgttatgttgttgatgtccacgggtatggttatgtag

SEQ ID NO: 1346 - DNA, 828 bp, Glycine Max
atgggttgtttcatggcatgttttggtctatccaacaaaagaaagcgtagaaagactatctacaaagtcctagctggacaccaagtaactcttgccataaccgaaaaattcactatccctgattctgatttcagaggaagagatgaagttaaggagcagaatagtgttaaaagcaagaagaagaaagttaccttcaatttgaatgtacaggtatatgagccaaaccccacagcttatcaggtattgaataatgaggaagaagaaaataggaaccatgctgcagaaacagaaggatctgcagccttgccagtgagatacccttctaatcatagatattacaattgcggagatggatatgatgatcaggaggatgaaatggcatatgaggattctgacattgatgactatgaggatgacgatgacaatgaatttgatgatgatgagtatgattgggatgatgatgaagataagataaggaatcagatgctagatgaagctgagctgaaatccaatttaagtggaggagacagaagcaaggacatgcattctgttctgatccctgtggagaatctcacacagtggaaagcaatcaaaacaaaagttgtatcatcaagcaagcacacgaggaaggagaatgttccatcaaagcaacatacaaacatgcccttagtctctgaagcaagcttgaatttctcaccttgcagcttggaatcaaatgcccttcagtccatgcctctattgccagaaattgcagttgatgctagtctttcaaactggttggtttctcctaattatcgtgtctcctcgaccacaattcattgccaatga

SEQ ID NO: 1347 - DNA, 1083 bp, Glycine Max
atggtaactagaattgtggatcttcggtcagacacagttacaaagccaaccgaagcaatgagagctgctatggcaagtgctgaagttgatgacgatgttctaggctatgatccaactgcgtttcgcttagaaacagagatggcaaagacaatgggcaaggacgcagctctttttgttccatctggcactatggggaaccttatatctgtacttgtccattgtgatgtcagggggagtgaagttattcttggagacacttgccatatcaacatttttgagaatggaggtattgcaactattgggggagtgcatcctagacaagtgaaaaataacgatgatggaaccatggatattgatttgattgaggctgctatcagggacccaatgggggagctattctatccaaccaccaagcttatttgcttggaaaatactcatgcaaactctggtggcagatgcctctcagttgaatatacagacagagttggagagttagctaagaagcatggactgaagcttcacattgatggggcccgtatttttaatgcatcagttgcacttggtgttccagtggataggcttgtccaggcggctgattcagtttccgtttgcctatctaaaggtataggtgctccagttggatctgttattgttggttccaaaaattttattgccaaggctagacgactccggaaaaccttaggaggtggaatgagacagattggcatcctttgtgccgctgcacttgttgccttgcaggaaaatgttgggaagctggaaagtgaccacaagaaagctagacttttggctgatggattaaacgaagttaaaggattgagagtggatgcctgttctgtggagaccaatatggtatttattgacattgaagagggtacaaagactagagcagaaaagatatgcaagtacatggaagaacgtggtatccttgtgatgcaagagagttcatcaagaatgagagttgttctccatcaccaaatatcagcaagtgatgtgcaatacgccttgtcatgctttcagcaagctgtagctgttaaaggagtacaaaaggaaatgggcaactag

SEQ ID NO: 1348 - DNA, 2175 bp, Glycine Max
atggtactgggaataagatcaaagagtaaaaaaagtgtttcaatccaagttcactacatcatccatgttcaggagatcaagccatggcccccttcacaatcactgagatcagttcaaacagtactactgcaatgggaaaatggagatcaaaattctgggtccctaccatccactgctggcaatgggaaaattgaatttaatgaatctttcaggctttcagttcttatgtgtagagaagcatccaagaaaggcaaacaccgtgaaactttccagaagaactgcttagagttttacttgtatgacaagacagtaaagagtcaactgttgggatcagccacaataaaccttgcagattttggaattattaaggaaactaaagccttaagcattcagtttaactgcaagaagagttccaggatttcttcacagccatttctttatgttaatattcagccatttgatatagagagttccagctcatcaccaagcagcagcttgtcaaaagaattgtcactagagaaggaaggaagcgaatctgtatcacaatcactaaaagatgatgacaatcttgaaattgcctcttttactgatgatgacagtgatgacatcccttcaaatacctcccaaactagcagacctgcttcagagattactggagagaaaacgaaggagggaaggaaaggacaagaacagtttactatgaggaatgaacttttagaaaatgagcttgttaataatttatctgacgatgattctacaaagaaagggaaattcaatagtactactcatttgctaaacaagaaattacatgatcatccaacaagtattttgatgaatgataaaacagaggacgtgacaaatacccataatcaggccgaggaaattaatactatgaatgatgttcatgttgaagagctgagggaagccgctgctcttgaagtttcaatgtactcagttattgctgaacatggtagctcatcaaacaaggtccatgcacctgctcggcgcctttctagattctatttccatgcttgtagagttgggtccccagctacaatggctactgcagcccagagtgctgtctcgggatttgttttggtttctaaggcatgtggaaatgatgttccaaggttgacattttggttctcaaatttaatattgctgagagcaattgtgagcaaagaagttgagaatatacactttggtgatggtccatccatcaacagtgaaagtgatggaactggtaacactcttcacaaagaagaaaaagacaatacagaaaaacattttcatagatgggaagatccagaaacatttttagttgcattggaaaaggttgaagcatggatattctctcgaattgttgagtctgtgtggtggcagactcttacaccatatatgcaatctgcagctgctaagaactctagctctaggaaagcctatgagagaagatatcgtgttggtgatcaagatcagggaagtttttctattgatttatggaaaagagctttcaaggatgcatgtgaaaggatttgccctcttcgagctggagggcatgagtgcggctgcttgctagtgatagctagattggtaatggagcagttggttagtagacttgatgtggcaatgttcaatgctattcttcgtgaatccgctgaagagatgcccatggatcctatatcagatcccattagtgattctatggttcttcctattccagctggaaaatcaggctttggggctggtgcacaactgaagaatgctattggtgactggtcaagatggctttcagatttatttagcattgatgatagtgactctcgtgaagttagcaatgaaaacaatgaatccaaatgtgaatcatccttcaaacctttccaattccttaatgctttaagtgatttaatgatgcttccattggacctgcttgcagatgggtccatgataaaagagctacaagaagtgggaaacaaaacttcactaagaactgggtcatttgtgctcaaaaagttatataccagtgatgatgaacttgatgaattggattcaccactttctgctcttggtatggatgactcatcactttcatccaaggaaaagcttgcactagttaagggaggccgcaaggttgtacgatatgagctcttgcgagaagcgtggaagactagtgaatga

SEQ ID NO: 1349 - DNA, 573 bp, Glycine Max
atggtcatagtccaggtgggctataccttcttatatttcatcactgaagcctccttcaatcatggtatgagccctcatgtgtacgtaacctatcggcatattctggctgcggctatgatgttcccttttgcatactttttggagagaaatgcaagaccaaagctgacatttgctcttttcatggaaatttttgtgctttctctgttaggggttagtgtgactcttaatatgtactttgcaagcctgaactacacaaatccgacctttgttgcttccatggtcaacaccatagcttcccttaccttcatcattgcagtggcactcgggtttgaggttcttgatcttcgaaatcctcgtggtatagcaaaagttattgggaccatgatctccttagctggagttttgatcatgacactgtacaaaggaccagttatgagaaatttatggcatcctctaatccatattccagggaaaagtgctgctataaatgaagactggttaaagggttcaattcttacggtttcaagttgtgttacatggtctgtatggtacattatgcaggttttcacctaa

SEQ ID NO: 1350 - DNA, 1576 bp, Glycine Max
atggtcgctgaagcttggattgtgaagatgggtaaccaggtaagcgccaatctcaagcacgctcttcttcttgaaccttccgcaaggagaaaacacaaccccaaaaggcaagataatagtaccagcagtaaagaagtaattgggattctttctttcgaagtagcaaatgtaatgtccaaaaccgttcacctccacagatccttgtcggagcccgagatcgtgaagctcaggaacgagatctcgaactcacagggtgtccaaaaccttgtttcctccgaagagggttatctcctcgagctggctcgagcagagaagctcgaggagctgaaccgcgttgcaaacgtggtttctagattggggaagaagtgttccttgcctgctttgcaaggctttgagcatgtttatggggacattgttagtggggtcatagatgtgaaggaattggggttcttagttaaacacatggaaggaatggtgaggaaaatggataggtatgttagtgctaccaggagtttgcacagtgaaatgggggttttgaatgatttggagcaagcagtgaagaagtttcagcatgaggagagcagaagggcgtttgagcagaaactcacttggcagaagcaagatgtgaagcatctaaaggagatttcgctttggaatcagaactttgataaggttgttgagttgttggccaggacagtttgtaccctttatgctagaatctgtattatcattggtgattctacatggagaaaaagtaatagtcttgggcttagtggattgaaaaacatacattgcaagagaaataggagaactgctgtggagacaagggaaactattagtaagcctatgaggagaggtgaattggcatatcttcaactcgaagattttggttttccttgcggaacaagtccggggagacttttcatggaatgtctgagtttaagcagctcggttgtgaaattagacgatgacgatgatgattatgccaagaaaagggatcactttggtgttcctttcaccgaagatctaagttgctcaacctttggtccccaaagtagattagctgtttatgctcctccttctacacttggaggctgtgctctagcattgcactatgccaatgtcataatcgtcatggagaaactccttaggtatccacatttagttggtgaggaagctaggaataatctatatcagatgctaccaacgagcttaaggttgtctctgaaaggcaaacttaagacctatatcaagaacttggccatatatgatgcacctcttgcccatgactggaaggttactcttgatgggatactcaagtggcttgctccacttgctcataacatgatcaggtggcaaagtgagaggaattttgagcagcaccaaattgttaacaggacaaatgtgctgctatttcagacattatactttgctgacaaggacaggacagaggaagctatatgccagcttcttatgggactcaattacatatgccgttatgaacaacaacaaaacgtgttgttgggttgtgcaagtagttttgattttgaagattgcatggaatggcaactgcaat

SEQ ID NO: 1351 - DNA, 1947 bp, Glycine Max
atggtgaagttctcaaaggagctagaagctcaactgataccagaatggaaagaggccttcgtcaactattggcagctgaagaagcagataaagaggatcaagctctccaggcttcccaagcaatcccaccaccacgcaaaaccagactttggtctctccattttcgattctttaagcttctttaatatatcagtatctatctggcacgtccggaaaacctgtgttggcaacaaaatgtcacacacacgcacgctgaaacctcggaagaaaaccacaaagggtgacgaagaagaaatctatgagacagagcttgcacaattattttctgaagaggatgagatacgtgtgttttttatgaggctggatgaggagctgaacaaggtgaaccaattttaccggagacaagagagtgagtttatcgagagaggagaaaccctgaacaagcagcttcagattttgcttgatctcaagcgaattatcagtgatcgtcgccggaaaaattctccgtcgaagccatatagcaccggaatatcccctcaatattctccaacccgagattctgattattcgggaaattttggagattctgatgaaacaaattcagaaatttcacatacggatgaggtaatcacaacattagagagaaacggtataagttttgtgaattcagcgacgaggacaaagacgaagaagggaaagccaaaaacggcaatgagaattgatgttccagccaccaacccaactcgggcaattacagctatcactagcatgctgtgggaggatttagtcaacaatccaaccggagacttccttcacaagagaaagctccaatgtgctgagaaaatcatcagaagtgcctttgtggagctctataaaggccttggcctactcaaaacttacagctcactgaatatggtagcatttacaaagatattaaagaaatttgacaaggtatcttgtcaaaaagcttctgcaaattatttaaaagaggtgaagagatcacatttcgttagttctgacaaggcttttggactaatggacgaagtggaatccatattcacaaagcactttgccaacaacgataggaaaaaggcaatgaaatttttaagaccccaacaacataaagattctcacatggtcactttccttttcgggttgtctacaggttgctttgtatccttgttttgtgtatatgcaatcttggcacatttgtgcggtatattctcctctagtaacgagccagcttatatggaaacagtctaccccgttttcagtgtgtttacattgttaagcctgcacttgtttatgtatggatgcaacctgttcatgtggaagaatacaagaatcaattacaatttcatatttgaattttcaccaagcacagcactcaagcacagagatgcatttctgataagcactaccttaatgacaactgtgattggggcaatggtcatacatcttcttctaagggctgcaaacttttctcctaccgaaattgatgccattcctggaattcttcttctgtttttcatagcactgctcatttgcccatttgacattttttatcgcccaacacgttactgcttcatccgtgttatttgcaacatagtatgctctcccttttataaggttctgctagtagacttttttatggctgaccaactaactagccagattccattgctaaggcatttggaaactgcaggttgtcacatttttgctagagctttcaaaacacaccaccctgatacatgccattctggaagagtatatatggaaataacttacatcatctcatttttgccatattattggcgtgctttgcaggtaagcctaggatgcagattggtaattgtaggttctcttttgacattgcaacctaggaaactaatcaactacttcaaccattggagacatgctacattgctaattgaatttctcttttaa

SEQ ID NO: 1352 - DNA, 2331 bp, Glycine Max
atggtgaagttctcaaaggagctagaagctcaactgataccagaatggaaagaggccttcgtcaactattggcagctgaagaagcagataaagaggatcaagctctccaggcttcccaagcaatcccaccaccacgcaaaaccagactttggtctctccattttcgattctttaagcttctttaatatatcagtatctatctggcacgtccggaaaacctgtgttggcaacaaaatgtcacacacacgcacgctgaaacctcggaagaaaaccacaaagggtgacgaagaagaaatctatgagacagagcttgcacaattattttctgaagaggatgagatacgtgtgttttttatgaggctggatgaggagctgaacaaggtgaaccaattttaccggagacaagagagtgagtttatcgagagaggagaaaccctgaacaagcagcttcagattttgcttgatctcaagcgaattatcagtgatcgtcgccggaaaaattctccgtcgaagccatatagcaccggaatatcccctcaatattctccaacccgagattctgattattcgggaaattttggagattctgatgaaacaaattcagaaatttcacatacggatgaggtaatcacaacattagagagaaacggtataagttttgtgaattcagcgacgaggacaaagacgaagaagggaaagccaaaaacggcaatgagaattgatgttccagccaccaacccaactcgggcaattacagctatcactagcatgctgtgggaggatttagtcaacaatccaaccggagacttccttcacaagagaaagctccaatgtgctgagaaaatcatcagaagtgcctttgtggagctctataaaggccttggcctactcaaaacttacagctcactgaatatggtagcatttacaaagatattaaagaaatttgacaaggtatcttgtcaaaaagcttctgcaaattatttaaaagaggtgaagagatcacatttcgttagttctgacaaggcttttggactaatggacgaagtggaatccatattcacaaagcactttgccaacaacgataggaaaaaggcaatgaaatttttaagaccccaacaacataaagattctcacatggtcactttccttttcgggttgtctacaggttgctttgtatccttgttttgtgtatatgcaatcttggcacatttgtgcggtatattctcctctagtaacgagccagcttatatggaaacagtctaccccgttttcagtgtgtttacattgttaagcctgcacttgtttatgtatggatgcaacctgttcatgtggaagaatacaagaatcaattacaatttcatatttgaattttcaccaagcacagcactcaagcacagagatgcatttctgataagcactaccttaatgacaactgtgattggggcaatggtcatacatcttcttctaagggctgcaaacttttctcctaccgaaattgatgccattcctggaattcttcttctgtttttcatagcactgctcatttgcccatttgacattttttatcgcccaacacgttactgcttcatccgtgttatttgcaacatagtatgctctcccttttataaggttctgctagtagacttttttatggctgaccaactaactagccagattccattgctaaggcatttggaaactgcaggttgtcacatttttgctagagctttcaaaacacaccaccctgatacatgccattctggaagagtatatatggaaataacttacatcatctcatttttgccatattattggcgtgctttgcagtgtgcgagacggtggtttgatgatggtgacgtgaaccatttggctaacatgggcaagtatgtttcagcaatggtggcagcaggggctagagtaacatacagcagacagaatgaccatctatggtttgctatagtcttaattacttctgtagtggccacaatgtatcaactgtactgggattttatcaaggactggggatttcttaatcctaaatccataaatccatggctcagagatgatctaattctaaagaataaaagcatatactatatgtctattgtcttaaatattgtccttagagtgacatgggtagagactatcatgcacttcaaagtagggcgtgcccaatcacgactactagaatttttattagctgcacttgaggttattcgaagagggcattggaatttctacaggttggaaaatgagcatctaaataacgttggccattatcgggcagtgaagacagttccactaccatttcgagaggtagactctgactga

SEQ ID NO: 1353 - DNA, 1344 bp, Glycine Max
atggtgacagaggagaaagtacatgcactgaaagacaagttgcgggagtcggtcaagattatcgtggagagtgatgactacaccgtggacgccgcggacgaggccatggatgctctttctgctctcaaggatttgaaatgcaccacttctctctctcgcaacttggacgatgcagctgttcctccacactttcgctgccccctctctggaaatttgatgacagatcctgttatcttggcctctggacagaattttgatcgggctttcattcagaggtggctgaacgaggtccgcagaatttgccctaagactcagcaagtcctctctcactccatcctgacccctaattgctttctccaaaacatgatttcactgtggtgtaaagagcatggagttgagcttccaaagcccgtttgggacattcacggtgaaaaattagccgaagatcacagactccatatgcgttctcttctctacaagctatcactttctgtctccgaacaaaaagaagctgcaaaagagcttcggcagttaacaaagcgaattccgacgtttcgaacactctttggtgactcagaagtgattcaactaatgctgagacccttatcacccggcacggcctccgtggaccccgagctccacgaggacttgatcacaactcttcttaatctctcaattcacgataacaacaagagggtcttagcagaggacgaaaaggtcatttcacttcttatcgaatcgttgaaatattcaggaacagttgaaacgagaagcaatgcagctgcagccattttctcaatgtcagctattgatgcaaacaggcacataattggaaaatccggagttatcaaatacttggtggatttattagaagaggggcatccaccagcaatgagagatgctgcttcagcactgttcaagctatgctacacgcatgaaaacaaagggagaaccgtgcgagaaggtgcagtgcaggttattctcggcaagatcgttgaccatgttttagttgatgagttgttggcactgctagcacttctctcttcgcatcacatggctgttgaagcattggtgaaccatggtgctgtaccattcttgttggatatcttaagggaaaaggaaaacacatcagaagaacgcatcaaggaaaactgtgttgttattctgtgcacaatctgtttcaatgatagagaaaaaaggagggaaattggagaggatgaaatggtcaatggcacactgtatgagcttgcacaacgcgggaattcaagggcccaaaggaaagctagggctattcttgaaacaataagccacacggatgaattgtatcatattttttttttataa

SEQ ID NO: 1354 - DNA, 1197 bp, Glycine Max
atggtgagaaaacaagcagaacaaataattcttcctagcattttggatgttgaagatctttggccattctttcatgaagactctattaattttgcccaacgtttaacaagaagtcttaaagactccagggagaagcaaaggaatttagaggctcagataagaaaaaaaatgaagaagtttggcaaggaaaaacacagtattatttattcaccagaagaagaggtggttaagggttttcccgaagttgagttaaagtggatgtttggaaataaggaggttgtgcttcccaaagctgttggtctccatctttaccatggttggaagaaatggcgtgaagaagccaaggcaaatttaaaacagaatttaataaaagatgctgagtttggcagacaatatgtggctgaaagacaggaaagaattcttttggatcgtgacagagtagtgtcaaggacttggtacaatgaagggaagaatagatgggagattgatccggtggctgttccttatgctgtctcaaaaaagctaatagagcatgtccgcattaggcatgactggggtgccatgtatatcacattaaagggggaggatgaagaattttatgtagacataaaggagtatgaaatgctttttgaagatttggggggatttgatgggctgtatatgaaaatgcttgcctgtggtattccaacagcggttcatctgatgtggattcctttctcagaattgaatatccgccaacagtttctattgatattaagagtgtctcgtgggattttgagtggcttgtggagttctggagttgtcacgaatgtgagaaattggatctttaagaatattaaggatacaactgatgacataatggtggtgatagtgtttcctattgtggaatttttagtcccttacccggtgaggatacaattggggatggcttggccagaggaaatatatcagacagttgactccacatggtacttgaaatggcaatcagaggcagaattgaattttagatccagacaaacaacaacagatgatgatgaagaagttccatggtttttttggtttcttgtcagagctgctatatatgggtttgttttgtttcatgtgttgaaatttacgaggagaagacttcctagtcttctcgggtttgggcctttgcgaagagatccaaatatgcagaagttgcagcgagtggtataa

SEQ ID NO: 1355 - DNA, 819 bp, Glycine Max
atggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgagatgttgggaaacaggtggtcagcaattgcagccaaattgccaggaagaactgacaatgagataaaaaatgtttggcacaccaatttgaagaagaggctgctgaaatcagaccagtccaagccaagttccaaaagagccactaagccaaaaattaaacgttctgattccaattccagcatcataactcaatcagaacctgctcatcttagattcagagaaatggacacaacatcaacagcatgcaatacttctagtagtgatttttcatcagtcacggttggtgacagcaaaaatattatcaagagtgaagacatagagtctatggaaacaatgcctgtgatagatgagagcttttggtcagaagctgcaattgatgatgaaacccccaccatgtcatcacaatctttgatcacaatctcaaatgacatgccacttcaatacccttttgctaactatgaggaaactttccaacagagtcatgcttatgattcaaactttgatgatggcatggatttctggtatgacatattcaccaggaccaatgattcaatagaattgtcagagttctga

SEQ ID NO: 1356 - DNA, 246 bp, Glycine Max
atggtgccttcaaaaatcatgagaattttggtaaggttgttttttaaccaaaaaattatcatgttatttatcttctcattaattaaagaattttttgttttttctaaattagttcttacttttttattgattaaaaaaataactaagtaccaaaatcctcgtaatttttcaagggttcatagagattctcttactattttttcaacctattggtggataaacctaacctgcttaaaaagcggataa

SEQ ID NO: 1357 - DNA, 2034 bp, Glycine Max
atggtgctttcagtactactacttttgttttctcttgtgtttttgctctcaaacccaacatgggtgtgtgggaatggagagttaagagcactgatggatatgaaggccagtttggacccagagagtctttatctaccctcttggagtatcaatggtgatccatgtgacggatctttcgaaggaatagcatgcaatgagaagggtcaggtggcaaatgtttctctgcagggaaagggtctcttagggaagctttcaccagccattgctggcctcaagcacttaactggactctacttgcattataactctttgtatggagagataccaagagagattggaaacttgactgagcttgttgatttgtatttgaatgtgaataatctgtccggggaaatccctcgtgagatcgccagcatggagaacttgcaagttttgcagctttgttataatcagttgacaggaagcattcctacacagcttggtgctttggaaaagctgagagttgttgctttgcagtcaaacaatttaaccggtgccatccctgctagtctaggtgatttgggtatgctggtgaggctagatttgagttctaataatctctttggttccattcccactagcctagctgatgctctttcactgaaggttttggatgttcacaacaataccctttctgggaatgtacctcctgctcttaagagactagatgatggatttctgtatgaatacaatttggggttatgtggagttgggttttcatcactgaaagcttgcaatgcttcggatcgtgtcaatcctagcagacctgaaccttatggagcagccacaagagatatcccagaaactgctaatgtgaagttaccttgcaggggaactcaatgccttaattcatcaaaatccagtcaatccacatcagttactgctggcatatttgtggttataattgcactgtgtgcaattggtgtttggacattcgcaatatatcgtcgaaggaaacaaaagcttggagattcttttcatatcagtgacagtcatctaaacactgatgaagccattggagcatataggaaaaatggatctcctttggtcagccttgagtactctactggatgggaccctttggctgatagtaggaatttcaatgggtataaccaagatatattccagagtttgaggttcaacttggaggaagtggagtcagctactcagtatttctctgagttgaatcttttgggtaagagtagctttagtgcaacatatagaggagttttaagagatggatccgttgttgctgtgaagagcatcagcaaaacaagttgcaagtcagatgaagctgagtttatgaagggattgcacatgttgacctcactgaggaatgataatgtagtgaggttgagaggattttgttgttcaagaggacgaggtgaatgctttctgatttatgattttgttcctaatggaaacctttcacgcttcctggatgttaaggtaggaggtggagaagtccttgaatggtcaactagagtttctattgtgaaagggattgctaaaggtatggcatatttacatgcatacaaagcaaacaagcccgttttggttcaccaaaacatctcagctgacaaagtactcattgatcagcggtacaatccattactagcagattctggcatgtacaagcttcttactaatgatattgtcttctccgcgctcaagggtagtgcagcaaagggttacttggcgcctgaatatgccaccactggccggtttgccgagacaagcgatgtttatgcttttggggtgctgcttttccaaatcctttcagggaagcacgagatcacaagctcaataaggcttgctgcagagtcttccaagtaccaagaatttatggacccaaatctccatggaagatactttgaatatgaagcagctaaactggcaaagatagctttgctttgctcccatgaatctccttttgagaggccatccatggatgccattgttcaagaactggggaattgtagtagctgtctctga

SEQ ID NO: 1358 - DNA, 255 bp, Glycine Max
atggtggtgaagatgatgagttggcctacatggccacctctctcatctaagaaatttgaagtagttttcatagtgcacaggcttgaggggtcatcaagtatggagaaagatgagttggcctccatgagaaatttcaccagagaaaagggtcttaatgatgcaggagtagttgaatggaatcaggaatttagaaatgcgtgcaactttactaggtataaggagaacgtgttttatccatgggaagttatgttcaca

SEQ ID NO: 1359 - DNA, 996 bp, Glycine Max
atggtggttccgctgaatatgtgggttctgatctcaaatttcaagttggcatacaatcttctccgtcgccctgatggtactttcaaccgggacttagcagagttccttgatcggaaagttccagccaatgcgaaccctgtggacggagtgttctcatttgatgtcattgttgaccgtgaaaccaatcttctgactcgaatctatcgtcttgctgagggagaagaacgttccgtgaacattcttgaccttgagaagcccgtgaactctgaggttgttcctgtcatcatattcttccatggtggaagttttgcgcattcttcagccaatagtgctatatatgacacactgtgtcgtcgcctggtgggtatctgtaaggctgttgtggtgtctgtgaactataggcgtgcacctgagaataggtatccctgtgcatatgatgatgggtggacagctcttaagtgggttagttctgcatcttggcttcagagtaggaaggataagaaagttcatatctacatggctggggatagctcgggtgggaacattgtgcaccatgttgccctcaaagccatggagtcgggaattgaagtgtttgggaatatactgctcaacccattgtttggcgggcaagaaagaacagagtccgagaagcgtttagatgggaggtattttgttggagttaaggatcgagactggtattggagggcttttcttcctgaaggggaagatagagaccaccatgcatgcaacccgtttggccccaagggcaaaagccttgaagggataacctttcccaagagccttgtggtggttgctggtttagaccttgttcaggactggcagttgggttatgcaaaagggcttgagaaggctggccaagaagtgaaattgctattcctggagcaagcaaccgttgggttttatttgctgccaaacaatgagcacttctctcctgttatggatgagataaaatattttgtcggctctgactgttga

SEQ ID NO: 1360 - DNA, 1182 bp, Glycine Max
atggtggttgcgagctgttggtgttcatcttcatcttcatggctgccactgtcattgccactgcattcgaacttgaaggcagcatcaacgtcactgtccccgaaatggaaatatcacgcattttctgaagcctcctcctcctcgtgttctctcgttcacaacaaccaagacgacgaccttcaagctctcttacagatccttccatctgatttgcatcacaatctcctcaatcaacctaaccgccctcaacttctagaggttattttggatttggggcgttttccagaagcgcgttatctaggaaaacacggaggccattctttaaggaacactgaggtaacagtgaaggagttggaatatgctgaacaagctgttggtgaatttgggaaggacaatagagctggcattgagggtacgttacaccgaatatctgcaattaggagtaggaatggtcacatagttggtttgacctgtcgagttgggagagctgtcactggccagattgatatggtttatgatctgcttcagtatgggaagagcattttatttgttggaaggcctggggttggcaaaactactgttatgcgagagattgctcgtgtactgtctgatgagcttcacaaaagagtggtgattgttgataccagcaatgaaattggaggtgatggcaatattccacatgcagcaataggtggtgcacgaagaatgcaggtgcctgagccatcaatgcaacatagagtgatgattgaggcagtagaaaatcacatgcctgaggtgattgtagtagatgagattggcacagaagctgaagctcatgcttgccgatcaattgccgagcgaggaatcatgcttattgggactgctcatggacagcagcttgaaaatatcatcaagaatcctacactgtctgatctgattggcggaatagaaagtgttactctgggagatgcagaagccagagccagaaattctcagaagacaattcttgagaggaaagcacctccaacatttgatttcttaattgagatgagagatagacactactggcttacacatcagactgacaaaagtgtagatatgttgcttcgaggaataagtccacaggttgaggtaagaaaaagagatgaaaaatgtaaggtcgtgatagaaaagtctaaagcatatgataaatgccaaatttga

SEQ ID NO: 1361 - DNA, 2895 bp, Glycine Max
atggttagcggcaacatttttcattgtagaaaaaattcgtggcctcctcaggagtatatcagtaaatccactttgcagctgtttgattatgatagttctgctcctcctgaacaagcttggagaagaagattgaacagccatgccaatcttcttaaagaatttagagtaacttttatggaagctataaaaatggttcgattaggtatacgcatttggtcatatgttagggaagaggcttctcatggaaggaaagcacctattgatcctttcactcgagaaagttgcaagccatctgcatctcaaggagtcccactcggagggatggggagtggcagcatatcaagaggatttagaggtgagttccgacaatggcaaattattcctagcttatgtgaagcgtcaccagtcatggccaatcagttctctatttttataagtagagagggaggaaacaaaaattttgcatcagttttggctcctggccagcatgaaggtttaggatctagcaggaaacctgatgatcagggcatatcatcatggggttggaatctaagtggccagcactcaacctaccacgctttgtttccaagagcttggacagtttatgatggtgagccagacccagaactaaaaatatcgtgtcggcagatatcaccattcgtaccacataattatagagaaagcagtctaccagctgctgtttttgtttatacgttggtgaacactggtaaggaaagagctaaagtcagccttttgtttacttgggcgaattccattggtggaagctcacacttgtcaggagatcatgtgaatgaaccattcaaagctgaagatggagtctccggtgtacttctatatcacaagcaaagttcagcttcccacacacccatttcctcttgcattgtgaattgggttggcaattttgaacaaatatttgctatttctacgaattttttttcttcttttgcccctatacttgtggggactttttctccatacaatatccatgatttggaaaagaaaggattaaaaagccctgcagcactcatttcactgttgttttgtgtgggtttatgtgttttaaaaaggacagcaaaaggaaaccctcctgttacttttgccattgctgcatgcgagacacagaatgttaatgtttctgttttgccaagttttgggttgtctgaaggaagtagcacaactgcaaaaggcatgtggagtaaaatggtgaaggatgggcaatttgaccaggagaatttcaattctggacctagcatgccctcatcgcctggagagacactatgtgctgctgttgcagcttccatgtgggttgagccccatggaaaatgcactgttgcatttagtcttgcatggtcgtctccaaaagtgaagtttgtgaaaggtagcactttcaacaggagatatacaaaattttatgggacttctgagaaagctgcggcagacttggcccatgatgcattgacacattacaatcggtgggaagaagagattgagaaatggcagaatcctattcttaaggatgagacactacctgaatggtacaaatttacattgtttaatgaactctactttcttgttgctggaggaacaatttggattgatgatgatgctgatgttggaaggttcttgtacttggaaggagtggaatatatcatgtggtgcacatatgatgtgcacttctatgcgtcatttgcccttcttgagctctttcctaagattgaattaaatatacagcgtgactttgctagagctgtcttgtgtgaagatggaagaaaagtaaagtttctggcagagggaaactggggcattcgcaaggtttatggagcagtgccacatgatttggggacacatgatccatggcatgaaatgaatgcctataacatccatgatactagcaagtggaaggacctgaacccaaaatttgttcttcaggtgtatcgagattttgctaccacaggtgatttggaatttggagtggatgtgtggcctgctgtccgtgctgcaatggagtacatggaacaatttgatagagatggggatggtcttattgagaatgatgggttccctgatcaaacatacgatacatggacagtccatggtgtgagcacttactgtggttgtctttggcttgctgctctacaagctgcagctgcaatggcccttgatttaggtgacagagaatttgcggaaaaatgcaaacggaagtttttgaaggctaagccagcatttgaagaaaaactgtggaatggtacgtattttaactatgacagtggatcaagtggtaacagtaaatccattcaagctgatcaattggctgggcaatggtatacagcgtcctcaggactgcccccactttttgaggattcaaaaatcaaaagtgctctccggaaggtttatgatttcaatgtaatgaaagttaaaggaggcagaatgggtgctgtaaatggcatgcatcccaacggtaaggtggacgagacctgtatgcagtctcgagaagtatggacaggtgtgacctatggtcttgctgctacaatgatacttgcgggaatggaagaagaggccttcgcaactgccgagggaatatttctagcaggctggtcagaagatggatatgggtactggtttcagacaccagaggcatggacaatggatgggcactacaggtcccttatgtatatgaggcccctagctatttggggcatgcaatatgcaataaatcggcccaaggcaattcttgaggcccctaaaataaatataatggacagaatccacttatctcctgttattggaggatactctcataatgaaacaggtgtgagaaagattacaacaaaagcaagatgctttaacaattctgtatttcattgtgcttgctga

SEQ ID NO: 1362 - DNA, 1710 bp, Glycine Max
atggttatggcttctttgattcagttttccccaactcccctctcctctgttcccatcactacccgtttcacccggacccacaagtctcgccttcgttgctccttagatgctaatgtttccgacatgagcgttaacgcgccaaaagggttgtttcctccggaaccagaacattatcgaggaccgaagctgaaagtggcaattattggagctggacttgcaggcatgtcaactgcagtggaactcttggatcaaggacacgaggtggatatatatgagtcaaggccttttattggtggcaaagttggttcttttgttgacaaaggtgggaatcacattgaaatgggattgcatgttttctttggttgctacaacaatcttttccgattgatgaagaaggtgggtgcggataacaatctacttgtaaaggatcacactcacacttttgttaacaaagggggtcaaattggagaactagattttcgcttcccaattggggcaccaatacacgggataagggcgtttttgtccacaaatcagcttaatacttatgataaggctagaaatgctgtggctcttgcactcagtccagttgtcaaagctcttgttgatccagatggtgcactgagggacataaggaatttggatagtattagcttttcagactggtttttatccaaaggtggcacacgcatgagtattacaaaaatgtgggatccagttgcctatgcccttgggtttattgactgtgataatatcagtgcccgctgcatgctcaccatatttgcattgtttgccacaaagaccgaggcttcccttttgcgaatgctgaagggttcaccagatgtttatctgagtggccccatccgaaagtacatcacagacagagggggcaggttccatcttaggtggggatgtagagaagtacttcatgacaaatctgctgatgggagtatttatgttacaggactttccatgtcaaaggctactgccaagaaaattgtgaaagctgatgcttatgtagctgcttgtgatgtccctggaattaagagattacttccatcaaagtggagggaacaggagtttttcaataacatatatgaactagttggagttcctgtagtcacagtgcaacttagatacaatggttgggttacagagttgcaggatctagaaaagtcaaggcgactggggaaagctgttgggttggataaccttctctatacacccgatgcagatttttcttgctttgcagaccttgcactttcatctccagaagattattacattgagggacaaggatcattgctccaatgtgttctgacgccaggagatccatacatgcccttaccaaatgacgaaattattgcaagggtagcaaaacaggttgcgctgttcccatcatctcaaggtttggaagtcacttggtcttctgttgttaaaattggtcaatctttgtaccgtgagggacctggtaaagatccatatagacctgatcaaaagacgccagtgaagaatttctttcttgctggatcttacacaaagcaggactacatagacagcatggaaggtgcaaccttgtctggcagacaagcttcggcctatatctgtgatgcaggggaaggattagtggcattgcggaagaagctcgatgatgagtttaaagacgacttaacaatatcaaatactaaagatgaattgagcctagtatga

SEQ ID NO: 1363 - DNA, 1713 bp, Glycine Max
atggttatggcttctttgattcagttttccccaactcccctctcctctgttcccatcactacccgtttcacccggacccacaagtctcgccttcgttgctccttagatgctaatgtttccgacatgagcgttaacgcgccaaaagggttgtttcctccggaaccagaacattatcgaggaccgaagctgaaagtggcaattattggagctggacttgcaggcatgtcaactgcagtggaactcttggatcaaggacacgaggtggatatatatgagtcaaggccttttattggtggcaaagttggttcttttgttgacaaaggtgggaatcacattgaaatgggattgcatgttttctttggttgctacaacaatcttttccgattgatgaagaaggtgggtgcggataacaatctacttgtaaaggatcacactcacacttttgttaacaaagggggtcaaattggagaactagattttcgcttcccaattggggcaccaatacacgggataagggcgtttttgtccacaaatcagcttaatacttatgataaggctagaaatgctgtggctcttgcactcagtccagttgtcaaagctcttgttgatccagatggtgcactgagggacataaggaatttggatagtattagcttttcagactggtttttatccaaaggtggcacacgcatgagtattacaaaaatgtgggatccagttgcctatgcccttgggtttattgactgtgataatatcagtgcccgctgcatgctcaccatatttgcattgtttgccacaaagaccgaggcttcccttttgcgaatgctgaagggttcaccagatgtttatctgagtggccccatccgaaagtacatcacagacagagggggcaggttccatcttaggtggggatgtagagaagtacttcatgacaaatctgctgatgggagtatttatgttacaggactttccatgtcaaaggctactgccaagaaaattgtgaaagctgatgcttatgtagctgcttgtgatgtccctggaattaagagattacttccatcaaagtggagggaacaggagtttttcaataacatatatgaactagttggagttcctgtagtcacagtgcaacttagatacaatggttgggttacagagttgcaggatctagaaaagtcaaggcgactggggaaagctgttgggttggataaccttctctatacacccgatgcagatttttcttgctttgcagaccttgcactttcatctccagaagattattacattgagggacaaggatcattgctccaatgtgttctgacgccaggagatccatacatgcccttaccaaatgacgaaattattgcaagggtagcaaaacaggttttagcgctgttcccatcatctcaaggtttggaagtcacttggtcttctgttgttaaaattggtcaatctttgtaccgtgagggacctggtaaagatccatatagacctgatcaaaagacgccagtgaagaatttctttcttgctggatcttacacaaagcaggactacatagacagcatggaaggtgcaaccttgtctggcagacaagcttcggcctatatctgtgatgcaggggaaggattagtggcattgcggaagaagctcgatgatgagtttaaagacgacttaacaatatcaaatactaaagatgaattgagcctagtatga

SEQ ID NO: 1364 - DNA, 888 bp, Glycine Max
atggttgagcaatcggtgctggcactggaaaagcagcaagggtcaaatccagtgttatcagaaggaatccacgattgggtgtttgagtgccatgggtttttgcacaatgcgggtttgatcatcgcttcctttctcttcctcttgtacttagcactgcaagctaaaaagagcttcctcaaactctcccatggccgctcttatatcattatttcctattacgcttccctctggcttgtcagcatcctcaatcttctttggtgcttttcccaggcgtgggagtgctctcctgggaaagagtttgcgtggaacttgttgtccctctttactacttctggaatgttgtttctagaagtgagcttgctggcttttttgcttcaaggaaatagtaccactggcttagaggcgttgacacgaacttttggtatatcagggattattgttggttttgatatcttgttgaaggcaatatatctgtttgcatttgggattccaattttcatcaacagtgattaccctactcctcacgtgaagtggaacttgtgggttgcccacaagctgttgcttacccttgtttatggtttcatattgttcatgtatcattctaggtggagagaaaggttacctgcaaggcctgcatactacaagtatgttactattatgctcatcttgaatgcaattgcactgtttgcttgtggtattacaggaaacggcactgcatttggtttctggttatatcatttcacggttgtatgttaccatgccgcttatcttcccctgctgtatataaccttcctggctgacttttttcaggaggaagatttgcatttggagaatgtgtactactctgaaatgaaagatgccggtttctttgaagcagattggaactga

SEQ ID NO: 1365 - DNA, 208 bp, Glycine Max
atggttgcaatgtttttaaacatggttggccatgcggaaggaaatatgaacgtccaagagaggtttcaagaccctaagaaactgccactagatcctttatttcataatagagcaattgatggtacacatatttcatgtgtgattactcctagtgagcaagatagatttactgaaataaaaggtattctaacacaaaaatattatagtt

SEQ ID NO: 1366 - DNA, 924 bp, Glycine Max
atggtttcagcttcgcttcaattctggtcttggatagcacctactcctatatcccaccgttacacccataaatttgcttccctaacctcactcaaattagccactcctgtttcttctactaataccgtttatcttcccaagcctctagttgtgcgttttgctctaactgagtccgactcgcccaaatccatagaacctgaccctcaaactcttctccaagaaattgctgacagttttgatcttccttccgattacttttcaaagcttcccggcgatcttcgattagacctaaacgacgcggcgttcgacctttcaaacggacctgttttagatgagtgtggccaagagttgggagagactttgctgaatctctctcgagcatgggaacttgctgacacatcaacctcccactctttagtgaaaaagctccctttgattgaggccaagctgacgggttatgccaaatcagcacttggaaagcgtttggtatctgccggaagaaggtttcaatcaatgggacagtatggccaaggtgagctgcaaaagattgcaaaagcaatgattgcagctggtagagttctgactgctagttcaacgtcagcagtgatagttgaagaacccaaagaggaagctagggtgctgaaatttggagaattgcaggttgaagtaaccccagataaggccaatattggggctgtaattgggtttctttttgggattctttgttggcaaatagcgcggggagttcaaaacgttcctgacagttcattgcagtatgcaaatgacaatgctttgctgcttgctaagtctttaaagggagcattgcttgctatattctactcctcaacgttcttgtctgcatttacctcggtgggacttgttctacttgggttacagctcaaatcaaagaaaaataaagattga

SEQ ID NO: 1367 - DNA, 1131 bp, Glycine Max
atggtttctgaggctgacctagaaaacgacgatcgatgttttttactgtacttcatcatgggaacctacttgggccccgacatcaaaggcgaagccaccaaaaaatcaatcttgcaaagagttgcggaggggcttcctccttacacattggagcaactaactcattcttgcatcgaagtggtggaattggagcgtgtctactattacattctcaggaacactgataaatcactcatcctcaacttaacctctttgcgccgtttcttccatggccaagcacagggtggagatggaaatggaaacaacaattaccctcaatttcctgagttgttccctcctgggtttcatcctcagtaccgcttaaaaaacaagcacaaagttattgataatgttgtgtttattaataaccctgatagcttctatattaggtctgaggatgttgagaggttcaagaggctgagtggtgtgcaggagttgcatgtggacagagatgttgccaggttgcaattgggtacttgttttgataacaacaatcgtgttccgagtaacagtaccatttcagaggggaaggttgagcctgatggtaatgttgagtcctgtggtggtgctggttcttctgagcttcaggatcgtgtgaatgttgttgcatccacgagtgacggcaccacgtgtcgtggtggcggtactaatgtgatgtatgatttcatggatactgaagatgatgagagtgatcctgataaggttgggccggctatgttgttccttccttcgcggccttctaagaaggaatggtctgatattgtggctgctaccaagaatggttttgcattgaccggaactgtggctatgggggggattgggccaaccatggggcttgtggacattggagagtgtgaagatgcgtacctgtttcgcttgtctcttccaggagtgaagagggatgaaagggaattcagctgtgaggttggcactgatggtaaagtgttgatatctggagtaactacaaccggagagaatactgtatcccggtactctcagctgcctggccctgttgatccacatcaattttcaggtaattttggcactgatgggattcttgaaggaattgtcatgaaagggaaatgtacatga

SEQ ID NO: 1368 - DNA, 849 bp, Glycine Max
atggttttctttctctatgtgcctattcttctttcactttctttctcgttccttctccatgtgtttaagaagcatattcacatttccttattggatcttgtcaccaccttcaactctaccaacataatgattgacaactacaagctttatcccaatcagattggttttattgaagatgttagtgaagggattgaagggtttatgacttgcaccaaaaatcttggtttccaaagcattgatattagtgataaaatcgatgataatgacaataataatgatgatgaggatgaagataattgttggaggaaaacaagggtgacagaaggtaaaggaaactttcctccaccactttcgtcgttgaatgggaatggacaacctagtttcattcttgtaccggtaaggaaaaatggaaggttacaactcagcaaagtaagaattaagaaaccaaaaattctctatgctacccgacaagatggacgattgaaattgttcctcgttccagatcaatgtgtaaaggataatgcacaagaagatgagaaagaacaagaacaagaactagtagatgacatggaggaacatacagaggaggaagaaggcatgatgatagtagaatcaatggaggaagaggaagaagaagatgatgatgaagtggttgaagagattacctattatgagcaaaaggattttaggattggagagtggaagtttcctaacgaaagatctaggaagtgtcatgaagttttgaatcatattcaaagccatcatcatcatcatggtcatgggagtcatcaccacctacatatgggacaacaattatatgatgaacctgtggtgatgatatataattag

SEQ ID NO: 1369 - DNA, 1641 bp, Glycine Max
atggtttttgaaatcagtactgttgtttcaaaattgcaaacgttatccacctcagaccatgcctccgtggtctccatgaacttatttgtggcacttctttgtggttgtattgtccttggccatcttcttgaggagaatcggtggatgaacgagtctatcactgctcttttgattggtgtttgcactggcatagtcattttgctgtttagtggtggcaaaagctcgcatattcttgttttcagtgaagatcttttctttatataccttctgccgcctataatatttaatgccgggtttcaggtgaaaaagaagcagttttttgttaacttcatgaccatcatgttgtttggtgctattggcacattaatatcttgtaccatcataactttgggtgccacacaaatttttaagaggttggatgttggtccactggaattaggggatttcctagcaattggtgcaatatttgctgcaacggattctgtttgcacattgcaggtgctaaatcaggatgagacacctttgctgtacagtcttgtatttggggagggtgttgtgaatgatgctacatcagtggtgcttttcaatgcaatccaaagctttgacctcaaccaaatcgacccttcaattgctgggcactttttgggaaatttcttgtatctatttattgcaagcacaatgcttggagtgttgacaggtctacttagtgcttacattattaaaaagctgtacattggcaggcactctacagatcgcgaggttgctcttatgatgttaatggcatacctctcctacatgcttgctgaattgtcctatctgagtggcattctcactgtattcttttgtgggattgtcatgtctcattatacctggcataatgtgactgagagttcaagaatcactaccaagcattcttttgcaaccttgtcttttgttgctgagatctttatcttcctttatgttggtatggatgccttggacattgaaaaatggaaatttgtcagtgatagccctggaacatctgtagcaactagttcagtattgttgggtctaattcttcttggaagagcagcttttgttttccccttatccttcctatccaacttggctaaaaaatcaccaaatgagaaaatcagcttcagacagcaagttatcatttggtgggctggtcttatgagaggtgctgtttcaatcgcacttgcatataatcagttcaccatgtcggggcacacttcactaagaagcaatgcaatcatgatcacaagcaccatcactgttgtgcttttcagcacagtggtgtttggtctgttgactaagccactaataaggcttttactgccccatactccacatcataaagaatcaagcatcacgataaccacagatccatctactccaagtccaaaatcagtcactgtcccacttcttgggagtgcccaagaatctgaagtcgatattgatggccatgatattcatcgtccaagcagcatccgtgctttactttccactccaacacacactgttcatcgcttgtggcgtaagtttgatgatgcattcatgcgtcctgtttttggtggcaggggttttgttcctatagaacctggctcaccaactgaacgtaatggccatcaatggcgttga

SEQ ID NO: 1370 - DNA, 1728 bp, Glycine Max
atgtaccgctttgcaacctccctcgcctccaaagctagaattgccaggagcagcactcaacagattggaagtagggtcacttggaacaggaattatgcggccaaagacattaagtttggtgtggaggctcgggctctgatgcttaagggtgtcgaagagctcgctgatgccgttaaagtaacaatgggccctaaggggcgtaatgtggttattgagcaaagttttggagcacctaaagtgacgaaagatggagtaaccgttgctaagagcattgaattcaaggacaaagtcaagaatatcggtgccagtcttgtaaagcaggttgctaatgctactaatgacgtggctggtgatggaaccacttgtgctacaattcttactaaagcaatatttacggaaggatgtaaatcagttgcagctggaatgaatgcgatggacctgagacgaggtataaatatggctgttgatgctgtggtgacaaatctgaaaagcagagcacgtatgattagcacttctgaagaaattgcccaggttggaacaatatctgccaatggggagagggaaattggtgagttaattgcaaaagctatggagaaagttggcaaagagggtgtcatcacaatctcagatggcaagacattgtacaatgagttggaagtcgttgaaggaatgaagctcgacaggggatacatttctccatatttcataacaaaccagaagaaccagaaatgtgaacttgaggatcctctcattataatccatgaaaagaaaatctcaagcataaatgctatcgttaaagtattagagttagctttgaagagacaaagatctttattgattgtcgccgaggatgtggaaagtgatgcccttgcaactcttattctaaataaacttcgtgctggaatcaaggtatgtgccatcaaagctcctggttttggtgaaaaccgtaaatctggtctccaggatcttgctgttcttacaggaggtcaacttatcaccgaagagcttggtttgaatcttgaaaaagtagacctggacttatttggctcttgcaagaagataacaatttctaaagatgacactgtcatccttgatggagctggtgataagaaagcaattgaggaaagatgtgagcagattagatcagcaattgaaaatagcacttcagattatgacaaggaaaagttacaggaaagattagccaagctttctgggggtgttgcagtactgaagattggaggagccagtgaggctgaagttggtgagaagaaggatagagtgacagatgccttaaatgcaaccaaggcagctgtagaggagggcatagtacctggtggtggtgttgctcttctttatgcatcgagtgagttggataagcttcaaactgccaactttgatcaaaagataggtgtccagatcatccaaaatgctttgaagactcctgtgcacacaattgcttcaaatgcaggagttgagggtgctgttgttgttggcaaactattggaacagaatgatcctgatcttggatatgatgcagccaaaggtgaatatgttgatatggttaaaactggaattattgatccattgaaggttattaggaccgccttggttgatgcagccagtgtgtcatctttgatgacaacaactgaagctgttgtgtctgaactcccgaaggacgataaagatgttcctgccatgggtggtggcatgggtggcatggattattaa

SEQ ID NO: 1371 - DNA, 453 bp, Glycine Max
atgtacctagctgcaatagctgattctcaaccccaaccatctccaatgcctggtcagtatccttctagtggacttatgcagcagggagcacactacatgcaggctcagcaggctcagcagatgtcacaacaacagctaatggcttcgcgctcctcactcttgtactcccaacagcctttctcagtgcttcaacagcagcaaggcatgcacagccaacttggcatgagctccaatggaagtcaaggcctccacatgttgcaaactgaagccactaatgttggaggcaatgcaaccataggaaccggaggaaggtttcccgactttgtacgcattgctagtggcaagcaagatattggaagttctggtgaaggccgaggaggaagctctagtggccattctggtgatggtggtgaaacccttaattacctgaaagctgctggtgatggaaactga

SEQ ID NO: 1372 - DNA, 1587 bp, Glycine Max
atgtattttacaacaaatttttcagacagttctattgggaaagttttcaagttcacacatgttctggctgcctccttcgccggtttagttgccgccgccgccgcctcaagctaccggcgggcaccgtccacggtggtgggagagcagaagaaggttattcccgagctacgtaggacggaatctgggcgtctcggggagatcgaaaagttctcccactatgttgcaaggcaaatggggtttgaagatgctgatgaggttccagagctatgcatattggcccaagagtatttgaaaaaatccaaagggtgcgatgaaagcatctttgaatatatttccagtggcaatgtggagaacactgattctctatatgcgaaattagttgaggagttagagagatgcatcctcagttatttagcatttcactggaaccaagctacatctgtcattagtcaggttttgggtgtggagtctcagcagaaaaaaaagctgaagggaattctattggcagctacaagggaacagaggtttgatagagtaaccaagaatctgaaagtgacaagagtgatctctactttggtggaagagatgaaagcaataaatggtgactcgcaatgtacagaagtgatggtgcccatggcccacagtgagaggagtccagtcctgctgttcatggggggtggcatgggagctggaaagagcactgttcttaaagacattcttaaagaatcattttggtcaggagcagcttcaaatgctgtggtggttgaggcagatgctttcaaggagagtgacgtcatatatagagcccttagctccagaggtcaccatgatgacatgctccaaactgctgaattggtgcatcaatcttccactgatgctgcatcatctctgctggtgacagctctaaatgagggtcgagatgtgatcatggatggtaccttatcatgggaaccatttgtggagcaaactattgctatggcaagaaatgttcacaaacacaggtaccgaatgggggtagggtataaagtagctgaagatgggacaattactgaaaattactgggagcaagtaaatgatgcagaagagcatcaatcagaggaaatttctaatggagaagcacacacccaaaagccttacagaattgagctagttggtgtggtttgtgatggctatcttgctgttgttagaggcattaggagagctattatgacagggagggcagtgagagtgaattcacaactgaaatctcacaaaagatttgctaatgcatttccaagatattgcaaacttgttgataatgccagactctattgcacaaatgctgttggtggtccaccaaagcttatagggcggaaggatggtgatcacaatctactagtggatcgtgaagagatcaagtgcttggaaacgttaggcagtttgaatgctggagctgattccatctacgaacttcacaaagaacccagccccataatggaacctggttctgtttggaatgatatagttatgtcaccttcaaggccaagtgatcaaaaagaattgaaggaatctattcagaaaatagagaaatccatccgaaaaatgtaa

SEQ ID NO: 1373 - DNA, 282 bp, Glycine Max
atgtcaaatcctcaaacaaacaataaccgccgccagcccagccgcctgcagcggcgagccccctcctccctgcaaataaaccgcgccgtcgagtggaacgtcgccatccccctcctctcgccgttggcatcatctccgacgccgatcgagctaaaaccgccgcaagagccgccgcagagggagccggagaaggtcaccttgtcgttcaagaagtggcagcatcctgcggctcccttctgttacgagcccgctccaatggtgccgccctttgttcctgtgtag

SEQ ID NO: 1374 - DNA, 231 bp, Glycine Max
atgtcaatttcaagaactcaaatggggtgtctcttggtgctcatactagtattattaagcagttcttgtttaaaccatggagcattaggtgctagatatgggaaaaaagtggagcatacacacaagtttagagtatggtggaaaagctttagccatgaaacagctcgaggctcttataagacagttaatagagaagtaccttcctctcctgaccccttacacaacaggtag

SEQ ID NO: 1375 - DNA, 1635 bp, Glycine Max
atgtcactgtccaatggagatgattcaactgtcacttccaagcagcaaaaacctcagcttccgaacccttttgatctcactgactctgagatccttgagaaagtttatctgacccacctccatgatgatgacaggtgcgatgtagaagtcctttcggacattgtgtcaactgttgtacttaagacgaggttagctgaaggcaaagcatatcagaccgttttccaaccagaatatcgtacaatgaagctgatttcttgtcagcacctgagaagctactcgtgggaggcaaaagcactggtaactctagctgcttttgctttggagtatgggaaccttttgcacctgagtgatgttgcaacgccagagaagcaactcacaaactcgttgaaacaactgaaccaagttgaagctagaaagaagcctgccaccactttggtggagttggtaatggaagtgcttcatggcatccaagagtggacaagattatcaggtcttgattatgacatagtggaagtgccttccttgacagaagcccagcaagaggtccctgttgttgtgtattggataattgcttcccttgttgctgccaccgccaacctcgttggtctatcgttatgtctatttgttgcaggttatgcagatgaatactacaagcgcaggaatgcaatttctaaacccaaagatatagtagaattcttgaagcttctgatccatcacaatggatcaaaggttcaaatatatcacggcagcatcaaaaccaaaactgttatcttcagccagaaatatgtcttgttgttcatttcaagcctcgacaagattgaagatgagatctcacttttgaactcaatccatgacagattgcatgagaatccaaatgaagtagtaaaaaattacaagaaaggggatttcaagattttgtggatccccattgtggatgcctgggacgtacaggcaaaaacacaattcttcactgaattgccaggcactgacctgataaaagagaaattcaactacttgggaaaacctattatcccagtgctcacccctcttggtgacataatgaatgaagatgcaatgaacttgatttttcaatggggtatcgaagcgttcccctttaggaaaattgatggcattgagcttactctaaaatggaaatggttctgggacgcaacaaagaaagcaaatcttggaatacagcaggagattgatacgaggaaattatctgtgttggcagtggagaaaacaaaagggcatgcaactatcttgaacactgatacaataatagatcactatcagttggggaaggaagaccccacggatattgtgaagaccttgctttgcctcaaacaagatcaacaaggatgggctattctcaccaaaggctctaacgttagggttttgggtcacggtgaaccaatgcgccaaactttggctgagtttgacacatggaaagagaaagtgtttcaaaaagaagggtttgacgtagcctttgatgagtactataagactaagcttgatgagttatatgctcgccaagaatcatgcccaaatcccacatgtggacgtgtgatggaggtgacatctgttaattacaagtgttgccatcgtgatgctacgaacaatatgaaagcctga

SEQ ID NO: 1376 - DNA, 138 bp, Glycine Max
atgtcagctaggttgcagggtttaagttatgcttttatgattcctgtagagcttaataaattagttcagtctctacataggtggatcaataaggatcaaacttttgatattatattaaactcagtctttaagattgag

SEQ ID NO: 1377 - DNA, 669 bp, Glycine Max
atgtccaaaaggctcttgcatgagaggcatgttaaggatgttactcaaatgaagcaggagcatgacaagaggcaagcaagcctcatagctgaacacaacgaacagctaaagcatacccaactgcaagctgaaaaggaattgagagagaaaacaatgtttatgaggaatgatcatgaagctcagatcaaagcattgaggtgtgaacttgaagatgagtgtcggaagctggaagaggagttgcatcttcaaaaatccaaagaagacaggcaaagggctttgttgcagttgcagttgaaagtgatgagtgacaagcccaaagaggaccaagaagtgaattcaaaacagtttggtttgacatattacatttatcatttggtaggcatagttggggaaatgagaagacatttcttacccactggttcacatatgcattgccttcatgctaaaattgtcacttatgaaacaagcataatcttacattggtttggttgtgatttggtatctgttactttaatcattcttcttttcaagctccttactatcttaaagatgaacactatagaaagtaactacacttactatttagtgggttcagtgagtgcaaatttaatcaacctttgtaatgaatttcaattgaatttgaaaattagcataatgattttcatatga

SEQ ID NO: 1378 - DNA, 2103 bp, Glycine Max
atgtccaaacctcaaaatgatccccttgtgcaatcggaaacaacttgtggaacacttctctatgaacttcagataatatgggatgaagtaggggagtctgagtctgacagagatagaatgctgtttgagcttgaacaagagtgtctagaagtatacagaaggaaggtagatctggcaaatcggtctagagctcaattaaggcaggcaattgctgattgtgaggcagaacttgcagccatttgttcatcaatgggagagagaccagtgcatattcgacagactgatcaaaatgctggaagcctgaaggaagaacatgcaagaattcttccacagttggaggagatgcaaaaaaggaaaattgagcgtagaaatcaatttatagaaattcaagagcagattcaaagcatttcaattgaaatatatggtcctagagagtatattcctgctgtcgaagatgaaactgatttatccttgagaaaacttgaagaattgcacaggcagctacatgcacttcagattgagaagagtagtcgcttaaagcaggtccaggagcacctgtgtacattaaattctctttgtttagtgcttggttttgactttaagcagacaattaatggaattcatcccagtttagtggactcaaaaggatctaagagtgtaagtaatgataccattcagcaattagctgttgctatacaagaactgcgggaagttaaattacagagaatgcagaagctccaagatcttgcgactacaatgttggagctctggaacttgatggatacccctattgaagagcaacagatgtttcagaatgttacatgtaatatagctgcttcagaacatgaagtaactgaaccaaacaccttgtccgtggacttcatcaatttggttgaggtggaagtagctaggttagaagcgttaaaatcaagcaagatgaaagagcttgtattaaagaaaagaacagaactggaggagatttgtcgaaagactcatttgatcccagaaatagataatgcagtggaatctgctgttgaggccatagaatctggatctgtggaccctgctttcgtgcttgaacaaattgaacttcagatttcccaagtcaaagaggaagctttgggcagaaaagagatacttgaaaaggttgagaaatggttggcagcgtgcgatgaagagtcttggcttgaggagtacaacagggatgataatcgctacaatgctgggagaggtgctcatcttactctcaagcgagctgagaaagctcgtgccttggttaacaaaattccagcaatggtagatggtctgacttcaaaaactatttcatgggagaaggaaaaaggcattgagttcacatatgatggtattcgtctactttctatggttgaagaatacaatatattacggcaagagaaagaacaagaacgtcgtaggcagcgggatctgaagaaactccagggacaaatgatagctgaacaggaggcactatatgggtcaaaaccaagcccttcaaagccccaaagtgttaaaaagggacctaggatgtcgaccggaggaggtgcagctagtagaagagtctctctgggaggagcaatgcttcaaactcctaaaccggattcaaaatctactcactcacctagaagagggctggatattgctggcgctcctgttaaaaagcactcatttggtgctgggactcaaatcatagaatctcctctgatacgacaacctttttctcccatctcttctaacagtgtatcttcaaaagctaatgtggcaaatgctacagatgaactgagtaaacagaatgagaagttgcagagaacagtgtcgcttaacaatgggccatttactactccctccaagacagttcctactgtggtagatgaagagaataggactccaaatattcctgccccagctaccccttcgacagtatcagttccaatgaatatggccatgactccagttccttcttcaattttgaagaacgtaagcttgaattcaactcccatatcagttccttatggaaataatgacttggttcaggaggttgaatattcattcgaggaaaaaaggctcagttactatatgttagcgtga

SEQ ID NO: 1379 - DNA, 570 bp, Glycine Max
atgtccaccgcagcgcagcccaaggccaagaaaacggcgtcgtccaagaagcccctctcccatcctaccttcgccatgatagcggaggcgatagcgagtctgaaggagagaaccggttcgagccaatacgcgataaccaaattcatcgaaggcaagcacaaggagttgcctccaacctacaagaagcttgttctcgttcatctcaagaagtctgttgctgctggcaagctcgttaaggtcaaaaactctttcaagctcgcaccgactaagtctgctcctgttaaagccgctgctgctcccaagaagcccaccaaagctgcggctaagcccgccgccaagcccgcttccaagcccaaagctgctgcacctaagaagaaggctgttgccaagcccaaggccaaagctgcggccaccaagcccaaggccaagcccgctaaggccgcgccgaagaaggtcgccgctaagcctgcgaagaagactcccgtaaaggccgtgaagaagcccaagagcgtcgtgaagaaacctaaaagcgtgaaatctccagcgaaaaaggccaaggctaagaagtga

SEQ ID NO: 1380 - DNA, 573 bp, Glycine Max
atgtccaccgcagcgcagcccaaggccaagaaaacggcgtcgtccaagaagcccctctcccatcctaccttcgccgtgatgatagcggaggcgatagcgagtctgaaggagagaaccggttcgagccaatacgcgataaccaaattcatcgaaggcaagcacaaggagttgcctccaacctacaagaagcttgttctcgttcatctcaagaagtctgttgctgctggcaagctcgttaaggtcaaaaactctttcaagctcgcaccgactaagtctgctcctgttaaagccgctgctgctcccaagaagcccaccaaagctgcggctaagcccgccgccaagcccgcttccaagcccaaagctgctgcacctaagaagaaggctgttgccaagcccaaggccaaagctgcggccaccaagcccaaggccaagcccgctaaggccgcgccgaagaaggtcgccgctaagcctgcgaagaagactcccgtaaaggccgtgaagaagcccaagagcgtcgtgaagaaacctaaaagcgtgaaatctccagcgaaaaaggccaaggctaagaagtga

SEQ ID NO: 1381 - DNA, 579 bp, Glycine Max
atgtcccacattcccaccgccggctacggcaccctcgccggcgccactcccactcccactcccaccggaattactccatccaccgccgccacctcctcggtgactccccgtccatggcgcgagtttctagacctatcagccctctcccgcccctactcctacgacgacgccatgatccgagtccgaagaaacctgagctacttccgcttcaactacgccgccgtcacgctcctcatcgtcttcctcagcctcctctggcaccctatctccatgatcgtcttcctcctcgtcctcgtcgcctggtactacttctacttctcccgcgacgtccccctcgtcgttttcaaccaaaccctcgacgacagaaccgtgctctgcgttttgggattgctcactgtcgtttcgctcgtctccactcacgtcggcctcaacgtcctgctctcgttaatcgtctcggtggttctcgttggcttgcacgctgcgtttagggttaccgaggatttgtttcttgacgaggaaagttcgttgctttccgttgtggggactcagcctatcagaacaaattatacccccatttga

SEQ ID NO: 1382 - DNA, 210 bp, Glycine Max
atgtcccagtgcaaaggtaagaggtcatggcctgagctggttggagtgaaaggaacggtggcagaggctacaattgagagagagaattctttggtgaatgctatcgttgtgcctcaaggatcaggcgtcaccgctgatttccgctgtgatagggtttgggtttgggtcaatgaaaatggatttgttttccaggttccaacaattggataa

SEQ ID NO: 1383 - DNA, 2664 bp, Glycine Max
atgtcctcactcatcttaccttacacttacacttacggttacgcccgcttccccttcaaactgaaccggttttctccccgaaccgtgacggttcgcgcggcggtttcatctccggacaaacgaggcagaaagaaaaagcaagcaaaggatgacgatagcgcggtcgagaacggcctccggttcagtttcatggaggagctcatggaccgggccaggaaccgcgactctaacggcgtctcggaagttatgtacgacatgatcgccgccggcctcagccccggtcctcgctcgtttcatggcttggtggtgtcgcacgccctcaacggcgacgaagaagccgcgatggaatcgttgagaagagagttggctgcagggcttcgaccggttcacgagactttcttggcattgataaggttatttgggtctaaaggtcgcgccactagaggtcttgaaatacttgcagctatggaaaagctaaattatgatattcgccaagcttggcttattcttattgaggaacttgtttggaacaagcatttggaagatgccaacgaagtgttcttgaagggtgccaagggtggccttaaagctactgatgaggtttatgatcttctgatcgaggaagactgcaaagcaggggaccattctaatgcgttagacattgcctatgagatggaggcggctggccgaatggcaaccacatttcatttcaattgcctcctcagtgtgcaggctacctgcggaatacctgaaatagcttttgcaacatttgagaacatggaatatggagaagattacatgaagcctgatacagagacatacaattgggttattcaagcttatactagagctgaatcttatgacagagtacaagatgttgctgagttacttggcatgatggttgaggatcacaaacgtatacagccaaatgcgaagacccatgcgctgttggtggagtgttttaccaagtactgtgtggtacgggaagctattaggcattttcgtgcccttaaaaactttgaaggaggtataaaagttctacataatgaagggaaccatggagatccactttctttgtaccttcgggcattatgtcgggaaggaagaattgttgaaatgcttgaagctttagaagctatggccaaagacaaccagccaatcccctcgcgggcaatgattttgagcagaaaataccggacattagtgagctcatggattgaaccattacaagaggaggctgaacttggctatgagattgattatatttctagatatattgacgagggtggcctaactggggagcgtaagcggtgggtgcctcgaagaggtaaaacacctctagatcctgatgctcatggatttatatattcaaacccaatggagacctccttcaaacaaagatgcctggaggagttgaagttgcacaataaaaagcttctgaagaccttgcagaatgaagggcttgcagctttaggggatggtgtatctgaatctgattatattagagtgcaggaaaggctaaaaaagctcataaaggggcctgaacagaatgttttaaagcctaaggcagctagtaaaatgctcgtgtctgaactgaaggaagaactagatgcacaaggcttgcctattgatggaaatagaaatgttctttaccagcgtgtacagaaagcaaggagaataaatcgatctcgtggtaggcccctttgggttcctcccgtggaagaggaggaagaagaggtggatgaagagctggatgcattaatttcacatataaagctggaggaaggaaatacagagttctggaaacgtcgctttttaggagaaggcttaaatggtgatcaagaaatgccaacagatgcagctgaatcagaggtccctgaagttctggatgacgttgatgctatagaagatgctgcaaaagaggttgaagatgatgaagcggatgatgatgaggaggaagcagagcaggcagaagaggaagtagaaccagcagagaaccaagatgtaaacaggataaaggagaaagaagttgaagctaaaaggcctcttcaaatgattggggtccagttgttgaaagatattgatcaacctactgccacatcgaaaaagtttaaaagatctcgcaaagtgcaggttgaggatgatgatgatgatgattggcttccgctggacctatttgaggcatttgaggaaatgaggaagcggaaaatatttgatgtgtcagacatgtatacattagcagatgcttggggatggacatgggagagagaactgaagaagaaacctcctcgtagatggtcacaggaatgggaagttgagttggcaatcaaagttatgcagaaggtcatagaattgggagggagaccaacaataggagattgtgccatgatattgcgtgcagctataagggcacctctaccttcagctttcttgacaattttgcaaaccactcatagtcttggctttaagtttgggagtcctctttatgatgagatcatctctctctgcgttgatcttggggaactagatgcagctgttgctgttgttgccgatttggaaaccacagggatctcggtttcagacctgactttggatagggtgatttctgcgaaacagaggattgacaatacctccaatggtgtcattacggatgcaggattgtaa

SEQ ID NO: 1384 - DNA, 1557 bp, Glycine Max
atgtcgaggggatctgatggatcacaaaaaaagcgtttagttgctgcgatctgtgttgtggcaatttttcttggttttctgtatgtgtatggcggatccatctttggttctcagaatagtggttcatctgctcttgaatatggcagatcattgaaaagacttggctcgtcatatttgggtgcagaggatgacactgatggcaagcaagatgaatcttcatcaagtttcagacagggagatggggaggataatattgttcctaagagtttccctgtttgtgatgatcgtcattcagagttgattccctgcttagatagacaccttatctatcaaatgaggatgaagctggacctgtctgtgatggagcactatgaaagacattgtcctcctgcggaaaggcggtacaattgcttgattcctcctccatcaggatacaaggttcctattaagtggccacaaagcagagatgaggtgtggaaagcaaatatcccacatactcaccttgcacacgagaagtctgaccagaattggatgactgtaaaagctgaaaaaatagtgtttcctggaggcgggactcattttcattatggagctgacaagtacatagcatcaattgcaaatatgcttaacttttcaaacaataatctaaacaatgaaggaaggttgcggacagtgcttgatgttggttgtggtgttgcaagttttggagcatatcttctatcatctgatatcattgcaatgtccttggcaccaaatgatgtgcatcagaatcaaattcaatttgctctagaaagaggaattcccgcatatcttggtgtcctgggaactaagagactcccttacccaagcagatcttttgagctcgctcattgttctcgttgtcgaattgattggcttcaaagagatggaattctacttcttgaactagaccggttgctcaggccaggaggttattttgcatactcatctcctgaagcatatgctcaggatgaagaggatctaaggatatggaaagaaatgagtgaccttgtggggcgtatgtgttggaaaatagctgcaaagaggaaccaaactgttgtctggcaaaaacctccgacaaatgactgctatatggaaagagaacctggtagtcgccctcctctttgccagtctgatgatgacccagatgcaatttggggagtaaatatggaagcatgcataacaccttacagtgatcatgacaacagagccaagggtagtggattagctccatggcctgcaagattgactagtcctcctcctagattagctgactttggctattcgagtgacatgtttgaaaaggacatggaactatggcaaaggagagttgagaagtactgggatctcttgagttcaaaaatcacatcaaacacattgaggaatattatggatatgaaagcaaacatgggttcatttgcagctgctcttagagacaaggatgtttgggtgatgaatgttgtacctcaagatggaccaaacacacttaagctcatatatgacagaggcctcattggaactactcatgactggtattga

SEQ ID NO: 1385 - DNA, 1863 bp, Glycine Max
atgtcgaggggatctgatggatcacaaaaaaagcgtttagttgctgcgatctgtgttgtggcaatttttcttggttttctgtatgtgtatggcggatccatctttggttctcagaatagtggttcatctgctcttgaatatggcagatcattgaaaagacttggctcgtcatatttgggtgcagaggatgacactgatggcaagcaagatgaatcttcatcaagtttcagacagggagatggggaggataatattgttcctaagagtttccctgtttgtgatgatcgtcattcagagttgattccctgcttagatagacaccttatctatcaaatgaggatgaagctggacctgtctgtgatggagcactatgaaagacattgtcctcctgcggaaaggcggtacaattgcttgattcctcctccatcaggatacaaggttcctattaagtggccacaaagcagagatgaggtgtggaaagcaaatatcccacatactcaccttgcacacgagaagtctgaccagaattggatgactgtaaaagctgaaaaaatagtgtttcctggaggcgggactcattttcattatggagctgacaagtacatagcatcaattgcaaatatgcttaacttttcaaacaataatctaaacaatgaaggaaggttgcggacagtgcttgatgttggttgtggtgttgcaagttttggagcatatcttctatcatctgatatcattgcaatgtccttggcaccaaatgatgtgcatcagaatcaaattcaatttgctctagaaagaggaattcccgcatatcttggtgtcctgggaactaagagactcccttacccaagcagatcttttgagctcgctcattgttctcgttgtcgaattgattggcttcaaagagatggaattctacttcttgaactagaccggttgctcaggccaggaggttattttgcatactcatctcctgaagcatatgctcaggatgaagaggatctaaggatatggaaagaaatgagtgaccttgtggggcgtatgtgttggaaaatagctgcaaagaggaaccaaactgttgtctggcaaaaacctccgacaaatgactgctatatggaaagagaacctggtagtcgccctcctctttgccagtctgatgatgacccagatgcaatttggggagtaaatatggaagcatgcataacaccttacagtgatcatgacaacagagccaagggtagtggattagctccatggcctgcaagattgactagtcctcctcctagattagctgactttggctattcgagtgacatgtttgaaaaggacatggaactatggcaaaggagagttgagaagtactgggatctcttgagttcaaaaatcacatcaaacacattgaggaatattatggatatgaaagcaaacatgggttcatttgcagctgctcttagagacaaggatgtttgggtgatgaatgttgtacctcaagatggaccaaacacacttaagctcatatatgacagaggcctcattggaactactcatgactggtgtgaagcattttcgacatacccccggacatacgatttacttcatgcatggactgtcctctctgacatagaacagaaaggttgcagtccagaggatctattaattgagatggatcgcatgcttcgacctactggtttcgtgatcatccgagataaacagccagtgattgattttataaagaagtacctaagtgctttgcactgggaagcaattgattccagttctgactctgtccaagatggtgacgaagttgtttttatcatccagaagaaaatgtggctgactagtgaaagctttagggacacagaatag

SEQ ID NO: 1386 - DNA, 1863 bp, Glycine Max; identical to SEQ ID NO: 1385

SEQ ID NO: 1387 - DNA, 1863 bp, Glycine Max; identical to SEQ ID NO: 1385

SEQ ID NO: 1388 - DNA, 1017 bp, Glycine Max
atgtcgtcaactcttctcccagtgacagcaactcccattttcactctcaccaaaaccctccctctccccaaaccctacctactctcctataaattcaaattcaacaccctccgctggctccgcgaagagcagcgctggctccgcgacgaacaccgctggctccgtgaggagcagcgctgggctcgcgagcgcgaccaactcctccgcgagatcgccgacctcaagctccaaatccaggcgctggagcgtcgcctcttgacgcgcgatttgtcctctccggcttccatctccgacgccgtcgccaatgtcacgttgctcttgcaggtgctcaaggacaagaatctggttctcgagagcggttcgagcctgcggaacacggaggaggtgaagcaattggaagaggtcgtcgaacatgtgaaggaggttgtggtggttgaggaatctgctagggttgaaaagaggatctcgttgcggataggttccgaaggtgaagaggttcgacagatgcaggaagcattgttgaaattggggttttactctggcgaggaagacatggagtattccagcttctcaagtggaaccgagcgtgctgtgaagacttggcaagctgcattaggtgctcctgaggatggtatcatgacagctgaacttcttgaaaggttgtatttggagataaggaataaggacaccggcagtgcgactcaagacaaacaatctactactgttttgccaaaggaagttgaaaatggagctgcagttgcttcagtggcagaaaattcagagggtcagcaaaaagatgtgaaaagtgataagggaacagaagtctcccaccggggagtttttctccttggagagaatcggtgggaagaaccatcaagacttttcacaaggaatggagttgataggagcaagaacaaggatgtaacgacaaaatgccttcaatgtcgtggggaaggtcgcttgctgtgtacagtttttggaatgggtggacgagggtacaaaatgcccatattgtga

SEQ ID NO: 1389 - DNA, 1017 bp, Glycine Max; identical to SEQ ID NO: 1388

SEQ ID NO: 1390 - DNA, 1764 bp, Glycine Max
atgtcgtcgcggcaagtggtgaagcgtgccaaatacaaaaccactgtcaaagaccctggcacccccggcgtcctcaaattgactcaagataagttcgttttcaagccgaatgatcctacctcgaaaaccaagctcgatgtggagttcagatttattcagggtcataaagtcactaaagagggatcaaagaaaccagcatggcttaatcttatccattcacagggaagttacatctttgagttagaaacttttgcagatcttcatgtttgccgggaattggtgggtgttgcccttaacaagcaagtgcctggagaagctacaaaagttatttctgaggaacagctgagccctgctgaaatggcactgaagataaagctattgcaggaagatagcaagttgcagaggcttcataaggaacttgtggctagtggtaagcttacagaatcagaattttgggctacaaagaagaaaatgctggatcaagatgaaagcagaaagttaaaacaacagattggttttaaaaattctttgatctttgacacaaagcctatgagtgatggacggataaaccaggttaaatttcagttgacgccagagataaaatatcagatttttgccctcaaacctgccgtccaccaggcattcctgaattttgtacctaggaaaatgaatgaggtagatttctggaataaatacttcaaagctgagtatctccatagcaccaaaaatgctgttgcagcagctgctgaggctgctgaagatgaggatcttgctgtttttctgaaagatgatgagatattggaaattgaagctcgaaagaaggttcgacgggttgatccaactttagacatggaagcagaccaaggagatgattacacacatcttcctgatcatgggattttccgagacggtagcaaggatatatctgaagcccaaaattctttgtataagagaacattgttgcaagatcttaatagacaaggtgcagttgttcttgaaggaaaaactttagatatggagatggaacacccaagaacagtagcagaaattcttgctcggagaaaacaggaatgtgatggggttgtagatgaggagagacaaaacagaatttctaagatgaccctgattgatgatcttcaggcacaagataatcatccgtatgcaccactctgtatcaaggatcctcgtgactattttgatttccaacaagctaatgctgtaaaaactttggatgattctcaaactggaatggagcaaatgaaatgcagtttgggttctgaggaagcctatggctctttgagggcatcaatatctaaaataaaaactacaggattaagggatcctctctttagtcctgatgttgctcttaaggtccttaacggattgactaaaaatatctcaagtcccaaatatcatcttgggagaagttctcaaggtagtgtccttgatatattgcccaatacaactaaggagacactactagatcattgggtgtgcagtcaggaattgctgaggcacttttggtcttcatatccaattacaacacagaaccttgttaataagacacgaagactgaaagaatccatatcacaaatatattctaaacttgaggacataaaggtatctgctgagtcagacctgcgacaccatgtttcccttgttgtccatcctatgcagcaggctctgaatgctgccttgttacactatgaggctgacattaggaaaagaaatgcaagaggacagaagcctaacggttatgtttag

SEQ ID NO: 1391 - DNA, 1743 bp, Glycine Max
atgtctcaaatcttggcaccgttccagttactggaactgaacgtgatttccgcccaggacctggctcctctgggtcgcaacatgcgtacctacgctgtctcctgggttcacccggaccggaagctctccacacgcgtcgactctgagggccacaccaacccaacttggaatgacaagttcgtcttccgcgtcgacgaagagtttctctactccgacacctccgccatcatgatcgagatctacgcgcttcattggttcaaggacatccacgtcggcaccgtccgcgtcctcgtcggaaacctcgcccctcctccctccaaacccttccacaacaaccgcactccgctcggcatgcgcttcatcgccctccaggttcgccgcccctccggcaggccacaggggattctaaacattggcttcaccgtcctcgacagctccatgcgcagcatgccgctctacactcacaacgcctcggccgtcggctaccgccacctcatgggtgagaaggacgcttacgacagccacaaccacctcagcccccgcatccgccccactgccgtcgcaactcccatgcctgagcttcgccggaccaagagcgacaccagctccatgctcggcgccgctgaagccgtggcgcgccaccaccgagccatggctgttagcgttaaaaagaagaaggggaagaagaagaaaacgaaagccaagaagagtagctcggttgtgagtagcgtcaacgaaacgaactcggtcctcagcgacaccgttttgccgtggaaggttaaaagcggaaaggcaagtcccgatgatattgtccacgtccacaacaacgtcgttgaggaggttcataatgataatgacgatgataacgagaacgcacattcaaccgttaactccgtttctgaaattgccaccagcgaaaccgacgctgatgaaggacaacaacatgttcatgttaatcacgttcaatacgaagttcgagcctcccccaaaccgcagtttcgaaactctccggcaccacaatttaagaactctccggcaccacaatttaagaactctccggcaccgcaatttaaaaattctccggcaccgcactttaagaattctccggcaccacaatataagaattctcctgcaccacggtatatgaactctccgaagccgcagtttaagaattctccggcgccgcaatttaagaattcgcctgcaccgcagtttaagaactctcctacgccacagtacaagagttctccggtgctgcagtatatgaactcgccgaagccgcagtttaagaattctccgatgccgcagtatatgccaactccaaagccgcagtttcggaactcgccggcagtgtcgaagttcaacccggcggtggggttcaacgggtcgcagagggggacgccaatgcatccattcgggaaagtcaaacttggccaacatggggcatgtggtgataacggagtcggagctggggccgtcgccatcggaggtggcggcggcgatcgcgaggaagccggtgatcgacgagggggagaattcaacggtgggaggatggagcttggacgcggagagcgtggaggggctgcagtcgaagctggagaggtggcggacggacttgccgccggtggtcgatcgcggcgaggtctcgagctacccaacgacgagcaccaccaagacgagccggcactcgcggaggcacaccgacggcgggagtactgggagtggcttgttctcatgctttag

SEQ ID NO: 1392 - DNA, 534 bp, Glycine Max
atgtctcgtctgaggctaggaaagaagctccaacctgctaagaaggcttggaagagcttctccaacaaagtgcaatcaaaagtccaaaaactcaacattcctaaagccatcaaaaccaccttcaaacgcctccttgcctccttgcactcccttcattacctcatacgctcgagaggtcgtcgtcggtctctcgcttctaataattaccatgttcatgttcatgttcatagcaagaagaacatatctgccataagcatagatgacctctttactgagcctgcttcttcttctgtgcatgcacatgatcaaggggaaacaagcagaggcaaagaggtgataaaaaaggatttggcagaagggagcagtgacatgaatactatagaggatgcatggaaggctttggttgctaagtcacctcagctacacgtggatcagaaggcagaagaattcatttccaagtttcgtgaagatatgaggcttcagaaagagaggtctttgcttgaatttcaggagatgctagcccgaggttcctga

SEQ ID NO: 1393 - DNA, 462 bp, Glycine Max
atgtctcgtctgagggtaggaaagaagcttgagcctgccaagaagacttggaagagcatctccaagaaagtgcaatcaaaagtccacaaactcaacattccaaaatccatcgaagccaccttcaaacacctccttgccatcttgcactcccttcatcatctcataacctcgagaggtcgtcgtcgtcgctctctcccttcgaataattaccatgttcatcattgcaagaagaacatgtctgccatacgcatagataacctctttactgagccttcttctgtgcatgcacatgatcaagggaaaacaagcagaggcaaagaggatgcatggaaggctttggttgctaagacccccgagcttcacgttgatcagaaggtagaggagttcattgccaagttccgggaagaaatgaggcttcaaaaagagaggtctttgcaggaatttctggaaatgctagcctga

SEQ ID NO: 1394 - DNA, 396 bp, Glycine Max
atgtctctccttgttaattctcctctgctgccactgcaaagtactcggtggttgaaaccgaagcaagaagctaggtttttgtcacacgggccaaccataataggaggaggaatgagcacaaacatctttggaactgcgaaaaggaatggaaatggaaatggggttaaagcctttttcattaatcctgaacaagacctcatcatcaaagaagctctcaaggaaccagtggcattcttgggcggaatgtttgcgggtattttaagacttgatttgaatgaggagcccctcaaggaatgggttactaggactgcagaagctgctggaattagtgaagaagaagccaatacagaagagtcaacgactgaggaagctccacaagagatccagattgaataa

SEQ ID NO: 1395 - DNA, 558 bp, Glycine Max
atgtctgacgaagtcaacagcgttttcaagaaatatctcaaccagcttcagctccatcctctcagaaccaaggcaattactgcagcagttttggctggttttagtgatgcagtggctcagaagttatctggggccaagaagcttcagttgagaagggtgcttcttttcatgctctatggtttcgcctactctggaccctttggacattttctccacaaattgatggataaaatctttaaggggaacaaaggcaatgatactgttgctaagaaggtgatccttgaacagataaccagttccccatggaacaacttttttttcatgatgtactatggcttggttatagaaggaagaccttggagtacagtcataaacaaagttaaaaaggattacccttctgttcaattgactgcatggaagttttggcctatagttggttgggtgaattaccagtatatgcctctgcagctccgtgttgtatttcacagctctgttgctgcttgctgggcaatctttctgaatctgaaagcaaggtctgttgcaattaaggcttcctag

SEQ ID NO: 1396 - DNA, 213 bp, Glycine Max
atgtctgacgattgcaaaggtaagagctcatggcctgagcttgttggagtgcaagggacagtggcagaggctacaattgagagagagaatcctttggtgaatgctatcattgtgcctgaaggaaacagggtcatcactgattaccgctgtgatagggtttgggtttggatcaacaaagatggaattgtcaaggaagttccacacattggatag

SEQ ID NO: 1397 - DNA, 204 bp, Glycine Max
atgtctgtagcaaaccaccccaccatgaacctctgcaaaatctcaaaatcattgttaaccacacacaccatgaacctccacaaaccgcccctacctccaaaccacagtgaatcccttaatattcgtcgtctctactccctcttgcaacctcaatcagacccaaatcccaaacaacaaattgagatccaaaatcgaaacctttaa

SEQ ID NO: 1398 - DNA, 1005 bp, Glycine Max
atgtcttggtgcaccattgagtccgatcccggtgtgtttacagaactcattcagcaaatgcaagtgaaaggagtacaggttgaggaactgtattcattggaccttgactctctcaacagccttaggcctgtttatgggttgatttttcttttcaaatggcgtccaggagaaaaggatgatcgtgtcgttatcaaagatcccaaccctaacttgttttttgctagtcaggtaattaataatgcttgtgctacccaagcgatcttgtccattcttatgaattcaccagatattgatattggtccagagctgacgaaattgaaagaatttaccaagaatttccctcctgagctcaaaggtttagccatcaataacagtgaggccatacgtacagcccataatagctttgccaggccagaaccttttgttcctgaagagcaaaaggttgctagcaaagatgatgatgtttaccatttcataagctatctacctgttgatggggtactatatgagcttgatggattaaaggagggtcccatcagccttggtcagtgctctggtgggcaaggtgatatggaatggctgaagatggtgcagcccgtgatccaggaacgcattgaaaggtattcccaaagtgaaataagatttaatctcctggcagtcatcaagaacaggaaagagatgtatactgctgagctgaaggaacttcagaagaggagggagcgcattttgcagcagctagcagcatcaaagtcagacagacttgtggacaatagcagttttgaggcactgaacaattctctctctgaagtgaatgctgggattgaagcagctactgagaagatcttgatggaggaagaaaaattcaaaaaatggagaacagaaaatattcggaggaaacacaactacataccctttttgtttaactttctaaagattctcgctgagaagaagcagctgaagcccctcattgagaaggccaagcagaaaacaagcagccctcggtga

SEQ ID NO: 1399 - DNA, 1389 bp, Glycine Max
atgtcttgtgaagttgtgaacaatgatgagcttcatgtggttatgttcccattccttgcatttggtcacattaacgcatttgttcaactctccaacaagttgttctctcatggagttcgtatcactttcttgtcagctgcatccaacattcccagaatcaaatcaactcttaatctcaatccagccatcaatgttatcccactatacttcccaaatggcataaccagcactgctgaattgccaccaaacttggctgcaaatctcatacatgcacttgaccttactcaacctcatgtaaagtcccttttgttggaactcaaaccccattatgttttctttgactttgcacaaaactggctcccaaaactagcttctgaacttggcatcaaatctgttcgctttgcgtccttctctgccatatctgattcttacattactgtgccttcaaggcttgctgatattgaaggaagaaacatcacttttgaggatcttaaaaagcctccaccagggtatcctcaaaactccaacatttccctcaaggcctttgaggccatggacttgatgttcctcttcaaaagatttggtgaaaaaaactttactggttatgagcgagttttgcaaggctttagtgactgctcattaatagtgtttagatcgtgcaaggaaatagaagaatcctacttagactacattgaaaagcaatttgggaaactggttttgttaactggtttccttgtcccagagccatcaatggatgtgctagaggaaaagtggtccaaatggttagacagtttccctgccaaatctgtcatactatgctcctttggcagtgagcaatttctgaatgatgatcaaatcaaagaagtggccagtggcttagaactcagtggcttacctttcattttggttctgaatttcccatccaatctctctgccaaagctgagttagagagagcattaccaaaagggtttttggaaagagtgaagaataggggagtggtgcacactggttggtttcagcagcagcttgtactgaaacactctagcgtgggatgccatttaggccatggtggcttcaattctgtgattgaagctctggccagtgattgtgaactggtgctgttgcctttcaaggctgaccagtttttcaatgctaagctcatagccaaggctttggaggcagggatagaggtgaataggagtgaagatggggactttaagaaagaggatatactgaaggcagtaaaaactatcatggtggaggatgataaagagccagggaagcaaataaaagaaaaccacatgaaatggaaggagtttttattgaataaaggaattcagaacaaattcatcactgatctggttgcccagttgaagtctatggcttag

SEQ ID NO: 1400 - DNA, 201 bp, Glycine Max
atgtgcaggtgcaacaatacgacaccgttccacgaactcctaaacctgttgacgaagatctctataagatccctcccgaactcctccacactaccaacaaacggaagaaattgctggggttcatttccaagtgtcttgtactacttgtgtgtcacgagcattgctaaactggaagaactcctatccaatatcaatctataa

SEQ ID NO: 1401 - DNA, 1677 bp, Glycine Max
atgtgcggcggcgccgactggagcctccagaacgagcatggctggagcgcgctccaggaagccgtgtgcacccgagaggaagccatcgccgtcatcatcgcgcgccactaccagcctctggcgtgggcgaaatggtgccgcaggctcccccgcattgtcgcctccgccgcacgaatccgcgacttctacatggagatttctttccatttcgagagctccgtcattcccttcattggtcgcattgcgccttccgacacttaccgcatttggaagcgcggctctaacctccgcgccgacatgacccttgccggattcgacggcttccgcatacagcgttcggaccaaacttttttgttcctcggagagggttatgcctccgagaatgggaatttgaacttcccaccgggttctttgcttgcgcttgctcataaggagaaggaggttacgaatgctttggagggagctggtactcagccgactgaagctgaggttaatcatgaggtttctttgatgtctcagactaatatgtataggcctgggattgatgttactcaggcggagcttgttccgcatttgaattggcggcggcaggagaagacggagatggtggggaattggaaggctatggtttatgacatgcttcatgtgatggtgagtgtgaagtcgaggagggttcccggggcgatgaccgatgaggagcttttcgctgtggatgatggggagagtatggtgaatcgagagaacaatgatgagtatgatgatgtgttgactgctgaggagaagatgcagttggattccgcgcttcggatggggaattctgatggtatttgtcaggatggggagcctgggtttgatgggcatgagaatggttcagcggcttcgaattgtgaagccaatggtggtggggttaaagagaagaagggatggtttggttggaacaagaaaaacatcaagggtggtgacgagcctggggatttgaagactgccaagaagttttcgggtgatcagcagaagccgcaacctgagtttgtgaaggaagatcctggggaaacaaagaagggaaaggataaaaaccttagaaggaaaaagaagaaaggaggaattaatgagtctaagaatgagagtgagtacaagaagggcttgagacctgttttgtggttgacaccggactttcctttgagaacagatgagcttttgcctctgcttgacatcttagcaaacaaggttaaggctattaggagactcagagaacttttgacaactaaacttcctcttggaacctttcctgttaaggtagctatccctatagtccctaccataagggtccttgtcacttttacaaaatttgaagagcttcagccagcagaggagttttcaactccactctccagcccagcatacttccaggatgctaaatccaaggaatcggaaggatctacgtcatggatttcatggatgaaaggaagtcatggtacacagtccattgactctgatagtcatagatttaaggatgaaatcgaccctttcaatatacctttggactacaaatgggtagatgccaatgagaggaaacgccgtatgaaggcaaagagagccaaaaatatgaaacataagaagcagactgctaaaggaggagatggagtgcaactagggagtgaagatgtggaagaatactaa

SEQ ID NO: 1402 - DNA, 2268 bp, Glycine Max
atgtggaagttgaagatagcagaaggaggaaaggggttgatatccgtgaacgatttcatcgggcgtcaacactggatatttgatccaaatgcaggaacgccgcaagaacgcgctgaggtagaaaggctacgccatcaattcacaaaaaaccgattttccatcaaacaaagcgcggatctcttgatgagaatgcagctcacaaaggagaaccagtgtggtcccattccaccagcagtgaaagtgagagacacagaaaatataacgatggaagacatgattactacaattagaaggggcatcagtttctattcatcaattcaagcccatgatgggcactggcctgcagaatcagctggccctttgtttttccttcaacctttggtaatggcattatacattacaggatcccttgatgttgttttaggacctgaacacaagaaggaaattgttcgatatttgtacaatcatcagaatgaagatggtggttggggattccatatagagggtcatagttcgatgtttggatcagcattgagctacattgccttaaggatactcggagaagggtctcaagatggtgaggaacgagcaatggacagagctagaaaatggatccttgatcatggtggtttagtggctattccatcatggggaaagttctgggtcacggtacttggtgtttatgaatggtcaggctgtaatccacttccaccagagttttggttgctacccaaatgtagtcctattcatccagggaaaatgttgtgctactgtcgcttggtttatatgcctatgtcatatttatatgggaagaagtttgtgggccccatcactagcttaatcagatccttgagagaagaagtatacaacgagccttatgatcaaatcaactggaataaggcccggaacattgttgctaaggaggatctctactatccccatcctatgatccaagatatgctatggggatttcttcatcacgtgggagaacgtgttatgaattgctggcccttttctatgcttagacagaaggcattagaaatcgcaataaatcatgtacgttacgaggacgagaatagtagatacctttgcattggaagtgtagagaaggtgttatgtttgattgcgcgttgggttgaagaccccaactcagaggcatacaaacttcatttagcccgaatccctgattacttttggctggctgaagatggcttgaagattcagagttttgggtgccagatgtgggatgcagcatttgctattcaagcaatacttgcttgtaatgtgagtgaagaatacgggcctacacttcggaaagcacactccttcgtgaaggcttcgcaggtccgtgaaaacccatctggtgatttcaaagcaatgtacagacacatatccaaaggatcgtggacattctcaatgcatgatcacggttggcaagtctccgactgcacggcagaaggactcaaggctgcactcctattgtcagaaatggctactgatctagttggggaagaaatggaagcagagcgattatatgacgctgttaatgtcatcctttctttacaaagcagtaatggtggtttccctgcttgggagcctcaaagagcataccgttggttagagaaattcaatccaactgaattctttgaagacaccctcattgagatggagtatgtggaatgcactggatcagcaatgcaaggtctggctctcttcagaaagctatacccaaagcacagaagaaaggaaatagatcactgtatttccaatgcaatccattacattgaaaacacacaaaatcctgatggctcttggtacggttgttggggtatttgctatacctatggtacctggtttgctgtagtgggactaacagcctgtggaaagaactaccataatagtccttccctacgcaaagcttgcaaatttttgttatcaaagcagcttccaaatggtggatggggagagagttacttgtcgagccaaaacaaggtttatacaaacttagaaggcaaccgtgcaaacttagttcaaacttcatgggctttgttgtcccttattgatgcaggacaggctgagatagatccgacacccatacaccgtggaataaagttactaatcaattcacaaatggaagatggagatttcccacaacaggaaatcacaggagtatttatgaggaactgtacccttaactactcatcgtatcgaaacatctttccgatatgggccctgggagagtatcgttgccgagtcttgtgtggttaa

SEQ ID NO: 1403 - DNA, 1233 bp, Glycine Max
atgtggcgcaatgacttccaattcccatcatactcttctctctcttgctccgccaaccaccttgcacccctcttcaacgacaccgccgccgcaaactacctctgcgcccaattcgattccatttccaagggcctcgccgacaccacctactttctagccaagaacaccatgaacatcatgctcaccaaagtcctcgacgccgccgccggcggcctctcttactacctcttcggcttcgcattcgccttcggcgccctctccaacggcttcatcggccgccacttcttcggcctccgagatttcccgatgggtgcctctccctccggcgactacagcttcttcctctaccagtgggccttcgccatcgccgccgccggaatcaccagcggcaccatcgccgagagaacacagttcgtggcttacctcatctactcttctttcttaaccggtttggtttaccccatcgtttcgcattggttctggtcctcagacggttgggccagcgcggctcgtagcaacggaaatgttttgttcgggtctggagtcatcgactttgcgggctcaggcgttgttcacatggttggcgggatagcgggcatgtggggggctttaattgaaggcccgagaatcggccggttcgaccggacggaccggtccgtggctttgcgtggccacagcgcgtctttagttgtgcttggttcgtttttgttgtggttcgggtggtacggcttcaaccctggttcgtttatcactatagcgaagggacagctgtcacgacggcattggctgggagcactgcggttattggtgggccattggaacgcgattgacgtgtgtaacggcctgcttgacgggttcgctgcgattacatcgggctgtgccgtagtagaaccgtgggccgcgattgtgtgcgggtttgaggcggcgtgggttttgattgggcttaataagcttgccgcgaaggtggagtacgatgatccactggaggcggcgcagcttcacggcgggtgtggcgcgtggggagtgttcttcacgagattgtttgcgaagagagtgtacatggaggagatttgcggcgttggaaggccgttcggggcgttgatgggcggcgcaggtgattcagatattggtggtgtgcgggtgggtcacggcgaccatggcggcgttgttcaaaagatgaatctgttgagaatttcgagggatggtgggtttgcatatgcatatgatagctga

SEQ ID NO: 1404 - DNA, 825 bp, Glycine Max
atgtggtcagccctaaagaggaattacgaggttagcgaggagattggtcgcggtcgtttcggcaccatcttccgctgcttccacccactctccaaccaaccctacgcctgcaaactcatcgacaaatccctcctccttgactccaccgaccgccactgcctccagaacgaacccaaattcatgtccctcctctctcctcaccccaacatcctccaaatcttccatgtcttcgaggacgaccactatctctccatcgtaatggacctctgccagccccacacgcttttcgaccgcatgctccatgctcccttctcggagtcccaggccgcctccctcatcaagaaccttctcgaagccgtcgcccactgccaccgcctcggcgtcgcccaccgcgacattaagcccgacaatattctcttcgattcggcggacaatcttaagctcgccgacttcggttcggcggagtggttcggcgacgggaggagcatgagcggcgtggtggggacgccgtactacgtggcgccggaggttctgttggggagggagtacgatgagaaggttgatgtgtggagctgtggggtgattttgtatataatgttggcggggattccccctttttacggagactctgctgctgagatctttgaggctgtggttagggctaacctcaggttcccttctagaatcttccggactgtgtcccccgccgccaaggatctcttgagaaaaatgatctctagggactcttctagaaggttctccgcagaacaagccttgagacacccttggatcttgagtgcgggtgacacggctgaactgacttga

SEQ ID NO: 1405 - DNA, 2397 bp, Glycine Max
atgttaaaagcagtggcatctgggcttgtgattacttctatcctcatatgtgtatctgcaaatgataatggatttcctagatgtaactgtgatgatgaggccagcttgtggactattgaaagcattctggagtgtcagagagttggtgatttcttgattgctgtggcctacttctctatccctattgagctgctttattttatcagttgctcaaacgtcccattcaaatgggtcctgattcagttcattgccttcattgtactatgtggattgacacatttgctgaatgggtggacctatggccctcacactttccaacttatggtggcacttactgtctccaaaatactcactgcattggtgtcatgtgccactgccataaccctcatcactctgatcccattgcttctcaaagtgaaggtcagagagttcatgctgaagaaaaagacgtgggatcttggacgtgaggttgatcatattatgagacaaaaggaggctgcaatgcatgtaagaatgcttactcaggagatacgtaagtcactcgatagacatacgattctgtataccactttggtggagctgtctaaaacacttggcttgcaaaattgtgctgtgtggatgcctaatgttgataagactgagatgaacctcactcatgaattgaatgggaggaattttaatttgactatacgcattactgatccagatgttgtgagaattaagggaagtgacggtgtaaatatactcagctccgactcagcacttgctgttgggagtagaggagtttctggagaggcaggaccggttgcagcaattcgaatgccaatgctacgggtttgtaatttcaaaggaggaacacctgagctaagacaggcttgttatgctatattggtcttaattcttccttctggagataatcaggagcctagatcgtggagcaatcaggagctggagataattaaggtggttgctgatcaggtcgcagtggctctatctcatgctgcaattcttgaagagtcccaacttatgagagagaagttggaggagcaaaatcgagctttgcaacaggcaaaaaggaatgctttgatggcaagccaggcaagaaatgcatttcagaaagtcatgagcgatggaatgaggaggccaatgcactcaattttgggactgctttcaatgatacaagacgataaattgaagagtgaacagaaacttattgtggacgcgatgctaaggaccagtaatgtcctatcaaacttgataaacgatgccatggataactcaactaaggatgaaggaagatttcctttggagataaggtcttttgggttacattccatgctgaaggaagcagcttgtctttccaagtgcatgtgtgtttataagggctttggttttatggttgaggttgagaagtgtttgcctgacaatgttatgggtgatgagaggagggtttttcaggtaattttgcatatggttgggaacctactggaacacaaccatgggggagggatccttgtatatcgagtttttgcagaaactggaagtcagggaaggagtgacaaagggtggacaacctggagaccaagctcttctagtggtgatgtaaatattagatttgagatagggatcaacagtagtgattctgaagttgggagctcaatttcttcaggatttgggggtagaaaatatagcagtgatagggttgggggcagattgagcttcagcatttgcaagagggtagtccagactttggtggaaggcggctattatgcagtccttcagtattccgctaaattttctttttgccagcctttagatgattcaccagggtggcgtagctctgggaggttggagttgatgcaggggaacatatggttagtaccttgtaatcatggttttcctcaaagcatgactcttcttcttcggtttcaattacgaccgtccatttccatagccatctctgaccctggagaaggttcagagcgcactgattccaattcaatgctgagaaatctgcaagttcttttagtcgaaaatgatgatgtaaatagagcagtgacccaaagattgcttcagaaactaggttgtgttgtaactcctgttgcttcaggatttgaatgccttactgtcattggacctgcaggatgttctattcaagtcattcttttagatcttcacatgcctgatttagatggctttgaggttgccacgaggattcggaagtttagaagtggtaatcaacctatgattgttgccttgactgcaagtgcagaagaagatttgtgggaaagatgcatgcaagttggtattaatggagttatccgcaagccagttttgttgcatggaattgctagtgaactcagaagaatcctcatgcagggaaataatgtcctttga

SEQ ID NO: 1406 - DNA, 2289 bp, Glycine Max
atgttaaaagcagtggcatctgggcttgtgattacttctatcctcatatgtgtatctgcaaatgataatggatttcctagatgtaactgtgatgatgaggccagcttgtggactattgaaagcattctggagtgtcagagagttggtgatttcttgattgctgtggcctacttctctatccctattgagctgctttattttatcagttgctcaaacgtcccattcaaatgggtcctgattcagttcattgccttcattgtactatgtggattgacacatttgctgaatgggtggacctatggccctcacactttccaacttatggtggcacttactgtctccaaaatactcactgcattggtgtcatgtgccactgccataaccctcatcactctgatcccattgcttctcaaagtgaaggtcagagagttcatgctgaagaaaaagacgtgggatcttggacgtgaggttgatcatattatgagacaaaaggaggctgcaatgcatgtaagaatgcttactcaggagatacgtaagtcactcgatagacatacgattctgtataccactttggtggagctgtctaaaacacttggcttgcaaaattgtgctgtgtggatgcctaatgttgataagactgagatgaacctcactcatgaattgaatgggaggaattttaatttgactatacgcattactgatccagatgttgtgagaattaagggaagtgacggtgtaaatatactcagctccgactcagcacttgctgttgggagtagaggagtttctggagaggcaggaccggttgcagcaattcgaatgccaatgctacgggtttgtaatttcaaaggaggaacacctgagctaagacaggcttgttatgctatattggtcttaattcttccttctggagataatcaggagcctagatcgtggagcaatcaggagctggagataattaaggtggttgctgatcaggtcgcagtggctctatctcatgctgcaattcttgaagagtcccaacttatgagagagaagttggaggagcaaaatcgagctttgcaacaggcaaaaaggaatgctttgatggcaagccaggcaagaaatgcatttcagaaagtcatgagcgatggaatgaggaggccaatgcactcaattttgggactgctttcaatgatacaagacgataaattgaagagtgaacagaaacttattgtggacgcgatgctaaggaccagtaatgtcctatcaaacttgataaacgatgccatggataactcaactaaggatgaaggaagatttcctttggagataaggtcttttgggttacattccatgctgaaggaagcagcttgtctttccaagtgcatgtgtgtttataagggctttggttttatggttgaggttgagaagtgtttgcctgacaatgttatgggtgatgagaggagggtttttcaggtaattttgcatatggttgggaacctactggaacacaaccatgggggagggatccttgtatatcgagtttttgcagaaactggaagtcagggaaggagtgacaaagggtggacaacctggagaccaagctcttctagtggtgatgtaaatattagatttgagatagggatcaacagtagtgattctgaagttgggagctcaatttcttcaggatttgggggtagaaaatatagcagtgatagggttgggggcagattgagcttcagcatttgcaagagggtagtccagttgatgcaggggaacatatggttagtaccttgtaatcatggttttcctcaaagcatgactcttcttcttcggtttcaattacgaccgtccatttccatagccatctctgaccctggagaaggttcagagcgcactgattccaattcaatgctgagaaatctgcaagttcttttagtcgaaaatgatgatgtaaatagagcagtgacccaaagattgcttcagaaactaggttgtgttgtaactcctgttgcttcaggatttgaatgccttactgtcattggacctgcaggatgttctattcaagtcattcttttagatcttcacatgcctgatttagatggctttgaggttgccacgaggattcggaagtttagaagtggtaatcaacctatgattgttgccttgactgcaagtgcagaagaagatttgtgggaaagatgcatgcaagttggtattaatggagttatccgcaagccagttttgttgcatggaattgctagtgaactcagaagaatcctcatgcagggaaataatgtcctttga

SEQ ID NO: 1407 - DNA, 2382 bp, Glycine Max
atgttcaaattcttgaaagaggtggtgagtggatctggcacgggcctcaaagatctcccatacaatatcggtgaaccttatgcttctgcttggggctcttggcttcattttcgcggcacctccaaggacgatggttctccggtgtccatattttctctgtctgggagcaattctcaggatggacatttagctgcggggcgtaatggcgttaagcgtcttcgcactgttaggcatccgaatattttgtcgtttcttcacagcaccgagattgaaaccgtcgacgctggttctcccaaggttacaatttatatggtgactgagccagtgatgccgctgtccgacaagattaaggagttgggtcttgaaggtacacaaagggatgaatattatgcttggggcctgcatcagatagcaaaagctgtgagcttcttaaataatgattgtaaacttgttcatggtaatgtttgcttggctagtgttgttgtcacacaaactttggactggaaactccatgcttttgatgttctatcagagtttgaagggagtaatgaagcttcctctggacaaatgctgcaatatgcttggcttgttggatcacaatacaaaccaatggaactggcaaaatctgactgggctgcaattaagaagtctcctccatgggccattgattcttggggcatgggttctctaatctatgagctattctctggtatgaagttgggcaaaacagaggagttacgcaacactgtctccattcccaagtctctgcttccagattaccagcggctactgagttctgtgccctctcgtagattaaatacatcaaagcttatagaaaacagtgagtattttcaaaataagttggtagacacaatacatttcatggaaattcttagtttgaaagatagtgttgagaaagacaccttcttccgcaagcttccaaatttggcagaacagcttcctcagcagattgtgttgaaaaagttacttcctttattagcttctgcgcttgaatttggttcagcttctgcccctgctttgactgcattgctgaaaatgggttccagtctttctgctgaggagttccgtgtcaaggtgcttccaacaattgttaaactttttgcatccaatgaccgagctattcgagttggccttcttcaacatattgatcagtttggggagtcattatcagcacaagttgttgatgagcaggtttaccctcatgttgcaactgggttctctgatacatctgcttttctgagggaacttactctcaagtccatgctaattctggctccaaagctgtctcaaaggaccttttcaggatcattattaaagcatatgtcaaagttacaggttgatgaagaaccagctatacgaacaaatactaccatcttattgggaaatattgcaagccacttaaatgaagggacaagaaaaagagtgttgataaatgcatttacagtccgtgctttacgtgatacctttccccctgctagaggagcaggcattatggctttatgtgcaaccagttcctactatgacatcacagaaattgctactcggattcttcctaatgttgttgtactcacaattgatcttgatagtgatgtgcgatctaaggcatttcaagctgttgatcaatttttgcagatggcgaagcaacattatgaaaagacaaatacagcagaggctactgagggtacagccattggaatctcttcacttccaggaaatgcaggtttacttggatgggctatgagctccttgactcttaagggtaaaccttctgatcatgctccagttgcttctgtcagttctagtgcacgtactccaacatcttccaatgccagcccagctgtagatgctccttcaacagcacctgttcgtgttagctccacaccagattttgctgaacaccttgtccctacatccccaacgtcaacagatggctggggggaactagagaatggactaggtgaaaatgacaaggatgggtgggatgatctggaaccacttgaagaaataaagccaactccagctcttgtaaacattcaagcagctcaaaggaggccagtttctcaacctgtttcacagataaaacaagcctcaagtttgctatccaaaagtacgccaaagttgagcaaggatgaagatggtgatttgtggggttccatagcagctcctgctccaaaatcatcaaaacctttaagtttgaagtcaactgtaactgacgatgatgatccttgggcttccattgctgctcctgcacccactactaaggccaagcccttatcagctggtagaggaaggggtgctaaacttgctgctccaaagttaggtgctcagcggataaaccggacaacatcatccgggatgtaa

SEQ ID NO: 1408 - DNA, 708 bp, Glycine Max
atgttccgcagaatcttgtcccatcatcgcacactctcagcctgcgcccacaatgcaacaacacgctctctggccactcgccgccacgcccccaatgtccctccacccccttccttcctaatcccacgatcaaggcccctttcttccaaaacatcccaatccaacgaagccgctgaaagctccaataaggccaaaaaggacgtggcaaacgttgaagatccctttagtgcccctacctataacattccggagaagcctgtgacgtttgtggagggagcgtcctacagtgttgtcattcttgcgggactcggaatcgctgctgctgccggatatgctgttttcaaagagcttatttttcaacctaaggagtacaagatctataacaaggctctcaaaagaattcaggatgatggtcaggtacgggtgaggattggatttccaattactggttatggtcaggagagtagaaaccgagctgctcgccaaagaattcctcacagggtatggactgatgaggaaggtgttgagcatgtggaggttaatttttatatccggggcccccatgggcatggaaaagtatttgcggaaatgttcaaaggcactgacaacgaatggaagtttacttacttgattgttgagattagagcaccatctactgcacaaataattctggagtcatacattccatcttacagtccaaccaagtag

SEQ ID NO: 1409 - DNA, 708 bp, Glycine Max; identical to SEQ ID NO: 1408

SEQ ID NO: 1410 - DNA, 708 bp, Glycine Max; identical to SEQ ID NO: 1408

SEQ ID NO: 1411 - DNA, 1773 bp, Glycine Max
atgttcgatggagtaccagaccagttccaccaattcataactccaaggacctctctacctcttcacttacctttccctctccatacttcaggaggaacccccaatacgaccaccttcccctccaattttgatccctataaccatccccatcaattgccactccaacccaacaatctcttgcacccattacaccacaaagatgaagacaaggaagaaaacaccaccgtcccgatgaacttggaaatccaaagggatcaaaggcaacaacttcccgagctgattgatccctggaataacgatgaagtgcttgcgctcttgaggatcagatctagcatggaaagttggttcccagaactcacttgggaacatgtctcaaggaagctagcagagcttggatataagaggagtgcagagaagtgcaaggagaagtttgaagaagagagtagatatttcaacaacattaattacggcaagaataataataataataataatagtagcaattatcggtttcttagtgagcttgaacagctttatcaccaagggggtagtggtgatcatcatcttgaaaatacgactcagccaccactgcagaaacaagacaagatgggccaccatgcattggagttggaagtagaaggggattctagaaacgttgttgacgcattggtgacaaaacaaaacgagcaaagcgacgaggcactagcagtggaaaagatcacaaaggaccgcaagaggaagaggcctgataggtttgagatgttcaagtgtttttgtgagagcattgtgcacaagataatggctcagcaagaagagatgcacaacaagctccttgaggacatgatgaagagagatgacgagaagttcactagagaggaagcttggaagaagcaagagattgagaagatgaacaaggagcttgagatgatggcacgtgagcaagctattgcaggtgatagacaagccaacattatccaaatccttaacaaattctcagccacttcgtcccctgcaagccacaccctcaagaaggtaaacaatgattcaaacataaacacacacattacacaaaaccctaatccttcacaaacagaaaaccctaccttaagtgttgcacaagacacattacaagtgattccttctacttcttctacttcaactccagctcttccccagaaccctagtacttattctctaaatatccagaataataataataatattccagtagagacaaattcggttttgaataaagggaatgagaaagacgatgttgggagaaggtggccaaaggatgaagtgttggcactgataaacctgaggtgcaccagtgtgaacaacaacaacaatgaggagaaggaagggaacaacaaggtccctctttgggagagaatctcacaagggatgttggagttgggatacaagaggagtgcaaagaggtgcaaagagaagtgggagaacataaacaagtacttcaggaaaaccaaggatgttaacaagaagaggtcccttgactcgaggacttgtccctactttcaccaattgagcagtctctataatcaaggaaaacccgttctgcaatctgaaagccacttgaatagtccacctaatcagaatcccgagcaagtgacaccagatcaaacaacacaagctcacgagtcttcttctcaggtggggtctggtggtggtttcagtgtgcagcagcagcaggttgatcatggaggtgagaaaaccttgatgcaagtaccttctttggatttcgatcagttttaa

SEQ ID NO: 1412 - DNA, 369 bp, Glycine Max
atgttctttgcacttgtctctggatgtgacaagtgtccacccgtaacaaacacgagtattactactacttctattacagttacttctactccttcgttgaatgcaacaacgggatgtcctcgtgacgttctcaaactaggtgtgtgctcaggtattcttaatggatggatgaacttttcgatgggtttacctttaaagacacattgttgctctgcgatcgaaggcctttatgactttgaagttgcattgtgtgtttgcactgccctgaaagcaaacattatgggcatcaaccttgatattcccatttcctttaccaagcttatcaacacttgcgacaagaaagttccaaatggtttcatatgtgactga

SEQ ID NO: 1413 - DNA, 835 bp, Glycine Max
atgttgagtggattatacttacaggttggtaaaaaactgtctctatctggaattacaaatatgttgatttttatttttgagttgtatattaccatagtcgagtcttttcaggttactgacttaggtcagccaagtttattgcacgcaaacagtggaatgttgcaggggctgatgatcggtttattcatgtatataattacatcacaaaggatagagttaaaagagtttgaggcacaaaaatttaacattagttgtgtggcagttcatcctacccttccttacgtgttgtcatcagctgatgacataaagctttggaattgggaaaacgactggatcttgacatttaatcctacagacctaaagacctttgccagtgcatctcttgattgcaccataaagatttggaatcttgactctcctcatcccagttttgcattgaatggccatcaaggaagagtgaattgtgtcgattactttacagatggtgacagaccttattggaattattatgccaataaaacctttgaaacaggtatgggattatcaaaccaaaagttgtgtccatactctagaagattactgggcttagagctttacttttttttatttaatttggtaaatagttcttgccttttggcctcaatgtcatcactccattataggaacttgaataatttgattttggttgactttttttttttatctgagattgatgccttgtgctgtgccagaagactggataatgatagatcgacgaccaacacacctccacacacggccacgacttgcacatgcgccgctggagcatgggagaaagaagagaaaagagagaatt

SEQ ID NO: 1414 - DNA, 126 bp, Glycine Max
atgttgcttgattcttgtaaaaagaaagaggagaggatggtggcatatgttcatgattccagtgacagtaacgcactaacgcgttccggtggtgcgttctcctaccttggggttggggacacttag

SEQ ID NO: 1415 - DNA, 1344 bp, Glycine Max
atgttggacatcaacctattcagagaggagaagggccacaaccctgaattcatccgcgaatcccagcgccgtcgtttcgccagcgtcgaagtcgtcgacgaggtcatcaatctcgacaaagaatggcgaaagcgtcaattcgagttggagaatctccgcaaagaatttaacaagatcaacaaggaagtctccaaactcaagcgtgctggcgaggatgcaactaagttcatcagtgaatcagaggaaaccaagaaatcgataggggagaaagaggttgaagttcgggaaactctgaatctcttgaattccaagttggaaactattggaaacctcgtccacgattccgttccaattagccaggatgaggccaacaatgttgtcgttagatcgtggggagagaagagagtggagcctaagctgaagaatcatgtggatctagttgagcttctcgggatagcagatacaaagaaaggagctgatgtagctggaggtagaggtttctatctcaaaggagatggtgttcgtcttaatcaagctctaataaactttgggcttgattttttggaaaaaagggagtatactttattgcatactcctttcttcatgagaaaagatataatgtcaaagtgtgctcaactagcccaatttgatgaagaactttataaggtaactggtgaaggagatgacaaatatctgattgcaacagctgagcagccactctgtgcatatcatttagatgattggatccaccctacccagctaccattaagatatgctggatattcatcatgctttcgtaaagaagctggatctcatggtcgagacactctaggaatattccgagtccaccaatttgagaaagtggagcagttttgcctcactagcccaaatgacaatgattcatgggacatgcatgaggaaatgctgaagaactctgaagatttctacaaagcgttaaaccttccctatcaagttgtttccattgtatctggtgctttgaatgatgctgcagcaaagaagtatgatctagaagcatggtttccagcctctcaagcttacagagagctagtgtcctgttcaaactgtacagactatcaggccagaagattagaaattcgatatggtcagaaaaagagcaatgagcaaatgaagcaatatgttcacttgttgaactctactctaacggctactgagaggaccatttgctgcatactagagaacaaccagaaggaagatggggtagagataccagaagccctcaggccattcatgggtggaaagactttcctacctttcaagaaccaaccatctaatgaagccaaagggaagaaatcgaaggcctaa

SEQ ID NO: 1416 - DNA, 1200 bp, Glycine Max
atgttggagaagaggcagtggtccacgaggaaaatttacaattcacacattttccttattggttctctttgcagcaatctatttgggattcacaagaacaaactacttcaaagttcactacttgaaatactccctcacatcaccaccacccctttttcatgcaattgggtctctcttttcaccccccaaaaccagtttctttgcactcccattgtgtgctatggatggccccctttctttcaggtggtgggtatagctcagaaggttggtcctatgttttggcccttcatggccacagaaaaatgcaatcttttaggttggcaattgagcaccgtgccacatgatatgaagaacttggcacttgagttgtaccaaaatcaatgtagaatgaatgagacaattgtgatttgccacagtgaacctggtgcttggtaccctctactgtctgaaacctttccatgccctccatcttcttaccatgatttcaagtctctgattggcaggactatgtttgagactaatagagtgaatgatgaacacatggaacgctgtaatataatggactatgtttgggttactacagagtttcacgagtctacatttgtgcaaagtggaattgatccttccaaggtggtgaagattgttcaacctgttgatgtgaagttctttgatcctgtgaggtacaagccattggatcttgcttcgagagctaaacttgtcttaggttctggtgtgaggaagagttgtgtttttaagtgtcttcaagtgggagaattctcaaaggatgattgggttgctttgtacttgttaacaaatccttatcatactgacatggatttcgggaacaagatattggattttatggagagttctgatatggtagaaccagttagtggttgggctccagagcatgtgattgatactcacatagcattgaggaagtttccgagaccactggtggaggccatgtcaatggcattgcaggttattgcgacaaattggtcaggaccaactgaatttttgacaaatagctatccactgcctgtggatagaatgagtgaagtaacagaaggtccattcaagggacatctttgggctgaaccttccgaggataaacttcaggttcttatgagacatgtgatggataatctcactgaagctacagctaaaggcagaaaggcaagggaggacatgatatga

SEQ ID NO: 1417 - DNA, 984 bp, Glycine Max
atgttgtacaaatcatctgtgaggcctttaaaggtggtcatggctaatttgcttacagtgtttttgctaattgaggtgtttgcatatggctacagttacggacaatatggcttaaacacgaattactacttgatgagctcttgtccttttgttgaacctgttgttaagaacattgtcaacagagctttgcaggatgatcccaccctagcagctggtctgattagaatgcactttcacgactgcttcattgagggatgcgatggctctgttctgattgactccactaaggataatacagcagaaaaggattctccagggaatttgagcctgagaggctttgaagtcatagatgccatcaaagaagagcttgaaagacaatgccctggggtggtttcatgcgctgatattcttgccatggctgctagagatgcagttttctttgctggaggcccagtgtatgacatacctaaaggaagaaaggatggaagaagatccaaaattgaggatactatcaatttgccattccctactttcaatgcctctgagctcattaagtcgtttggtcaacgtggtttttctgcacaagagatggttgccctctctggggctcatacactaggagtggcaaggtgtgcttctttcaagaaccgattgaaacaagtggatccaactttggatgcacaatttgccaagacactagcgagaacatgcagttccggcgacaacgcaccgcagccattcgatgccacgagcaacgattttgacaacgtttacttcaacgctttgttgaggagaaatggggttcttacatcagaccaaacactctacaatagccccagaaccaggaactttgtgaatgcttatgcattcaaccaagccatgttcttctttgatttccaacaagctatggtcaagatgggcctgcttgatgtcaaagacaattccaacggtgaagtaagagaaaattgccgcaaaataaactga

SEQ ID NO: 1418 - DNA, 213 bp, Glycine Max
atgtttagcatgttaggaccacgagccatgcgaagacgcacacatgcaaaagctatggtgacaagtaagaagaccaagccaattacaaaagctacaccatatgtaaactcacttggatcaaagccattatcttccttgttgctggtgctgttgttcatctttgatggagaattggaattggatgggatcaatttgtggggtggaattgcctaa

SEQ ID NO: 1419 - DNA, 543 bp, Glycine Max
atgtttctcaaagtccagctgcactggaatgtcatcatcgctgctgaaaatctgcaaccggaaggtctgatgcttcatagggcaatcattgtccgccttctgagtgactttgctgtgaagaaggccaccaaagatctgggatactttcttgcagtgaccacactggagaaaataggggaaggaaaggtcagacaacatactggggatgtgctcttccctgtggtttttaatgtcatcaccttcaagtttttcaagggtgagatattagagggtgttgtccacaaggttctgaagcatggagttttcatgagatgtggtccaattgagaatgtctatctctcaaatttgaagatgcctgattaccgatatgttcctggcgaaaacgcatgcttcatgaatgacaaaatgtcaaagattggaaaagatgtcacggtccgcttctcggtgataggtacaaagtggatggaagcagaaagggaatttcaggcattggtcagtttggaaggggattatctgggaccaatttcaactccggatatttag

SEQ ID NO: 1420 - DNA, 543 bp, Glycine Max; identical to SEQ ID NO: 1419

SEQ ID NO: 1421 - DNA, 535 bp, Glycine Max
atgtttgaaggattatatgctctatggcaagaggcattggttatcaaacttataggtaagtccattggttttcatgttatgaaagaacgattaacaaggatttggaagctgaatgcaggctttgaaatcctagatattgaccatggatactatatggtaacctttgaccaggaagcatacagggtgaagcttattggtgaggaaccatggatgatctttgataattatttaatagtggagttgtggactccagacttcatctctcccgtagcaagcattaacaaaactatggtttggatacgttttcctggattgaataatcttgtttattatgatgagactatacttctagccctggcctctgcaataggtaagcctgtcaaagtggatatcaaccccaaggatgtcagaaggggaaggtttgccagagtttgcattgaggtcaatctaacaaagcctgttgttgggagggtatggttgaaagatttatggtaccatgttgagtatgaaggtctccatagaatttgtggaacct

SEQ ID NO: 1422 - DNA, 1680 bp, Glycine Max
atgtttgggtgcaagagtttatgctgggattctgtccctgaattcactgaccctgatccacttcccttttctctgccttcaccccttcctcaatggccacaaggtggtagttttgcatgtggaagaatatgccttggagaaatagaagttataaaagtaaacaagtttgagaaggtttggagatgcacaagtttgaatgggaaatcgcttggtttcacattttatagacctttggaaattccagaaggctttttctgccttggtcactattgccagtccaatgaccagccattgagaggatatgttcttgtggcccgtgacactagttctgatgcctccactctagaatctcctgctctggaaaagccacttaactactcgttaatatggagcctggattctcatgatgaatgtgtttacttttggttgccaaaccctccaacgggttataaagccatgggcatagtagttactagcagtcctaatgaacctgaagttgaagaagttagatgtgtgcgagatgatctcacagaaagttgtgagacttctgatctgttactgactgtaaagtcaaaatattcaaaagattcatttcaggtttggaatacacaaccctgtgatagaggtatgttagctagaggtgtagctgttggggcattcttctgtggaagtacatctgttgatcctgaacaagtggtggatattgcgtgcttgaagaatcttgattcttccttgcacgcgatgccaaatcagaaccagattcatgcacttattcagcattatggtcccactgtgtactttcatcctgatgagaagtacttgccatcatcagtgcaatggttttttaagaatggagcagttttgcatgcagcaggcaataagaaaggtatagctatagattatcagggctcaaatttacctagtggtggaacaaatgatggtgccttttggattgatttgcctactgatgctgatgcaagaaacaatctaaagaagggaaacatagagagtgctgaactctatgttcatgtaaaaccagcattgggaggagcctatactgatattgtgatgtgggttttttgccccttcaatggacctgccacccttaaagtggcattgatgaacattgagatgaacaagataggagaacacataggtgactgggagcacttcacccttaggataagcaacttcactggagagctatggtctgtttacttctctcagcatagtggaggtggatgggtaaatgcatttgatctggagtttattaaggggaataagccaattgtttattcatcaaaagatggccatgctagcttccctcatcctgggacttaccttcagggatcatccaaactaggaataggagtacgcaatgatgcagctccaagcaaatttattgtggattcgagcatcaaatatcagattgttgcagccgagtatcttggtgatggagtcattgcagaaccatgctggttgcagtatatgagagagtggggtcctaccattgtgtatgattcacggtctgagatagagaagataataaatctgctcccactatttgttagattttctgtggagaacttatttgaactatttccaacggagctttatggtgaggaggggccaactggtccaaaggagaaggataattggctaggagatgaatattgctag

SEQ ID NO: 1423 - DNA, 1525 bp, Glycine Max
attgctaggtcaaattcccctactgatataattatacaagttggtgattctagctttcacttgcacaagcttgcaattgcctcaagaagcgaatatttgaaccggcttgtatttcagaggggaagcaacagagaaaaagctggtgacagcctcatcatccaaatgaaaaatcttccaggtggtaaaaaaacttttgaattagtagtcaaattctgttatggaagaaaaattgatattaccgcagccaacattgttccattgtattgtgctgcacatttcttggaaatgagtgaagatgttgaagaaggaaatctcatatccaaaacagaatcatttctaacctttctaatactatcttcatggaaagacacatttcgaatacttaaaagcagtgaatccatttccccttgggccaaggacttacatatagtgaaacgctgctcagaagcaatagcctggaaactgtgcacaaatccaaatgcatctagtttcacttgtgaaagtgaaacacccttaagtaataatagtgttgataattggtggttcgaagatgtatcatgtctacgtatagatcattttattgaagtgattcaatcaattagaaaacgaggaaccaaacctgagcttgtaggttcttgcatagaacattggacaagaaaatggttttcccaagtcacatttggacttgataaggagactcctatacccataactctccagttgcatagaatttcaactgagtgcttgattagcatacttcctagtgaagaaaattcagttacttgcaattttttgcttcacctaataaaggcaggggtgatgctgaagataaattctgagttgttgtgtgtgctagaaagaagggttgctttaatgttggagaaatgtcgtgttcctgatctcttggttaaaaatcaaggagataaagattctttgtatgatgttagtgtggtacttagggtgttacggttttatgtctgtggcatgtcaagtaatcaatcagcaaaaccccacagtgttggaaggttagttgatgggtatctcacacaagttgcacgggatgagaatctcacaatggagagtttcaaatcacttgttgaagcattgcctcaaaaagccagacactgtgatgacaacctctatagagccattgacatgtaccttaaggcacatccaaatttggcagaagaagatagaacagatgcttgtagagtcctagaataccatagattgtcgcacgaagcacgtcagcatgtgatgcaaaacgataggttgccattgaaattaactacagagtttgtccttttagagcaagtgaacatggcaacctcaatgacaagtaatggatcaaactaccgaaggacaaatgctcagacaatcatcagagtgaacaaggatatggaaaaaagacaaataacaaatgcccaggagataagcatgatgaaaaaagacgttgaaatgataaagtcacaactattggaagtatatagctgcaaaatgaagctccaaaaccaactgaagagat

SEQ ID NO: 1424 - DNA, 651 bp, Glycine Max
attttagtgtacaaaacctgtgcaagccaaacctttaacgaccaattaactaaaacttattctcaaacactcaactctctgctccaacaactcattgcacaatcctcccaacaaaagttcttcaaaaacacggaagccgttagcgacgacgcagccatctcaggccttttccaatgtagagacgatatcggcataaaagattgttttaactgcgtaaacttgctgcatcagatgtcaaacaccttgtgcagtgattccatgccaacacgggttcaacttgacggttgctacattcactacgagacagaggagcttccagaaacaaatggtgaatctaaaagttatagcaatttcttgcttcacaaggagtgtggggaaccggttgtggactatatcaagttcaaagagtttatggacgaggcgtttgtgaatctggaaagtgggattccgaacagtaatgggttctatacgatgaattataaatcagtgaaattgatggcgcagtgtgaaggggattcaaatatttgtgactgtagcaactgcgtgagcgatgcagtgcaggttgctaaggaagaatgcggaacttcactttcggcacaaatatatcttgacaagtgtttcataagctactatggcattcctggaaactct

SEQ ID NO: 1425 - DNA, 372 bp, Glycine Max
caagttacgaatatggcaactcaccatttttggtcgaagagcattgatggtctctttgcttaccctcaatcatctgcttcacctaatgacttttccttgttcaactctgggttgatggtcatagagccatccacgtgcatgatgaaatcatataatggtggtgaccaagctttggtcaacgaggtgttcacgtggtggcaccgtttgccaacaaaactaaactacttgaagagttttgaaaagagggaagggaatgagaatttggaggtggttcctgaggacttgtattcttatagagattatgactgtaattgggacatgaaggaacttcatatttttgcttgtgacttggctcaccacatgtggtggcag

SEQ ID NO: 1426 - DNA, 133 bp, Glycine Max
cacctttttttttgcttgctttggtgtagttggttttcctcttattttctctctcactacaatggtgtcaaatgcaaatacagttgcacccttttcttgttgaaagattataaaaacactgttttttggaacc

SEQ ID NO: 1427 - DNA, 264 bp, Glycine Max
cacttccaaaatgaggttcgtgttgttgtgcttggagctagtggctacagtggttctgagtattatgtgttatctaaaattagagagcgtgattggtgcaatgtggtcacttgtcatatggatactgcccaggcatatgtttggagacttcaaaattttgttcttggtgagcatatattgaatccatgccctgaaaatccaacacctgtaaaggttaggaattccacttcattcaatattttttgtttcctatgcttattttag

SEQ ID NO: 1428 - DNA, 941 bp, Glycine Max
cagaaaggaaatcccttgctaaaacacattaggaacgttagatgggcatttgctgatgttgtttgtgactacttgcttggccaaagctcctgtgctctgtatctcagtcttcggtatcatcttctgcatccagactacttgttttatagaataaggaagttgcagaagaatttcaagcttcgtgtggttttatgccatgttggtgtggaagatgtaataaagcctcttcttgaagttacaaaaacagctttgcttcatgactgtacactcctatgtggatggagaaaatatcatatgaccatcaaagtttgtggttgcaacttgattaagattgttaacgtgactatgtatgttgcaactcctggaggaatgtggccgttacttggaaaccataaaagtctaagaaaacaagcctgcagacattattcaaggccaaatggatacagattatctatcaagggtatgctaacacatgcccttacaacagtccggcatgttaacaagactgatgtagtcaccctcggtaccacatttgggtatctttgtaacattatgggtgcatctatggaagatctagctcgttgccctggcatagtaggagagcgcaaggtatattaccaatggtcaagcgcttgtttgacacttttcatgaacccttcaagcatgtggaatccagccggcaagccattccagagacttctgtccagaacaagccagctagtccgtccagtctcatcgatcaggaacaatgctgaatcttcctccttgattgaagacaagcatgaggatgcagaagatttactgtcaaatctgccctttctgcagcttttgccaaatattctggtagagttggaaagaggaaaagcacttcacaggtggaggaaaaaggagaatcaattatttccaaagaatcagaagctgaaacataaaattaccatgaa

SEQ ID NO: 1429 - DNA, 357 bp, Glycine Max
cagagccatgaaaatctaatgatgtgggagattctgctatacatctacatcctctattccccaggttggcagtatcctcgtacaatgcccatcttcctatgtttatatggaataggcttcaaagttcactatgtcatcctctgcctcctctgtattcctagaatatacaagtactacatttacaccgatgatgtgtgcgccaagtgcctcgcacggctttatgtagctactcttcttttgggaagttcaggttggctaagtgatcttgttttctgcaacatgatatcaagttggccaattaacccacaaggcatctcttcatgggtttcaactcctactttgctaacacgttcttga

SEQ ID NO: 1430 - DNA, 1896 bp, Glycine Max
caggttctgttacctgaaaatgcaagtgaggtttcagagtcaccctcattgaatttgaacccagattcagttgatgggtccccacctgtttccaccgtttacactgacgtgggtgtcgtgccagaacaccaaaagaacgagcttgagcacttgatatccaatttagaaggagaaatcgaggaactgaggctcaagcaaaagaaattggataaaaagcggagagaagcattgagcaagatattggacatcaaagggagcattcgagtattttgtagaattcgaccgaatctggttacggagaagagaaaaatttccgaaccggtatcggctggaccagagaaaattcaggttaagttcgggggaacaaggaaagattttgagtttgataaggtttttaaccaagaagcaagccaagaaagtgttttcgttgatgttgagccaattctaagatctgcaatggacgggcacaatgtgtgtgtttttgcttacggtcaaacaggcacaggcaagacattcaccatggatggaacaaacaaggagccaggaataattccgcgtgctcttgaagagctctttcgtcaagcctctttggataattcatcttcttttacctttacaatgagcatgttggaagtttatatgggcaatctcagggatttgttatctccaagaccatccggtagaccacatgaacaatatatgacaaagtgcaatctcaatattcaaacagatccaaagggattgattgaaattgagggtctctcagaagtgcaaataagtgattatgctaaagccaaatggtggtacaacaagggcaaacggtttagatcgacctcatggactaatgtgaatgaggcatcaagcaggtcacactgcttgacgaggataagcatatttcgacacggggatgctttggaagtcaaaagtgaagtaagtaaattgtggatgattgatcttggagggagcgaacggttgcttaaaactggagccaaaggactaacacttgatgagggcagagccattaatctttccctttcagctttagctgatgttgttgcagctttgaagaggaagaggtgtcatgtgccttacaggaatagcaagctgactcaaatactgaaagattctcttgggtatggctcaaaggtattgatgttggtgcatataagcccttccgaagaagatgtttgcgaaacagtttgttccttgaactttgcaaagagagcgagagcaatagagtccaacaaagaaatgccagtggaagtgaagaagcaaagggagaagaagattatggaactagaggaagacatcaaggaagccgtaaaacagcgccagaatttaagggaacaaatacagaagattgagttgaagttaaatgagtgtaaaaagctcgcatcaaccacatatagtgttgtggaaagtgatgacattgcaacctcaactagcctcaaagatgatgtcaaagaggtcattgaaacccctaaaacatccaagaagtccattaaaagaaatttctccaattcaacgcctcgattcatgacttcaactgttgcaagtcgccaaaggcaaagtgctgcagaacgagacattagtactgtgagattgaaaagttttagatctattatctctaaaagttccaataattattcatattcccaatcaatgagttactcagatatccgcatcaaagcaatactacgaagttcaaatggaaaatctcggtatgctgaagcagatagtgttccaattccaaacactgttctcacagaaaagcctaaatgcaatgatatggaatcaaaagtgactactcctcgaagcaagatggttacatcatcagaccaaaactttagagtttcattgggtcgtcacaggagaaggatgtctgatctgatctaa

SEQ ID NO: 1431 - DNA, 462 bp, Glycine Max
cagttaattaatatgaaggaggtgctgagtgaagatttgattgttgagtttctagaagccttctgtctttttgacagagatggagacggctgcataaccatggaggaattagctagtgcacttagaacactgaatcaaaataatcctaggaaggaagagttgcaaatcatgatgaatgaagtggatatgaatggcagtggaaccatagaatttgggcagttcttgaatctcatggccagaaaaatgaagcaaagtgaagcagaagaggaattaaaagaagctttcaaactgtttgacaaggatcaagatggttacatatcacccactgagttgttatctgcgatgagaaatattggagtgaagatcacagaagaagagctggagcatatgatcagactggctgatttggacggtgatggacgagttaattatgaagagttcatgaggatgatgacggtttaa

SEQ ID NO: 1432 - DNA, 130 bp, Glycine Max
cagttgaagaagcatataagccataaggcggtagaaaatggcgatggttacccatttggtgcagttattgttcaaaacgatgaaatacttgcaagctgtcataacatggttgtaagaaacactgatccca

SEQ ID NO: 1433 - DNA, 1236 bp, Glycine Max
ccacatgtatctttaatgaaaaataatttgaatgagccgggtatgattattataggtgacaaaatgaaacaacttcatatattgaactataaattatcagaatatacattcaggctttccactgctccatacttctatactaagagtttgtctttatttgttgcagccaatgtacgagattacattaccatccagaacgtctttgagaggcctaaagatattgtggatcttttgaaggctctgatctacccccaacaaaagggagctgagaatcccaagatatttgaagggaccaacctagttacaagggatgacaattatttagaaatggagggaataatttttgttatactggattgcaagaagatccaaaagaagcaaaaggcttcaagaaaagaagatttcaagatattgtggatctccattgtggttgagtggagccagggtagtagggaacagttcaaagctttgaagagtggcatcaagttttatgcggtggaatacttctttgagttaccggggctcaagataataaaagatacagaaagactgaattatgagattcagcctattgccccgttgttcagctctaaaggtaccctattgaatgaaaatgccctggaagtgatctttgaatggggcatagaggccttccctttcaggaaagttgatggtgatgaacttactctgaaatggaagtggctttgggatttaatcctaaaagcaacacctgtactacaggtgaatcaggtgaaggagaacagatacatctttatctatggaggtgccaacaatacgtgggtccagaacttcacacacgagctgtcaaagataaaaatgaacgagaatatccaacgtgcagatatcataatagagaactatgaactggggaaggggaagggtgaactcaacaacagtgttccaagtttctggattggcgtatcgcaccaagaggcagtggactgtgagattcagaagattgtaaagtgcttattctgcctcaaaagggacccacaagggtgggccattctcagcaaagggcacaacattaagcatctctgtcatggccaggctgtttatcagatcgtggctgagtttcaaaactggaaagagagagtgttcgatagagaagggtttgacattgccttcaaagaatatctcacgtgtggccgtgtcatggaggtgtcttctgttaagtataagtgttgtcatcgtgatgatgctttgaactgttga

SEQ ID NO: 1434 - DNA, 510 bp, Glycine Max
ccagagagagctaatgctttgttaaccttcgccataacccttctggccgccatggcttctctctccgacaacctcaattcccccactccctttctgcatgttcagatctatttgcattcattgtctttcagtagtggaattgctcatgaaaacaatgacacaaatagagtttcagtgttgttaatcatgacaatgaatatatcagcaaatttgcagtctcttttcacatggaacacaaaacaggtttttgtatttttagctgctgagtatgaaacccctaagaaacccttgaatcagatatcgctgtgggatggtataattccttcaaaagatcatgctaagttttggattcatacatccaataacaatttgcgcggtaaagaatttaatttgacaatgcactggcatgttatgcccaagactggcaaaatgttcgctgacaaaatagtcatgccagggtatcgattgcccgaggaatacagacgaagcttgcatttgttaatgtattga

SEQ ID NO: 1435 - DNA, 1167 bp, Glycine Max
cccatctccgccgtcctcaactcatcttccttcaagaagcaccagcagcctccgccgccgcagctgcaagtctaccagcccttccgccctcccccggcgcccctcccctcgcaattcggcaccctcgacatcgccggccgcatcgacgtcctcgccaaccgcctcgccctctggtacgagtacgcgcccctcatcgcttccctaatccgcgaaggcttttctcctcccacgatcgaagaaaccaccggcatctccggcgtcgagcagaaccgcctcatcgttggcgcgcaggtccgcgactccctcgtccagtccaacgctgaccccgacctcctcgccgccttcgagactggcggcgccgagctcctctacgagatccgcctcctcagcgcgtcgccgccgcacgcttcctcgttgagaatcggtgcgacgggaaggccgcgcaggagctcgcacgggtgggagagcttcgactacactctccccggagattgtctttcttttatgtattaccggcagagtaaggagcataggaacccgtcggagcagaggacttcggcgctggagcaggcgctgcgcgtggcggagacggaggcggcgaggaatgtgattttggaggagttggaggggaagggtgaggagggggatacggtgggtgaaggggaggctgcggcgcgtgttccggtggtgaggctgaggattggggaggtggcggaggcgagttcggtggtgttgttgccggtctccgcggcggaggagagggagattttggaggcgccgtttgagagcagaagccagggggagtttggtgtagtggtggcggagaaggggtggggaaaatgggtggtgttgccctcgtgggacccagtcgttggtttaggaaaagggggtgtcgtggtgtcatttcccgatgctagggttttgccgtggaaggttaataggtggtataaggaggagcctatattggtggtggctaacaggagtaacagagaggtgggtgctgatcatgggttttatctcgtgaatagtgatgctgagggtttgaaggtccaaagaggttttgcattgaaggaaaaggggttcactcagagtttaggaactgtgttattggttgttagaccgcccaaagaagagaatgatgaattgagtgacgaagattgggagtga

SEQ ID NO: 1436 - DNA, 1062 bp, Glycine Max
cccatggaatccgatctaaacgacgccgtttttcccgaagaagatctcgacgacgacgacgaaactccagaggatgaagaggaggaggaggacgacgacgtcttagatgacgatgaaaccgaaccccctccctccgtcatcgccgtcgcgccgcccgcttccgaaacgctcgacaccgcgttaattccgatctcctccgtcgcggattcctcgccgaaaccgctgcgcacggagctaatcgaggagaaaaaagcgctggacgattcgcggcgactgttccagcgtctgtggacagacgaggacgagatcgggctcttgcagggttttctggagtacacggcgcagcgaggatcctctcaccacaacgacaccgccctgttctacgaccaaatcaagtcgaagctccaactcggcttcaacaagaaccagctcgtcgagaagctccgaaggctgaagaagaagtaccgcaacgtcctcaacaaaatcagctccggcaaggaagtctctttcaagagccctcacgaccgagccaccttcgaaatctcgcgcaggatctggagcaacaccgctccaatcaccggtcccgtcgaagacgacgacgaaatcatcactaaccctaatttcggcaattcggcgaagatgcctatttcgcggaagcggtcgcggcctcagaagcgcgagttgaacgacggttcaacgttgaatagagataataattgcaatagtaacagtaataataataataataatgagaattgtaatagtaggcttaacttacagggtttgattgaagagacggtgaggagttgcgtgtcgccggtgttgaaggagttggcgtgtggtactggtggcatgggattgggaagagggttcgcattgaatcccttgcaaatgccaatgccaatgagtttaatgaatttggggattgttggggaaacggcgatggatgagaagtggaggaagcaacagattctggagctggaagtgtattccaaacgtttggaattggtgcagaatgagatcaaggttgctctcgaggaattgcgttcagctggtggagga

SEQ ID NO: 1437 - DNA, 266 bp, Glycine Max
cctaattcaatgttttccctctcaaaaccccacttctctctgatttgttgcggcacccgcgagctacgcgaacgaatccaaacagtccaaaccacacaaaagatcaccgaagccatgaaacttgtcgtcgccgtgcgcgtccgccacgcccaggaggccaccgtcagcggccgccccttctcctcgaaccttgccgcaaatgctcaacgacatcacagtgcctccaaaatgatgccatatccacccctctcacccatgccaaaccc

SEQ ID NO: 1438 - DNA, 2253 bp, Glycine Max
cgtccacaccaccttcattccgctctctcccgagacaacatcaaaacattcgtgaatgacgacaaccttgataaaggagacgaggttgggccgtcattgtccgaagcaatccaccactcacaacttgcaattgtggttttctcggaaagctatcttagcttatgcagtttgacaactcatttggtttggaacgtgaatgttgaaaaagagttttcttatccacttgtcatcaaagatgcttctatgatcattataaattctattcctaaaggaaaaactcagggattggtagtcacacccgtcttctaccaagtagatccatcgcacataaggaagtgtagtggcagttacggtgaagcaatcgcaaaacacaaagacaacgaatccttccaagactggaaagctgctctcgctgaagctgccaatatatctggatgggcctctcttagccgtcattacaatgttatgtcagggttgtgtatatttcataaagtcaaactgttgctgtccaaaagccaagatcggttacaagaaaatcttcacgtaattggaatttggggcatgggagggattggaaagacaactattgccaaagccgtattttctcaactctttccgcaatatgatgctcttctttctaagttacttaaggcagaccttatgagaaggttccgtgataaaaaagttttgattgtacttgatgatgtggatagttttgatcaattagataagttgtgtgaagcatgtaactatgtaggtccagatagtaaacttattataacaacaagagataggcatttgcttagaagaagagttggggacagacatgtctatgaggtcaaggcatggagctttgccgaatctctggagctttttagtttacatgccttcaaggaaagacatcctcaaaagggatacaaggttctctcaaaaagggcagtgaactgtgcaaagggagttccattagctttaaaagttctgggttctaatctttattccagaagtacagaattctgggatgatgaattgagcaaactcgagaactatccgaatgacagtattcaagatgtgttacaagtgagctataatggattggatgacctagagaaggaaatatttctacacattgcattctttatcaaaggtgaacttaaagatgatgtcatacgaatactagatgcttataaagctcttataactatttcacattctaggatgatagaaatgcatgacttgatagaagaaatgggtttgaatatagttcgtcgaggaaaagtttctgatgtacttgcaaataaaaagggaagtgatttaattgaagggataaaactagatttatcatccattgaggatttacacttgaatactgacacactcaacatgatgactaatttaagagttcttagattatacgtcccttcaggtaagagatcaagaaatgtgcaccattctggtgtcttagtgaattgtctgggtgttgtaaatttagtgcgaattgacttacgtgaatgcaagcactggaagaatctcccagatttgtctaaggcatcaaaacttaattgggtgaatctttctggttgtgaaagtttgcgtgatattcatccatctattttttcttttgacacacttgaaactttgatgctggatggctgcaaaaagcttaagggtcttaaaagtgggaaacatttaacatctttgaggaagatcagtgtcaatggctgcactagtctcaaggaattctccttgtcatcggattcaatcagaagcttggatttaagcagcacaagaattggaatgatagactctagatttgagcgtctaacaagtcttgagtcactcaatgtacacggtttgagatatggtaatattccggatgagttattttccctaaaagatcttcaggagcttaagatttgtaattgtagactagcaattgacaaacagttacatgtgttatttgatgcttcaacatatctacgtctactacacttgaaggattgttgtaactttctatcaaagcttccaccatttgttacagagtttaatgccgttaactgctggtcattgatttcagtgtcctctttaaactcttctgcattgaacttgaaagggaagggaaaattcatttcattcaagaattgtggttggctggatgaaccttctctccactgcattatgaagggtctgtttcccgggaagcaaagtcccgagccagttcaaatgtcaatcaacagactcctcaatcactgttaa

SEQ ID NO: 1439 - DNA, 311 bp, Glycine Max
ctcgaggagcgcatcgaggctcgtcatcgtgagatccaggccctgctcaccgacaaccaacgcctcgcccgcatccatgtggcgttcaagcaggacctcgtcgccactcaagaggagctctgctgcctctccgccactgtcgtcgaggtcaaggccgagcgtgacgccgaggtccgcggcatcgccgccatgagctctgagctggatcgcgtacgggcggacattctggagcttgtggcggagcggaaggagctcacgacacaactgcatgccgtggagagcgagcttgcaaaggcgagcacgaaggcgca

SEQ ID NO: 1440 - DNA, 2721 bp, Glycine Max
ctttggatttgtaaagctcttggaggaattacatggttttcagccttgaaacattcatttcttcttatggagatcctaaggttttctgcatcaactttttcaactttgttgaaattcactgattttggtgacaaggaattgatggacactgttgaaatctttattttagaagcattaaatctgaccaaagattctatatcagatgctaagaaaattcaatcatttgggtcagaaatattgaaggttgcacacatggtcattgatgctgtggtaaaattatgcaagacgcgttctgaattaataaaccaggagggaggtgatgaaaaatggttgaggcttgacaagcctgctacttttgaccatgttatccacataacgaaatgtgcaatagaaaagctgtctcagattggtgtccttgctgcaaatgatggtggcaactctgtcaatattcttaatgtctcctggaaaggtgttgtttctttgcttcaaggtggtggtggacattttacagaagttaacatagcaaatatagtgttaactttgcttgcattgataacggagcctctgaaatgtgctgcccaggcttggtcttcctcactgaatgaagccatttctgtgactgaagctaaaaggatctttgtgccagtgaaattttacctaattaatgctgtaaaaatatgctcactgtatcctcatcaggcctatacagtgtacaaggaaattacgctgtgtgttctcaagatcaaatgtttttggatttttgtaagtaacgaaaaccttctgaaatgtgcatctgtgataattactgaattactggaggaaacaacattgaatttgctattgtctttgctaaattctcataaactgaaactggaacagaggcttcaggtgctagaatggttgttcattaataaaggggattgtcattctggccttgattgtccaaccttaagtgattgtaaccttgcatgggttaatgaaatcttttgcaatagttatgaaagtatgagcagatcaaaaatactaatacttggtcgagttgtattgtttattaacttcctcagacattcgcttgagcttgatggagatgtgagaatagcaataactcagaagctttattggtttttggatgttttagttgaggaagatgtctattctcatatacttgttttgcaatttcctttattgtatggctctggaaaaacagtggaactcttgtggcagcctatgtttactttcctcttgcaagcattcaaaaccttcatgatcgtgatctcttcaagtacagcttgggaggagttggagtctttcttattagagaatttctttcatcctcactttttatgctgggagattgtgatggaatgctggtgctttatgctgcgatatgctgaaacacaaatggcaaacagcattcttggaaaactatgttcattacttaagctgtcggcatcctcatactcagttttcctgccttattcttccttcagaaagttggcaagatcaatatgcatgcttttaaccgatggtgcacaatcaatggttaacgtggtgtacatgtctcttgttggtgatgggaaatcccatttgtcatcagttttttgtttggctttgttcatggaaggttttccttttgatttactgacagatgaattgagaaagacttctattcaaagaattatatctgactattttgacttcatagacaactttgatgaagcaccattgatggcatgctcctctggtttgtttggtgttccagtttttattctttctgtttctttgcaatcactccaggatggactatctgatattgatgaaagggccttgaagtttttggttgcaatttcttctaattacaaaagtactgtagacaaagtaatcaaggaccgttttcttcagcttttcagtgaaactctagggatcatctcctatttgaaaaaactgtatacctcaaatgctattgaacaagtcatcatggagattcaaaatatctttttgtctgagcctccagcccttttggacaaatgcaaaccacatttggcccaattccttgcaggacttgttcacatggaaatttccgaaagtgatgatgatgctaagagctgtgctgtgtgggaattatatcacttgctcttgaaagagcggcactgggcactcagtcacttggcaataactgcatttggatattttgcttctcatactaggtgcaataagctatggagatttgttccagaagatgcagcactttcatatgatacagtttcaggagtggagtcagatcagcaaagatttatggttgagtttggaaaatttcttaaaaaggaaatagctcttcttacacttgaaccaagccctgaacagcttgatcttctagggagagaaggttttgtgttgaaacagatggtccaaaagatttcagccactgctgaagagagagagaaatgtgagatcatggatgttgatcacaagaaccaatcaaataaaaagaggaaacttcctgatggaattagcagaggagtggaattgctgaaaaatggtttaaaaattattggtgacggtttttcccagtggcagcttaatgattttgataccactgaactgcatgtaaaatatttgactcagttttctcaacttgaagacgtaattactaactttgaggaattgaccggcagcggtgaggtatgttcatcttctatgcagagtaattctcgagtttga

SEQ ID NO: 1441 - DNA, 2454 bp, Glycine Max
cttttgttggtgttctgtttccctgttttcttaaacgccgtaccccccgacaaaggtggcggcgattccttgatgttggggtgtggattaggcgaaggtggcggtaaagacagcgacggaaggcaatggacccccgacaacaaatacctctcagggggcaactccgtcacttccaaagcctctttccaagacccttcgcttttttccgaggttccgtacatgacatcacgcgtttttacctccgaagcaacctacaagttccccgttaaacccgacaaacgctattggcttaggctccatttctaccctgcagtttacaacaccttcgaccccgccaattcgtatttctccgtcacatcaaacgccgttacgcttctttccaatttcagcgcctcaatcacatgccaagccctctcacaagcctacctcgaccgagagtattccctcgcgcctttggattcggacactctcacccttaccttcaaaccttctgagaaacagaacggtgctttcgcttttgttaatgggattcagcttattgaaatgcccgagttgttcgattcggctcctttggtggggtactctgaccaaaccatggatacaaaaagtttgcattttcagacaatgttcagattaaacgttggtggacaatttatatctccgaaacaagattctggtctaagcagaatgtggtacgatgatacaccttatttatacggtgctgccactggtgttaccaaccaagctaccaaggatgtcaagattgactacaaaaccatgccacaaaatattgctcctcctaatgtgtactccacttcaagatccatggggaacaataaggacgtcaacatgggtttcaatctcacgtggatcttccaagttgatccgggctccatgtaccttacaaggttgcatttttgtgactattactattccaaagtgaatgaaattgttttcaaaatcttcatcaacaatcaaacggcggaggctgaagctgatgtgattgggtggacaggaggtaaaggcgtgccaacttataaagattatgtgatatatgtgaaagatgaggcaggtgatgatcaactctggcttgctttgcaccctgcacttgaaacaaagccagaattttatgattcattgctcaatggggtggaggtgttcaagctcaatgacaccgacttatctggtcccaatcctcaaccttctgagatgttgattcaacacgaggagcacgcaaagactttccaaaacaaacatggtagtaataagacttttgttattggcagtgctgctgggggtgctgcaggttttgccttagtggctgcaatacttgttgttgttcaacaccaaaagaaaaagaaagctccaggatcatacaacacatcaagctggctacctatttacgggaattcacacaccgcaggcaccaaaacctctgggtcagggaagagtgttggtagtgccaacatatcagccatggctcaaggattgtgccgttatttctccttacaagagatgaaacaagcgaccaagaattttgatgagtcaaatgtgataggggtaggagggtttggaaaggtttacaagggtgttattgataatgggttcaaagtggcaatcaaaagatcgaatccgcaatcagaacaaggagtaaacgagttccagactgagattgagatgctgtccaagttgagacacaagcatttggtgtccttgattggtttttgcgaggaggataatgagatgtgtctggtttatgactacatggcacatggcaccatgagggagcacctttacaaaggaaacaagccattggacacactatcttggaagcaaaggttggagatctgcataggagctgcaagaggccttcactaccttcacacgggtgcaaagtacaccatcattcatagagatgtcaaaacaaccaacattctccttgatgaaaattgggttgccaaggtttcagattttggactttccaaaacgggtccaaacatgaaccaaggtcatgttagtactgtggtgaaaggtagctttggatacttggatcctgaatatttcaggaggcaacaattgaccgagaaatcagatgtgtactcatttggggttgttttatttgaggcgctttgttcaaggcctgctctcaatcctagccttccaaaggaacaagtaagccttgcggaatgggcattgtacaacaaaagaagaggaacacttgaggacatcattgaccccaacatcaaaggacagatcaaccctgaaagcttgaaaaagtttgctgatgcagctgagaagtgtgtgtctgatcttggattcgaacgcccctccatgaatgatctcttatggaatcttgaatttgctctcaatgtgcaacaaaacccgaatggtacaactcacgaaccgtgtcttgaggaaaccttggaagtgagcatgaccttagccactagtcca

SEQ ID NO: 1442 - DNA, 894 bp, Glycine Max
gaaactgatgataactgtctccatgcactttctttcatggccgttcttttctccaatctcatcagcatcaccaacaacaccaaacctcgcttccctttcagctcaaaacccataatttgtggggccaaacggaacctcatccttcaaactcctctcgtctgcattggcattggcctaactcctcaagtctcagttgcgcaatcttcacctcaagagtcgtcgccgtccaaatcgcttctttctagctttgaaaacacgacatcttggtttcagttctacggtgatgggtttgccattcgagtcccaccagagtttaaggatatcatggaacctgagtcattttttttattgttgaacttggtaaattgtaatttagaaaattacaattggaaaatgattgcaaaatgtgttaatagaaactttaagttgcctataacttttactaatgacaggatttcgatgctggacagtctctttatggggacaaggcaaagacagactttttcagcacggtttgcatcttccgatggatcagagattctaagtgttgttactcggccagccaatcaacttaaaatcaccttcttacaggctcagaatataactgatttaggttctctgaaggaagcagcaaaaatttttgttccaggaggctcaaaaatttattctgcaagatcaataaaaataaaggaagatgagggttttacgacttactatttctatgaatttggtagagataaccaacacgtagcattgatgacaggcatcagcagtggaaaggcttttattgctggagcaactgcaccacagtccaagtgggacagtgatggtgtaaaacttcgttctgctgcaatatcattaaaacttctgtggccatgtgctgaatttttttag

SEQ ID NO: 1443 - DNA, 980 bp, Glycine Max
gaagaagaagagatccttgacattatcacagataatgacattaaccatgaaaatgaccaaaagctcaatgtagaagatgacgagtgtgatgtggacaacaccattcccgttgcacttgctgttcccaatgcctcccccgccgtgacagtggccttcccggccaatgacgaaagaaacaccatcccagtcaccgccactgccaccactgtcgtaacatgctcaaaagggcagcgcaacgccaagtattccggaatggtgagacaataccaaaggctgtggacgaaggaggatgagatggaactgttgaagggataccttgattacgtcaagcggcatagaaaggaaaccaccaccctccaaagcgtcgtagcctcgttgtatgatcacgtaaggcccaaactgaacgtgagtttcaacaaaaatcagcttgttgagaaactgcgtaggttaaagagaaaacacaagttagctttggacaaagacaaggacaaggaggttccctttagaaacccccaggagcaggccatttttgaaatttcccacaagatttggggcattgacacggataatataatagaccaagatgccttggatggttatgaatcaggacacactcctgaaagtcatgatcatgttggcaacatcaaggtgaagattgaacaacttgacaacaatgatgaaatagataatagagtgccaaagcggttgcggctagatgatgcagatgatgtgaacaaaacaaatgaccaaaacaatggtgatagcatacaaggcttcattgaggagaccatgaggtcatgtttcccaccattgctgaaggaagtgttgcatgatgcacatgaagagccacttcctgagttggagccaatcccaatgccactatgccctggggaagtggaccatgaacaatggagaaaacggaggattttggagttggaggtgtatgtgaagcggttggagttgttgcaggatcagatcaa

SEQ ID NO: 1444 - DNA, 1520 bp, Glycine Max
gaagctggaattggaagtggagtgagaagaaactcaacattaatatgtgcttcgacaagcgcggaatcagtggaagaaatggtgtttgagatggtgaagggaaaagaattgggtgctgatctagtagaggctcggttggacttcttgaatgacttccatcctactcaacatcttccttctctaatcaataaccgtcctttgcccattttaatcacttacagaccgatatgggaaggaggagagtatgatggtgatgaaagccagcgacaagatgctctacgtctagccattgaattgggatcagagtttgttgatgttgagctaaaggtggctgatgagttttacaaatccattggagggaagaaggctgagagtgtgaagatcattgtgtcttcacacaacttggaaagtactccatccgtggaggaaataggcaaccttgctgcaagaattcaggctaccggggcagatgtggtcaagattgctacaaccgccttagacatcacagattgtgcacgtcttttccaagtcctagtgcactctcaggtcccaatgattggaattgcaatgggtgagaagggatttatatcacgggtactctgcgcaaaatttggaggatttctcacgtttggttcaattgaggccggagctatatcagctccaggtcaaacaactatcaaagaattgttggatttgtacaattttaggcagattggggttggcaccaaagtgcatggtgttataggaaatcctattggtcatagcaaaagtcctcatctttataatccagctttcaagtcagtgggatttgatggaatttacttgcctttgttgatcgataatgtctcagattttctcaacacttactcgtctcctgatttcgttggatacagctacacgattcctcacaagcagaatggacttagatgttgcgatgaggtcgatcctattgccaaggcaataggagctattagttgcatgattaagagaccaaatgatggaaggctaataggctataattttgattatcttggtgccattgcagctattgaggaacgactacatctacaagattcaaacggaagatccatatctggttgttcacctttgtatggcaaactgtttgtggttatgggagctggaggggctggaaaggcactagcttatggtggaaaagaaaagggtgcaagagtagttgttgccaatcgtacatatgccaaagccaaagaacttgccactaaagtgggaggagaggccattactctatctgaattagagagcttccacccggaacaagggatgattcttgcaaatactacatctgttggaatgaaaccaaaaattgacctgacacccataccaaaggaagccctgaaacactactccttggtatttgatgccatctacacacccaaattgacaagactccttcgagaagcacaagaaactggagctgccatcgtctatggtacagaaatgttcatcaaccaagcattcatgcagtttgaaatgttcacaaa

SEQ ID NO: 1445 - DNA, 1260 bp, Glycine Max
gacacagaacttgggaaagcttgccacagcagtaagcaccaacaaggcaacaacaaatcctttcttttgcatccaaaaccttcgagagatgagcataataatgtcaatgtctaccaaattttggaggaaatttactcaacccatgtcggcagtgacacaaatgtggattctcttttcacccttcttgagaacactcttagacgttcaaccctcattgttgacaatttcgtgcagttatatatacaactctcttctttccctccacatgaaattggtcacaaaacaacactagccatacttaacaagctctcaaactacgagtggaatgcaaaggcagtgctgacaatggcggcttttgcactcgaatatagcgagttttggatgcatgctagctcagtcccaacaatcctcttgcaaaatctaagaacgtgtactttgtttatttcctccctagacatcacgggggaagagatttcagtattcgaaacagtttatgattcaattaaaactagtgaacagtataagatcgtgtggattcccattgtggaggaatggaccgttgagtacgacaacaaatttgaggattttaaatgcaagatgccttggtttgcggtgcagcattctagaaccatagcaagcctatatatggttgtggtgttgagccctcaaggaaaggtgcaacactcaaatgcattccatttgatccaggctcatggaaaaagagctttccccttcacatttgtcaaacaagaacaaataaacaatgagatctattgggttggctccgaaataggcaacatttaccccatcataaacacttggataaatgagaaaaagtacattttcttgtacggaggcaaggacaaagacatccttgcaagtgatgccgctataacggaggcaaatatttccatagagtggctttgtgtggaaaaggaagacaaaagcgtgatgaggcgcttttggggtggcattgagagtttgtttgtgactaagaagtgcaaaagatgctttctttcaagaatgaatctggatgggacggatctccttattagcgaagggtcatctgtggctgtgtgtggtcacggaaagaccatctcggagacagtggaagggtttcagaattggaaaggaagtgtgaccaaaaagggctttgggttatccttccaaggttaccatcagaagattgtagacatcactcaccgttgctcataccttgaaatttctaataatgtttcaggaaagttacctgagatctag

SEQ ID NO: 1446 - DNA, 672 bp, Glycine Max
gacacatccacatttggactttcgtgtacaacatcatccgcatattcatgccggatttttaatgtgaacaaagttgatgattccaaagtaggtccagtgtcagcaatagaaacagatcttgaaaaccattcagctgaaccagtggttactgcagaggatctttcacaggccaacgatcatgtaccaaaacaaaagcagattatgaaaccattgaaaccattagtacaaaagctcaatctaaaggttcttttagcaactgcaacaatcggatcgattcttggtctaataattggtgtagttcctccattccaaaagatgtttgttggagatgatgctcctttaggtgtgattgaagactctgcatccatgctgggggacgcatccattccggcaatcactttgttacttggagcaaatcttctgaatggtgtggccattgtaaaaggtgcaattcattttggtattatccagcatgatccattataccagtttattttactccttcaatacgcccttccgcctgcaataagcataagtacaattactcaattatttggagccggtgaaacaaaatgctcaattgttatgctagcaacttatgtctgtgcctcattttctcttacactatggtccacagtttgtagcaaaatacttcagtcatctctagtataa

SEQ ID NO: 1447 - DNA, 816 bp, Glycine Max
gagaaccttggcttggagcctactctgccgtatttgagtcctctggttgtcggagagaggctcctagttggtgcaaattttgcgtccgcagggattggaattctcaatgatatcgggtttcagtttctgcacatcatccacatctacaagcaactgaagctattcgcgcattaccagcaaaggttgagtgcacacattggtgaggagggagctcggaggcatcactcttggaggcaacgattttgtcaacaattattacctgctcccatattcactaagatctcgccagttttctctcccagactacgtgacctatatcatatccgaaagggccctgtatgcctcaaattagcaaatgagtgtgaccatgcaggagacataaaaaatttggttgaagtacttttagagaagtttatattcaaacagacccttaatccacaacttgttgaaatgatcaaaggagtcaaccaagagattggcgctcacgtcttcattgctgtaaatgcatatgaaatgcacatggatttcgttaccaaccctcaagcttttgttttagacccaaattcgcttgatgtgggcaaggcccgtttaatggggttggactctgcacacccctttcaaacttgtgtcctaatagagacctatacgcgttttgggatccatttcagccattccgagaaagctaaccgaatcatagtccaacagatgatgactggctctgccctccctaagtttttgtcatttgtggtttcaaaaatgtcctattcctttgattgcatcgttgtgagaatttttgtgtgtagtggagcatgttaa

SEQ ID NO: 1448 - DNA, 228 bp, Glycine Max
gatgaactagctaagttagcaggaattgcagcaactgcaacagccagtggtgggaaatttgacaagaaattggcaggtgaaaagcctccacaacacaaaggaaaatatcgaaagttcctgccagtggtagaaggaaccgggataggatcacaggaaagggagcaaactgaaaaaaatattgaacaagatcatctccaagaattctcaatttctcatgacatactcaac

SEQ ID NO: 1449 - DNA, 1065 bp, Glycine Max
gatgacatcacccctgaagaagttttgaagagaactgttttggttggacagagtttggaagctacaggcagtggtgacttcagctttgggagtaacaagatggatttgattgaggaaggagagaatgagaatgagaataatgattggtcaactgggattcggaatttgagtattgaggaggaagatgttcagccagctagtccccccatgtatctggcagcagggcttggggttgatgctgatgtaggatttgataaatttatcagcgatgatgtatttaatcccagtttggaagaaagtgaggatcttgaagggtattacaagcggatggttgatgagtacccctgccaccctttggttctcaaaaagtatgctcagcttttacaatctaatggagaccttcaaggagctcaggagtactttcttcaggctaccgtggcagatcctaatgatggtgaaatcttgatgcagtatgcgaagctggtgtgggagaaccatcatgacaaggatagagcaatggtctattttgaacgtgcagttcaagcagcaccacaagacagcaatgttcttgcagcatatactagttttctctggaatattgaagatgatgagaatgaagatagaaaacatgaaattcagagtgacatggaaatacaaaagactgaacctgtaaagccctccaaagaagaaagtggacaagtgattgatgcagcaaatgttacaacagctaattttggtgaagaaagcaatgttgaagattatttgaagaagatggttgatgaaaatccaagcaatcctctgtttctgaaaaagtatgctcagtttctgttacagtccaagcgagatcttcaagcagcagaggattactactcacgtgcggtagtagctgatcccagtgatggtgaaatgatatcagaatatgctaatctggtgtgggaacttcatcatgatcaggaaaaagcttcttttttgtttgagcaagcagttcaggctacccctggggatagcaatgttctggcagcatatacctgttttctctgggaaacagatgacgcagaaagctga

SEQ ID NO: 1450 - DNA, 315 bp, Glycine Max
gatgggcaatgcactctgagcaatcttgaagtgcaccaatacgatacaggaagaccctatcagggtacaagtttgtttgctgtgaccatcatcaatagatgcactccactgtgcgatcaaagcaatgtgaagttaaactgcactggatttaagaccgtgaaacccatagacccttcaattttgaatgtctctggtgatgtttgtattgtcaagaatggccaacctatcactatcgatgatcctgtgaacttccactatgcttatgactactcattcaatctgaacccaatttcatctgacatccattgtcattaa

SEQ ID NO: 1451 - DNA, 1011 bp, Glycine Max
gatgtgaaaagtgggtgtctcaatgggggaaatttgagcaggaccccagcacctaaatttagaggagtacaagtgttcacctatagggaattagaaattgccacggatggattcagcgaagcaaatgtgattggtagtaatggaattggagggcatggtttgatgtacagaggtgttctaagtgatggcactatggcagcaattaagttgcttcacactgagggtaagcaaggggagcgtgccttcagaatagcggtcgatctcctgagtcgcttgcactctcctcattcggtggagttacttggctattgtgctgaccaacaccacaggttattgatttttgaatacatgcccaatggaaccctccactaccatcttcacaccctcaacgatcaaactcggccgttggattggtgggcccggatgaggatagcccttgattgtgccagggcactggaattcttgcatgaacatgcagtctctcctgtgatccacagagacttcaagagtaacaacgttctactggatcaaaacttgcgtgccaaggtgtctgattttggattgcctaagatgggatcagacaagaggaacggtcaggtttccacccgtatgttggggaccactggatatttggcaccagagtacgccatgggtaagcttactacaaagtcagatgtttacagctatggtgtggttcttcttgaactgctcacgggacgtgtgccagttgatatcaagcgggccccaggagaacacgtccttgtctcttgggctctcccaaggttgacaaacagagaaaaggtgattgaaatggttgacccagctctacgtggacagtactcaaagaaggatttaattcagatagctgccattgcagcaatgtgcatacagccagaagctgattacaggccgctcatgacagatgttgtacaatcactgataccacttgttaggaaccaatcctctcttagttcatctagctccctacgatttcagaaacaaacgccaagt

SEQ ID NO: 1452 - DNA, 614 bp, Glycine Max
gcaagcatcaccaccctcctcaaagccagcaagaaaagtgagcacctgaaacaaatgcaagcgtgcgtcatccatcacgccctcgagcaagaccacttcctcgtttccctcttcatttcctgcgcccacaccctcctctccactttctcctatgccttttccatcttctaccacgttctcgcccttcccaccttcctctggaacactctcgtcaaatcccactgccaaaagaatctcttttcccacaccctctccgtcttcgctcgcatgaaggcacatggggaactcccctatagcttcacctacccttttgtcattaaggcctattctggtgcatgcaaggtaagggagggaaaattgcttcatggtttcgcgtttctgtgcagcattgaccatgatctctacaagggcaccattttgatcaacatgtataggaaatgcagggatattgctgatgcttgtaaggtgtttcatgggatgtctgtgtttgacgcaatgcctgggaagaatgttgtttctttcaccaccatgattgatgggtatgccaaggcgggtgacatgacgacagtgaggttcttgtttgatccttctctggagaaggatgttgttgcttg

SEQ ID NO: 1453 - DNA, 1707 bp, Glycine Max
gcaccatcccgtgcgaaaaagaagccatgtcctagaagccctttgcaggatctcaaccgcatttccagcagcagcaacagtagttatgcttcttctagtgtttccactgaagccccaaagggttgtctcaggttcttgtcttcctcttcttttagaacccctgtccacagacccaagagtctcaccaaaactcccagctcagttcctcgtgcagctccaccgaaacagtctaaatctaattcttccatggagaaccttccaaagggtaatgctgggttgagaactaagacacttgcatcggataagaagcggacgcataagaagaacccgctgtgcctctaccaatggcagtctgggaagaaatctggttctaggactggccaaaagtctaagccttgttctgctttgaatgaacatggcaagcttttacatagactaccatctgcatcagaggagttaaaggaaaaggaggatatcttgggagggagaaatgataatgctggtgagcatgcccatgtcaatttgggtcatggtgctgtaaactcgactcctttgagtaaaaaggttactgggtcgtatttggaggatgttagagtttttagggatgtggaggagaatccaaactcaatggatagtagaacacctccaattcatgactctctttccccggagatacaatgtgggtcttctttggttccaaaaacagcaacacctgcttgttatggtgctggctatgttgtttctggtgtcgttgacaagaggaaatgtaggcctagagggattctcactgtagagaagaactattcatgcagtgataaaatagctgctaatagttttgataatgatgagaagaagaaagtaattgatactaatgaccatgctagtccttccttgttacctttgccaactgaagctgtagtgcattggctttcttctccatttaacaagggaaagaaaattccgagtaaggagtttggaaatggactaaatcaaagtcagggactagcagaatccacaactcttgcttccagtacttcaccatcatccagttctaaaactttttggaatgtaagtgataacggtgatttgtctggtggtgctaatggtatcatgagaaaaatcagttcttcaatttctccaaatggacttgctgaatttcaagtaccttctaattacatattatcgccttcttattcatccttattgttttctcccaatcccacacctatttgtagggcaggcagctcaggaaaaggaaaaactgatagatataatctcattgatgagaattctccattttccctgaattcatttggtagtggaaatgttattcaaactccacagtcagattctagttcagatttacatgttggattgtcattggattctgttaattcaagtttccaatttgattttttaactatgccttgtgaatctattgatctcagtaaacgtccaaattttttggagggtcaagatccttggttatctagttctacaacagagaatgcttcacaatcccaaatgaggatatcatggagggaagggttaatgagccaatttgatgttggaatcactgaaactgaggatactgaacaggaaattgatggccttagcaaagaaaaaattccagctttaatatcatgttcaggtgctgagtccataagcactgatggtggtagtctagttgctccaggggatgactga

SEQ ID NO: 1454 - DNA, 495 bp, Glycine Max
gcagcaccgtattcaactatcatgtcacataactttatagatttcaccccaaacaaaagaaaaaaaaaagtattgccaaaagggttcttggaaagagtgaagagtagggtagtgatgcacactggttggtttcagcagaagcttgtgccgaaacactctagggtggggtgctatgtatgccatagtggctttagttcagtgatagaagcaatgttcaatgactgccaactggtgctgttgcctttcaagggtgaccagtttttcatggccaaggatttggaggcaggggtagaggtgaataggggtgatgaagatgggttctttcacaaagaggatatattggaggcattgaaaactatcattgtgaaggatagcaaagaaccagggaagcacacaagagaaaaccacatgaaatggtgcaagtttttgtcaaataaggaaattcagaacaaattcatcacaggtcttgctgcccagttgaagtccatggcttag

SEQ ID NO: 1455 - DNA, 2139 bp, Glycine Max
gcggcgaggaagcgctacgagggccttctcacagtgcgcacgcgcgccatcaaaggcaaaggcgcgtggtactgggcccacctcgagcccatgttgctgaacaacgccgtcaagctcaaatgctccctctgtgactctctcttctccgcttccaacccttctcgaacggcttccgagcatctcaagcgtggcgcctgccccaatttcaaccactcttcattaccttcaccttcccccatttccaccgtgctttcccattccaacaacggtagaaagagaacctcaagctctccgaaccaggaccactctgttcagcatttggtgttctctggtggaaaagatgatttgtgtgccctcgctgtttttgaggacagtgtgaagaagctcaagagtcctaggaacttgtcgcatgtttctcctcctgagttgacaaaggaccaggttaactccgctgttgaattgctggcagattggttctacgagtcttgtggctctgtgcctctctctgctcttgaacacccaaagtttcaatcttttctcacccaactgggtttgccggtgactctgttgagacgagagatatatgggtctaggctcgatgataggttcggagtggccaaggctgagtccgaagctagaatgagagatgccatgttttttcaagtagggtgtgatggttggaagggagaggatggtgtggtgaagtttatagtgaatcttcctaatggaactagtgtgttccacaaggtagtgtttggtggtggagtggtgtctgctaagtatgctgaggagattttgggggaggtggtgagtggtgtttgtgggagtgatgtgcagaggtgtgtggggatggttgcagacaggtttaagaggaaggcgttgaggaacttggaggttcagaaccattggatggtgaatgttgcttgtcaggttcaggggttcatgggtttgatcaaggattttagcatcggggtaccacttttcagggttgtcattgagaattgtctcaaggttgctaatttcatcaacactgagtctcaggttaggagtagtttcctcaggtacaggatgcaggagctggagtgtgctgcgctggttcgagttccctcgccaaagtgtcatgtgttgaaggactttacatcggtatttccaatgctggaggacatcctgagctgtgctgcagtgatccaaatggtggtgttggaggacacgtttaaggtggtgtgtatggaggatccactggccagagaggttgctggaattgttcagagtgaggggttttggaatgaactggaggctgtttattcgctggtgaagctaatcagaggagtggttcaggacattgaggcggagaggccgttgattggtcgttgtttgccgctttgggaggagattagaaccaaggtgaaggagtggtgtgttaagtacagtgttgtggaagaacctgtggtggaaatatttgaaaaacggttcaggaagaattatcaccctgcatggtctgctgcattcatacttgatccactttacttggttaaggaggccagtggaaagtaccttcctccgttcaattgcttgactcgtgaacaagagaaagatgtagataagttattgacaaggctggcttcccgagaagaagctcatgttgtgttgatggagctcatgaagtggagatcagaagggcttgaccctctatatgcacaggctgtgcagatgaaacaacgagacccggttaccgggaagatgaaggttgctaatccactcagcagtagacttgtttgggaaacttgcctcagcgagtttaaatccctcggaaagcttgcagtgaggctcatttttttgcatgcaacttcatttggatctaagagtaattgttctttcatcaagaagatttctgcaaataaacattcgagagtttccttggaaagagctcagaaaatgatatatatcgcagctcatgccaagcttgaaagacgagacttttccaatgaggaagagaaagaagcagaactacttgccatggaaggtagtgatgatggcatgctggctgaggtctttgctgatgcacccctaatgatttatcagatttttttccatagctgttctattattcccttattccaagtgaaaaatattttgtga

SEQ ID NO: 1456 - DNA, 1674 bp, Glycine Max
gctgttgctgatataattcgtacaaccttgggacccaggtccatgttaaaaatgctacttgatgcttcaggagttattgatgattcttgtgaatcataccctttaatatttacttgtgaaaagaaaaatatttcccgagttatgactacaatggctgggaaagttttttttttttttgtgtgtgtgggtggaggaggttattgcaaccagaaaaacgttatttctttatctatgattgaattgagtcgcacccaagatgaagaagttggagatggaacaacgtctgtcatcattcttgctggtgagatgcttcatgttgctgaagcactcatagataagaattatcatcctacagttatttgccgagcttatgacaaagctttggaggatgccattgctgtccttgacaaaattgctatgcccgttgatgccaatgatcgaggtacaatgctggggatagtcaaaagctgcataggtaccaaattcactagtcaatttggggatttagttgctgatttagctattgatgctactaccacagtagatattgatcttggcctaggtttgagagatgtagatattaaaaattatattaaggttgagaaggtacctggtgggcagctggaggattcaagagttcttaaaggagttatgataaacaaagatgtagttgcccctggcaaaatgaaaagaaagattgttaatccgcgtatcattcttcttgattgtccccttgagtataaaaagggtgaaaatcaaacaaatgctgaaatgcttaaagaagaagactggagtctcttgttgaggatggaagaagaatacattgaggagctctgcatgcagatattgaagtttaaaccagatttggtgattacagagaaaggacttaatgatttggcatgccattttctcagtaagcatggagttagtgcaatcagaaggctgagaaaaactgataataatagaattgccaaagcatgtggtgctgttattgtgaacagaccggatgaattacaggagtctgatgttggtactggtgctgggttatttgaagttaagaagattggagatgagttttttgcatttattgttgaatgcaaggaccccaaggcttgcactgtactattgaggggtgctagcaaggatctcctaaatgaagttgaaagaaacctccaggatgccatgtctgtagcaaggaacataataaaaaattcaaaacttgttcctggaggaggtgctactgagttgactatatcagcaacactgaagcagaagagttcatctgttcaaggtatacagaagtggccttatgaagctgctgccattgcttttgaggcaatcccccgtactttggcacaaaattgtggagtaaatgtgatccgcactatgactgcactacaaggaaaacatgcaaatggagaaaatgcatggatgggcataaatggaaatactggtgacatcactgacatgaaagagtgcaagatctgggatgcttacaatgtgaaagcacaaacatttaagactgccattgaagctgcttgcatgcttctgcggattgatgatgtagtgagtgggatcaagaagaggcaggcccctggagcaggccaggctcgttcaaagcctaaggttgagaccgaggtagatgctgacagtgagcaaattcttcctgattga

SEQ ID NO: 1457 - DNA, 1068 bp, Glycine Max
gctttttctgttgctgatacaaagagtagaaaatcatgtctttatgccatcttcccagcagcttctttaatttgtgttgttttatttttcatgacctcggccttcacacaagagaaccagtgcaggcctagtggaagtgaggcattacctgcaggcatagtctccatcacttccaatttggaattgcgacctttgtggaatcctcccatgcctaagaagggtcgtcacacaatagaacttaaggtaaatgcatcaaccaatttgtttgcaatggtagttgggataaaacagaaagatcttgtgaacaagatggttaaaaagtttatagacagtaatttcgtcgtgatgctcttccactatgatggtattgttgacgaatggaaggatctcgagtggagtagtcgtgtcattcatgtgtcggcaattgatcaaagcaaatggtggtttgccaaacgattcttacaccccgacatagttgcagaatatgattatattttcctttgggatgaggacctaggagttgagcattttcatccagataagtatgtttctatcatcaaacgtgaaggactggagatatcacaaccagcactggaccctaaaaaatcagaagtgcatcatcagattactgcacgtgggaggaggtcatcggtgcacagaaggacatatagagctagtaatgatggtaaagggtgtgataaaagcagcactgccccaccttgtacagggtggatagaaatgatggctcctgttttctcaagagctgcatggcgttgtgtttggtatatgattcagaatgacttgatccatgcatggggtctagacatgcagcttggctactgtgctcagggtgatcgaacaaaaaaagttggtgttgtggatgctgaatacattgtccactacaatcgtcccacccttggaggcatagataagactatggtttcatctcaggaaaaggatcatagagttgatgtgaggagactttcttaccaagaattagatatctttagaaaacgttgggaaaaggcagttgaggaggataaatgttgggtagatccatttcaatag

SEQ ID NO: 1458 - DNA, 881 bp, Glycine Max
ggaatttgtatccttctctttctcttcctccttccttttgctgcggcacaacatggcaaccaaaacgaatcgtattacaacaagttcagcccttccatggcgatcataatcgtgatcctcatcgccgcgctgtttctaatgggcttcttctccatctacatccgccactgctccggctccccctccgccagcatccgcaacctccctgccgcctccgggaggtcgcggcgcggctcgcgcgggctcgaccaggcggtgatcgacacgttcccgacgctggagtactcgacggtgaatatccacaagctgggaaaggggacgctggagtgtgcggtgtgcttgaacgagtttgaggacaccgaaacgctgcgtttgatccccaagtgcgaccacgtgttccaccccgagtgcatcgacgagtggctagcttcccacaccacttgccccgtgtgccgcgccaacctcgtcccccagcccggcgactccacgctgaaccggaaccgcaccagaggctcccagtcgggccggccccggcggttcccgcgctcacactcgaccggccattctttggtccaacctggcgaggatactgaacggttcactctgaggcttccccagaaagttagaaagcagatactgcagaagccggaactgcatcgcgcgagaagcttggttatcttaccgagagaaggtagttcgcggcggggatatcgaaccggtgagggaagtagcagagggaggtcctcgaggcggttggaccggtgggttttcagcatggcgccggctttctttgtgagagcgtcgtcgattaggtcgcccagggtggccaataacggcgccgacggaacttccgctactgcgcctttgccgcctgctgtgga

SEQ ID NO: 1459 - DNA, 492 bp, Glycine Max
ggactttcttttttctttttcagatcaaatttcgtcggcaccacccaccgccacgccgacgaccttcattcgctgtcggcaacacatcccttctgctgcgtcttcgtcgtctctgaccactcctccctggtcaagcttcgccgacctcatctagcccctctccccgtcgccatagcgagatccgtcgtgagatccagtccgtttctctctatcatttttctgattttttttccagatctgagattagctcctcccagatctgagattcgttcctcccttggtgtcctccttttccgcctcgtcctcgtcggtaactccattgacgtcgtcactgcgagatctagacccgctcctcgctgccgcctccacacgattgcttcaggaaccgctttccctttatttgttgtggagaatttggctgggaaaatgtctttgttgccaaggagaaagtgttctaatgaaggtgagaaagatagaattcagttgtcgtag

SEQ ID NO: 1460 - DNA, 2181 bp, Glycine Max
ggcttcagacctttctccttcgagatctcgccccacgcgcctgtttccgcctccatcatggtcgtgagcggagggaagggcctcaaacgcgccgcgaagaagagagtcaccgccgacttctacgacttcctaacgttccccacgccggcgctcgccgagtcggagaacttcgccggcggaccgttccgctccaacgtgcgcgcctttctgacgaagcacgcgctgcttccgccaccgtcggcgctctttccgcacctgctgacgtggcagatcgtcttccgcgtcggcgaactcaccgagggccccgacgcgccggcggtgtgcctcgacgtcgtcgaggaggatgtcgccagatccagatccgtttactgcgatcagtgccgagttttcggttggagcggccatccagtgtgcgggaaacgttaccattttataatcaaagccgatgggagctccattggtgggtaccacaagccgtgtatgtgctgtggagacatcttgcatttgtcagaatccaaatgcaagtcatgcaaccatgtgaccaccactgatgacgtcgaagactgggtgtaccaccaattagaaaacacaactcatcttttacatggagtagtccatgccaatggatatgggcaccttcttcgggttaatggaagagaagggggctctagatttctttctggtattcatattatggatttctgggatcgtctatgcaagactcttggagtcagaaaagttagtgtgatggatgtttcaaagaaatatgggatagagtatcgcatgctccatgccattatgaagggacatccgtggtatggtgactggggttataaatttggctctggtagctattgtcttactcatgaagcatacaagtctgctgttgaaagcctatccaatctacccttgtccaccttttcccacggacggatgcccaactctcgtgtggaggacatgattaaatattaccagtctttgtcagagcacgagcttgtaaatataagggacctcttttgtttcataatgggtttgattggtgatgctcacaagactgcatcaaatgttgatgagacaacctgcaagaagcgttgttttaatgcttctggactgtcaatgtcatgggataagagtggcattgaacgtgtggagcaagccatgatcagagtgctgtgtgcagtgtctgagtccaagtgggtgagctggcgtgctcttaggggtgcagcctccaagttgggctctccagagctgcttgattattgccttggagaactgggaggaaaaatggtctatggtggaatggttgttaatagccaatgcaatcctcaaactggagtttatgagttcagacttgaggctgcaactggtgcttgctatggaattttagcaaagaataattctctgggctcgaagtatccatctgaagaaaacctcctacaatgcttgagatatttatacgactctttgcttcatcctcagatgatggtaaactatgaagcagggacaaggactcttgcaatgaactcagctcagaagctttttgactgcaagcagtttgtaaaagattataatcctgagatgtggccattgtcagattcgcagatgtttcgcctctcatgtcatgttgaacttgtagatgaatttgaagattcagaagctataactccaccagaattagttgtgctgcccctgaatgccacggtggctgagcttaagaatcaagcagcaaatgcttttcaagatgtatatctaaggttcagaagacttcaagttgatgggctacatggttatagcggtgtcgacgattccacccaggtcaagctcttgttaggatcgagagatgtagtttgtgtccgaggaagatgcatcgggaagaatgggttgagcaagttccgaatggaaaggggacttgagaggtggactgtagattgcagctgcggggccaaggacgatgatggagagagaatgttggcgtgtgatatatgtggagtgtggcgacacaccaggtgttctgacatccatgatactgatcctgttccagctcgttttgtttgcctgaaatgccaaaactgtgaatcaaaactcaaatgtagtgggcactgcaaagatgagaccgtgactaacgttagtggtagtagttgcttcagaaacggcttgccagtgccatctgatgttatttga

SEQ ID NO: 1461 - DNA, 4657 bp, Glycine Max
gggactccagtgaatattattgtgggttctcatgtctggattgaagacccagaggtatcttggattgatggacaggtattaaaaatcaatggaacggatgctgaaattgaagataccaatggaaaaaaggttgttgcaaatttatcaaaaatatatcctaaggatatggaagctcctcctggtggagtggacgatatgactaaactgtcctacttgcatgagcctggagtcctgcagaacttaaaagctagatatgaattgaatgaaatatatacttatactggaaatattctgattgcaataaatccattccaaagactacctcatatttatggtgcgcacatgatgcaacaatacaagggagctccatttggggaattaagccctcacgtgtttgcagttgctgatgttgcatatagggcgatgattaacgaaaaaaaaagcaattcaattctagtcagtggggaaagtggagctggtaaaactgaaactacaaaaatgcttatgcaataccttgctttcttaggtggtagggctggtaccgaagggcgaacagttgaacaacaagttcttgaatcaaatccagtactggaagcatttgggaatgctaaaactgtcaggaataacaattctagccgttttggtaaatttgttgagatccaattcgataaaagtggaagaatatcaggagcagccatccgaacatatcttctagagagatctcgggtttgccaaattaatgatcctgaaaggaactaccattgcttttatcttctttgtgctgcaccacaggaggaaattgagaaatacaaattaggaaatcctagatcgtttcactaccttaaccagtcaaaatgctatgaactggctgatgtaagtgatgctcatgaatatcttgccacccgaagagctatggatattgttggaataagccaaaaagatcaggaagccattttcagagttgttgcttcaattcttcatattggtaatattgaatttaccaaaggaaaagaagttgattcatcagttccaaaagatgacaaatccaaattccacctgaaaacaactgctgagcttctcatgtgtgatgctgatgccttggaagacgcattatgtaagcgtgtcatgatcacccctgaagaagttataaaacggagccttgacccccaaagtgcagcaatcagtagagatggattggcaaaaacaatctattctcggctatttgactggttggtggacaagattaataattccattggacaagaccccaattctaaatctttgattggggtccttgatatctatggtttcgaaagctttaaatctaacagggcattactgaagatattgaaagcaaactacctctacttattctcaattttgagcaattttgcattaatttcacaaatgagaagttgcagcaacatttcaaccaggcaaagtctaagaacaaattatgcacttcaacacgtgtttaaaatggaacaagaagaatatacaaaggagcagatcaattggagctacattgaatttgttgacaaccaagatgttttggaccttattgagaagaaacctggaggaatcattgctctccttgatgaagcttgcatgtttccgaagtcaactcatgaaacatttgcaaacaagctttatcaaacatttaagaataacaagcgctttattaagccaaaattgtctcgaacagatttcacaattgctcattatgctggggaggtattataccagtctgaccaattcttagacaaaaacaaggattatgtggttcctgaacatcaagatttattgagtgcttccaaatgttcttttgtatctggcctttttcctccacttccagaagagacatcaaaatcttccaaattttcttcaattggttctcgttttaagctacaactacaaagcctgatggacacattaaattctacagaaccccattacattagatgtgtgaaaccaaacaaccaactcaagcctgcaatttttgagaatgtcaatattatgcaacaacttcgctgtggtggtgttttggaggcaatcagaatcagttgtgctggctaccctactcgtcgtgctttctttgaatttataaacagatttggcatccttgctacagaggccatggaagcaaactgtgatgaaaagactggttgccaaaagattttggaaaagatggggcttcaaggatatcagattggaaaaacaaaggtattcttgcgagcaggtcagatggctgaactagatgcacggagagctcaagtacttagtaatgcagcaaaagttatccaacggcgtatacgaactcatcaagctcgtaaacattatcttgcattgcgaaagaagagcatatatgtgcagtctcggtggagaggaagacttgcatgtaaactctatgagcacttgagaagggaggctgctgctaggaaaattcaaaagaacgtacgcagatatgaagctaggaaagcctataaagaacttcatgtgtcagcacttacactgcaaacagctataagggccattgctgcccgcaataaattcagatttaggaagcagactaaagcttccattattattcaggcttggtggcggtgccacaaagctgccatatattataagaggcttagtagaggtgcaatagttacacaatgcagatggagggggcgcatagccaggaaagaacttaggaaactgaaaatggctgcaagagaaactggtgcccttcaagaagcaaaggataaactagaaaaacgagtggaggaactcacttggcgtctccaactagaaaaaggtttaaggaccaatctggaagaatccaaagcacaggagatagcaaaagtgcagaattcattgcaggagatgcagaacaaatttgaagaaactaatgctctgctcatcaaagagcgagagaatgtgaagaaagttgttgaagaagcacctcccgtcattaaagaaacacaagttattgttgaagatacacagaagattgagacactgactgcagaagttgagagcctaaagacttcactcaagtcagagaaacagaaagctgatgactttgaaagaaaatacaacgaagcccaagtttgtagcgaagaaagaggtaaaaaactggaagacacggagaagaagacacgtcagcttcaagaatcactgactaggctagaggagaagatcactaatttagaatcagagaatcaggttctacgtcaacaagctgtgtccatggcacctaataagttcctttcaggacgttcaagatcagttgtccagagaactgaaagtggtcatattgtaccggaagcaaagacaactctggaaatgcatagcacatcaatgcaccggagggaaccctctgacggcttggatgacaaaccacaaaagtcactaaatgagaaacaacaggagaatcaagagttactcattagatgtattgcacaacatctaggctatgctgggaacagaccaattgctgcctgtatcatatacaaatgcctcttgcactggcgatcatttgaagttgagcgtactagcgtttttgaccgtatcatccaaactattggccatgcaattgagacccaggataacaatgatatcttggcttattggttatccaatgcctctacacttctcttgttactccagcgcacgctcaaggctagtggtgctgctggaatggctccacaacgccgtcgttcttcatcagcaaccctgtttgggaggatgactcaaagtttccgtggagcaccagctggagtcaatctttccctaataaatggtaacacaagcagaggagtagatacattaagacaagttgaagccaagtacccagctctgcttttcaaacaacagcttacagcatatgtggaaaagatatatggaatgattcgtgataatttgaagaaagaaatttctcccttgcttggattatgcatccaggcaccgagaacatccagagcaagccttgttaagggatcatcacgttcagtagcaaacaccgaagcacaacgcgctttgattgctcactggcaggggatagtgaagagcttaggaaactttctaaatactttgaaagcaaatcatgttcctccatttttagttcgtaaggtgttcacacaaattttttctttcatcaatgtacaattattcaatagtcttcttttaagacgggaatgctgctcatttagtaatggagaatatgtcaaagctggtttggctgaattggagcattggtgttataaggcaacagatgagtatgcaggttcagcctgggatgagctcaaacatattagacaagctattggatttctggtcatacatcagaaaccaaagaaaacattggatgaaataagccatgacctgtgcccagtccttagtatacagcagctatatcggataagcaccatgtattgggatgacaaatatggaacgcatagtgtgtcctccgatgtcatatccaatatgagagtgttgatgactgaagattcaaataatgcagttagtaattctttcctgttggatgatgattcaagcattccgttttctgttgatgacatatcgaaatcaatggaacagatagatatcgcagatatagagcccccgcctctaattcgtgaaaactctggctttagctttttgttgccac

SEQ ID NO: 1462 - DNA, 178 bp, Glycine Max
gggctgtgttctggaatggtggtgttgttggtgaccaaacttgttctttctttacttgcttcccccaatcactttcaatgccgggtaatcaagaagaaacagttcttcaagaatttcacaactatactgctctttggagtcgttggaacagttgtttcattctgtctgatatctgttg

SEQ ID NO: 1463 - DNA, 1521 bp, Glycine Max
gggcttctccggcccagtttgaggctctacagtagtagtagtagcagcagcaatggggagccaccagaggattggcctcacgatcactacgctgctacgcaaactcctattagtgttaatttcattcgggcctctgggcccagggacgggtgggtcggagggtccaatttgggtagggattttcctactccgaaggaaatctgcaagggactcgacaagtttgttattggccagcacagggccaagaaggtgctctctgtagctgtttataaccactatcaaagaatataccaggggtctctttctttcttctttcgctatcatactttctttattcattttgtaattgcagatgaaggactctctcaaggattggatgatggggatgatgtggagctggaaaagagtaatgttctcttgatgggtccaaccggttcagggaagacgttacttgcgaaaacactggctcgttttgtgaatgttccctttgtcattgctgatgctactaccctaacacaggcaatattagctatttctgatttggttccgtggttcactcaaggtttcattgctggttatgttggggaagatgtcgaatcaatattgtataaactacttgcggcagcagagttcaatgtccaagctgctcaacaagggattgtttacattgatgaagtggacaagataactaagaaggctgagagcttgaatattagccgggatgtttctggtgagggtgttcagcaggcattattaaaaatgctggaaggaactatggtaaacgttcctgagagaggagcaaggaagcatccacggggtgataacatacagattgacacaaagaatattctttttatatgtggtggagcatttattgatcttgagaaaaccatttcagagagacgacaagattcttcaattggttttggatcaccagtccgttccaatatgagaactggtggagttacaaatgctgcagtcacatcatctttacttgagtcggtggaaagtgctgatcttattgcatatggtctcatacccgaatttataggacgatttccaatcttaattagcttgtcagctctaaccgaagaccaacttatgcaggtcctcacagaaccaaaaaatgctcttgctaagcagtacaagaaattatttaacatgaataatgtaaagctacacttcacagagaaagctctgagattgattgcaaagaaagcaatggccaaaaatactggtgccaggggtttaagagcactactggaaagcattttaactgaagccatgtttgagattccagatgttaaagcaggaaatgaactcattggtgcagttgttgttgatgaggagtcagtaggatcagtaaatgcccctggttgtggaggaaaaattctttgtggagatggtgctttggaactgtacctagctaagatggagggttcagtggctaacggtgccgtagctgagccagacttacaagaaggggaatcagagatttcatcaagagccgtgagcatgtaa

SEQ ID NO: 1464 - DNA, 534 bp, Glycine Max
ggtccaaaagtcaatgcaaagttcgagctgaagccgccaccatatccactgaatggtttggagccggtgatgagccagcagacacttgagtttcactgggggaagcaccacaagacttatgtggaaaatctgaaaaaacaagttgttgggacagagcttgatgggaagtcactagaagagattattgtcacatcatacaataaggtgcaggtatggaaccatgacttcttctgggagtgcatgaaaccaggtggaggtggaaagccatccggggagcttctagaactgattgaaagagactttggttcatttgtaaaattccttgatgagttcaaggctgctgctgcaacacaatttggttcagggtgggcttggctaccacttcttaccattgatgtttgggagcatgcttactaccttgattttcagaaccggcgtcctgattatatatcagtgttcatggataagcttgtttcctgggatgcagtgagctctagacttgaacaagctaaggctttaattaccagtgcatga

SEQ ID NO: 1465 - DNA, 1176 bp, Glycine Max
gtagatgaattaagttattcatcagagtcactggccacgagggactattcggcaagtggtggtttatcatctcgacctggtgaaattgagacggaggtggacaataccaacattgaagaagcagagtcctctctccgtgaaagtggttatttgaactatgaggaagccagagcattgcttggaagacttgagtatcagaaaggcaatatcgaagctggacttcatgtgtttgaaggaataggtattgctgctgtcattcccaagttgaaagtttctatatctagaagatgtgaacccaatagatgccgttcgcaaagtgatgcaatgacgcttgggcctcaggtatgttctgaatatgctgaacagaggaagttaagcattgcgtttgatcatgaaaagaaactgattaagcttgagggtggatctagtgttagtggatatattctactagcacggattttatcagctcaacaaaagtttgtagatgcagagcttgttatagatgctgctctagaccaaagtgggaaatgggatcaagatgaattgttgagaactaaagctaaactacggattgcacagggaaaattaaagaatgcagttgagacacatactcttgcagttcttcaggtccaaaataaaagtttaggcacagcaagtaatgttgtgaagaataataaaaattacttttctgatttatcttttgtacagaataagggaaaccgtgacagaagtctggaaatggatatatggcttgatttagccaatgtgtacccagccttatcgaagtggcaagatgctgaagtttgtcttgtaaaatctgaggctattaatccctattctgcttctagatggcacacaaaaggtttactttttgaagccagaggtcttcatcgagaagctttgaaatcatataggaaaggattggatattgagcccaaccatgtgccaagtttgatatccacagcctgtgtactcagacaacttggtgatcaatcatcttcaattgttagaagccttctcaccgatgcactacgccttgacagaacaaaccctcctgcttggtacaatcctggactgctctacaaagctaatttggggacatcagcaatggaaactgttgaatgctttgaagcagcagcttttcttgaagaatcttcttccattgaactctttaga

SEQ ID NO: 1466 - DNA, 180 bp, Glycine Max
gtcagcatcgtggtggtcactcgcgaagaaggaaggttagtggttggaagattagggtgcaaattgatcaacaacaactttgttgaccttcgaaaaccccaacttgaacttgatggcaaggcttgtgtcgctatcggacataatagtctcatggctctccacgatactctctttactcaa

SEQ ID NO: 1467 - DNA, 1499 bp, Glycine Max
gtcataacaatcaatggcatgttccctggaccccttataaatgcaacaacaaatgatgttgttcatgtcaatgttttcaacgatttggatgatcccttgctgtttacatggaatggcatacagcaaaggctagattcatgggaagatggagtgtctggcacaaactgtcccatccaaccaggcaggaattggacttatgaattccaaaccaaagaccagattggcacattcttctactttccttccatcaatttcctcaaagctggtggagggtttggtccaattcgagtcaacaatcgacccgtgataagtgttccttttccaaaacctgaggcagagtttgattttctaattggtgactggcacagcagtagctacaaggatattaggtccaggttggatgcgtcggatgttcttcctcctgattggatgctaataaacggaaaaggaccatatatgaacaatttatctctatcatatgagaccttcaatgttacacaaggtaaaacatatttgctcaggatatcaaacgtagggacagcctggagcttcaatttcaggattcaaaaccatcaaatggttttggctgaaactgaaggttcttatgtcaatcaaatagagttggagtctcttgatgttcatgtaggccaatcctactcagttcttgtcacagcaaaccaaagtgctgctgattactacatagtggcctctcccaaaatgagtaatgccacaaataataacactcttgtcggtgtcgctgtgcttcattatgataactctaccacaccggctactggttctctgccaagtggtccagatccatttgatctgcaattctccatcaaccaagcaaaatccattaggtggaacctcactactggagctgcaaggcctaatcctcagggaacgttcaatgtaaaaaatgtggcaatatctgagactttcattttccaggcatcaacagcagtggttgatggtttatatcgctacactgtcaacaatgtgtcttacttgaccccaaatacaccactgaagctagctgattacttttctaacggaactggagtatatgaacttgatgcttattctaagaacagttcaaatgttaatgctgtgcgtggagttttcgtagccagtgcattacataaagggtggacggagatagtgctcaaaaacaatttagacatcattgatacttggcatttggatggatacagcttctttgttgtcgggattggggaaggagaatggaatccagaatcacggtcaagttataaccttaatgatcctgttgctcgctccactgtgcaagtgtaccctggagggtggagtgcagtgtatgtgtaccctgacaaccctggaatgtggaacctgcgatcacagaacttgcaaagctggtatttaggtgaagagctctatgtgagggtttatgatgctgatcccaaccctgccaaggagaagccacctccacagaatctccttctatgtggtcagttcat

SEQ ID NO: 1468 - DNA, 1578 bp, Glycine Max
gtctccttcatctgcttcaactctgcatcgaccttcgatctcagaaactcgcccaacaatctcacgctcaaatcctcgccaatgggtttgcgcaaaacactttcctcgaaacctgcttacgccacgtgtggcgagttaaccgcgtcgaggttcgtctttgagtccgttgaggccaagaacgtttacctctggtactcactgattaatgggtacgttaaaaatcacgactttcgccaagcccttgctttgttccgcgaaatgggtcgcgatgaggtgttgcccgatgactacacacttgcaacggttttcaaagtttgtggtgaacttgaggacttggtttccgggaaattgattcatgggaaggtgaaggtgttcgatgaaatgcctcggaggaatgtgggttcatttaatgtagtaatttctggatgtgctgcattggaaaattctaattctacttcccatgatgatttatggaatttttttgtgagaatgcattgtgaagggtttaaggctgatgctttcaaggttgcgagtttgctgcctgtgtattgtagcgatactgggaaatgggattatgggagggagcttcactgttatgttgtgaagaatggattggatttgaagatgggttcagataggagtaagaaagttgttcttggaaggagagtgtttgaccaaatgaaaaacatgaatgtgtatgtttggacggcaatgatcgatggttatgtgcagaatggagtacctgaggatgcactggttcttccccgtgagatgcaaatgaaggatgggatacgacccaataaagtatcacttattagtgtgcttcgagcttgtgccttgcttgctggattaataggagggaaacaaatacatgggttctctattaaaatggagttaaatgatgatgtttccctatgcaatgctttaattgacatgtattccaaatgtggcaatgctgtcacttggagttcaatgatctctgcatatggattacatggaagaggagaagaggctattattacgtattacaaaatgcttcagcaagggttcaaaccagacatgataacagtggttggtgttctttctgcttgtagcaagtcaggattggtagatgaaggcattagtatatacaagtcactgatgacaaagtatgaaataaaaccaacaattgaaatttgtgcttgtgttcctcggaattcatcaaagatatgccttagtccaagtgtttggggatctattttaactgcctcggtaatgcatgggaattcaaggacaagagacctggcttattggcatctcttagaactggaacctgaaaacccttcaaattatatctcactttcaaatacatatgcttctgatagaaaatgggatgtggtaactgaggtgagaacgattatgaaacaaagaggcttgaaaaaggttccaggttgcagttggataactattagtgggaagactcattctttttctgttgctgacaaagcgcatccttcgtctagtttaatctatgaaatgcatgatgaccttgtatcaataatgatggatggttgtgctgatattgatatcctgacttaa

SEQ ID NO: 1469 - DNA, 2031 bp, Glycine Max
gtctggaaaatattggaacttagagttctggttttactgagtttggccttccaaataatgctaatagtttttggcaaccaaagaaagtaccaagcaggtaaggagctacaattggttgtgtgggtggcctatctgttggcagatttggttgctacctatgttctgggcattctttcaaaagacagcaaagatcatccagtacacatggccatctgggcacccttccttcttgtgcatcttggtggccctgacacaattactgcctatgccctggaggataatgagctatggaaacgacactttcttggaataatgacccagatattcggagcagtttatgtggtttacagttcatggaatggaagcaagcttaattatgttaccattccagttatggtggcaggagtaatcaaatatggtgagaggacttggtccttgtggtgtggaagcagtgaaaagttcagagaatccattctccctcctcctgacccaggaccaaattatgccaaattcatggacgactgcactgcaaaaaaagctgaaggatataaagttgaattgaaggtcaaagatacttccactttatcatataactctaaaggagcaatagcaaatgaaaatgtacaagatgctttgctcttacacgatggattctatttctttaaaatttttgagcgcctatttgcagatctcatccttagcattcaagaactcaaaatcagccgaaattactttcagcacaatggcatgtcatgggagcgtgcgtttaaagtaattgagtgtgtgacccttttctgcaccctctctgcgtttattacatttttatgtctgacagataaagcacacatggattttgaccagattataactgctgtgcttttcgctggggctattttacttgagatatgtgcgggcatcatttttgcttcttcaagttggacaatgttttggttaagcacgcgcaagaattggatagttgatcttctcatcttatgttttcaaagattttataaatgcttacatgctaagaggtggtctaatcgtatatcacaattcaatctaatgagtttttgcttgaaatgtgagctacacgaacgcgtcaaaatctggaattgccaatccaagtatcagcttttcaagaagtttcaccaaaaaccagaaactgtctccaagaaattgaaagaagtcatatttgaacagattcggggtaagtctaaggctgcaaaagacattgagaaatgtaaaaaattttgcgctcacaggggtgatggagttcttcgtgctttgaagtgcaactgcaattccattgccaagagcactgaggtagagtttgatcaaagccttctgcttcggcttattgattccattgccaagaccaccgaggtagagtttgatcaaagtcttctgctttggcatattgctaccgatctttgcctttattcagataaatcagaatcagatgcaaattatgaatcagaatcaaatgaaacagatacaaattgtgcctggctccaaaattataaaataagcaaattgttgtcaaattatatgttatatcttcttgttgaatgtccttttatgttgcccaacggaataggacagatcagatttaaggacacgtgtgctgaagtcagtgaaattttgcaagaaaggaagtacatatcagaaacagatcaaatttgcaaagtgctagatcgagtgagtgtagatgaagagtttccaccgacaaaggttaaaggagaccgaagcaagtctgtgttgtttgatgcacagagacttgctaaatccataaagtctttagaacaggaaatgaaatggtcgaaagaagagaaatggagaatgataagtcgtgtttgggtggagatgttgtgtcatgcagcaagccagtgtagagggtttcatcatgccaaacagcttagccgaggtggcgagttgcttacccatgtctggcttttaatggctcatttaggtataactgaacagttgcagatttcaaaaggtcacgcaagggcaaagttgttactcagctaa

SEQ ID NO: 1470 - DNA, 2010 bp, Glycine Max
gtctggaatgtactggaaatccgagttctggttttattcagtttgatcttgcaaataatccttatagtttgtggcaaccaaagaaagtacaaagcaggttgggtgctacaattcggtgtgtggtttacctatctgtcagcagattgggctgcgacctttgtgctgggcattctttccaaagacagcaaaaatccttcaacagaccccaccaactccataatcatggccatctgggcacccttccttcttgtgcatcttggtggccctgacacaatcactgcctactccctcgaggataatgagctatggctacgacactttcttgggttaatctcccagctatttggagcagtttatgttgtttacagttcatggaatgacagaaaccttaactatgttaccattccagttatggtggcaggaataatcaaatatactgagaggactttgtccttgtggttgggaagcagcaaaaagttcagagaatccattcaccgtccaccagacccaggaccaaattatgccaaattcatggatgactgcactgcaaaaatagctgaaggatataaagttgaattgaaggttgaatctactcccatattgtcggatcactctctagcggcaatagcaaatgaaagtgtaccagatgctttgcgtttgcactatggattctatttccttgaaattttcgagtgcctatttgcagatctcatccttggttttcaagaactccaagaaagccaacatttctttcagaacaaatcatgggaacatgcgtataaagtaattgaggttgagcttggattgatgtatgataagctatatacaaaggcagtggtaacatactctcgccttggccttttcctcaaaattgtgacctttttctgcaccctctctgcatttattgcatttttatgtctgatagataaagcacacatagattgtgaccaaattataactgttgtgcttttcgctggggctatttttcttgagatatacgcaggcatcgttttactttcttcaagttggacaatgcattggttaagcaagcataagaattggatcgtgaatcttctcatctcatgttttcaaacatgctataaactctcacatgctaagaggtggtctaatcttatatcacaattcaatctcataagtttttgcttgaaaggtgagccagcaaaacgcatcaaaatctggaattaccaattcatgtatcagattttcaggatactttaccaccaagaccaagaaactgtccccgagaaattgaaagaactcatttttgaacacattcgggagaagtctaagggtgcaaaacacattaaggcatgtaaaaacttttgcgctcacaggggtgatcaagttcttaacaaatggaagtgccgttccattgcctggagcactgaggtggagtttgatcaaagccttctgatttggcatattgctacagatctttgttgttattcagataaagattgtgacaagctcaaaaattatgaaataagcagattgatgtcagattatatgttatatctccttgttaaatgtccttttatgttacccaacggaataggacagatcagatttgaagacacgtgtgccgaggcgagtgaacttttgcaagaaaggaagtacatatcgcaaacagatcaagtttgcgaagtgattggtggagtgagtgtagatgaaaagttcctaccgtcaaaggttaaaggagatagaagcaagtctgtgctgtttgatgcatgtaggcttgcaaagtcgataaagtctttagaagaggaaaagaaatggtcgaaagaacagaaatgggaaatgataagtcgtgtttgggtggagatgttgtgtcatgcagcaagccagtgtagagggtttcatcatgccaagcagcttagcagaggtggcgaattgcttacccatgtctggtttttaatggctcatttaggtataactgaacagtttcagatttcacaaggtcacgcaagggcaaagttgatacacagctaa

SEQ ID NO: 1471 - DNA, 360 bp, Glycine Max
gtgagctttattgttctaacccttatagttacactcacagcttatgtgtgctctaataacattccacgcactattccatctgtgcctggtggtgccacacactccaacaacaaccacaccataatcactgtggagacacctgagccacgcttagatcacactagtgtcagaagctatcctagtctccaattctccaaggccaaattgtgtagtagcaatagtaatagtagctcttcaagttgttccatatgcttgatggattacaaagagtgtgattccttgagagtgcttcctgcttgtgctcacttcttccatgtcaagtgtgttgatccttggttgagaatcaatttgacatgcccg

SEQ ID NO: 1472 - DNA, 963 bp, Glycine Max
gtgcaaaccctaaacactaacccaactcacttcaacccacaggtcccacccctccgaaccctctcgtcctcgaagcgcttcgaggggtcctcggagttcgtcaagctgaaataccacatggggccggtgctttcatctccgatcaatatctacctcatctggtacggcaagtggccccaatcccagaagctcctcatcaaggacttcctcaactcaatctccgaccaccgcgccgccccctccccctccgtctccgactggtggcgcaccgtctccctctacaccgaccagaccggcgccaacatctcccgctccgtctccatcgccggcgagtactccgacctccgctactcccacggcacccacctcacgcgcctctccgtgcaggaggtcattgccaccgccgtccaggccaagcccttccccgtcgaccaccgcaacgggatctaccttatcctcaccgccgaagacgtcaccatggaagacttctgccgcgccgtctgcggcttccactacttcaccttcccgtcgaaggtgggctacacgctcccttacgcgtgggtggggaactccggaaaacagtgccccgaggtttgcgcttatcccttcgccgtccccgggtacatgggcggcggcggacccggccacctcacgccgccgaacggagacgtcggggtggacggcatggtgagcgtgatcgggcacgagctggcggagctctcgtcgaacccgctcgtgaacgcatggtacgccggcgaggaccccaccgcgcccaccgagatcggagatttgtgcgagggcttgtacggaacgggtggtggcggcggctatattggttccgttatgaaagacggcgaagggagaacgtttaatcttaacggtagaaatggacggaagtttctggtgcagtggatttggagccccgttttgaaggcctgtgctggtcccaatgctttggattga

SEQ ID NO: 1473 - DNA, 1119 bp, Glycine Max
gtggtgaaagtaaagagagatacgctacgaccatgcatgacatgccctctctgccacaagttcttcaaagatgccaccaccatctctctctgccttcacaccttttgcaggaagtgcatatatgagaaactctcggatgaggagatggattgctgtcctgtgtgccatattgacttaggctgccttccggtggagaaactcaggccggaccataatttgcatgatataagggcaaaaatattcccttttaaaagaaaaaagatcaaagcccaagaagttttgtcttcaatatcattgcctgcaaaaaggaaggaaagatcactttcatcattggtagtcagtgctcccaaagtttcaatgcagcctggctttacaggaaagagaacaaaaaacagtacaagaaaggctgctgctttacgtggatgcagttttcttctcgacgaatcaataaagaaggaacaaacaaatggtgatgataatatggattctcccatgcctgagcattctaagaagcataagccccatgaagatacagagaacagtgtgcaacatacagaagggaaggttgatctttggacaccactgaactgtcttgttgaagctgccaacagaacaaagtcctccaggatgcatctgaaactacaaccaaaacagacctacctgcttctgcccagacgaagaagattgcgtcctgctggtcagaaaagggttgcagcatctgagatgtctgcctcatccccagccccactcgatgcaacagggggcaagtgcaacagaaaaaacagtcctatttggttttcattagttgcttcagaggaccagaaaggagattttcccttgccacagatctcagcatgttacttacgaataaaggatggtactgtgcctgtctcatttattcaaaagtaccttatgaagaaacttaatcttgccagtgaagcagaggtggaaataatgtgcggaggtcagccagtgctcccatctttacaactgcataatttagtagatctatggttccggacagcatcaacctcaaaaaagataccagcatcagtgggttcctcagccaaagattttgtcatggttttatcatattgtcgaaaggccttgcctccttga

SEQ ID NO: 1474 - DNA, 438 bp, Glycine Max
gtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagagggtgacactaaaggatctgctagaagtggtgatggatctgctacaccagatcaagttggccttgcaggtcaaaattctcag

SEQ ID NO: 1475 - DNA, 190 bp, Glycine Max
tatagtacagcacaaccaagtgggcagccaggttatgttcaacccactcccactcaaactggttatgaacagtctaacacgcaaccagctggttatgcagctgtcccggcaagtgctccggctgcgtatggcaaaacattgtcgccccagcctgctgcttatccccaatacgactcaacccaagtttatg

SEQ ID NO: 1476 - DNA, 354 bp, Glycine Max
tatgatgtgacacggcgtgagacatttacaaacctcatcgatatatgggcaaaagaagttgagctttattcaactaatcatgatagcatcaaaattcttgttggcaataaggtggataaggagagtgaaagagctgtaagcaaagaagagggtatggctcttgcacagcaacatagatgtttgttcctagagtgtagtgctaaaactagagaaaatgttcagcaatgctttaatgatctcacattaaagatattagatgtgccgagtttaagggaaagggggtctgttgcagtgaaaagacaaaagcagaaacacatatatgagacatctaaaagcggtggttgctgttcttag

SEQ ID NO: 1477 - DNA, 252 bp, Glycine Max
tcatcacctccacgtgacctgatctcgagcctcacggggcaggaccacactgacttcggctacaacgtgatcaaggacgtgctgatcgtgcaacgcttcatcagagagtggggcgacgtcgttataacactcaaggagggcatcaaggtcgatctcaagagtgtttccaagttcagagaaaacgtcaagtactacctcgtcatgactcaaaaacccctcatctttgacgaaactggacccaaagacttctag

SEQ ID NO: 1478 - DNA, 795 bp, Glycine Max
tctactctccaaattccaccatctaaggcttgttttgtgcagcggttcatgcgctttttggcacacaatggaatatttgatatccatgagagacaagaagatcatgaaccaacatatgctctcacctctgcttcaaagcttcttgtcagtggcagtgatcactgtttatctccaatggttctgttgaatactgatcaacttctgacgagtacataccatcagttgggggagtggattcgaggggaggacctttcagtatttgagacagcctacggaacaagcggttggagatttttttttgagaaaaaccctgaatattttaggcttttcaatgaggctatggcaagtgattcccgaatagtagacttggcactcaaaaattgcacttcagtttttgaggggctagatcccatcgtggatgttggtggtggaactggaaccacggccagaattatctgtgacgcatttcctaagttgaaaaatgattttttactttctttccagtggattttacacgactggaatgaggaaaattgcataaagatcctggaaaagtgtaaatattctatttcaagcaaaggcaacagagggaaagtgattatcatagatacaataataaatgagaagctagatgacccggatatgactctaacaaagcttagtttggatatagctatgtggaccatctttaatggaaaagagcgaactgaagaagaatggaaacaagtcttcactgaagcaggattcaaacactacaaaatacttcccatctttggttttagatctctgatttag

SEQ ID NO: 1479 - DNA, 2271 bp, Glycine Max
tcttcctcatatcagcgtgtcacagggctcagatcgaaataccaattaatcaaagacgaaatggacttgatgaatgcactgattgatgatgtaggagagcttggaaaactagagggaagatccgaaatctgggttgagcaaatgaaaggtattgcctcagaggccgaagctgtcatccgcgagtgtgatagtgaattggagagtaaccactatttcaaacacctgctggtgcggtataaaattatgggcaagatagaccggatcacagaggaaattgaagatgcctcgagaagaagaaacgcatatggcttggttcaacttcaatcccgagatgagtcactgtccacggttcaaatgttacgtcgaaagtcagaacaaccatctctcattggcaaagaatccataatcgttggtaaagaattcacaatcattggcttcaatgaagacgtggattttttgacggaccacttactctcgaatgaggaaagttgctgcgttacttcaatagtaggaattgaaggcacgggtaagacaacactagccagattgatttttgacaacaaagctgttgaagatggttttacttgtcgagtaccagtgtcagtgtctccaggttgcacagttgacaaacttttagaagaaatagcgaaggaggctgccacacaaattatgggaggccaacggaacaaatggacaatacaagaagcactcagagccttggggagtacaaagtatctcatacttgttgatggcattgaaacttgccagcttttggacagcttgacagaggccatacctgacaagtcaaaaggaagcagatttcttcttaccactcgcaatgcaaatattgtagcccgacaaccaggtacaagatcctttgtttaccatctacagttattggacgatgaaaatagttggattcttttcaaaaaaaagttgaaagttcccattccctcagaaccaaaactaatagaggttgcaaaaaaaattgtggccaaatgcgggggcctgccattggaaatattaaaaatgagtgaattactatcaaataaagatgtcacagaagagcagtggtcaagggtgcaagagcagcccaatccaagtcaaaacccatggtctgaaacacttagctcagtcaccatcagcttaccttcacatctgaggagatgcttattttatcttgaattattccctgctaattttgggattcctgcaagaagattggttgtcttgtgggttgcagagggtttagtgcagcatggggagaaccaagagccaccagagcaagtcgcagagagatacttgacaaagctgatagatctgaacttggttcaaattgccaagagaaggcccaatggcaaggtcaaaacatgccgtctccctaatgctttgcgtgaaattttggtggaagaaaatacgtcagcttccttgggaatctacaaggatgttttctccttcctgtcctttgattttcgagaaggaagtaaacctggccaagacataagtaactttctgaacctgtgtatttctagcaagtgtcttttactgcttcgggtgcttgatctcgaaggcgttcacaagcctgagttgcccgaaaacattaaaaagcttgctcgattgaggtatcttggcctaagatggacttatttggagtcacttccatcatctataagcaaattgctgaaactccaaactcttgatctgaagcatacttacatacatactctaaccaactccatctggaagatggaactgagacacctgttcttgagtgagacttatcgtaccagatttccacccaaaccaagagctgcaggtgattctctgtctgacctccaaacattgtggggactttttgtagatgaagagactccggtgaagggtggtctggacaaattggtcaatatcagaaaactgggaatagcatgccaatcaatgtcaccagaacaaggggcaatgcaatcacaacttgatgcattacctccaaatcttgttgaacttaccctatcacattcaaaacttgaggaagaccccatgaaaattttgaaagatcttccaaatctccgctcattgtctttacatgcagaatcctacataggaataaaattggtctgcaattctaaaagctttcctcagctttatgttctaaaagtttggaagctggaacaattgaaggactgggaagtaaagcaacaagcacttccctctcttagacaactggaaatccgatcatgtctgcgcatgacaaagcttcctgatggactaaagcat

SEQ ID NO: 1480 - DNA, 222 bp, Glycine Max
tgccgccgctcaacttcgtcatggtcgacaacggcactaatttttagggttggctttcccgattctgccaacttcgaattcctgaaatcactccgtctccgttacgtaatatgtttgtgccctgaaccgtatccagaaacgacttttgaattttttaaggccaacggaataaggctttatcagtttgggatcaatggttgtaaggtttgtattattcctttt

SEQ ID NO: 1481 - DNA, 1062 bp, Glycine Max
tggaatagctggaatcattttggctgcgatgttaatgaaagtgtagttcgagaaacagctgatgcaatgatgtcaacggggctcgctgctttggggtaccaatatgtaaatatagatgactgttgggccgaacttaatcgagatactgagggcaatatggttcccaatgctgcatcatttccttcaggaattaaggctctggctgattatgttcacagcaaaggtctaaagttggggatctattcagatgctggaaatcaaacatgcagcaaacgtatgcctggatcactgggacatgaagaacaagatgcaaagacatttgcttcttggggagttgactatttgaagtacgataattgtgaaaataatggtataaaagccacagacaggtatccaccaatgagtgaagctttattaaaaactggaaggccagtcttcttctctatgtgtgaatggggatggcaagacccagcaacttgggccaaaactgtgggaaatagttggagaacaacaggagatattgaggataactggaatagcatgactaacatagcagatgcaaatgaccaatgggtatcttatgctggacctggaggatggaatgatccggacatgctggaagttggaaatggaggcatgaccacagaagaatatcgtgcccatttcagcatatgggctttagctaaggctcctttattggttggttgtgatattcgatcaatggacaagacaacatttgaactgataagcaacccggaagttattgcaaatgttatggaacttccaaattacaatcttctcattgtgaaaagcaataacgatttggaggtgtgggcaggtcctctcattgataacaaggtagctgtggtcttatggaatagaagttcatcaaatgcaacagtgactgcgtcctggtctgacataggcctcgaaccaggaactatggttgatgcaaaagatttatgggcgaatactactcaacaatcggtttcaggagaaatctctgctcaattagattcacatgcatgcaagatgtatgttctgactccgaagagcccttga

SEQ ID NO: 1482 - DNA, 312 bp, Glycine Max
tgttatggaagagggggaaacattgtggactaccatggctgcgatttctttcctgagcgatggtttgatagcgtggttgtacttcaaactgataacaccattttgtatgatcgtgagtacttactttccacgtatatatgtgaatgtgacagagggtacaaagattcaaagctttcaaacaatattgaatgtgaaatcttccaagttctgcttgaggaggctaaagaaagttactcggaggagaaagtgatcgcaatgaagagtgataatattgaagacattagtagaaatgttgcaactctgacagattgg

SEQ ID NO: 1483 - DNA, 1632 bp, Glycine Max
tgttcatgttcactctgccacttccaaattccaatattaaactatggccggccacaacatatgcatggcttggcttcttgcttggataatcacaatatcaaaaactttaccacgttcccttacaaagaacatgatcattcctctgcctatagttacttcaaaattctcaatttttccatccaaaaccttcggtttgcagaacccgtgattcctaagccaatagccattgtactgccagagagtttggagcagctgcagaaaagtgtagcatgctgtagagaaggctccatggaaataagagtaagatgtggtggacacagctatgaagggacttcatatgttgctgatgatggcactccttttgtcatcattgatatgatgaatttgaaccatgtttgggtggacatggagacagaaacagcatgggttgaaggtggtgcaacattgggagagacttactatgcaatctctcaggaaagcaatgaacatggattctcaggtgggtcatgtccaactgttggagttggagggcacattggtggtggtggatttggtttgttgtctagaaagtatggtcttgcggcagataacgtggtggatgcccttcttgtcgatgctaacggaaaattgttcgaccgcgaaaccatgggagaagatgtgttttgggccattagaggaggaggaggtggtctttgggggatcatttatgcctggaaaatccaggtgttgaaagtgcctcaagttgtaactagtttcactgtatcaagaactggcacaaaaagtcatgttgccaatctagtgcacaaatggcaatatgtggcaccaaacttggaagatgacttctacttgtcatgcttggttggtgctggtctgccccaagctaaaaccacagggttatcaacaacatttaatggcttctatctcggtcctagggccagtgccacatccatcctaaaccaggcttttcctgagttgagtattgcagaagaagaatgcatagaaatgagttggattcagtcaattgttttcttctctggcctaagcgatggagcctcggtctctgacttgaagaacaggtatctgcaagaaaaagaatatttcaaggccaaatcagattatgtaaagaaaaatgttcctcttgtgggcatagaaactgcactagacatcctagaaaaggagcctaagggatatgttgttctggacccttatggtggcatgatgcataatataagcagtgagtccattgcttttccccacagaagaggaaacctgtttacaattcagtacctgatctattggaaagaagctgacaatgacaaaagcagcgattatgttgattggataagagggttctatgctgctatgactccctttgtttcatggggtccaagggctgcatatattaattacatggactttgaccttggagtgatggaggggattggtaatggtgctaatatgaaagatgctgtggaacatgcaagggtttggggtgaaaagtacttcttgagtaactatgacagattggtgagggccaaaactctgattgatcctaacaatgttttcaccaatgatcagggcattcctcccatatctttgaccagtccctatgccaaagcgcagagcaaataa

SEQ ID NO: 1484 - DNA, 303 bp, Glycine Max
tgtttggatgctctactgaagaaatttggtttaaaagaggctagtttcttgccaaccaataaagtggaggatgatgaacagactaggctctaccaaatggacaagtttgacttcagaacatcaaacatgttccttgtgccaatggttgcacttctcatcatcagcatatcttgcttcatagggggcatctacagagtgttatctgtgggagattgggaccagatgttcatacagcttttacttccagcttatatcattgttgtcaactattcaatcattgaaggtttggtgataaggaaagat

SEQ ID NO: 1485 - DNA, 414 bp, Glycine Max
ttatataacattcccaggaattttgattcccagacatgtttcgagcatttttccaatttctcaccaattcattcccatagaggcaacatatttgctttggaattgatggaggccaaattttttcgctttctcaagattgtgggtgttggatacaaagccagagctgaagctgcagggcgtctgttgtatctcaaattggggtacagtcatgatgtggaactagctgtccctcctgctgtccgtgttttctgcttcaaaaacaatgtaatttgctgcactggaatagacaaacaaagggtgcaccagtttgctgctactgttcggacttgtaagccacctgaagtttacaaaggcaagggcttaatgtatgttgatgaagttatcaagaaaaaacaaggaaagaagtctaaataa

SEQ ID NO: 1486 - DNA, 1137 bp, Glycine Max
ttcggagttctaagctgtttgacaaatgatcctatttttgaacgagtcaccaagaatgcagtgtgtggactttgggcatggcgttcaaagcttaatctggttggtggtcatattaatgttttcacaggtgaatggacacaaaaggatgctgggataggaactagtattgactctttttatgagtatctgttgaaggcgtatttattatttggagatgagcagtatttatatatattccaagaagcttatgctgctgccatgcattatctttaccatgacccttggtatgtagaacctgcaggcattttggcctggccttcagctggagatatcaatcctgcaattcgcactcatgctgccttcttgagtgtctggagaagatatggttttacccctgagagctttaatcttgctagtctcagtgttcagcatgggcaaaagaaaaaagaaattgggattaccctttcttgttggacttatacaaattttttgttgataggtgtgttatatcttgatgctgggagggacatgattgctagtttacagtatggaactcgatgcccttgtggatactatcacatttctgatgttgagaatcacatggagagcttcttcttagctgagacggtcaagtatctgtggcttctgtttgatttgtggaaaatgggccatacaagtgagtacatattcagcactgaaggtcatttactgcctgctactcctcaaatctccttactgagggaacattgtttatactatggggcttattgtagaagtggtgatttgagacaaacttactttgtgccagagtctaacaaagataagaaagaatccaatgatgctggactaaagctacatattcttcggactactctacttttgagccaagtgccgtttcagggtttctgcccaggattaaatcatggacagaagtttggtatattatatgcgtattcaactgatgaacaacatgattatgaaaccaagcaagtccaacagaaagaattaactactgtgcaactgcaaagccattcagtattggttcttcgtgaccagagaatggtggggaaggatataattttcaacataacatcaaagggttgcacttttaaaacttgggctggctcagccacctga

SEQ ID NO: 1487 - DNA, 2076 bp, Glycine Max
ttctccaccgataaacactggttgaagcgttggaacgaccccacaaacaaccacgcccgtccgaagccgccatgtgctgttttggactattctgaaaatgggcacgcgtcaaaatccggtcttgcgagctctgacgaggagggtggtgatggaaataccggtggaagcaccatggataggattgtggaaaaactgaagaaatttgggtacgttgaagatgggattcagaataaggagagggtgatagaaaaagggtcagtggaggatatattttatgtggaggaaggaatgttgcctaattcacgaggtgggttttcttcagaatctccattagggtttggaagctttggaagtgatgatagagaagtgaggtttccgtgggagaagccggtggttgaagagttggaagagaggaaatccatgaggagtaggagtaagacctctctggcggaattgactcttcctgagtcagaattgaagaggcttctcaagttgacttttgagaagaagcacaagaccagaattgggaggagtggggtcactcaggctgttgtggacaagattcatgagaggtggaagacttcggagattgtgaggctcaagttcgaaggcgaggccgcgcttaacatgaagaggatgcatgagatacttgagagaaaaactggtggtctggtgatttggaggtctggcaactctgtttccttatacaggggtgtgagctacgaggttccttcagtacaacagaataaaaaaatatataggaaaagcgagaactcttctaagcttttaccaacaccttcttataattctgtggggaatccttcagacattgcttctaattctgggacaagtgcaccattggcaaaattggaatctacaaatgatgagaaagaaagagattatctgcccaaagtcaattatgaacatgaagtagacaagttactggacggtcttggccctagatacacagattggcctggatgtgatccattgcctgtcgatgcggatatgcttccagtaactgttcccggttaccaacctcccttcagagttcttccttttggagtgagagcaacacttggtttaagggaggcaactgctctacgaaggattgcaaggacccttcctccacattttgctttaggtagaaacagacagcttcaaggattagctgtagccatgattaaattgtgggaaataagttctattgcaaaggttgcactcaaacgtggtgtgcagctaacaaccagtgagagaatggcagaagagatcaagaaattgacaggtggtattctactctccagaaataaagacttcttggtcttctttcgaggaaagaattttttatcagcagatgtcactcaagccttgctggagagggaaagaatggcaaaagtaatgcaagatgaggaggagcaagcaagattgagagcgtcatcattgctcataccgactaataatacatcagagctgtcagcagaggcagggactcttggtgaaactttggatgcagatgcaaagtgggggaaaacattggatgagcgtcacaaacaaaaaataatgagagaagtagaacaactacggcatgccaaccttgttaaaaaattagaacagaagctttcctttgctgaaagaaagttaaggagagctgaaaaagccttaatgaaggtggagtcgtttttgaagccatcagaatacaaagcagatcctgaaagtataactgatgaagagagatttatgtttcgcaaattaggattgaggatgaaagctttcttacttcttggtagacgtggggtttttgatggtactattgagaacatgcacttgcattggaagtaccgggaactggtcaagataattgtgaaggctaaaacctttgaacaagtaaaaaaaattgcactagcacttgaagctgagagtggaggtgttctggtctcagttgataaagtttcaaaaggatattctgtaattgtttatcggggtaaggattaccagcgtccttcaacattgagacccaaaaatctattgacaaagagaaaggctttggcacgctcaattgagctccaacgacatgag

SEQ ID NO: 1488 - DNA, 90 bp, Glycine Max
ttgagaaaaaatattgtaggatgcctcttaatgctggtgtctttaacgcctcatttgtttgaaaaactacacttggtatcaaaacaatga

SEQ ID NO: 1489 - DNA, 1314 bp, Glycine Max
ttgaggcatttggaattggagaaagagaaagaaaatatagcatcaccaagaggagtcttggaagcctgcatgaaagactttgactctcacgaccaatcacatgaatcgaaagccacttgttcaaccacgagggcacgctctcactggtccaaattcttcaaaatttggaggaaaaaatcttttaagcgcctaggctccctccctcctcttattagtgtgccaaagataccgaagtggaaaagcaaaagcagcagagaaaaccaagttctaagtaagctatacaacttcaggtcttcttgggtcactttcagcctctctgaactcagaaatgcaaccaacaattttagtgatgaaaatataattggaagaggtggctttgctgaggtttacaaagggtgtctccaagatggacaattaatagctgtgaagaaattgagtaaagggaccacagatgaaaaaaccgcaggctttctatgtgagctaggtgtaattgctcatgttgaccatcctaatactgcaaagctagttggatgttgtgtagaaggggaaatgcaacttgtctttgaactctctacactcggaagtttaggatctcttcttcatggttcagataaaaagaaattagattggagtaaaaggtataaaattgctctgggaatagctgatggtctcctctatctgcatgagtgttgtcacaggcgaatcattcatagagatatcaaggcagagaatattctgctcacggagaattttgagccacagatatgtgattttggacttgcaaagtggttaccagaacaatggactcaccatagtgtatcaaaatttgaaggcacatttggctattttgctcctgaatatttcatgcatggaatagtagatgagaaaactgatgttttttcatttggggtcctacttttggagatcataactgggcgtccagcggtggatcatatgcagcagagtgttgtgatatgggcaaaaccattgcttgacgctaatcatatcaaggaccttgttgatccttctcttggcgacgattataaacgagaacagatgggttgtgttgttttaactgcatcaatgtgcattgagcactctcctatcttacgcccccgcatgagtcaggcaatcataactgtatgtgttgtaacactgctaagaggtgaagaccatgttctgaaagctacaaaatcaagccgaaggaggcctctacaaagagcatactcagaagagctactagacgcgcaagaatacaactcaacaaaacatctaagagatctcaagcgatttgagcagattgcattgggttaa

SEQ ID NO: 1490 - DNA, 1485 bp, Glycine Max
ttgcggtgtagaagttttcagcgaagtgttttaattgatagagctaatgaagttgaccatgaagattggtgctttggaaaggcaccgtttgttcaaaacgatgaaatgaccaacaatgaaattcttcagaggctctgcagtcgtggaaagttaacagttgcggcaaggttgattgatgtcatggcacggaaaagtcaaataccccatttcccttcttgcacaaatttgatccgaggttttattagaaaaggtttggtagatgaagcttgcaaaacattgaataaaatggtcatgtctggtggcgttcctgacacaattacatacaacatggttattggtggcctgtgtaaaaatggtcgtttaagatctgctcttgatctggtagaagatatgagcttgagtggttgctcccccgatgcgattacttataattcaataattcgctgtctatttgacaaggggaattttaaccaggctgttaatttctggagggaccaattgagaaaaggttgccctccttatctcattacctatacagtgcttattgagctggtctgcaaatattgtggggctgctcgagcccttgaagtactggaagatatggctatggaaggctgttatcctgatatcgttacatataactctcttgtaaatttgacttctaaacaagggaaatatgaggatactgctttggttatactaaatcttctatcccatggaatgcagcccaatgccgtgacatacaatactctcatccactctctaattaaccatggatattgggatgaagttgatgatattttgaagattatgaatgaaacttccagtcctcctacacatgttacgtacaatattctgctaaatggtttatgtaaatctggacttttggatcgtgccataagcttctacagcacaatggttactgagaactgttcaccggacattataacgtacaatactcttctaagtggtttgtgcaaggaggggtttatagatgagggcatccagttacttaacctattggtaggtactagctgttctcctgggttggtcacctataatattgtaattgatgggttggctagattgggatctatggagtcagcaaaagaattgtatgatgaaatggtggacaaaggaatcattcctgatgaaattactcacagtagtttgacttgggggttttgtcgggcagaccaacttgaggaagctacagagctactaaaggagatgtctatgaaagaacaaaggattaaaaatactgcttatagatgtgtaatccttggattatgcagacaaaagaaggttgatattgcaattcaagttctagatttgatggtgaaaggtcaatgcaatccagatgagagaatatattctgctttaattaaagctgttgctgatgggggtatgctaaaagaggctaatgatttgcatcaaacgttgatcaaatggaagattctgaaaaaagaaatcatgttgaattag

SEQ ID NO: 1491 - DNA, 573 bp, Glycine Max
ttgtatccaaaggtgaaggtaagacacgacgacgacgacgctgaacttggtctcaaagctttcctctctctatatctgaaaccatctccttctccagtgatggaccagaaagttgtctctacggcatccattgtcaaagcaccaaagtgttatgtgcctgtaactattccaagagtacttgtaactgaagaagattctggagacttcagttcggtatctgattcctcaggagctacaggatccgagaaggatgatagtaccgatgaaaataaagtaaatattagagccagttcgatcccacgccctcgtgctgtcatttctagtcctgaaaatgacatgatgatcgggaatagaaacaagaatggagatggaagactttctgcttcaaagaatggcggtgtgttagaaaatagacatgcacactgtaaagttaaatcacatgacgttactgatattcctccagacacaagaaagcagagggagccagggtctaaggataaagctgatcctgtaggaaagaaaaaggtccataaaggcagcgtaaaattcgaaaatgcaccctggaaattttag

SEQ ID NO: 1492 - DNA, 259 bp, Glycine Max
ttgtgcgaagcagtcaaggactcagagcttgctattgtggtattctccgaaaactatgctgactcagaatggtgcttgaaagaactgatggaaatacttcactgcagaaaaactaagggaatggtagtgatacccgtgttctacgaagtggatccatcacacataagaaactgcacttacatttacgggaaagcaatggaaaaacacaacgacaacgaatccatccaagactggaaagctgctctcgatgaagctgcca

SEQ ID NO: 1493 - DNA, 327 bp, Glycine Max
tttcacttttcacccagaggaatctaccgttattggataattgatatgaatttctttgaaaaactgccaagtgcagatgagagccaaactgcacgaaacaatgtggtagttcttggaggagcatcaaagttgaagccaaaaaaaggacaaattggaaatgacactagcaacaaaaagccaagacctcattataatcactatgcaaatggccctggctggtgggattacgacatggaaggtgttgatagtgaggaattgggcttcagtgatgaagtatgggagggggtgggatccaccacgcttggtggaataatagattggcattga

SEQ ID NO: 1494 - DNA, 2205 bp, Glycine Max
tttgacaactgcaactgcgatgatggggaagggatttggagcatacatagcatactcgttggccaaaaagtcagcgattttttcattgccgttgcttatttttccatacccattgaactcctttactttgttagccgttcaaacgttccattcaaattgctcttccttcaatttattgccttcatagtgctctgtggcatgacccatttactcaatgcttattcttatcatggccctccttccttccaattgctgctctccctaaccgtcgctaaattcctcactgctcttgtttcctgtgcaaccgctttaacccttccccctctcatccctcttctcctcaaaatcaaagttagggagcttttcctgaggcagaatgtgatggagcttggccaagaggttgggatgatgaagaaacagaaggaggcaagctggcatgttaggatgctcactagggaaattaggaagtctcttgataagcacaacatcctctacactacccttgttgagctttctaaggcgttggatttgcataattgcgcagtttggatgccgaatgaggaccggcgagagatgcacttgactcacgagttgaaaaccaactctgccaagaattttcagaattctattccggtgaacgaccctgatgtattggagataagaaagaccaagggggtgaagattttgaggcccgattctgcaataggagctgcgagtagtggtggctctgcggagttgggtgctgtggcagctattcgcatgccgttacttcatgtatcaaatttcaaaggagggacaccccagttggttgagacttgttatgctatacttgttttggttcttccaagttcaagcactagggtttggacctaccatgagatggagatagttgaagtggttgctgatcaggtggctgttgccctgtctcatgcctctgttcttgaagagtctcagcaaatgagacagaagctggaagagcggaaccgagcgttgcaacaagctaaaaagaatgcaatgatggccagccaggcaaggaagtcatttcaggaggtgatgagccatggaatgcggaggcctatgcattctattttggggatgctttcattgtttcaagaggataatttaaggtctgagcagaagattattggtgatacaatgttgaaggttggccatgtgctctccagtttgattaatgatgtaatggagatttcagaaaatgaaaagggaggctttcggttagagatgaaacctttccttctgcattcaatgatgagggaagctgcttccattgccaagtgtttgtgtgtttatgaaggctttggttttgaaattgatgtccagaagtctttgcctgaaacagttatgggtgatgaggcaaggactttccaagtaattttacacatgattggctatttattgaacatgaatgacaaagggactctcaattttcgagtttttcttgaaagtgatggtggagacagggatgataaaaatattggaatatggagatcaagcagtcaaaatgagtatgtacatataaaatttgattttcagattactgagagttctcagtcagacaaagcaatttcaacaatacattatagtagtaggaggcagtactacaacaatgaacctaaggagggcctgagcttcagcatgtgcaaaaagttggtacagatgatgcaaggtaatatatggatatcaccgaactcccttggtttggtgcaaggcatgacacttcttctcaagtttcagataggaccatcacttggaaaatccatatttgcacctaaagattattcaagctcacagttcagaggccttaaggttttgttagccgaggatgatggtgtaaacaggaccgtgaccaagaagctacttgagaagcttggttgtcaagtaattgctgtttcatcggggtttgagtgcctgagtgctataagtggtgctggtaactcattcagaattatcctgttggatcttcacatgcccgaaatggaaggctttgaagtggcaaagagaatccggaagttccacagccgtagttggcccttgattatagctcttatagcaagtgcggaagaacatgtgagggagaaatgcctacttgctggaatgaatggattgatccaaaaacctatcgtacttcatcagatagcaaatgaacttagaacagtcctacaaagagcaggtgaaaaactgtga

SEQ ID NO: 1495 - DNA, 318 bp, Glycine Max
tttgctcttttggcagttctcagatgtcacaaaatcaaagtcaaagacagcgtatcggcaatcattttcaggcaaggatgcagtgaaatcatcatagctctcagcagggcctccagttttttcaacgataacctctttctttttctcatcaattttaaaaatcacatagcgatgaactttcttcctctgcaattccaggaagaagaggcatttccctacattgaagccacacatcaaattctaaacactagtccttttcaaattcaatactttaaccatatttccaataataatgataatgttcttccagtaaaatga

SEQ ID NO: 1496 - DNA, 1464 bp, Glycine Max
tttggtgataatatggagaaaatgaacactgcaagagaaacacctaatttgccaaacagtaagaaggagaatgtaatgaatgacttggagaagaatatttgtgctcaagccaacattggaacagctataatatctgagataaagggaaacaaatctactatttcagatatgtcctgtcatcatcattttatggttgatgaaaggccggttagtaatttattacttcaagcagatgaacctaaatgcaacatggaagaaaatccttcaccaagtaaacattgcaatggagacatagatactggtattgtcaaccaggtggttgaaatagaagatggattatatactagggttgagcatacaatcgaatgtaaaggttctggtgctctaggaataaatttaatatcttctggcatcaaaatgaaggtaaggcaaagtccttatcagatgaggattcaaatgacaataaatgaaggtaaggcgaagtccttatcagatgaggattcaaatgtcagtttatcaaaggaggaagagggccatttaagtgaagagaagcaggtttcaacaagtgacaattggagtaaaaaattcaaaaagcaaactcaagaaacttcatgttctaaatcctatgttaaactggatagctcattcatgaacttgatttcaaacatgatcaaaggatgctcacaatcaattcaagatgaggacaagtctttggctcttaaccttgaaaatcccaatcatcatcttcaacagccagatcagaagcttctcacgtgcaacaagaatcaagatccagagctaaaaaatgcagggttcagatcaaatgttcagtctatggttggtgcaaaatttaagaatgttggaacaataatgtctcaagtcggagaggcttctaaagattttgagccagagaacaatagcctttacagacaacaaaacacaaatgataaggagaatgtcgagtcttatgcactgtatgagagaaaggaaatctgtcatagaagtgataatgtggaaggtctctggataaatcgttttttaccaaagtcaacttcccccttggtagtttttgaccaccttaatgagagaggtggttctgaagatgataagggaaatcaatatcacacagcaaagctgcataagttcaattcctttacacctttcccaggatttagagattcagggccaatgaatagtctacttcacataggtaaaaatggcttgcttgttttatgggacaaggggaaagaaactgtttctctgtggattctagagatggcaaaggcattagttaggcaatacattaaagaaaatacttacattattaacttatggaatggacatctaatttttgtttactttgttccatctctctcttatcctacaggaagacattatacagtggtggtgatccacctcagaagctggtgccgagattccaacagaaaaaaaaaaaaaaactaa

SEQ ID NO: 1497 - DNA, 207 bp, Glycine Max
tttggtggtggtgttggtggaggaataggcaaaggtggaggttttgggggtggtgttggtggcggatttggtggaggtggaggtggtggcggaggtggtggaggaggaggtgcgggtggcggatttggcggaggagcaggaggagggtttggtgcaggaggtggatttggcggaggaggtggtggtggtggaattggacaccactag

SEQ ID NO: 1498 - DNA, 147 bp, Glycine Max
ttttcagcccgcagtacagtgtcttttgagaatggcttaaagacactgaaagcggtttatatggaagatgcaaaaatgaaagtgccccagaagctaatggcagtatccacctccatatttgaggccacaatgattagaactgcataa

SEQ ID NO: 1499 - DNA, 594 bp, Glycine Max
ttttttttagccttcttatgtcactgttctgctacaacattcacagtgggagattcagcaggctggattattccaccatatccaacatactacaataattggtcacattcccatttcataagagtaggcgattctgtagaattcaagttcgatgacaaattctacaacctaattcaggtatcacagaaagagtaccagcattgcacttcacttgaacctctaaggatattcaatagtagcccagtaattcttccactgagggagagaggtgtgttgttcttcatatgcaacatcccaaactactgttgtctaggccagaagattgtgatttctgtccataaagattccttagaaaaaaccccatcaccatcaccttctcaagtgccaatcacaatctctccacatccatcatcaccaaatgcttctgctcctcaaccccatggatcttctagtggcatgagtagccctccatctcctactacaaacacttcaggaggtaatggtgggaactctcctggaccatcttcaactcaagagggaaagtctaatgcagtggcattgctaaataatatatatatatatatatatatataa

SEQ ID NO: 1500 - DNA, 2430 bp, Glycine Max
aaccaccactactaccttcaccttcttcgttcatgcaaatacttgaaccctctgctccaaatccatgctcgtctaattgtccaacaatgcaccttggcacccaattccatcacaaacccttctctgattctgtggaactcattgattagagcttattctagactccatctattccaggaagcaataaaatcgtatcaaacaatgtcatacatgggacttgaacctgacaagtacacattcacctttgttttgaaggcttgtactggtgctttggacttccatgagggtgttgccattcatcaagatatagcttccagggagttagaatgtgatgtttttattgggactggacttgttgacatgtactgtaagatgggccacttggacaatgcaagaaaggtatttgataaaatgcccgggaaggatgttgcttcttggaatgcaatgatttcaggcttatctcagagctcaaacccttgtgaggcactggaaatatttcagaggatgcagatggaggaaggtgtggagccggactctgtgagtatcttgaacttggctccagctgtttctagattagaggatgttgattcttgcaagtctattcatggttatgtggttaggagatgtgttttcggtgtggtttctaattcattgattgatatgtactctaaatgtggtgaggtaaagttggctcatcagatttttgaccagatgtgggttaaggatgatatctcgtgggcaacaatgatggctggatatgtacatcatggttgttactttgaggttcttcaattactagatgaaatgaaacgaaagcacataaagatgaataagatatcagttgtaaactccgttttggcagctacagagacgagagacctggagaaagggaaggaagttcataattatgctttacagctagggatgacgtcagatattgtagttgctactcctatcgtgagcatgtatgcaaaatgtggtgagttgaagaaagctaaagagttttttctgagtcttgaaggaagagatttggttgtttggtctgcttttttatcagctcttgtccaagcaggatatcctggagaagcattgtctatattccaagagatgcagcatgaaggtttgaaaccagataaaacaattctatcaagtctggtttccgcatgtgctgaaatttcaagttccagattaggtaagatgatgcactgctatgttattaaagcagacatggggtcagatatttcagtagcaacaacccttgtctcaatgtacactagatgtaaatcatttatgtatgctatgacgctattcaacagaatgcattataaagatgttgtggcatggaatactttgataaatggatttaccaaatgtggtgacccacgtcttgcattggaaatgttccttagattacaattaagtggggttcaaccagatagtggaaccatggtgagtttgctttcagcttgtgcccttctggatgacctttatctaggaatctgctttcatggaaatatcataaagaatggtattgaatctgaaatgcatgtaaaagttgctctaatagacatgtatgccaaatgtgggagcctttgcacagctgaaaacttgtttcacttaaacaagcatgtaaaggatgaggtatcttggaatgtaatgattgcagggtacctgcataatggatgtgccaatgaagcaatttccacatttaatcagatgaaattggaaagtgtaaggcccaatttagtcacatttgtgaccattcttccggctgtatcatatttatcaatattaagagaggccatggcttttcatgcctgcataatccgaatgggattcatatctagtacccttattggaaacagtcttatagatatgtatgctaaaagtgggcaactcagttattctgagaaatgctttcatgagatggaaaataaaggcactatctcatggaatgcaatgctttcaggttatgctatgcatggccaaggtgaagttgcccttgcccttttttcacttatgcaagagactcatgtccctgttgattcagtttcctacatcagtgtattatctgcctgcagacatgctggcttaattcaagaaggaaggaacattttccagtctatgaccgaaaagcacaatcttgaaccaagtatggaacactatgcctgcatggttgatcttttaggctgtgctggtttatttgatgaagttttgtgtttaattgataaaatgccaacagaacctgatgctcaagtctggggagccctgctgggagcatgtaaaatgcattccaatgtgaaattaggagagattgccctccatcacctcctcaaacttgaaccaagaaatgcagttcattacatagttttgaggacaagatcaaatatgaccgaccatggattgaagaaaaatcccggatatagttgg

SEQ ID NO: 1501 - DNA, 120 bp, Glycine Max
aatttggtagagactgttacatgtctgggacataatatactgagagtgagtctgataaatatgggtttcccatgttgtctgatgacatatcttggaaaggtgtccatcgttgcccaataa

SEQ ID NO: 1502 - DNA, 591 bp, Glycine Max
acacgtgtccagcaacaacaacaacatcatcatcgggtttggcacatcatggctgaggctgaagaatcatcgagacacaataacaacactaacgaggaagctgaagttggagcttgcggttcaatctcaaaggaggaggaagaagaagaagatgaagaagaagcaaacaacaacagcaacaacaacaacaacagtaactggcttcaattaagcatagggcttgttgagttagacttgcttcctttacggcggagctcggagcagcagcagcagcagccgccgccaccggcggtttttccagtgatggcttcagggagaggaggagcatcatcgaacgacgtcgtattcatcttcttcttccatgtcgacgatgatgtctatggccagcctcatcccttaggatcttactttcccacagtaccctttcatcatcacttcccttcttcttcctcttctgggtttgatcaatatgacgtggcagctgggccaggaccaagctccgataataatgtcaccgttcgagttgttgatcctcctagaagacctcattctggaatatggtttatgttacaagcctctccaaaccagtaa

SEQ ID NO: 1503 - DNA, 594 bp, Glycine Max
agaagagatgagtcagagttcaatttgagagaatgggcagtgaaagctcgaatcagccgcgagggaaccaactccagaaggtactcaggatcttacatgagaagctttagagaagacacaagatcatttagatcaaacataaccatttctagcactgcttcttcacccggatacctcttaaaagatgaaatagacccttcaacatattctttcactactgctcttaaagcattgcaagcaaggtcaagctattacagttgggaatgcttatctccagatggttttgctttaaattcaaagtggaatgaagcagaaaggtatatatgcaaccctctctcaggggaggtaccattggagtgtttatctgcaaaaactcttagtggaagatcttttagaaactcaataaacagaattgccatgttcacacacttaattagcaagccatgttctttatttcctttttgcttgcaaggacacagttcaaaaaagaagaaagagggaatgacaagagatgttggtactcaaagtacacctccttatattagttcaaccagtcccagccctgcttcaactccatccatcacagagagatca

SEQ ID NO: 1504 - DNA, 522 bp, Glycine Max
agagatgatactatcaggaagaggctaaaggttgagctaagccgatctgaagactcaaaacagagaagctgcagacatgaaggcttatcaaacttggatgacaagaaacagtatacatccaagatgctgttagctgcaattgatgagtgccatagaggaacttatgattttaacaatggcaatgtgggatatgcattcatcaacatgatcaatcctggcttgattatactattctatcaggtgttcaatgggaagaaatgggagaaattcaacagtgagaaagtggcatcactagcatatgctcgcatacaagggaaagcagctctcattgctcacttccaaaattcaagcttgatgaatgaggataagcactgcaagcctatatcctcttcaacgccgatggccctaatgccagtgatcagaatcttggcaagccatttgaaatttgcacttctctttttaccaagagatgaagctacaaaatggttggcattaacattcgcaacaaagttggaagagtga

SEQ ID NO: 1505 - DNA, 225 bp, Glycine Max
agcgagagagagagagaaacaaagcagcacccatttggatcctctcttctcttctttgatctccgttaccctttttgttttctcaacagagagagagagagagaatctttcgaagttcgtttgcgtgtgttgtgtggtcagtcaccgatggcagcaccacctgcgagggcacgtgccgattacgattacctcatcaagcttcttcttattggcgatagcggttag

SEQ ID NO: 1506 - DNA, 1035 bp, Glycine Max
atgaaaatttcagaatcaatcttatattttgggactaaatcttttccaaaatatattttcttgattccaaaagaacctaggaatacaaaccctatccttggtctgttccttcattcttattgtctccccgcatcgtacgccgccgacacagcttcgaatcgctgccaagtgctaacaaacgcctctgagtctctgacaccaacgcaactctctctgctcacatgtttgaaggagatggtgaacgtgatggagtggcagaagcagcgttggcaaccgaatgggaacgcggaaatgatgtacgtgaaagtgatgaccgacgaacagctcgagactctgcgcaaacagattgcagtttacgcaaccatctgtgaacaactcatcgaaatgcacaaaaacatctcctcgcaccaagatcttgcagggattaggctggggaatatgtattgtgatccattgttggggtctggtgggcacaaaatagcttcaaggcagcggtggactccgtccgctatgcagcttcagattcttgagcgaatatttgatcaagggactggaacccccaccaaggaaaagatcaaggagatcactaatgagctcagccagcatggccagatttctgagaccaatgtgtataattggttccagaacaggcgtgctcgctccaaaagaaagcagcagaatgtggcacctagtgctaatgctgaatcggaagtggagactgaggttgattctaaggataagaagacaaagccggacgaatttcagtcccctcctagcgtttctgctgtgcctgctgatgataatttaggcttccagaaccatggcagtttgcagtacttgaatccagagtccaacaaaccagattctgtgttcccatctgatgcaagtttaagatctacaagaaatttcaatcatgtgcctgtttttgatgggctgctatcgaactcaaggagtgactatcttactggaaaaatggaagcacctgagaactacgacttataccagccagcaggcgacttcaacatggcaggttga

SEQ ID NO: 1507 - DNA, 528 bp, Glycine Max
atgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattga

SEQ ID NO: 1508 - DNA, 348 bp, Glycine Max
atgaagctcgtcaggtttttaatgaagttgaacaatgaaaccgtgtcaattgagctcaagaatggcactattgttcatggcaccattacaggtgttgatatcagtatgaacacacatttgaaaacagttaaactaactctgaaagggaaaaatccagtgactctggatcatctcagtgtgaggggtaacaacatccgttactacattcttcctgacagcttgaatctcgagaccctgcttgtggaagagacacctaagatcaaacccaagaagccaactgctgggaaacctttgggacgtggacgaggaaggggccgtgggcgtgggcgtggacgtggtggtcgttga

SEQ ID NO: 1509 - DNA, 1098 bp, Glycine Max
atgaagttactaggctggatgcacaggaaacttcgccagaatagtagtgaaccattcaaggacttggtcattgggaattcttgcaattgtctttcagggcaggcaccacttgatgatgaacaagtctatcagaaaccaaaccttgggatcagactttccaaacatgctcagaaaggtcacaacaaccttagaaactcttttgctggcctagaagcagcaagagtagatgaagactatgagggagaatacttccctggcttccttgcaattggaactcttggttcagaacgagtatctgacccctcaacaacaccatcatttcccatttctgttgagagcataactgaaaaagaagatgaagtcactgagaatgatctgaagctcatcaatgatgagctagagaaagttctaggagctgaaaccaaggatgatgttagcattgactcctcaaggaggactagccatgttagcactgggagaagcagccatgtcagcactgggagaagcagccatgtcagcataataacactcagtggaaagccaatagaaggcacagaaccaaatggaaatggtgctgcaatttgtccactccagggatatctctttggaacagctattgaactgtctgaaactactgcagcagcagcaaagaaagaacataggacttcgctcggggagctgtttcagagaagcaaatcagctgaggagaatttcagcgcaaaatgtgaaaaggaggacaaaagagctgagaaggaagtggacaagtctgccatgaacctgatgaaagaaaagctgaagaaaagaatgctccatgcttattctaagaattctacttcaataaatggtgggcctattgattctgcttctgctgagacaaaactgaataagattctccatatgttccgcaagaaagttcaccctgaaagttcaacagctgcacaaaaatctgctaaacaccacaagaaccagaagaagaagaaaacaatcaatgatggaggctacaacaaaagtgacctggtgcatccagaggaagattcatctgtcaacagggagtactggatcaaaacagatgcagatgacttagttctagagctgtga

SEQ ID NO: 1510 - DNA, 246 bp, Glycine Max
atgaatttgccggaggtgctacaagaattgaagagcatatcactggcaaaggaaacaatattacaaaatgcccaaaatatggtgcccatgaaggtaagtaatatgcttaacatttttgagatagcaatgaaagttgtcacctttacttttatatcatgtaatacttttgtcataggtaattatgtattaagcataataatggcactttgtgttaactgtatatatgtatcaatatgtgcttgcttg

SEQ ID NO: 1511 - DNA, 1320 bp, Glycine Max
atgacagatagtgttgttgcttttgtgctagataacttgtcgctgcttgaagatgagcacaagttgctttctggcgtggaggacaaagtcaactctctttgcaatgagctcaagtttatacacatcttcctcaagaattccgagggcaagcgcagtcatgacacagggaaagaagtggtgagccaaatcagagatgtcgcccacaaagctgaaaatgttgttgacacctacgttgccaacatcgctcaacaaaaacagagaagcaaactgagcaagttattccacctcaaagaacatgtcatggtgcttcaccaagtcaactctgagatagagaagatcaggagtcagatcgaagagatctataagaacggggacagatatggcattggagaaggtgaattccgaagcgaagaagctgctgcagaagcagaatcactcctcaaaagaaggagggaggtggaggaagaagatatagtgggcttagtgcatgactcaagccatgtaattcatgaactcatggaaagtgagtcacgtcttaaagttgtgtccataattggaatgggagggttgggtaagaccactcttgcccgtaagatctataacaacaatcaagtgcagctgcggtttccttgccttgcatgggtttctgtgtccaatgattacagacccaaggaatgtcttctcagccttctcaaatgttcaatgtcttccacatctgaatttgaaaaattaagtgaggaagatctgaagaagaaggtagcagaatggttgaaagggaagagttatctggtagtgcttgatgacatctgggaaaccaaagtatgggatgaggttaaaggagcctttccagatgaccaaataggtagtagaattctcataacaagtcgcaacaaagaggtggcacactatgctggaactgcgtctccctacgaccttcccatcctcaatgaagatgaaagctgggaactcttcacaaagaagatttttcgaggtgaagaatgcccgtctgatttagagcctctgggtagatccattgtgaaaacttgtgggggtttaccacttgccattgttggtttagcaggacttgttgccaagaaggagaagtcacaaagagagtggtcaagaatcaaggaagtgagttggcgtcttacacaggataagaatggagtaatggatatgctgaaccttaggtatgacaacttgcctgaaagattaatgccttgctttttgtattttggaatctgtccacgagactatgtggaaagctatgaggagaggaaagcgaaagaattagagactgttgaagttttcatccactaa

SEQ ID NO: 1512 - DNA, 3267 bp, Glycine Max
atgacagcagcgttccaagaaggcggcggcggcggtggcggtggtggtgacgatgacgccaccatcgacgtgcataccacgcgcggcactcccatccgctaccttcccctcgaccacctctactccgccacctctccctgccgcgtcaccgccagcggctcctccaacgtcatgtcgaagaaaatcaaagctcgcaaactcaccctaacgcataacaaccattttaacaaccacgaccagaagaaaacggcgccatcttcttcttcgtccctgacccttcctcccaagccccctctcctcttcgtctactcgcggcgccggcgcaagaggcattccccttccgcgacggcgtcgtttgccgacggcgcggagaacgacgagagcgagaggaggttgctgaagaagaggaaaattgggagcactgagttggagaggctgggtgtggatttgaatactgcgattggggatgttgacgggcccagattgagggaatgcagaaatcaatttgggaattccggtgctgctgggaatgctaagtgtggttccttggagaatttgcccaaaatgttgcccgaatctcgcaatgtgaagaaatgggtcgggttgacttttgataatgctgatcctgaggcgtttgttggattacgatgcaaggtttactggcccatggatttaaaagcatacattggctatgtcagaagttatgataaggaaactaagatacatcatgtcaagtatgatgatggtgatgaggaaagtttaattcttgcaaatgaaaatataagattccatgtttcccgcgatgagatgaaacatttaaaattgaattttgccaaagttcgtgacaataatgtctctgattatgatgttgaagagatgcttgcattggctgctagtttggatgattgtcaagactttgagcctggggatatcatatgggccaagctaacaggccatgcaatgtggccagctgttgttctggatgaatcacttgctagcaactgtaagggtttaaagatgtttttgggaggaagatcagttcctgtccaattttttggcacccatgactttgcaagggttagactgcaacaggtgaaatcatttctcagtggacttcttactgatctacactcaaaatgcaagaaacatagttttattgaaggtttagaagaggcaaaaagatatttaagtgaacagaagcttccatcagagatgctagagttgcggaaaagatgtacagctgatgactgtaacaacataagtggagaggatggaggatgtacagattcaggtgatgattgtttaaatgacaatgggactttgacggctctggaaaccattgaaacttttccatatgaagtaggagacctccaaattctaagccttggaaaaatagttgaagattctgctttccgggatggaagattcatctggcctgaagggtacacagcagtgaggaagtttacttcagttactgaccctaaagtttctgcaccttataagatggaggtgttgagagatccagaatccaaagttcgtcctctgtttagagtgacagttgaaggtggtgagcagttcaatggttatacaccatctgcttgctggaatgaggtatacgaaaagataaagaaaatggaaaaggatgcttctgaaggtactgttgctggtggggaagaaaagagctacgaatctgggtctgatatgtttggtttctccaatcctatagtacttaaacttatacggggattgtctaaatccaaaatctcttcaaagaactcaacttgcaagttaggttccagaagatataataataacttgcctcttggttatagacaagttcatatcaattggtttgacctcgataagtgcaatgtgtgccacatggatgaggagtatgaaaacaatctgtttctgcagtgtgacaaatgcagaatgatggtccatgctagatgctatggggaacttgaacctgttaatggggtgctatggttatgtaacttatgtcgttcgggtgctcctcctccaccttgctgcttatgtccactcataggtggtgcaatgaagcctactacagatggccggtgggctcatttggcttgtgccatgtggatacctggaacttgcttagctgatgtaaagagaatggagcctattgatggtttgagtagaatcagtaaggaccgctggaagttgttatgcagcatatgcggtgtatcttatggtgcctgcatccaaggttcaaataattcttgtcgagtagcataccatccactctgtgcacgtgctgctggtctctgtgttgaggttgagaatgaggacagactgtatctcctttctgttgatgatgatgaagatcagtgcatacgcttgctttctttctgcaagaaacataggcaaccatctaatgagccttctgttgctgatgaacgtatggtccgagttgctggtctatgttcagactatgaaccaccgcccaatctgtctggttgtgctcgaagtgggccatatgattactttggcaggagaggtcgaaaagaacctgaagcacttgcagctgcatcgttgaaacgtttgtttgtggagaatcaaccttacttagtaggtggatactgtcagcatggttcactaaacaacctagagccttctggcagaggagtctgctctaaattcttttgtagccaacaaaggctgagaacctctctggttgacacatcaaacagcatactttctatctctgaaaaatatacgtacatgagggaaacctttcggaaacgactggcatttgggaaatcaagaattcatggatttggcatctttgcaaagcatgcatataaaggtggagacatggtgattgaatacactggtgaacttgttagaccacctatagctgaccggagagagcacttcatatacaattcgttggtgggtgctggaacatatatgtttcgtattgatgatgaacgagtcattgatgctactagagcaggaagcattgctcatttgattaatcattcttgtgcagcaaattgctattccagagttataagtgttaatggcgatgaacatattataatatttgcgaagagggacattaaacagtgggaagagcttacatatgattacaggtttttctcaattgatgaacgacttgcttgttactgtggcttcccaaagtgccgaggtattgtaaatgatactgaggcagaagaacgagcagctaccctatatgcaccacgaagcgaattaatagattggagaggagaatga

SEQ ID NO: 1513 - DNA, 708 bp, Glycine Max
atgacgtccctgcagaattcaccaacgcttcaccgaactatgctccacaactctttccctcaggatgccactcgttcatctcgaagagatgccatttccttcattgtcaaagctgcccaagaaccctctgcttctttagcttctcaaggtagacaaagaaggcgccaagtgattgcctttggaaccactgccccattagtttttctgttcaaccaacactcgaactcttgtgctgcagaaaataagaagggatttttgcctgttttggacaagaaagatggatattcatttctctaccctttcgggtggcaggaagtagtaattgaaggtcaagataaggtgttcaaagatgtcattgaaccactggagaacgtcagtgtaaatgtgataccaactggcaaacaggatattacagaatttgggtcccctcaagaggttgctgaaactctaataaaaaaggttttggcacctccaaaccagaaaaccaagatagtagaagcaaaagaggaagatgttgaaggaaaaaagtactatcaatttgagttcattgctaaggctccaaactatactcgtcatgctctcagcacagtctccattggcaatggtaagttttacaccttaacaacaggagcaaacgagagaagatgggacaagatgaaagacaggctgcagacagtcatagaatccttcaaaattttcgatgtttga

SEQ ID NO: 1514 - DNA, 522 bp, Glycine Max
atgagaaaccgtattgaaagattagtagttccatggtctttcagctgtgcttcccattcaagtgtgaaattaggtgcacccaaaggaccaaaagaagattcaaaaggaactattgtttcaagaagacaagaaggacaagatagatcattcatcaggacccaaatgaagagaggcaagccttctgggtttctggttctaccaaagcctaatgtagctactggcatacagagaataatcaagggcatcaagaatttatctcaattatttggttacaaaaaagaggatgtcgaaaaaatggaacctgagatggaaattgggtatccaacagatgtgaagcatgtgacacatattggaattgatgggtcaacaaccattacaaataatgtcaagggttgggacaatctgaaggcacctgaattattgtctctgtctccaatttcattcaagcaatttgaattggccatggctagccaagctcaatatcctctcattaacgatcttaattcctcaaaacgtggttag

SEQ ID NO: 1515 - DNA, 867 bp, Glycine Max
atgagggcagagaacctattgcaattgcaacaccgcacccagaagtgcaccctgggctgtcccgtactcgatcgctgcctcgccggcggcgtcccctgcgcctccgtcaccgagttcgtcggcgagagcggttgcggcaagacgcagctctgcctccaactcgccctctccgcccagctccccccctctcacggcggtctctccgcctcctccatcttcatccacaccgagttccccttccccttccgccgcctccgccacctctcacgcgccttccgcgcctcccaccccgacctcccttgctccgacccctgcgaccgcgtcttcctacgcgccgtccactccgcgcacgaattactcaacctaatcccaaccatcgagactttcctcttgcactcgaaatcgccgtggcggccggtgagaatcatcgtgatcgattccatcgccgcgcttttccgctccgatttcgagaacaccggatcggatctccggcggaggtcgtcgctgtttttcggaatctcggggggattgcggcagttggcgaagaggtttgggattgcggtggtggtgacgaaccaggttgtggatttgatcggtgatggtgacgtgagctttgggagtttgggtaatgggctttattcttcgggccgaagggtttgtcctgcgttgggcctggcttgggcccattgtgttaactcgagactgtttttgtcgaaggatgaggatgagccgccggtgaagacaaggaaaatgagagttgtgtttgctcctcatttgccgcactcttcttgcgagtatgttattaaaggggaaggcgttttcggcgtggagatgatgcaacaccgagaagaagagataaatctttga

SEQ ID NO: 1516 - DNA, 1137 bp, Glycine Max
atgatgcagatgaagaacacccctttgtacagaacaactccttgggggggtatgcctgagccttgttttcgcaaagcaccctctaaggtggtttccatccctgttcacttcgtggggtcagagcgcaccagaacaaattctgattctgccacagagatccagagggtgctgagaggatttctggtgaggaacaccttgaggaaaatcactgccatgagggtggagttggagcggattgagagcgagataagtgtggaagtgatgaaattgaagagggaacaaagggagagggtgagggtaagcgagaccatcatgaacttgcttctcaagttggattctgttagggtgttgcactactctggcctcagagagtgcagaaagtctctcatcaacaaagctattgcccttcaagaaatgctagatcaaatggctgtcactcattctgatgagatggaagagaaggaaagtgagtgtgtggaagcaaagaattgtttggtggaggaagaggaagaggaagaggaaggggaaggcagtggaatggaaactttgaagaatggggagatagaaatggaggaggaggagggaaagaagaaatgggttagagaagataattgtttggtgaaggaagaggaagataatggaatagaaactttgaggagtggggaggtagaacggcaaaaggaggagagtggttgcatggaagaagaaagtattgggttgggaaaaagtttggttgtagaaaaggagggagaaattgaatgcgaggaggagcaagaggaaggtgaagaaattgaagctttgaggaatgaggaggtggaagacaaagagggtgtgggaacaagttcggttgcggagaattgtttgatgaaagaggaaggaggggattatgaaagagcggaaggagatgggaagaagaaggacttgttggagaagatggtggaggacaatcagaagatggtggagatgatgacacaactgtttcagaggaatgagatgcagactacacttctcacctctctctcgcaaagggtggaacagcttgagagagccttggcttgtgagaagttgaggaggaagaaaaagagaaaggctgatgccaaaattaaacgaaataatcctaaaaatggcttcatctga

SEQ ID NO: 1517 - DNA, 990 bp, Glycine Max
atgatggagacgacggcgaagcgaaacgctgtcgttgcgccaatcgcggcgttgttgttggtggtgctactcgcggcgagtgtggtggtggaggctcaggagaactcggacgtgaagacgctggtgaagcacatgcacgggaagaagtactgcgacaaaggatgggaatgtaagggctggtcaatttactgttgtaacctcactattactgattatttccagacctaccagttcgagaatctcttctccaagcggaactcgccggtggcgcacgccgtcggattttgggactaccactcgttcatcgccgctgccgcgcttttcgagccgcaagggttcggcaccaccgggaacaagacgatgcagatgatggagattgcggcgttcctcggacacgtcggcagcaagacctcttgtggttatggagtggctaccggaggacctttggcctggggtctttgttacaaccatgaaatgagtcctatgcagtcatactgtgatgactacttcaaactcacatacccctgtacacctggtgctgagtactatggtcgtggagctattcccattttctggaactacaactatggtgctgttggagaagctttgaagatcgacctactcagccatccagaatacatagagcagaatgccacccttgctttccaggctgctatttggagatggatgacaccaatgaaaaagtcacagccctctgcgcatgatgcctttgtcggcaactggaagcctagcaagaatgatactatggagaatcgtcttcctggatttggcactacaatgaacattctctatggggatggtgtttgtggacaaggtgatgtggactcgatgaacaatatcgtttcccattaccagtattatcttgaccttctaggtgttggtcgagaacaggctgggccccatgaaatccttacatgcgctgagcaggttcctttcaacccatcttccaaacctgcttcttcatcttaa

SEQ ID NO: 1518 - DNA, 4209 bp, Glycine Max
atgatggtatcgagagggttgttcgggtggtccccgccgcacgtgcaaccgctcacgccggtatcggaggtttcggagccaccggagtcaccgtcgccatacctggaccccggcgcagagacctccgcgtcgcagcaggtggaggcggaggaggagatggaggagccggaggagatcgagccgccgcccgccgcggttccgttttcgcagctcttcgcatgcgccgaccgcttcgattggttcctcatggccattggttccgtcgccgccgcggcgcacggcaccgcgctcgtcgtttacttgcactacttcgcgaagatcatccacgtgctgcggttggatcctcctaacggcacgtcgcaggagcagtttgacaggttcaccgagcttgctttaaccattgtttatattgctgcgggagtttttgttgctggttggattgaggtttcatgttggattttgacgggagaacggcagactgctgtcatcaggtcaaattatgttcaagtactacttaatcaagacatgagtttttttgatacttatgggaataatggagacattgtgagtcaagtattaagtgatgtgctgcttatccagtccgcccttagtgaaaaagttgggaattatattcataatatggctacattcttcagtggtcttgtcattggccttgtcaattgttggcagattgctttgataacgttagccacgggtccgtttattgttgctgctggaggaatatcaaacatattcctccataggcttgcagagaatatccaagatgcatatgctgaagcagctagcattgctgaacaggcagtttcctatataaggacattgtatgcattttcaaatgaaactttggctaagtattcatatgcaacatcactgcaagctactcttagatatggtatattaataagtcttgttcaagggcttggtcttggatttacttatggactagcaatatgttcttgtgcattacaactctgggttggaagattcttggttattcacggaaaagcacatggtggtgaaattataacagctctttttgctgtaattctaagtggcctgggattaaatcaagcagcgacaaatttctactcatttgatcagggacgaatagctgcttatagactatttgagatgataagtcggtcatcctcatctgttaatcatgatggcacttcccctgattctgtgctaggaaatatagagttccggaatgtttatttcagctatctttctcgtcctgaaatccctatcttgagtggattttatctcactgtacctgctaagaaagctgtagcacttgttggcagaaatggctctggaaaaagtagtattattccactcatggagcgtttttatgatcctacattaggagaagttcttttagatggtgaaaatatcaagaatttgaaactggaatggctgaggagccaaataggactagtcacccaggagcctgctttgctcagtttgagtataacagacaacattgcttatgggagggatgctaccatggatcaaattgaagaggctgctaaaatagctcatgcacatacatttatcagctcattagagaaaggttatgacacacaggttggcagggcttgtctagctttgaccgaagagcagaaaataaaactttctattgctagagctgtgcttctaaatccatcaattcttcttcttgatgaggttactggtggacttgattttgaggctgagagggctgttcagggggctctggatttgcttatgttgggacgctcaacaataataattgctcgaaggcttagtctcataaagaatgctgactatatagccgttatggaggaaggtcagcttgttgaaatgggtactcatgatgaattattaacactggatggcttatatgcagagcttcatcgatgtgaagaggccgcaaaacttcccaagaggatgcctgttcgaaactacaaggaaacttcagccttccaaattgagaaggattcttcaagtcatagcttcaaagaaccatcatcccctaaaatgatgaagtcaccctctcttcaaagagtttctaatgtatcccgacctccagatggcgtctttaacttgctagaatcacctcaagtccggagtccaccgcctgagaaaatgcttgaaaatggtctggcgttggatgtagcagataaggagccatcaataagaaggcaggatagttttgaaatgagactgccggagttacccaagattgatgttcattctgtgcaacgacatatgtcaaatgattctgatccagaatctcccatttcacctcttttaacatctgatcctaaaagtgaacgctcccattcacagacttttagtagaccacatagtcattctgatgatgtttcagttataatgagagaaacaaagggtgcacggcatcgaaaaccaccatcactgcagaagctggctgagcttagttttgctgagtggctttatgctgtgttaggaagcataggtgctgctatctttgggtctttcaatccccttcttgcttatgttattggtcttgtggtgacagcttactatagaattgatgacactcatcaccttgaacgggaggtagacaggtggtgcttgatcattggctgcatgggtattgtaactttagttgccaactttttacagcatttctactttggtattatgggagagaaaatgacggaaagagttaggagaatgatgttctcagccatgctacgcaatgaagtgggatggtttgatgatgaggaaaacagtgctgacaatttgtccatgcgattggccaatgatgctacttttgtgcgagctgcttttagcaacaggctttccatatttatacaggacagtgctgcagttattgttggtcttctcattggtgctttgctgcactggcggttagcacttgtggcttttgcaacccttccaattctctctgtttctgccattgcccagaaattttggcttgcgggattttcgaggggcatccaggaaatgcacaaaaaggcatctttggttcttgaagatgcagttaggaacatttacactgttgttgccttttgtgctggtaataaggtaatggagctctacaggctgcaattaaagaaaatatttaagcagagctttcttcatgggatggcaattggttttgcatttggcttttcacagtttctactttttgcctgtaatgccctgctactttggtacactgcaatatgtataaaacgtggttacatggatccacctactgcactcaaggagtacatggttttttcatttgcaacatttgcacttgtggagccttttggattggctccttacatacttaaacgacgaaaatctctcatatctgtgtttgacattatagatcgtgtgcctaaaattgatcctgatgatacctcagcattgaagccacccaatgtatatggaagcctcgagttaaaaaatgttgatttttgttacccatctcgtcctgaagtgttggtattgagcaattttagcctcaaagtcactgggggccaaacagttgctattgtgggagtttctgggtcaggaaagagcactataatatctttgatcgagaggttttatgatccagttgcaggccaagttttcctggatggtagggatttaaaggaatataacttgagatggttgaggagccaccttggtcttgttcagcaggaacctattatcttctcaacaaccataagggaaaacattatatatgcaaggcataatgcaactgaagctgagatgaaagaggctgcaagaatagcaaatgctcatcatttcattagcagtttgcctcatggttatgatactcatgttgggatgagaggtgttgacttaaccccaggacagaaacagagaattgcaattgctagggtagtgctgaaaaatgcccctatcttgttgttggatgaagctagttcagcaattgaatctgagtcaagccgagtagtgcaagaggctctagacacgctaattatgggaaacaagactactattttaatagcacatagggctgcaatgatgaggcatgtggacaatattgtagtgcttaatggaggacggatagtggaggagggcagtcatgatacattggtagccaagaatggtttgtatgtccgactgatgcaacctcattttggtaaggctttgcgtcaacatcggcttgtttag

SEQ ID NO: 1519 - DNA, 2472 bp, Glycine Max
atgcaattcgctaagctcgatgactctcctatgttccgcaagcagatacaatgcatggaggaaagtgctgaatctttaagagagagaagtttaaaattttacaaaggatgtagaaaatacactgaaggacttggggaggcctatgatggagatattgcatttgcaagtgccttggaaacttttggtggtgggcataatgacccaatcagtgtggcttttggaggccctgttatgaccaaattcaccatagccttaagagaaattgggacatataaggaagtccttcgatcacaggttgagcacatgttaaatgacagattgcttcagtttgtcaatattgatttacaagaggtcaaggaagcacggaaacgctttgacaaggctagccttatttatgaccagactcgtgaaaggtttctgtcactaagaaaaggcacaaaaactggtgtagctactgccctagaagaggagcttcatagtgcaagatctacatttgagcaagctcggtttaatctggttactgccttgtcaaatgttgaagcaaagaagagatttgaatttttggaagcagtcagtgggaccatggatgcacatcttcgttacttcaaacaggggtatgaattgttgcaccaaatggagccatatattaaccaggtcttgacttatgctcaacaatcaagagaaaggtccaattatgagcaggcagccctaaatgaaagaatgcaagagtacaaacgacagattgatcgggagagtaggtgggcttctaatggttctaatgggtctcctaatggagatggtatacaagccattggtagaagttcacataagatgatagaggcagttatgcaatctgctgccaagggaaaggttcaaactattcgacaaggttatctctcaaagcgttcctcaaacttaaggggggactggaaaaggagattttttgttcttgatagtcggggaatgctgtattactaccgtaaacagtgcagcaaatcatctgggtctagtagtcaacattctggccagaggaatagttctgagcttggttctggacttttaagtcgatggctgtcttctcatcatcacggtggagtacatgatgagaaatctgttgctcatcacactgtgaacttgcttacatcaacaattaaagtagatgctgaccaatcagatttgaggttttgcttccggatcatttcacctacaaagaactacactttgcaggcagagagtgcgctggaccaaatggattggattgaaaaaatcactggtgttattgcttcattactgagttctcagattcctgataggatgttgcctgcaagcccaatgggaagtggtcatcataggtctaccagtgagagtagttcttttgaaagttcagattttgatcactctgctgttgaagaatgtgcagcagatagaagttttacttctgcgtatctggagcgcccctcaagaagtttgcaacagcagcgatcctgcactaaaagtgagaagccaatagatgtactgcgaagagtttgtgggaatgataaatgtgccgattgtggagctcctgaacctgattgggcatcgctaaatcttggtgttcttgtttgcattgagtgttctggtgtacatcgtaaccttggtgtccacatatcaaaggtcaggtctcttacattggatgttaaagtgtgggaaccttctgtcataagtttatttcagtctcttgggaatacttttgccaactcagtctgggaggaattattacaatcaagaagtgcctttcaggttgatcttgtccctacaggcttaagcaagtctgataaaccaatgatgttcttcatcaccaaaccttgtcaatctgattctctatctgtgaaggaaaagttcatccatgcaaagtatgctgagaagctttttgttcgcaagccaaaggacaatcaataccgtctcttagtagcacaacaaatctgggaggctgttcatgctaacgataaaaaagctgtataccgttacattgttaattctgatgttgatgttaatgctgtttatgagccaacatgcagcagctccttaacccttgccaaagtaatgctattacaagagcagactagccatgatcacagctctactttagcagggaacacattggactggtcctccactaaagaaggccaggtcatggacaatctagatgggtgcaccctacttcatctcgcatgtgaaactgcagatattggcatggtggagctcctcctacagtatggtgcaaatgttaatgcaactgattcgagaggtcaaacacctctacatcgctgtattctcaaaggaagatctacatttgcaagattattgctttctaggggagccgatcctcgagctgtggatgagcagggaagaacccctattgagcttgctgctgagtcaaatgctggcggtgacagagaagtccatgctccatcgactgattctaatggatga

SEQ ID NO: 1520 - DNA, 681 bp, Glycine Max
atgcagatgaagaacacccctttgtacagaacaactcccttgggggtcatggctgacccttgttatcgcaaagcaccctctaaggtggtttccattcctgttcacttcgtgggctcagagcgcaccagaacaaattctgattctgccacaaagatccagagggtgctgagaggatttctcgtgaggaacaccttgaggaaaatcgctgccatgagggtggagttggagcggattgagtgcgaggtaagggtggaagtgatgaaattgaagagggaacaaagggagagggtgagggtgagcgagaccatcatgaacttgcttctcaagttggattctgttagggtgttgcactactctggcctcagagagtgcagaaagtctctcatcaacaaagctattgcccttcaagaaatgctggatcaaatggcagtccctaattctgatgagtgtgtgggagaagagaattatttggtgaatgaagaggaaaggagggtgaaattaaatgaggatagtgagggaggaaggggatttgttggggagaattgtttggtgaaagaggaggagggggattgtgaaagagagaaaggagatgggaagaaggacttgttggagaagatgaagaatgtaactcagtcaaatgacatgttgtcatcacaagatattgttttgccctctatttaa

SEQ ID NO: 1521 - DNA, 210 bp, Glycine Max
atgcatgtgcaggtggaagagaaagataaggaaacatgggagacaaaagaaacagaaagagaaaagaaggtgtggaggaagcaagaggagcaactttgcaaactaagtgggtgcttttcgtggatgagaaaaaaaaaggcagagagagagaaagaaagacaaagaaggaataacatctttctcactcacttcaaaggtagcaaaagataa

SEQ ID NO: 1522 - DNA, 411 bp, Glycine Max
atgcattaccaagtggagcctgcatggagctactacatgagggttcggaggagcatggaagaggaccagatggagagagtggcaagactggcctcacagagtgcagtggtgatattcagtgtgagtagctgttgcatgtgccatgcaatgaagaggctcttctgtggaatgggggttaaccccacagtgcatgagcttgaccaagatcccaaagggaaagacatggagagtgcacttatgagactccttggaattggaattggaaatggaatcaactccactgcttctgctgctgttcctgtggtcttcattggagggaaacttgttggctccatggacagggttttggctttccacatcagtggcacccttgttcctcttctcaaacaagctggtgccttgtggctttga

SEQ ID NO: 1523 - DNA, 2532 bp, Glycine Max
atgcctgagagtttttttgagagctgttcttcccttcatcacatttctctagctaggaacatgtttgatggaccagttcctggctcactgtctagatgttcctcattgaatagcattaatctttccaataatcatttctccggtaatgtggactttagtgggatttggtcattgaacaggcttaggactttggatctatctaacaatgccttatcagggtctttacctaatggaatttcatccgtacataactttaaagagatcttattacaaggtaaccagttttcaggtccattatccactgatattggattctgcctgcatctgaataggttggatttcagtgataatcagttcagtggagaactgccagagtcactagggatgcttagttctttgagctatttcaaggcatcaaataatcatttcaacagtgaattccctcaatggattggtaacatgaccagtctggagtacctagagctctcaaacaatcagttcactggaagcatcccacagtcaataggggaactgagatcactgactcatctgagcatttcaaataacatgcttgttggaactattccatcatcattgagtttctgcacaaagttatctgtggtccagctcagaggaaatggtttcaacggcaccattccagagggtttgtttggcctaggattggaggaaatagacttgtcccataatgaattgagtggctcaattccacccggatcaagcaggctcttggaaactctcacccacttggatctttcagataaccatctccaagggaatatccctgcagaaaccggtcttctatcaaaactaacacatttgaatctgtcttggaatgatcttcattcacagatgcctccagaatttggcctccttcagaacctggcagttttggatcttcgcaatagtgccttgcacggttcaattccagcagatatatgtgactcaggcaatttagctgtcctccaacttgatggaaattcatttgaagggaatattccgtccgagattggaaattgtagctctctttacttgctgagtttgtctcacaataatttgactggttcaattccaaagtccatgtcaaagctaaacaagctcaaaatcctcaagctggaattcaatgaactaagtggagagataccaatggagcttggaatgcttcagagtcttcttgctgtaaacatatcatacaacaggctcacaggaaggcttcctacaagtagcatatttcagaacttggacaaaagttccttggaaggaaacctgggtctttgttcacccttgttgaagggtccatgtaagatgaatgtccccaaaccacttgtgcttgacccaaatgcctataacaaccaaataagtcctcaaaggcaaacaaacgaatcatctgagtctggcccagtccatcgccacaggttccttagtgtatctgctattgtagcaatatctgcatcctttgtcattgtattaggagtgattgctgttagcctacttaatgtttctgtaaggagaaggctaacatttttggataatgctttggaaagcatgtgctcgagctcttcaagatcgggaagtccagccacaggaaagcttatcctgtttgattcccagtcctcacctgattggatcagcaatcctgagtccttgctcaacaaggcatctgagattggagaaggagtctttggaacactctacaaggttccattgggatcacaaggtagaatggtagcaatcaagaagcttatatccacaaacataatccaatatccagaagactttgatagggaagttagaatcctcgggaaagcaaggcacccaaatctaatagcattgaaaggatactattggactcctcaactacaacttttagtaactgagtttgcaccaaatggtagcttgcaagccaagctacatgaaaggcttccttcaagtcctcctctttcttgggctataaggttcaaaatcttgcttggaacagcaaaggggcttgctcatttgcaccactctttccgtccaccgatcatccactacaacataaagccaagtaacattttgcttgacgaaaattacaacgccaagatctcagattttgggttggctcggcttctgacaaagctggaccggcatgtgatgagcaacaggttccagagtgcactaggatatgtggcaccagaattagcatgccagagcttaagggtcaatgagaaatgtgatgtgtatggttttggggtgatgatccttgagctggtgacaggtaggagaccagtggagtatggagaagacaatgtgctgatactgaatgaccatgtgagggtgctgcttgagcaagggaatgtgttggagtgtgtggatcaaagcatgagtgagtatcctgaagatgaggtattgcctgttctgaagctagcaatggtatgcacctctcaaattccttctagcaggcctactatggctgaagtggtgcaaatactgcaggtcattaaaaccccagttcctcaaaggatggaagtattttga

SEQ ID NO: 1524 - DNA, 249 bp, Glycine Max
atgctcgatctcggaatcgaagtctcgaacagcaacacgaccatttgcagggctctcaagctcacttcgatttggtcgcgaacccaaaaccctagcgcagagacaaccttggagttcgaggttgcatatgattttgattttgatgtgtgttgggtattatcacttcactatttgtgtgttggtgtcactgcttcttcttcttctcacttctcagcaatagagagtaaaagtatattgggaattgtttaa

SEQ ID NO: 1525 - DNA, 324 bp, Glycine Max
atggaacacggctcatacactgatcagagtaaatcaacatttagtctcgtagatgaggatcatacttttgcaaacgctgttagattcaccttaaatcaagacccaagagtgtcattttgtggctacagcattcctcatccttcagataatcgtgttaatatcagagtccagacaacaggcgatccatcacgcgaggtgttaaaagatgcatgtcaagatctgatgcttatgtgccagcatgttaggagcacttttgataaggcagtcagtgattttaaaatcagcaaggctaggaagaataatgaggatatggatgtcgagtaa

SEQ ID NO: 1526 - DNA, 606 bp, Glycine Max
atggaagtagagatcaagcttcgtctcccagactcagccactcaccagaaactatccaacttgcttgcacctttccacaccaaaaccttaatccaagaaaacatcttcttcgatggcatgaacaaagagctcacttcaaacctcgccgttctccgaatccgcttctacgacttggaacactgcgtcctttccttgaaggccaagccagtgatctcggccggtataagccgcatggaggagcacgaggagccgttcgacgtcgcacttggccgtgcatgcattgctgagccatggaggctcttatccgtggagtcctcagagatactcaagagggtgagggatgagtaccgtgttggagaaaatggggtggtgtgcttaggtgggtttaggaatgtgagggctgtgcatcagtggaaaggcttgaaactggaacttgatgagaccaactatgatttcgggacaaactacgagttagaatgtgagagtgacgacccagagagacacaagagattgcttgaggagtttcttcaggggaatggaatcaattattcttattccaaactttccaaatttgctgtttttcagtccaggaagttgcctgaatga

SEQ ID NO: 1527 - DNA, 1548 bp, Glycine Max
atggacaaccctccgttgagcaagtactttgataaaatccggtttgtgtttttcacctccttcattttttgtatgtcattacttctctgggactattatatggctgtgagtgatcgtggcattacatttttaccctcaaattcttctttcaattataatgaaaatgccgattgtcctagaaaatttaatcataccaatcaaaatagtgtatcaagtggggcctccaatataccaagaaatttggattcttgttcaggtcaatatgtctatgtttatgatcttgctagcaggttcaatgaggatttgctgaaggggtgtcactctctcatgaagtgggatgatatgtgcccttacatgtctaacttaggccttggaccgaaggttattgagaaatcaaaggagaaggctctgttgaaggaaagctggtatgcaactaaccaattttcacttgaggttattttccataacacaatgaagaactacaagtgcttaaccaatgattcctcactggcttctgctatatatgtaccctactatgctggccttgatgtgggtcagtacctgtggggaggcttcaatgtttcaatcagagatgcttcaccaaaagaactagtgaaatggctggcgcaacaacccgaatggaaaagaatgtggggtagagatcatttcatggttgtagggagagttggttgggacttcaggagaagaacagaaaataatgatgactggggcaccaagctaatgcttttgccagaagcaagaaacatgtcaattatgctaattgaatctggctcaaaggtcaatgagtttccaatcccatatccaacttactttcacccctccaaggataaggaggtttttcagtggcagaaaaaaatgataaaagtgaaaaggccttacttgttttcatttgcaggtgctccaaggcctaattctaattcatcatcctccatcagaaatgagataatcaaacaatgccaatcctctaggagttgcaaacttctaagttgcaatgatggtcataattattgcaatgatcctgtgcatgttacaaaggtgtttcagagctcagttttctgtttacagcctccaggggattcattcactaggagatcaacttttgactcaattttggcaggttgcattcctgttttctttcatccagaatcagcatataaccaatatttgtggcatttgcccagaaatggttctagctactctgtgtacatacaagaaagagatgtcaaagagaagagagtaatgatcaatgagaaattgtctagagttccaaaaagtgaagtgttggcaatgagaaaggagattgtaagacttattccaaggataatatatcgttatccaagttctagattagagaccattgaagatgcatttgatatagcagttaagggaattcttgggagaatagaagcagcaagaaggaacttcacaaatatggattttaaaggcactcttttgcaggcagatgatgttaatagacatatcttatgtattttgccccaacaatattgcgttgttattcagttttaa

SEQ ID NO: 1528 - DNA, 2136 bp, Glycine Max
atggacacaattctatggcttcgaaactcctcagcatatctccccttgcaaccaaaaaccaaaaggttacaactcctcaaatacccagatgctttgtcctcaaactcattctatgcatctcttattgataattctacccacaagagacaccttgatcaaatacataaccggttagttatctccgggctgcaacataatgggtttctcatgaccaaactggttaatgggagttcaaatcttggacaaatttgttatgctcgcaagctgtttgatgaattttgttaccctgacgtgtttatgtggaatgctatcattaggagttattcgaggaacaatatgtacagggacaccgttgaaatgtatagatggatgagatggacaggagtgcatccagatggattcacttttccttatgtactaaaagcttgtactgagttgttagattttggtttgagttgcataattcatgggcagataatcaaatatggctttgggtcagatgtgtttgtgcagaatggccttgttgcattgtatgctaaatgtggccatattggtgtggcaaaagtggtgtttgatgggttataccatagaacaattgtttcatggacttccatcatttctggatatgcacagaatgggaaagctgtggaagcattgagaatgttcagtcaaatgagaaataatggtgtgaaaccagattggattgctctggtaagcattctgagggcgtatactgatgtagatgacttagagcaagggagatctattcatggctttgtcatcaaaatgggtcttgaagatgagcctgctttgcttatctctcttacagctttttatgctaaatgtgggctggtgacagttgcaaaatctttctttgatcaaatgaagacaacaaacgtgattatgtggaatgcaatgatatctggctatgcaaagaatggccatgctgaggaagcagtaaatctattccattacatgatctcgagaaatattaaaccagattctgtcactgtgaggtctgcagtcttagctagtgcgcaagttggttccctcgaattagcacaatggatggatgactatgttagcaagagtaactatggaagtgacatttttgttaatacttctctcattgatatgtatgcaaaatgtggaagtgtggaatttgctcgaagggtatttgatcgtaattctgataaggatgttgttatgtggagtgccatgattatgggatatggattgcatggtcaaggatgggaagccattaatctttaccatgtgatgaagcaagcaggggtgttcccaaatgatgtcacctttattgggcttctcacagcatgcaatcattctggccttgtaaaagagggatgggagctattccattgcatgaaagactttgaaattgtgcctcgtaatgagcattattcttgtgttgtagatctcttgggacgagcaggttatttgggtgaggcttgtgcatttataatgaaaattcccattgaacctggtgtaagtgtatggggggcacttttaagtgcatgcaagatctatcgctgtgtaacattgggagaatatgctgcaaacaagctattctcattggatccatacaatacagggcattatgtacaactctctaatctctatgcttcctcctgcttgtgggattgtgttgcacatgttcgagttctaatgagggagaaaggattgaataaggaccttggttacagtgtaattgaaataaatgggaagctacaggcatttcatgtaggggacaagtcacacccaatggctaaggaaatattcgatgagcttcagagattagaaagaaggttaaaggaggttgggtttgtcccatatacagaatctgttttgcatgatctgaattatgaagagaaggaggagaatcttagttttcatagtgagaggatagctgttgcttatggtcttattagtactgctcctggaactacacttagaataacaaagaatcttcgagcatgtgtgaactgtcattctgccataaagcttatatcaaagcttgttgagagggaaataattgtaagggatgcaaatcggtttcatcattttaaagatggtcaagcccttgctgatgagtatggtgtcaagttttttgaaacc

SEQ ID NO: 1529 - DNA, 2097 bp, Glycine Max
atggagataacctacgcatcccctagcttctccgacctccgcgccatgccgtcgacggcgaccgccgcgcgtcccgtcaggatcattcccctgcagcacccgaccgccacgacgtcgtcgccgcagccgaacgccgccttctcgcgctggacggcgaagctccggcgaatgacgtggctggagtggattgaattcttcctcccttgcctccgctggattcgcatctacaactggcgcgagtatttccaggtcgatctcatggccggaatcaccgtcggcgtcatgctcgttcctcagtcgatgtcgtatgcgaaattggctggacttcaaccgatatatggactctactctggttttgtgcccctatttgtatatgccatatttgggtcttctcgccagcttgcagtaggtccagtggcattggtttctctcttggtctctaatgtgctgggtagcatagctgattcatccactgaattatacacagagctggcaatattactgtcccttatggttgggataatggagtgtataatgggactcttgaggcttggatggctgattcgtttcattagccattcagtgatttctggctttacaactgcttcagctattgtcattggtttatctcaagcgaaatacttcttggggtatgatatagatgggagtagcaagatcattccagtagttaagagtataatagctggagcagataagttttcatggcctccttttgtgatgggatccattatgcttgcaatactgcttgtcatgaaacacctgggaaaatcgaggaagtacttgcgattcttgagagctgcaggtcctcttacagcagtagttctgggaacaacttttgcaaaaatatttcatccatcatcaatttctttggtgggagatatacctcaaggcctaccaaaattttctgttccaaaatcttttgagtatgcacagtccttaattccaactgctcttctcataactggtgtggctatattggaatcagtgggaattgcgaaggcattagcagcaaagaatgggtacgagttggattcaaatcaagaggtgttcggtcttggtgtttccaatgttcttggttcatttttttcagcataccccacaacaggatccttttcaaggtcagctgtaaatcatgaaagtggtgcaaaatctggtgtatctgggattgtttcaggaattataatgacctgtgcacttttgtttctaacaccattatttgagtacatacctcagggtacccttgctgccattgtgatctctgctgtgataggtctggtagattatgatgaggccatttttttgtggcgtgtagataagaaagattttcttctttggaccattactagcactacaacattgttccttggtattgagattggggtccttgttggggttggggtttcacttgcgtttgtcattcatgagtcagcaaatccacatattggtgttttgggtcgtttgccagggacaactgtttataggaatgttaaacagtatcctgaagcatatacatacaatggaattgtaatcgttcgtgttgatgctccaatttattttgcaaacacaagttacatcaaggacaggttgcgtgaatatgaagttgatgttgatcgttctaaaagacgtggacctgaggttgaaagaatttatttcgtgattctagagatggcacgtgtgacatacatagattctagtgctgttcaggctttgaaagacttgtatcaggagtacaaattacgggacattcaggttgcaatatccaatccaagtccagaagttctgcttaccttgtctagatcgggtctggtggagttgataggcaaagaatggtactttgtgagagtacatgatgctgttcaagtttgcttgcaacatgttcaaagcttgaaaggagcatctaacagtccacaagcaccattctcttcagtagagaacaaaccaagtttgtttgcacgattatcaaaagagagagtggagaagctttcaattaccgacttggagtctggtaatggcaggcctccactccccgaggagagagattccaaattggagccattgttgtctaaagatcattga

SEQ ID NO: 1530 - DNA, 1473 bp, Glycine Max
atggagatgcttcgcagaagcagcagaagactcttcgtctccgcgtgtctgtggttgcttctgtcaccgtcaccgtcaccgtcaccgttgagtgtcgttagcgccgcccacggcgtgttcaacgtgaagtgcaagtatcaggaccgcaccctctccgccctcaaagcccacgactaccgccgccagctctccctcctcgccggcgtcgacctccccctcggaggctccggccgccccgacgccgtcgggctttattacgctaaaattggtattggaactcctccgaagaattactatttgcaggtggacactggcagtgacattatgtgggtgaattgcattcagtgcaaagaatgccccaccagaagcaaccttgggatggaccttacactctacgacataaaggaatcctcctctggtaaatttgttccctgtgatcaagagttttgcaaagagatcaatgggggtctgctgaccggatgcactgctaatatttcctgtccatatctggagatatatggtgatgggagctcgactgctggttactttgtaaaggatatcgtactttatgatcaagtgtctggggaccttaaaactgattcagcaaatggaagtattgtatttgggtgtggtgcaagacaatctggagatctaagttcttcgaatgaagaggcacttggtggaatacttggatttggaaaagctaattcatcaatgatttcacaacttgcttcttctggcaaagtgaaaaagatgtttgctcattgcttaaatggagtaaatggaggtggtatatttgctattgggcatgttgtgcaacctaaagtaaacatgactccattattaccagaccggccacactacagtgttaatatgactgcagttcaagttggccatgctttccttagtctatcaacagatacatcaacacaaggagacagaaaagggacaataattgacagtggtacaaccttggcctatctgcctgaaggaatttatgagccgctagtatataagataatttctcagcaccccgatctaaaagttcggactctccatgacgagtatacgtgctttcaatattccgagagtgttgatgatggatttccagctgtcacattttattttgaaaatgggctctcgttgaaggtttatcctcatgattatttatttccctcgggagatttctggtgtattggttggcaaaatagtgggacacaatcaagagatagcaaaaatatgaccttattgggagatttagtgctttcaaataaacttgtcttctatgaccttgaaaatcaggttattggatggactgagtacaacggttcttcaagcattaaagtgagggatgagcgaacgggaacagtccatttagttggtttccactacatttcttttgcttgtggtttaaacatcaacttggtgatgattttgtctctacttgctctacttcataaatgggtatattga

SEQ ID NO: 1531 - DNA, 3102 bp, Glycine Max
atggatctttcgagtctcgctgttatactccaggccgctctcagtcccaatccggacgagcggaaagcagctgagcagggcttgaatcagtatgcgcctcagcatctggtgaggctgttacaaatcattgtagacaacaacgttgacatgggtgtacgacaagtggctagtattcatttcaagaactttattgccaaaaattggtctcctcttgatggtatgctctttttattgttgaagatctctcagagtgataaagatgtggtgagggatcacattctcgtgtttgtaacccaggttcctcctttgttgagggtacagcttggtgaatgccttaaaacagttatacattctgattatcctgagcagtggcctcatcttcttgactgggtgaagcataacttacaggatcaacaagtccatggtgccttgtatgtgctgcggattctttctagaaaatatgggttcaagtcagacgaggaaagggtaccagtttatcgcgttgttgatgagacatttcctcacctgctcaatatatttaacaggcttgtccagattgttaatccatcacttgaagtagctgatttaatcaagcttatctgtaaaatattctggtcctccatatatttggagattcctaagctgttgtttgatcaaaatatcttcaatgcttggatgatgctatttttaaatatattggagaggcctgtcccctctgaaggtcagcctgttgatcctgatcttagaaaatcatggggttggtggaaggtcaagaaatggacagttcacattctcaataggctctacactcgttttggagacttgaagctgcaaaaccccgaaaacagagcctttgctcaaatgtttcagaagcattatgcggggaaaattttagagtgccacttaaatctgttaaatgtcattcgtgtaggtggctatttacctgacagagttatcaacctaattcttcaatatctaagcaacagcatttcaaggaatagtatgtatactctgctgcaaccacggcttgatgtccttctttttgaaatagtgttcccccttatgtgcttcaatgataatgatcaaaagctttgggatgaagatccacatgaatatgtaaggaaaggctatgacattattgaagatttgtatagtcctaggactgcttccatggattttgtgagtgagttggttcgaaaacgtgggaaagaaaatcttcaaaaatttattcaattcattgttgaaattttcagaaggtatgatgaagtttctgcagaacacaagccctatagacagaaagatggtgcgcttcttgctatcggggcactttgtgacaaattgaagcagaccgagccatacaaatctgaacttgagcgtatgttagtgcaacatgtctttcctgagttcagcagtcctgttggccaccttagggctaaggcagcatgggttgcaggacaatatgcccatattaacttctcagaccagaacaacttccggagggctttgcagtgtgttgtatccagaatgcaggattctgaacttcctgtgcgtgttgattcagtttttgctttgcgttcttttattgaagcttgcaaagatttgaatgaaatccgtcctattcttcctcaactccttgatgagtttttcaaacttatgaatgaagttgagaatgaggaccttgtatttacattggagactattgtggacaagtttggggaagagatggccccttatgcacttgggctttgccaaaatttggccgctgcattttggaggtgtatgaacactgcagaagctgatgaagaagctgatgatccaggtgctcttgctgcagttggttgtttacgtgctattagcacaatacttgaatcagtgagcaggcttccacatctttttgttcaaattgaacctactttgcttcccataatgcgtagaatgttaacaaccgatggtcaagaggtttttgaagaagttttggagattgtatcatatatgacttttttctctccaacaatttcattggatatgtggagtctttggccattgatgatggaagcactggcggattgggcaattgatttctttccaaatattttggttcctttggacaactatatttcaaggggaactgctcatttccttacttgcaaagagcctgactatcaacagagtttatggaacatgatttcatccattatgtcggataaaaatatggaggacaatgatattgtgccggctccaaagcttattgaagttgtcttccagaattgcagaggacaagtggatcactggcttgagccgtatctcagaattacggttgaacgcttgcgtcacactgaaaaatcttatttgaaatgtcttttcatgcaagtgattgcagatgctctttactacaatgcagctctgactctcagtatattgcaaaagctaggtgttgcatcagaaatattccatctttggttccatttgctgcaacaagttaagaagagtggaatgcgtgctaattttaaaagggaacatgaaaagaaagtatgctgccttggtttaacctcattactggcactcccagctgatcaattgccagcagaggctttaggtcgggtgttccgggccaatcttgatcttctagttgcctacaaggaacaagttgcagaagctgcaaaagaggaggaagctgaagatgatgatgatatggatggttttcaaaccgatgatgaagatgaggatggcagtggttttgacaaggaaatgggagttgatgctgatgatggagaggacaccgatactatcacacttagaaagttggccgaacaggcgaagtctttccggccccatgatgatgatgatgatgattcagatgatgactttagtgatgatgaagagttgcagtccccaattgacgatgttgatccttttgttttctttgtggatacaatcaaagtgatacaatcatcggatccatcgaggtttgtgaaccttacccaaacgcttgagtttaattatcaagctctcgctaatggtgttgcccagcatgctgagcagagaagggcagaaattgaaaaggagaaaatagagaagtcaacggctgccacagcttcttaa

SEQ ID NO: 1532 - DNA, 1353 bp, Glycine Max
atggattgttggtactctcctcaccctctccatgatgaattcgagaagcttgtcattcgaatgaaccccccaagagttgctgtggataacatttcaagcggaacagacactgtcataaaggttgatagcgcgaacaagcgtgggagcttgttggaggtggttcaggttctcactgatatgaatctcagtgttagaagagcttatatttcctctgatggagaatggttcatggatgtttttcatgtcacggatcaaaatgggaaaaagtttatgcaagatgatgttgctgaccgcattcaacagtcactgggtccaagagcctctagttttcgatccttgagaaggtctgttggggtccaagctgaagcagaacatacaaccattgaattaactggaagagacaggccaggattgctttcagaagtgtttgctgttcttgcagacctcaaatgcaatgtggtagcagcagaagtctggacccacaattcaagaatggcatctgttgtttacatcacagacgaggcgacgggattgtccattgacgatccggatcgccttgccaagattaagcagcttctactgtatgtgctgaaaggagacatagataagaagagtgctaacactgctgtttctgttggttctactcacaaggataggaggctgcatcagttgatgtatgccgaccgtgattatgacgtagatgatggggattctgggtcaacaagtgacaggaacaagctcctagtaactgttgatgattgcatagataagggatacactgttgtgaacttgaggtgtccagacagaccaaagttactgtttgataccgtgtgcacactcacagacatgcagtatgttgtgtaccatggaactgtcattgctgaaggaccagaggcatatcaggaatattatataaggcatgtagatggaagtcctatcagttctgaagcagaaaggcaaagagtgattcattgtttggaggctgctgttaggagacgaacttctgagggtataaagctagaattatgtggggaagacagggttggccttctgtctgatgtaactcgcatctttagagaaaatggtctttcagtcaaccgtgctgaagttacaaccaggggcagccaagccatgaatgttttctatgtgactgatgtatctggaaatccagttaagagtgaaacaattgaaacagttcgaaaagagattggcttgaccatactgcatgtaaaagatgatgtctgctctaaacctccaccgcaagagagtggaaaattctctctgtctaatctctttcggtcaagctctgagaaatttctctacaacttgggtttgatgaagtcttattcttga

SEQ ID NO: 1533 - DNA, 1962 bp, Glycine Max
atggcaacaaatggcaagacacctgcgataggaatcgatttgggcacgacatactcatgcgttgcagtgtggcagcgtgatcgagtggagatcatcgcgaacgaccaaggaaacagaacaacaccctcttatgttgctttcaataacacccaaaggatgattggtgatgctgccaagaaccaggctgctaccaatccaaccaacactgtctttgacgcaaagcgcctaattggtaggagatttagtgatcaagaggttcaaagtgatatggagctatggccattcaaagtcattgctgatgttaatggcaaaccaatgattgctgttgattacaattgtgagaaaaagcaattttctgcagaagaaatttcatccatggttttggcaaagatgcttgacattgcagagtctttccttggatcaacagtgaagaatgctgttatcactgtgcctgcttacttcaatgattctcagcgacaagctactaaagatgctggtaaaattgctggcctcaatgttttgagaatcctccatgagccaactgctgctgcaattgcatatcggcttgaaatgaaaaattgtaataatgatagaaggaacgtttttgtgtttgatcttggtggtggtactttggatgtgtctcttcttgtttttgagaaggatcatatccgagttaaggcaactactggagacactcacctcggaggagaggacttcgataacaatatggtgacttactgtgtgaaagagtttaagagaaagaataaaatggacattagtggaaacaaaagagcccttaggaggttgaggactgcttgtgagaaagcaaagaggatactctcatgctctacaatgaccaccattgaggtagactctttgtatgatggtattgatttccactcatcaataagtcgcgcaaagtttgaggaactcaacaaggactaccttaacaagtgtattgagtttgtagggaagtgtctgatagatgctaagatggacaagagtagtgttcatgatgttgtcctcgcaggtggatctactaggattcccaaattgcagcaactattaagtgacttctttgatgggaaggatctctgcaaatgcatcaatgctgatgaggccgttgcatatggtgctgctgtccatgcttatatgcttaatggtgagtccagtgagaaggttcaaaacgcttcactttgggaagtcactcctctttcccttgggttgcaagaagatggaggtatcatgaaagtaatcattcctaggaatactagcattcctacaaagatggaagatgtactcacaacacattttgataaccaaaccaatatcttgattcatgtatacgagggtgagaggaaaagaactagagacaacaacttgttgggtaagtttgtgctagaaattcctccagttccacgtggtgttcctcaaattagcgtttgctttgaacttgattatgatggcatcctacatgtttctgccgaggaaaaatctaggggaatatccaagaagctggccataacaaatgacaaaggaaggctttcgaagaaagaaattgaaaggatgatatcagaagcagagaagtacaaagctgaagatgagatgtataggaacaaggtacaatcaaggcatgcattggagaagtacgcttacaacatgagggatgctataaacattaaggagattagcttgaagctttctccagaagacaagaaaaatatcaatgatgcaattgattctgccttagagtggctcgaggtcagcatggatgcaaacccaaatgattttgacaacatgcggagcactctttctagcgtttttaatccagttattgtgaagatgataaaggatgaggataatgttgcgcctccagatactgttgctagctctgtgtattcagctgctacaggtgatatcattggatttgcttccgtgattgttgactgtttgtcaatttag

SEQ ID NO: 1534 - DNA, 2133 bp, Glycine Max
atggcaacaaatggcaagacacctgcgataggaatcgatttgggcacgacatactcatgcgttgcagtgtggcggcatgatcgagtggagatcatcgtgaacgaccaaggaaacagaacaacaccctcttatgttgctttcaataacacccaaaggatgattggtgatgctgccaagaaccaggctgctaccaatccaaccaacactagcacaccggtgatagggatcgatctaggcacgacatactcgtgcgttgcagtgtggcaacacgaccgtgtggtgatcatcacgaacgaccaagggaacagaacaacaccctcttgtgttgccttcaaaaacacccaaaggatgatcggtgatgctgctataaatcaagctgctgccaatccaaccaatactgtctttggtgctaagcggctaattggtaggagatttagtaatccagaggttcaaagtgatatgaagcaatggccattcaaagtcattgctgatgttaatgacaaaccaatgatcgctgttaattacaattgtgaggaaaggcacttttctgcagaagaaatttcgtccatggttttggaaaaaatgcgagcgattgcagagtcattccttggatcaacagtgaagaatgctgttatcactgtgccagcttacttcaatgactctcagcgacaagctaccaaagatgctggtgccattgctggcctcaatgttttgagaatcatcaatgagccaactgctgcggcaattgcatatcggcttgaaaggaaaaattgtaataatgaaagaaggaatgtttttgtgtttgatcttggtggtggtactttggatgtgtctcttcttgtttttgagaaggattatatccgagttaaggcaacatctggagacactcacctcggaggagaggacttcgataacaatatggtgacttactgtgtgaaagagtttcagagaaagaataaaaaggacattagtggaaacgaaagagcccttaggaggttgaggactgcttgtgagaaagcaaagagaatactttcatccactgtaatgaccaccattgaggtagactctttgtatgatggtattgatttccactcatcaataagtcgcgcaaagtttgaggaactcaacatggactaccttaacaagtgtatggagtttgtagagaagtgtctgatagatgctaagatggacaagagtagtgttcatgatgttgtcctcgcaggtggatctactaggattcccaaattgcagcaactattaagtgacttctttgatgggaaggatctctgcaaatgcatcaatgctgatgaggccgttgcatatggtgctgctgtccatgcttctatgcttaatggtgagtccagtgagaaggttcaaaacactttaccgagggaagtcactcctctttcccttgggttggaaaaagaaggaggtatcatgaaagtaatcattcctaggaatactagcattcctacaaagatggaagatgtattcacaacacatttggataaccaaatcaatatcttgattcatgtttatgagggtgagaggcaaagaactagagacaacaacttgttgggcaagtttgtgctagaaattcctccagttccgcgtggtgttcctcaaataatcgtttgctttgaagttgatgatgagggtatcttgcacgtctctgccaaggagaattccttgggaataaccaagaaggtgaccataataaatgacaaaggaaggctttctgaggaagaaattaagaggatgatatcagaagcagagaggtacaaagctgaagatgagatgtataggaagaaggtagaagcaaggtatgcattggagaagtacgcatacaacataaggaatgctataaagcataaggggattagtttgaagctttctccggaagacaaggaaaagatcaatgatgcagttgatcgtgccttagaatggcttgaggtcagtgtggatgctgaaaaagaagatgttgacaatttccggggcaatctttctagcgtttttgatacaatcatggttaaaatgataaagggtgaggataatggtgcgcctccagaatcgctggttatcaatattggcaaaatttggtctccaggcagtgtattcagctgttacaggtga

SEQ ID NO: 1535 - DNA, 72 bp, Glycine Max
atggcaagcagtgacaccaagaaaaaaaaatcccattataaacattttttcccctcaatcttcttctcatag

SEQ ID NO: 1536 - DNA, 114 bp, Glycine Max
atggcaatccctcacccacccgcccaacatgggaatacaattttgggtaatgctacccacccccaaaaccctaatttaataaacactgttttggggggatgtgattctccataa

SEQ ID NO: 1537 - DNA, 759 bp, Glycine Max
atggcaatgcatagaattgcaattgggacccctggagaggctgcccaacctgatgcaatcagagcagcatttgcagaattcttctgcatgatcatttttgtttttgctggggaaggatctggcatggcttacagcaaacttaccaacaacggacctgcaacaccagctggtctcattgctgcatcactatctcatgcatttgggctttttgtggccgtttctgttggggcaaacatttctggtggtcatgtgaaccctgcagtcacatttggtgccttcataggaggaaacataaccttgttgagaagtattttgtattggattgcacagttgtttggttcagttgttgcatgcattcttctaaagcatgcaactggtggaatggaaacatcaggtttttctctatcccctggtgtgtctgtgtggaatgcattggtttttgaaatagtgatgacttttgggttggtatacacagtttatgccacagcagtggacccaaagaaagggaatgcgggagttgttgcaccaattgcaattggttttattgtgggtgccaacatcttagttggtggtgcatttgatggtgcatcaatgaacccagctgtgtcctttggccctgctgtggttacatggtcatggacccatcactgggtctattgggttggtccattcattggtgcagcaattgctgcaattatctatgataatatcttcattggagatgatggccatgaacctctttcaagcagtgacttctag

SEQ ID NO: 1538 - DNA, 651 bp, Glycine Max
atggcagcaccacctgcgagggcacgtgccgattacgattacctcatcaagcttcttcttattggcgatagcggtgtgggaaagagttgtctgcttttgcgattttctgatggttccttcacaaccagttttatcaccaccattggcattgattttaagataagaaccattgaacttgatggcaaacgcattaagttacaaatctgggatacagctggtcaggagcgatttcgaactattaccacagcttattaccgtggagccatgggtatcttgctcgtttatgatgttactgatgaagcatctttcaacaatattagaaattggattcgcaacattgaacaacatgcttctgacaatgtaaacaagatacttgtgggtaacaaggctgatatggatgaaagtaaaagggctgtgcctacctccaaaggtcaagcccttgctgatgagtatggtatcaagtttttcgaaaccagtgcaaagacaaacatgaatgtggaggaggttttcttttcaatagcaagagatatcaagcaaaggcttgctgacacagattctaaggctgaacctcagactatcaagattaaccaacccgaccagacagctacagggggtcttgcggctcaaaaatcggcttgctgtggttcatga

SEQ ID NO: 1539 - DNA, 768 bp, Glycine Max
atggcagcctactcaagccatgctttgaaaaccatccctttttcttcctttgtgaagcctgtcagtaccaaaccaacatcattcttcacaccttcacctaccaaacctttcttacccttcacctcaccaaaccactctctcaccaaaaatctcaagctgaactccactttgccacacttttgcttgtcttcagttcccaagaaatctttcacttgtagaagccaggctgagcctgttgactcagaaaaagtccaagaactgagtgtgtatgagatcaacgagcgtgaccgtggaagccccgtttatcttcgattgagctataaaagtgtcaattcccttggtgatttagtcccctttagcaacaagttgtacactggagatttgcaaaagcgcattgggataacatctggtatctgtattttgatccaaaacaaagctgaaaagaaaggggacaggtatgaagcaatcttcagcttctactttggagactatggtcacatagcagtgcagggaccttacctgacctatgaggacacatatttggctgtgactggtgggtctggcatatttgagggtgttaaaggtcaagtgaagctgcgtcagattgtgtatcctttcaagattttgtacacattttatctaaagggtatcaaggatttgcctcaggagcttcttgtcaagactgttgagccaattccatctgttgaaccttcccctgctgctaaggcccttgagcccaatgctaccattgctggcttcaccgactaa

SEQ ID NO: 1540 - DNA, 3078 bp, Glycine Max
atggcatggtttagagctggagcaagcatagcaaaacatgcaattaggagaactctttctaagggtggatccacacaccttgtgtcaagggcaagggtccttccatcgataccatcatcacatagcagaagcttccacagctcggttttcaaggagcaagctgcacctgttcctcgtgcggttcctctttcaaagctaacagatagtttcttagatggcacaagcagtgtgtatctggaggagcttcaaagggcttgggaggctgatcccaacagtgttgatgagtcatgggacaatttcttcaggaactttgtggggcaggccacaacctcacctgggatttctggtcagacaattcatgagagcatgaggttgttgttgctggtgagggcgtaccaggttaatggccacatgaaggcgaagttggatcccttgaatctggaaccaagggaaatccctgaggatttggaccctgcactttatggcttcactgaggctgatcttgatagagagttcttcttgggggtgtggaggatggctggtttcttatctgagaaccgccccgtgcaaacccttagatccattttgacaaggcttgagcaggcctattgtggaagcattggatatgagtatatgcacattgctgatcgtcacaagtgtaattggcttagggataggattgagacccccacccctacacagtttaatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagggcatctgatcttggggttgagagcatagttataggaatggcacatagagggaggctgaatgttttggggaatgtggttaggaagccgctgcggcagattttctgcgagtttagtggtggtcttcagcctgagggggaagttggactctacactggaactggagatgttaagtatcacttggggacgtcgtatgatcgccctactcggggtggcaagaggattcatttgtctttggtggcaaatcctagtcacttggaagctgttaatccagttgttgttgggaaaactcgtgccaagcagtattactcaaatgatgtggatagaacaaagaacatgggtgtgctgattcatggagatggaagttttgctggacagggtgtggtctatgaaaccctgcatttaagtgctcttccaaattacactactggtgggacgattcacatcgtgtttaataatcaggttgcatttacaactgatccaacgtctggcaggtcttcacaatattgcactgatgttgccaaggctttggatgctcccatctttcacgtgaatggtgatgatgttgaagcagttgttcatgcctgtgaacttgctgctgagtggcgccagactttccactctgatgtggttgtcgacttggtgtgttaccgtcgatttggccataatgagattgatgaaccatctttcactcagcctaaaatgtacaaggtaatccgaagccatccatcaactcttgagatctatgagaagaagcttttggaatcaggggagttgacacaagaagaaattgataggatacacaagaaggtcacatcaattctaaatgaagaatttttggctagcaaagaatacattccaaaaagaagagattggctttcagcgtattggcttggtttcaagtcacctgaacagctttcacgtatccgaaacactggggtgaaaccagagatcttgaaaaatgttggaaaagcaatcacaaccatccctgaaaatttcacacctcatagagcagtgaagaggatatatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggagagaaatattgtcccctggacaatgttataatgaaccaagatgaagagatgtttaccgttagcaataggtcactttctgagtttggtgttcttggatttgaattgggttactcaatggaaaatcccaattcattgataatttgggaggctcagtttggtgattttgctaatggtgctcatgtcatatttgacaatttcttggcttctggtgaggctaagtggctccgtcagactggtcttgttgtgttacttcctcatggttatgatggccagggcccagagcattcaagtgcaagattggaacgctttcttcaggtggctgatgacaaccctcatgttatccctgagatggatccaactcttcggaagcagattcaggagtgtaatttgcagattgtgaatgttacaactcctgctaattttttccatgttctaaggaggcaggtacatagagaattccgcaagcctctcattgtaatgtcccctaagaacctgcttcgtagcaaggcttgcagatcaaatttatctgagtttgatgatgtccaaggccacccaggctttgacaaacagggaaccagattcaagcgcctcataaaagatcaaaatgagcacaaagatgttgaggagggtattagacgtttagtactttgctctggaaaggtttactatgaacttgatgaacatcgaacaaaggttgatgcaaaggatgttgcaatatgtagggtggaacagctttgtcctttcccttatgaccttgtccaacgagagcttaaacgatatccaagtgccgaggttgtttggtgtcaagaagagccaatgaacatgggtggatacacttacattttaccccgacttatatcttcaatgaaagctgtaaataggggaggttatgatgatgtcaaatatgttggtcgtgctccatctgcggccacagccactggtttcctcaaggttcaccagaaggagcagactgagattgctgaaaaagcccttcaacaggaaccgatcgacttcccattttga

SEQ ID NO: 1541 - DNA, 1191 bp, Glycine Max
atggccaacattttcctacacaatgggggcaacacttgcaaggctaccctctatctcttattcataaccacaaccttttttatcgcaaactctgcaaggattctagatgaagtggaatcccaaccccaagccataggcaatctaccagcacctggagctaccaatccttcactcacaacagctccagtcaccaccacaccacagatagatcctgccaccactttgccaagtggccaaacatctgcacccaccaccatatcacaggtaggtcctgccaccactttgccaagtggccaaacacctgcaaccgccgccaccatgaaccctgctactacagaagactctggagaggaagatgataaccaagtagagccaccagttccagaaacagaagctccagctgctgtcactgcaccggctgaagaggaaactccagctatccctagtgcggctccagtgacaccaaactctttggcaaaagagccatctttttctttcttcatgcatgacatccttggagggtcacgtccatcagcaagagtggtagcaggaatagtagcaaacactgatgtcactggcctaccattctcaaagctcaacaacaacctcttcccaatcactggaggaattccactggtaaaccccaagctcaacggcatcataaccaacaacaatctcccaaaccttgtaggcctcagtggtgcacaatcctccactgtgttcaagaacagtggcaccagcaacactgtcactggtggcaacaaccaaccatttgtctcagcaggtaacctccctgcaggattcaccatccagaagctcatgttcggctcggtgacggtgatcgacgaccagctaactgaagggcacgagcttgattctgctgtgattggaaaggcacaagggttctacttggcaagttcattggatggtagcagccagaccattttgttgacagttttggtgcatggtggtgagcatgatcaacatcatgatgtggtggatgacagtatcaatttctttgggattcataggacagcttcatcagaatctgaggtagcagtgattggtgggactggcaagtatgagaatgctagagggtatgcttcacttgagactcttctcaaggaggaccagcacaccactgatggggtggacaccatcctgcatttcaatgtctacctcactgagtag

SEQ ID NO: 1542 - DNA, 1806 bp, Glycine Max
atggccaccacgctttattcaacgccttgtcgttcactggctacttcatcctcctcttcctcgtcgttgcaaccctgccctctgtcgtctaacctcgcttaccctcaacgcgtcaccttctcacagcgctttctcgcctccaaggtctctctcaaatctcaaccccaaccgtatcagattcccgttcacacccagcagccggaaggtacagtgacagctgctgtgacccctgttgaaaatggcacttctcacaagcagttgaaggctgacttattgtctcttaagtccccagatgagtctgaagacggttttgaaaaggatgaaaatgagtccagtgttagtattactgttgttggagcctctggagaccttgctaagaagaagatatttccggctctctttgcgctttactatgaggattgtctccctaagcacttcaccatctatggttatgcacgaagtaagatgactgatgcagaactgagaaatatggttagcaagaccctcacttgtagaattgataagagagagaactgcaatgagaagatggaccaatttctaataagatgtttctaccattctggtcaatatgattctcaggaaaactttgcagcactagacaagaagctgaaggaacatgagggtgggagaacttctaatcgcctgttttatctttcaattcctcctaatatattcatagatgctgttaaatgtgcaagcttgtcagcttcttctggtaatggttggaccagggttattgttgaaaagccttttggccgtgattcagaatcttcggctgcattaacaaaatcactcaagcagtatctgacagaggatcaaattttcaggattgaccactatcttgggaaagagcttgtggaaaatctttctgttctccgattctcaaatctcatctttgaaccattatggtcaaggcagtatataagaaatgtacagttgatattctcagaagattttggcactgaaggacgtggcgggtactttgaccattatggtatcataagagacattatgcagaatcatttacttcaaatactagcactctttgcgatggaaacccctgttagtttggatgcagaggatattagaaatgaaaaggtcaaggttcttcgttcgatgagacccctacgacttgaggatgtggttataggtcagtataagagccacactagaggaggagttacatatccagcatacgttgatgataaaactgtaccaagcggcagcttaactccaacatttgctgcagctgccctcttcatagataatgcaagatgggatggggtaccttttctgatgaaggctgggaaagcattacacaacaaaagagctgagatacgggtacagttcaggcatgtgccaggtaatctgtacaatcggaatttcggtactgatcttgatcgggctacaaatgaacttgttataagagttcagcctgatgaggctatttatctgaagataaacaacaaagttccgggtctgggaatgaagttggatcgcagtaatctcaatcttcactacgctgcaagatattcaaaggagattccagatgcatatgaaaggttacttctggatgccattgaaggagaaagaagactcttcattcgtagtgatgaactggatgctgcttggtcactctttacacctgtactgaaggagcttgaagagaagaagataattccagagtactatccttatggtagtaggggtcctgttggtgctcactatcttgcagccagacacaacgtgcgatggggtgaccttgggacagacgtagaccattaa

SEQ ID NO: 1543 - DNA, 741 bp, Glycine Max
atggccgaagagcccgaaaacaatccaccgccaccggaacctccaatcccctccgcaccggatgccgcggaggaaactgcagctccggctccggcaacgacgtcgcaaccaagtgccgagatcgtcgctcctctggcgctagctccgaagcggcagcgccgtccgagtgttcgcctgggggagatcggcgaccaacgcgcctcctccgcgcacggccacgactcgcacacgcgccgcccgagcatgccgccatggagctggcggactccgaaggaatcttccagaacctcgaaggcgcgcaccgtaacgaacctcgcgaacggcggcgaagagttcggaaacagcaacagccgaagaggaaaagcaaaacgaggaccagcgacgaagcgattgagaacaaattgggctcctagagcgacaatcgacgaaaatggtgacgaagaaggttttagggatttcgaacacgaacacgaacagagtccagatcctagggttagggtttcggaaaacgacggcgttgaatcggagtcgcaggaacggaggaagagcgatggagttcggtcttggctttacgagttagggctgagtaggtatgcgcctatgtttgagatccatgaggtcgatgacgagttgcttccgatgttgactttggaggatctgaaggacatggggatcaatgctgttggttcaagaaggaaaatgtacactgcaatccagaagctgaggaaatgcttgccgtga

SEQ ID NO: 1544 - DNA, 1026 bp, Glycine Max
atggccgctgccagcctggtgtccctttgggtcctcttctccggcgttgctttgtttcctggaagttgctcgccgcagcatcataacattcttaaacttaaaatgatctcccccttcactcataacctttcaacctccaaaatcattgactcccatctccatatctgggcttctcctcaagaggcttcggaattcccttatgctcccggacaagagccccctgtaccaggaaatcttcattttttgctccagaatatggaggaggcaggagtagatggcgttctcattgtgcagccaatatttcataaatttgatcatagttatgtcacaagtgctttgaagaaatacccgaccaaatttgttggttgttgccttgctaatccaactgatgatggaagtggactgaagcagtttgaagatcttgtcttaaaggatggttatcgtgctgttcgattcaacccagaattgtggccagctggggaaaagatgacaaataaagttgggaaggcaattttccaaagggctggagaactgaatgtaccagtgggattcttgtgcatgaaggggattggtctatatatgtctgagattgagcagttgtgcacagaatttccatcaacagttgtattgattgatcacttgggcttcatcaaaccaccattgaatgaagaagaaggtcttgtcttttctcagcttttgaatctatctagattcccaaaagtatatgtgaaatttagttctctttttcaagtgtcaagagagaagtttccttatctggatttggctcctcttttgtcccaagttgtcgctagctttggtgctaaccgtgttatgtggggcagtgattttccatatgctgctgctgaatgtggctacaaagcagccaaagaagcagtgcttcttattgccaaccagatctctttgcctccgtctgatttagagtggatcatggggagaactgttgcacaactcttcccaaaccaatggactgatgctaagcaaggttttcatagagagcgggagtga

SEQ ID NO: 1545 - DNA, 987 bp, Glycine Max
atggcgctgaggctgactactgttgtttcaagtgttggtcattcggggaaacccaggtttaggttcagaatcagaagtgttgctgccacagttagaaacatggccttcagtgcaacctccaaggtaattgattcccatctccacgtgtgggcttcacctcaagaggctggcagattcccttattctcttggacaagaacctactttaccaggaaatgccgagtttttgctccagtgtatggaggaggcaggagtagatggtgcactcattgtgcagccaattaatcataaatttgatcatagttatgtcacaagcgttttgaataaatacccaacgaaatttgttggttgttgccttgctaatccagcagatgatggaagtgggcttaggcagtttgaagatcttgttttgaaggacggttatcgtgctgttcgattcaacccatatttgtggcctcctggagaaaagatgacaaataaagttgggaaggaaattttccaaagggctggagaactcaatgtgccagtgggcttcatgtgtatgaaggggcttgatctgcatatttctgaaattgagcaattgtgcacagaattcccatcaacagttgtattgcttgatcacttgggcttttgcaaaccaccaagaaatgatgaggaaggtcttgtcttttctcaacttttaaatctgtctagattcccacaggtacatgtgaaatttagtgcccttttcagagtgtcaagagcacagtttccttatctagatttgtctcctctcttttcccaagttgtctctcactttggtgctaaccgtgtaatgtggggcagcgattttccatttgttgttgctgaatgtggttacaaaggagccaaagaagcagtgcatcttattgccagtgagatctctttgcctttatcagatttagagtggatcatggggaggacagctacacaactcttccaaaaccaattgactccagtcaatagttga

SEQ ID NO: 1546 - DNA, 2202 bp, Glycine Max
atggcggatacaattgtggttttcctgatagaaaagttgacgaggttgttagcagaagaagccaaactacttggtagcgcgcacgacaaagtaacatcgttgcgcaacgagctgaggttcatgaacctcttcctcaacaactcccaaggcaagcgcaaagatcacaacatggtcgcggaactcgttgaccaaatcagagacatcgcccacgaagccgaagacgtcatcgacaactacatcagcgacatgatcaagcagagaaggagaaacatgctggagaagtttggccgcggcgtagaccacgcgctcatgcttcgcaacttgaccgtcaaaatagacaggatcaagaccaccatcaacgatatcttcgacaataaggtcaagtacggcatcgaagctggaaggagagacagcgaggaagaagcagagcgtatacggaagcaaagaagagacgtggaggaacaagaggttgtaggatttgcgcatgactccaaggttgttgtaattgagaaactcatggcatcgggttcgcgccttaaactggtttccatcgtcggtatgggtggtttgggtaagaccaccctagccagaaaaatatacaacagcaacagggtcaagaacacgtttccttgtcgcgcatggggttatgcctctaacgattatcgacccagggaattcttcttaagccttctcaagtgtttgttgtccacgtctaagtacaacgatttgttcaagaaaagagaggaggcaagtagaagcgaggaggagctgaagatgaaggtgcgagaatgcttgagcagaagcggtggcaagtacttggtggtggtggacgatgtgtggcaaagccaagtgtgggatgaggttaaaggtgctttccctgatgacagcaatggaagcagaatattgataactactcgtcatgctgaggtggcttctcacgcaggtccaatgcctccctactttctccccttcctcaccgaagaagaaagctgggagcttctttccaagaaggtgtttaggggcgaagattgtccttctgatttggagcccatgggaaaattgatcgctgaaagctgtaatgggttgccacttgccatcatcgtcatggcggggattcttgcaaacaagaagtcactgagggattggtctagaatcaaggatcatgtgaattggcatcttggcagggacaccacactcaaggatatactgaaactcagctatgacaccttgccagcgaggttgaagccttgctttctgtattttgggatgtaccctgaagactacaagatccccgtgaagcaattgatccagttgtggatatctgaagggctattaacacaagaaacttgcggaagcagcaccaacataccggagccggaatacattgcggaagagtacttggatgaactagtggaccgaagcttgatccaagtggtgagtaggaccagcgacgggggtgtcaaaacatgccggattcatgatcttctccgcgatctttgcatatccgagagcaaggaagacaagtttttcgaggtttgtggagaggttgattttcaaatccgagatagttgtcccctggcgcttgatccacgcacaacttcattgttggatagtcgtagattccccaggttgacaaaattgggtatacaccatgaaagacgtgataagtgcaatgctcgtatacagttacaaagccttaaccgcttaagccatctccgcaagctaaaagtgattggcaccacggagattccgcaaaatgcaaatgtgtttccctcaaacatcaccaaaatatccctcacaaagtttggttgcttcaactccaatgccatgcatatactaggaaagcttcccagcctccaagttctgaaactgtcatcgcagacaaatgatactcgttttgacctccactgtgccacgggagggttccttcagctccaagtgtttgagatgatagcaatcaaggtaaaaaattggagacttgacaaaggttcaatgccacgcattcgacgtttagacgttagaagctgcaaatccttgacggagcttccaaaagaactatggtctttgactagcttgcgggaagtgcaggtcttgtggccatgtactgaattggtaaaaaggctccaaaatttggtggtgaacaatgggtgcaagctcgtggtctatcctctctcaacaaatgatgaattagattttctctaa

SEQ ID NO: 1547 - DNA, 2496 bp, Glycine Max
atggcggatgcaattgtgaacttcttggcagagaagttgacgaggctgcttgaggaggaagccaagcttctcaccgaggtgcatgacaacgtgacctcgttgcacgacgagcttaagatattgaacctcttcctcaaagagacccaagggaccaagcagagagagcacggactggtggcggaaatggtcggccaaatcagagacgctgcataccaagccgaagacatcatcgacacctatgtggcggacatgattcgacgtcgaaagatgaaccggttggagaaggtggtcatcggcagtgtcaatcacgcgctcatgcttcacaaagtggccgtcaagataggcgacatcaagacaagaatcgacaataggttcggcaacatagaaaaatacggcgtcagactcatcagtgcaaaaggtgaaaaaagtaacggagaagaagaagaaacagagcgcgtgaggaaacagaggagcgaggtggaggaagataaagtggcggggttcgagagttactccagggctgttatagaaaaactcacggcaagggtcagggacagggattcacgccttaacgttgtttccatcaccggtgttggtggcttggggaaaaccacccttgccagaaaaacatacaacaacgttagggtcaaggacacgttttcttgtcgtgcatggggttatgtttcaaatgattatcggcccagggaattcttcttgagtcttctaaaggagagcgacgaagaactgaagatgaaggtgcgagaatgcttgaataaaagcggaaagtacttggtggtggtggacgatgtttgggaaacccaagtgtgggatgagattaaaagcgcttttccagatgccaacaacggaagcagaatattgataacaagtcgttcgacaaaggtggcttcttatgctggaacaacccctccctactcgcttcccttcctcaacaaacaaaaaagttgggagctacttttcaagaagttgtttaagggacgaagaaagtgtcccccagaattagtggaactgggaaaatccatagccgaaagatgtgatggcttgccacttgccatcatcttcatggcggggattctggccaacaaggaattgcacaaggagtggtctgatatcaaggaccatatggattggcatcttggtagtgacaatgacaacatactaatggatatactgagactaagctacgacaccttgccttcacggttgaagccttgctttctatattttggcatgttccctcagggatacaatatccccgtcaagcaattgatccgcttgtggacatctgaaggactattaacaacacatgattcttcttccggaagcaggaccaacgcaccggagcccgaatacattgcggaacagtacttggctgaactagtggaacgaagcttggtccaagtcatacataggaccagctatggcagtgccaagacatgtcgtgttcatctcgttctccgccacttctgcatatccgaggcccggaaggacaagtttttccaagttggtggaattattaatgattcttctcaaatgcacagtcgtaggttgtccctccaaggcacactatttcacaagtcctctagtttcaagttggctcgggtgttggatctaggacaaatgaatgttacctcactacctagtggtttgaagaagctcatccacttaaggtacttgagtatacactcacacaatctcgaaactattccggattcaatatgcaacctatggaatctagaaacgcttgatctaaggggttcccctataaaatccttctctgccgaactctggcagcttaagcatctgagaaatcttctgttgcttggacccgtgtgtgatcctcgtgtgctgttacaaagttgcctccaccggctaagctatctccggaagctaaaacttattggcactactgagatcccgcaaaatgcagcaaatgtgtgtgtgtttccctcaaccatcaccaagataaccctaacaaagtttggtttcttcaactctagtgccatgaacacactaggaaagcttccaaacctcttggtgctgaaattgtcatcgcagaaaagtgatgctagttttgacctgcattgtgccgcgggagggttctcaaagcttcaagtgtttgtgatggtagagatcatggttaaaagctggagagtagtgaaaggttcgatgccaagtgttcaacgtgtagtcgtcagaaactgcgaatacttaactgagcttccagaagaaatctggtccttgactgcattgtgccaagtgaatgtttcttgtcccagtagaaaattggcaaaaacactgcaaaatttggagtgtgatatcatgcagggcccatttaaagatgccacttatgctgcaattttgaacgaagaggtggaaggaattgttggcttgacattactcaatcatatcatggaatcaatctttcaatataacaattgcaaagagcatagagatctctcatcagtggataagtga

SEQ ID NO: 1548 - DNA, 447 bp, Glycine Max
atggcggcggagtctatttacaaagagagatgtgtttcggtgaatgatggtccaagttgggccaaatacatgttgatctctggttctcctgatgatgaatatgatatcatcactttgcaatatactgaggagggtttattatctgtagatgagaatagagagggtcgtgctgcagctttcggtgatgatattgcaattgaatgccttgctacagagttcaagcgagagatatatgtggtgcaagcacatggttcagatgccatggtcgatgaagaaaattgtgttttcttccttccacatcgtccaaggagccgaattactgaacctccatttttccttttcatgaaaggaacaggttggtgcggtgctggagctgaccactatgagcccctcattgctcatccttccgcctttgtttcccaagaaaaggttgctgtggtactgtga

SEQ ID NO: 1549 - DNA, 1014 bp, Glycine Max
atggctaccagtcctgccagatctttcctccaagtcgccgcaacggaggaggctgcgccgcctctcagagtcgtccagattgaaggactggttatcctgaagataattaagcattgtaaggaccactcgccttctttagtcactggacaacttcttgggttggatgttggcagtgttcttgaagttaccaactgcttcccctttccagtgagggaggaggatgaggaaattgaagctgatggtgccaattatcagcttgaaatgatgagatgcctgagggaggttaatgttgacaacaacacagttggatggtaccagtctacattgcttggctccttccagactgtggagcttattgaaacctttatgaattaccaggagaatattagacgctgtgtttgcataatatatgatccatcaaggtctgatcaaggtgttctagctctgaaggcattgaagctttctgactcattcatggaactctatcgcagcaataattttactggagagaagttgagggagaagaacttatcatgggtggatatctttgaggaaataccagtcaaagtttcaaattctgcccttatcagtgcttttatgacagagctggaacctgatactccagtcacccagggtgattatgatcgtttgcaattgtcaaccagttcattgatggagaggaatactgaatttttgattgaatgcatggatgacttgtcactagaacaacaaaaggtccaattctattatcgaagcttgtctcgtcaacaagctcagcagcaagcatggcttcaaaagagaaggacggagaacatggctcgtaaagctgctggagaagaacctttgccagaggaagatccttcaaatcccattttcaagccgctcccagagccttcacggttggagagcttcctcataacaaatcaaatttccaactactgcaaccaaatcaatggggtgtcagggcagagctttaacagactctatttgatgaaggctttgcatgaggattga

SEQ ID NO: 1550 - DNA, 468 bp, Glycine Max
atggctcctgctaaggcggacaatgccaaaaaggctgatcccaaagctcaggctttgaagacagcaaaggctgtcaaatcaggtggccaagtgtttaagaagaaagctaaaaagatcaggacatctgttacatttcacaggccaaggacattgaagaaagaaaggaaccctaagtaccctcgtattagtgctccacccagaaacaagttggaccattaccagatacttaaatttcctctaactactgagtctgcaatgaagaaaattgaggataacaacacactggtttttattgttgacctccgtgctgacaaaaagaagattaaagatgctgtgaagaagatgtatgacattcaggcgaagaaagtgaatactttaatcaggcctgatggaacaaagaaagcctatgttaggttgactccagactatgatgccttggatgtagctaacaagattggtatcatctaa

SEQ ID NO: 1551 - DNA, 990 bp, Glycine Max
atggctctggaccagccttcgaatcccaacgccgtcgatggcgctggtaacggcgcgacgccctgctccgccgcagacggcggcgatgacgggaggccggcggcgaggctgccgcggtggacgcgacaggagattctggtgctgattcagggaaagagcgacgccgagagccggttcaggccgggtcgggggagcggttcggcgtttggttcgggcgaaccgaaatgggcgttggtgtcatcgtactgcaagaagcacggcgtgaaccgggaaccggttcagtgccggaagcggtggagcaacctcgccggcgattacaaaaagatcaaggagtgggagtcgcaggtgagggacgaagcggagtcgttttggctcatgaggaacgatttgaggagggagaggaaattgcctgggtattttgacagggaggtttataatattctcgattcgccgtcgtccacggcagcggctgcggcggcggagactccggtggcggtggcggaggcggcgtcggcgggggatgaggaggtgcacctctatgatagtaatcggagggttgggagtgaggatgggttgttctcggattctgagaaggacgaggttttgcttttagccgctgccaaggatgttcctgcacctgttcctctctcagagaagcaatatcagccgcatctccatgggtgtgaaggggaaggcaaccctcaaggtactaccaatgggaaacgggcaaccccaaatccagaaatgggttctacatctcaaggggaacggaagaggaagcggttagcaaccgacggagaggaggaaactttgcaaagccaattaattgatgtcttagaaaagaatggcaaaatgctacatgatcaacttgaagctcagaacctgaatttccagttggatcgccaacagcagaaagacactgcaagtaacatagttgctgtacttgataagcttgcagatgctctagggagaattgctgataaattgtag

SEQ ID NO: 1552 - DNA, 1050 bp, Glycine Max
atggctctttcactcggcaagctcttcattctcgtcggcgcaggtatagctggttcagtaattgcaaaagaagggcgtctgccagatgtctctggtctcgcctctggtgcttttaaggttgttttgaggcaacttaaaagcgatgatcctgctccaactgttaaaaagcagccgcataatgatgctttgttggctcaggttaacagtcttcggcaggaactacaacttcttgctagagatagatcaatcactattgtaaatgcaagtggaacaggtgggagaaaatatgcaacagtgattgttattgttgtggtaggatatggatacgtttggtggaagggatggaagcttcctgatctgatgtttgcaacaaggcgtggtttgtctgatgcttgcacatcaattggtaatcagatgggaaagctttatgaatcaattggggataccaagaagaaattatctgcaagaatcaacggtctggataaaaatttagaagaatgtgctgccattactgaaagtaccagggaggagatatatgtaattcaacggaaagcagatacaataagtgaagattcgaagtcttttcatgttgcagtccatgttctggaatctaaaattaaagaaatagaagagaagcaggtggccacaattgaaggagtgaacatgttgtgtcaatttaccaagactttggagaatagcagatccacagagtatattcaggcatcttcttccagttcttccaggccagcccttgagcttccaccagtttcaccctcttccaggggttcacagtcaggttccgctaggctatctcttgagccaccatcagttacgccatcatcaaggactgcatccttgccaccgacattgtctacggatccaccatctccatcaatttctggtggatctttccaggaacctaaagtagacaaaagcaatggatctagttctggcttgtttgggttgatatctggcgtctatggtccattgctgacaagaactcgcagtgcgacagatgcagtagtccaaaaaactcgttcgactagttaa

SEQ ID NO: 1553 - DNA, 2412 bp, Glycine Max
atggctgatagtgttgttgtttttctactagataacttgtctcggctgcttgaagatgagcacaagttgctttctggcgtggaggacaaaatcaactctctttgcaatgagctcaagtttatacacatcttcctcaagaattctgagggcaagcgcagtcacgagatggtgaaagaagtggtgagccagatcagagatgtcaccctcaaagctgaagatgtggttgacacctacctttccaacatcgcccaacaaaaacagagaagcaaactgagcaagttattccacctcaaagaacatgtcatggtgcttcaccaagtcaactctgacatagagaagatcaggactcggatcgatgagatctataagaacagggacagatatggcattggagaaggtgatttccgaagcgaagaagctgctgcagaagcagaaccactcctcaaaagaaggagggaggtggaggaagaagatgtggtgggcttagtgcatgactcaagccatgtaattcaggaactcatggagagtgagtcacgtcttaaagttgtttccataattggaatgggagggttgggtaagaccactcttgcccgtaagatctataacaacaatcaagtgcagctgtggtttccttgccttgcatgggtttctgtgtccaacgattacagacccaaggaatttcttctcagccttctcaaatgttcaatgtcatccacatccgaatttgaagaattaagtgaggaagaactgaagaagaaggtagcagaatggttgaaagggaagaagtatctggtagtgcttgatgacatctgggaaacccaagtatgggatgaggttaaaggagcctttccagatgaccaatcaggtagtagaattctcataacaagtcgcaacaaagaggtggcacactatgctggaactgcgtctccctactaccttcccatcctcaatgaagatgaaagctgggaactcttcaaaaagaagatttttggacttgaagaatgcccttctgatttagagcctctgggtagatccattgtgaaaacttgtgggggtttaccacttgccattgtggttttagcaggactcgttgccaagaaggagaagtcacaaagagagtggtcaagaataaaaaaagtgagttggcatcttacagaggataagactggagtgatggatatactgaagcttagctataacaacttgcctggaagattaaagccttgctttctgtattttggaatctatccagaagactatgagatcagtgcaaggcaattgatccaatattggatcgcagaagggttcatacaaccacaaaaaactggaattgcagatacaacagaactggaagatgtagcagacttttatttggatgagctggtggatcgcagtttggtgcaagtggcaaaaaggaggagtgatgggggtgtcaagaaatgtcggattcatgatattctacgtgatctttgcttgtcagaaagcaagtctgataagtttctggaggtttgcacaaactccaacattgataccgtcagtgataccaatccccgtagaatgtccatccactggaaaccagactcggatgtctctgcaaacacatttaacaaatcatgcactcgttctatgttcatctttggtagtgatgatagaatggacctagatcctgttttgaaaaacttcgagttggctcgtgtgcttggttgtgatatgattcaacgggtttggtctcatacagtctccagagatttgaagaggatgatccatctaagatacttgagaatagaagtggagcaccttccagattgtgtatgcagcctttggaatctagaaacactgcatgtaacatatgaaaccacagtatccagtaaaatttggacgttgaagcgactgagacatctttatttgagtggggaagggaagttaccagtcgtcctgccaaaaacaaatagaatggagaatctccaaacccttttgttatcgggtaagtatccacaacaaattatttccctgttgaacagtggcatatttcctaggttgggaaaattagctttgcgctgtcctaaaacacatgcagaatcagccatgttatcaagtctacaccacctcaacaatcttcatagcctaaaagtaattgaagatctagaacttccatccgacaccaatgcgtttccatcaaatcttatcaagataaccttgatactagcagcattcagtaatccccaccctttaatgaagacactaggaagacttaccaaccttcaaatcttgaaactaaattcaggcatcgatgatattcttcttgatattggcagtggagagttcccgcaacttcaattgcttcatatgaggcaaatatatgtaagacaatggagattagagaaagatgcaatgcctcgacttcgacatctg

SEQ ID NO: 1554 - DNA, 948 bp, Glycine Max
atggctgccaccaccttagtctctgaagtcactctcccctcctcctccggccagcggaagatgccgctgatgggcctcggcaccgcgccggaagcaaccagcgcggttaccacaaaagatgctgttcttgaggccatcaagcagggctacaggcactttgatgctgcttctgcttatggtgtggaacagtctgtgggagaagccatagctgaagcacttaagcaaggactaattgcatccagagatcaactcttcatcactaccaaattgtgggtcactgataaccatgcccatactattcttcctgccctgcagaaatctctcaggacacttcaactagaatacatagatctctttctgatccactggcccattgctactaagcctggaaaagttgtgtaccccattgaagtatcagagatagtggaatttgacatgaagggtgtgtggggatccatggaggagtgccagagacttggcctcaccaaagccattggagtcagcaacttctccatcaagaagcttgaaaaattgctctcttttgctaccatccctcccgcagtgaatcaagtagaagttaaccttgggtggcaacaacagaagcttagagatttctgcaaggaaaagggtattactgtaactgccttctcacccctgaggaagggtgctagtaggggtgctaattttgtgctggacaatgatgtaatcaaagaattggcagatgctcatggcaagactgcagcccagatttgtcttcgatggctatatgaacaagggttgacttttgttgttaagagctatgacaaagagaggatgaagcaaaacttggggatttttgattggtcactgactgaggatgattacaagaaaataagtgaaatccaccaagagaggctcatcaaaggaccaaccaagcctcttcttgatgatctatgggatgaagaatga

SEQ ID NO: 1555 - DNA, 1608 bp, Glycine Max
atggcttcaatctctcacttcagaacctccgcgaattccttcctctcccaatacgaacctctctctctgcttctcgctcctctcctctctctcctcttcgctcacgctctccgctccttcttccacctcctctcccagaacggactcaaagccacgctcctagggtttctcattaactccctcagattagtccctggcgtgaagggatacatagatgccgaaaaacaaaaggttgtggataagttgcaatctgatggtaaatctaaaagagaaggttggaaaactgagttgccaagcacaggattagggacatctgtccttgagaaaatgagagaggagaaaataaatgatgcggtttggcaaggcaaatgctctggtacaggctacattggaggaagtgaatctgatggacatttttctctgataaatgaggcatgttcaaggtttgctcataccaatcccctgcatttggatgttttcaagagtgttgcacgctttgaggcagaagtggttgcaatgacagcagcacttcttggaagtaaggaaaagagttctggacgacaaatatgtggcaacatgacgtcaggcgggactgaaagtatattattagctgtcaagtcatctcgtgactatatgaaatctaagaaaggaattacaagacctgaaaggattattcccgagtctgggcactcggcatatgacaaggctgcacagtattttaatatcaaactatggcgtgtaccagttaacaagaatttccaagctgatgtgaaagcgatccgacgtcatattaacaaaaataccatcttgattgttggatctgctccagggtttcctcatggagtaattgaccccattgaggaacttggtcatctggcatcaagctttggtatttgtttccatgtggacctttgccttggtggctttgtattaccatttgctcgtgagcttgggtaccacattccaccttttgatttttctgttaaaggggtttcttcaatatcagtggatgtacataaatacggtttagctcccaaaggaactagcgtagttctttacagaaaccatgaaatcagaaagcatcaatttgttgctgttaccgagtggtctggtgggctgtatgtatctccaaccatagctggaagcaggcctggaagtcttattgccggtgcatgggcagcgatgatatctctagggaaagaaggttacttgaaaaatacaaaagaaattatggaagggtcaagaagaatacagcaaggcatagaggagattgctgagttgtttattgttggaaaacccgacatgacgatagtggcttttggatccgacgttctagatatattcgaagtcaatgatgttatgtcatccaaagggtggcatttgaatgcattacagcgacccaacagcatccatatctgtgtgacactgcaacatgtgccaattgttgaagactttctcaatgatctgaaggaatctgtgaaaacggtgaaagcaaatccaggtccaataagtggaggcctagcacctatatatggcgccgcagggaagatgccagatagaggcatggtccaggaattgctggtagattatatggacggtacctgctaa

SEQ ID NO: 1556 - DNA, 1005 bp, Glycine Max
atggcttcttcactgggtcgaagaagaacccacgctcccaaatcttcctccaccctaaacgacgacgtttcctgcgaggaatgcggcggaggccactctccttcgaagcttcttctctgcgacaaatgcgaccgtggctaccacctcttctgcctccgtcccattcttccctctgtccccaaaggctcttggttctgcccctcttgctccaatcacaaacctaagtgtttccctcttgtgcagaccaaaatcattgacttctttcgaatccaacgctcgcccgaggcattggcgaaccaagacacgcggaagaagcgaaagaggggtgggggcttggtggtttcgaagaagaagaggaagctgttggcgttcgtgccgagcgaggatccgaagaggagattggagcaaatggcgtcgctggcgacggcgttgatcgcaactgaaacggagttcagcaatgagcttacttacatgcctgcaatggcgccaaggtccgctaatcgccctgctcttgagcgcggtggaatgcaggtcttgtcaaaagaagacaccgagaccttaaacctgtgcaaaagtatgatggaaagaggagaatggccgcctctcatggttgtttttgatcctctagaaggcttcactgtagaagcagatagatccatcaaagatttaaccataataacagaatatgttggagatgtagactttttaaagaatagggaaaatgatgatggagatagtataatgacacttctctcagcttctgatccttcacggacgcttgtcatctgtccagacaaacgaagcaacatagctcgtttcattaacggcatcaataatcacacaccggaagggaaaaagaagcagaacttgaaatgcgtgaggtttgatgttggaggtgaatgtcgggttcttttaattgccaatagagatattacaaagggggaaaggttgtactacgactacaacggagatgaacatgaatatccaactgaacattttgtctga

SEQ ID NO: 1557 - DNA, 1179 bp, Glycine Max
atgggaaaggatctgtttagtaatttaccagaccaaattctgtgtcgcatagtttcatttctaccaaatgagtcatcactagaaaccagccttctttctacaaggtggagagacctgtggaatgaagctcttgtcaaacatggaactcaagaggatatcataggtgttgttgctgattttatcacaaattttgaggagtttgatcccttgaagcatcccagaaagcttcaatttcactttgctgaagagagtgtagtctcagtaactgttgcaaacaatagcaagctcatgcttgatttctccccttggaaggaagagattccaatagggtatgaattggagttcaagctaagtaagcaacacatagccacctaccagtcttttccttccacattctcagtcaaaaccctccatttgaaatcagtgagttgtttcacaagtgaggttgctgcttccattgtttcaaatttggagcatctagagaacttggtggtcattgactgcaaagggttggaatctttgagtgttgactccacctctgagcttcacaagttaaccatcttggattgcttagagttgaagactctccgtcttaaaacttctaaactcaagtcttttcggtatcgtgggcctcttcctttgattaggccagagtatcatttcaacctgagtaatgccatgcttgatttcagattaggactcagctgcagtggtttaaaggccaaggattttgatgcaacccttttaacaataaagaactctgaagttcttactctgtgtaaatggacttttgaggaattaatatggccatcgatttctcctctatctgggagcttcaaattctataaattaagagagttatggtggattgacaactataataaggatgaatccaacaaggatgctttattctccttcttaaaattatgccctaccttggagcaactttttgtgactaatgatcctgaaagttatttggctggagggtccaattcatacgtagtgaaagggactaaatgcacaggaatggaacatcttaaactgataaagtttatggggttttcaagtcgaagagatgaaatctccctggctaaatgtttgattcatctgatcaagggaaagcctccaaagataaagacttcagatgggaatagcttggatgcaatgtttgtggagtga

SEQ ID NO: 1558 - DNA, 300 bp, Glycine Max
atgggagagtcttctaattcttcttctgcttcatacattcatatggtgcaccacctgattgagaagtgtttgacctttcacatgtcaaaggaagagtgcatggaagctctctccaagcatgcaaatattaagcctgtcataacatccactgtgtggaacgagctagagaaagaaaacaaggagtttttcgaggagtatgccaaaggtaagagtaaagaagaccgaatgtcggaggaagagacaacccaaatgttacagaagatgatctcagattcctctaaaggtgctgccaaggactaa

SEQ ID NO: 1559 - DNA, 176 bp, Glycine Max
atgggaggtggattcaggctgcttgacttagttgtcccctttgttccagaagttgagactgctgacaggaaagtggcatttagagagaatgtgatatacactgtcatctctctattcgttttccttgcttccaaccgcggaactgttatggagcttggaatcacccccattgtcat

SEQ ID NO: 1560 - DNA, 1245 bp, Glycine Max
atgggatcgtgcatctcggaggttggagctggtggaagttcccctcctcttcttcctttttcgcctgaatcgaacatggatggtgggaagaggagaaggttaaggggttcctcttcctttgatttcaaagtgcctgggaggatgttcttgaatgggtcaagcgaggttgcatccatgtattgcaagcaaggaagaaaagggatcaaccaagatgctatgcttgtttgggaggacttttgttcaaaggaagacaccattttttgtggtgtttttgatggtcatggaccttatggccacagggttgcaaagaaagttagggattcttttcctttaaagcttaatgcccaatgggatttgcatcataagaatagagatggactcagtgatcatagcagcgccacaggaagttataaatctgaagggaatggatttagactggtggatgagaaaactagtcccactgatcatgaacttgatgaaacagatacgattttgacattacgagaatcgtttttgaaggcttgtaagattatggataaagaactgaaacatcatcctgatattgactgcttttgtagtgggactacagcagttactttggtcaagcaggggctgaaccttgttattggaaatgttggtgactcgagagctgtattgggtacccgagatcatgaggattcccttattgctgttcagttgaccgttgaccttaagccaaatcttccaagggaagaagagaggatcaagcttcgtagaggaagggttttttcccttcagaatgaacctgatgtggctcgagtttggctgcctaactctgatttccctggtcttgctatggctcgggcatttggagatttttgccttaaggactttggattgattgctgttccagatatctcatatcaccgccttaccgagaaggatgaatttgttgtgttagcaacagatggggtttgggatgttctgtcaaatgaagaagttgtggacattgtggcatctgcttcacagtctactgctgctagagcactggttgagtcagctgttcgggcatggaagacaaaatttcctttttgtaaggttgatgattgtgccgcagtttgcctcttctttgattctgatttagatttcaagtcaacagatacaaaagacaagttaataccggaggcatctattgaccaatctgagcagttagctttacttggtgaaaagggagttggaaatgaagctgaaaaaaagcagcaatag

SEQ ID NO: 1561 - DNA, 1536 bp, Glycine Max
atgggcaagcctccgttgaggaagtactttgataaaatccggtttgtgtttttcacctcctttatcttatgtttgtcattgcttctcttggactattacatggctgtgagtggtcatggcattacctttttatttttcaacatgaatgatgcaaaacaagcacacatgcctaaaccctcaaattcttctttcaatcttaatgacactgccgatttggtgcctccaatataccaaggcgcattaaatttggattcttgttctggtcaatatatctatgtttatgatcttgctagcaggttcaatgaagatttgctgaaagggtgtcactctctcaggaagtcgatagatatgtgtctttacatgtctaacttaggccttggacctaaggttattgagaaatcaaaggagaaggttttgttgaaggaaagctggtatgcaaccaaccaattttcacttgaagttattttccataacacactgaagaactacaagtgcttaaccaatgattcctcacaggcttctgctatatatgtaccctactatgctggccttgatgtgggtcagtacctctggggaggcttcaatgtttcaatcagagatgcttcaccaaaagaactagtgaaatggctggcacgacaacccgagtggaaaagaatgtggggtagggatcatttcatggttgtagggagaattggttgggacttcaggagaagaacagaaaataataatgactggggcaccaagctaatgcttttgccagaagcaagaaacatgtcaattttgctaattgaatctggttcaaaggacaatgagtttccaatcccatatccaacttactttcacccctccaaggataaagagttttttcagtggcagaaaaaaatgataaaagtttcaaggccttacttgttttcatttgcaggtgcttcaaggcattcatcatcctccatcagaaatgaaataatcaaacaatgtcaatcctctaggagctgcaaacttctaagttgcaatgatggtcataattattgcaatgatcctgtgcatgttacaaaggtgtttcagagctcagttttctgtttacagcctccaggggattcattcactaggagatcaacttttgactcaattttggcaggttgcattcccgttttctttcatccagaatcagcatataaccaatatttgtggcatttgcccagaaatggttctagctactctgtgtacataccagaaagagatgtcagagagaagagagtaatgatcaatgagaagttgtctaaggttccaaaaagtgaagtgttggaaatgagaaaggagataataagtcttattccaagaataatatatcgttatccaagttctagatcagtgaccgttgaagatgcatttggtatagcagttaagggaattcttgggagaatagaagcagtaagaaggaacattacaaatacaaggattctatgtttctctttgcctcagaatagacatatcctatgtatttcccccaataaatattgcgttgttattcatttttaa

SEQ ID NO: 1562 - DNA, 3207 bp, Glycine Max
atggggaaggaggtagaggatgttgaagagggtgagatttcggatactgcttcggtggaagagatttcagcggaggatttcaataagcaagatgttaaggtgttaaataataacaataagcccaatggaagtgatgctagggtttgggctgttcatgatctttactcaaagtaccctaccatatgtcgtggctatgcatcgggtttgtataaccttgcttgggcacaggccgtgcagaacaagcctttgaatgatatttttgtgatggaagatgtggtggtggtggatgtggacaaagaggaaggggagttagaggagggtgagattgatgccgacgcggaacctgaaggagaagcagagagtgttgtggctgttcctgttgtttctgattcagagaagcttgatgatgtgaagagggatgtttctaattctgagcagcttggtgtgaggggtgttctggagggtgttaccgttgctaatgtggcggagtcgtttgctcaaacttgcagtaagctgcaaaatgctcttcctgaagtgctctctagacctgctgattctgagagggatgatctcgttcgcctgtcatttaacgctactgaagtggtgttttgctccatggactctttaaaaaaggaacagaacaaggatagcatattaagtgacataattggggcatcacatgctttaaaatttggacaaaatagtattaaaggtagaggggttctgctccctctgttagaccttcacaaggatcatgatgctgacagtttaccatcaccaacccgagaagcaccctcatgcttccctgtgaataaattactttccgttggagagcctatggttagttctggtgaaggttctaaatttcatctctatgaaactgatgctttgaaagctgtttccacatatcaacagaagtttggtcgaagttccctttttacaaatgataaatttccaagtccaactccttcaggtgactgtgaggatgagattgttgatacaaacgaggaggtctctagtgcttctactggtcctgggtctttgccagtgaaaagctctgcaaagaatagagatcctaggcttcgtttcgttaattctgatgcaagtgccgtggataacccatctacattgatacataatatgcctaaagtggaatatgctggaacaacaatctcaaggaaacaaaaggctgctgaagaaccttctttggatgttactgtatcaaaaagacaaaaaagtccattggaaaatactgagcataatatgagcgaagtaagaactggaattggtggttggttggaagagcatactgggcctggagctcagtttatagagaggaatcatttaatggacaaatttggacctgaaccccaaaagactttgaatacagtcagtagttcttgtactggttctgataatttcaatgcaacaagcattagaaatgagcaggcaccaattacaagtagtaatgtgctagcttccttacctgctctattgaaaggtgcagctgtaaatccaaccatgctggttaacttacttagaatagcagaagcccagaagaaatctgctgattctgctacaaatatgctgttgcatccaacaagctcaaattcggctatgggaacagactcaactgcgagtattggttcatcaatggccactggtcttcttcaaagttctacacaaacccttcaagatgattcaggaaagattcgcatgaaaccccgtgatccccggcgcattctccacactaataatactatccagaagagtgggaacttggggaatgagcaattcaaagccattgtatcccccgtgtctaacaaccagggaactggggacaatgtcaatgcccagaagcttgagggtagggtggatagtaaattagtgcctactcaaccaagtgcacaacctgatattgctcgacaattcgcccggaatctgaaaaacattgctgatattatgtctgtttcccaagaatcatcaactcacactcctgttgctcaaattttttcttcagcatctgttccccttacttcagatagaggggaacagaaatctgttgtgtcaaactctcagaacctggaggctggcatggtatcagctcatgaaacagctgcatcaggtacctgtcgatcccagaatacatggggagatgttgagcatctttttgaaggttatgatgagcagcagaaggctgctatacagagagagagagcaaggagaattgaagaacagaataaaatgtttgctgctcgaaaattgtgccttgtattggatctagatcacacactacttaattctgctaagtttgtggaagttgatcctgtgcatgatgagatattgagaaagaaagaagagcaggaccgtgagaaaccacacagacatctttttcgctttcctcatatgggaatgtggactaaactcagaccaggaatctggaacttcttggagaaggccagtaagctctatgagctgcatctttacactatgggaaacaagctatatgcaacagaaatggcaaaggtgcttgatccaaagggacttttgtttgctggaagagttatctctagaggtgatgatactgattcagttgatggtgaggagagggctcccaaaagcaaagatttggaaggcgttttgggtatggaatcatctgttgtaattatagatgattctgtgagggtctggcctcataacaaactgaacctgatagtggtggaaaggtatacatacttcccctgtagtagacgtcagtttggactgcctggcccttcccttctcgagattgatcatgatgagagacctgaagctggaactctggcatcctctctggcagttattgagaaaatacatcaaatcttttttgcttctcgatccttagaagaagtggatgtcagaaatatactagcatcagagcagagaaaaatcttagctggttgtcgcatagtatttagtagggtatttcctgttggtgaagcaaatcctcaccttcacccattatggcagacagctgaacagtttggtgctttttgcaccaatcagattgacgaacaggttactcacgttgttgcaaattcccctgggactgataaggtgaattgggctctaaacaacggaagatttgttgtccatcctggctgggtggaagcatcagcattgctttataggagggcgaatgagcaagattttgccattaaaccataa

SEQ ID NO: 1563 - DNA, 225 bp, Glycine Max
atggggtttcaagtttcaacacacacactgtctctgtacactacaaagtgtaagttgttaacaaagaaaggaaggagcatagactcaaagatgagcaaagattccatgagaggttcaaagaagaaacttttatgcagaaggcttggagggtacctcaaagagcaaaaaggaagactatacataatcagaagatgtgtagtcatgcttctctgttggcatgactag

SEQ ID NO: 1564 - DNA, 1191 bp, Glycine Max
atggtggagccggtggagcttcgctgcgaggagcagctctcgcttctgtcagattcgagcaatggtgatcggtcgtggcggttgaacttcgacgggtttcagctatcttcggagcacgcggagaagcaagtgaaaccccctcgcggactccacgactgttacggggttctaggtcaagaagataatattgcagagtactatcagcagcaggttgaagtgcttgagggctttactgaaatggatgctttagcagagcgtggttttattcctggaatgtcaaaggaagagcgagacaagttagcaagaagtgagacatttgccatcagagtgtcaaatgcagcaaacatggttctttttgttgccaaagtttatgcatcaatcaggagtggttccctggccatcattgcatccacgttagactcacttcttgacctcctttctggattcatcctctggttcactgcattttccatgcaaacaccaaacccatatcagtaccctataggaaagaaacggatgcaaccattgggaattcttgtttttgcctctgttatggcgacacttggactgcagataatcttggagtctacccgcacattaatatcttctgaaaatgcattcaacttgaccaaggaacaagagcgctgggttgtgggcattatgctttcagtgactttggtgaaattcctgctgatgatttactgtcgttcttttaccaatgagataattaaagcctatgcccaggatcacttttttgatgtgatcactaatatcattggccttattgctgcacttttggcaaattatgttgatgattggatggaccctgttggtgctatcattctggctttgtacaccattcgcacatggtcaatgacagtgttggaaaatgttaactccctggttggaagatcagcagcaccagagtatcttcagaaacttacatacctatgctggaaccaccataaggctgtaaggcacattgatacggttcgggcatacacatttggatctcactactttgttgaggttgatattgtcctgccatcggatatgcccttgcaagaggctcatgatattggggaatcattgcaagagaagcttgagcttttgcctgagattgagcgtgcttttgttcatcttgattatgagtatagtcacaaacctgagcatgctcaagcacactcttag

SEQ ID NO: 1565 - DNA, 297 bp, Glycine Max
atggtggcggaaatcgtcggccaaatcagagaggctgcatacgaagccgaagacatcatcgacacctatgtggcggacatgattcgacgtcgaaagatgaacctgttggagaaggtggtcatcgaggccatgcttgatttcaacctgagtgatgccatgcttgatttcagattaggactcagctgcagaggtttaaaggccaaggattttgatgcaacccttttaacaataaagaactttgaagttcttactctgtgtaaatggacttttgaggaattttcttttttcactaactga

SEQ ID NO: 1566 - DNA, 2502 bp, Glycine Max
atggtggggaacgatgacgcgggccacctctccgcctcccggaagatgttctggcggtcggcgtcgtggtcctcctcgcgaaccgccgccggaaacgcctcttccggcgagacggagaagggtttcgccgattccggtgccgctgacggtactcacggccagaaccggcggtttggtccgccgccgctgacgcctcggtcgcagcagaattgcaaggcgcggtcgtgcctgccaccgctgcagccgctctccatcgcccggcggagcctcgacgagtggccgaaggcgggctccgacgacatcggtgagtggccgcagccgcctaccacccccggcgggagaggtaatggtagcaatggtgaaaggttgaaacttgatttgtcttccattcagcataacaaccctgatcatagtaggagtaacaatgggaatgggcttgtgaagagggataagattgcattttttgataaagagtgttcaaaagttgctgatcatgtgtaccttggtggtgatgctgttgccagggatagggacatcttgaagcataatgggataactcatgtcttgaattgtgtggggtttgtgtgtcctgagtactttaaggctgattttgtttataggactttgtggctgcaggatagtccatctgaggatattactagtattttgtatgatgtgtttgactattttgaggatgtcagggagcaaggtgggagggtgtttgtgcactgttgtcaaggggtgtctaggtctacctccttggtcattgcttaccttatgtggagggaagggcagagttttgatgatgcttttcagtttgtgaaggcggcgagagggattgctgatccaaatatggggtttgcttgccagctgttgcagtgccagaagagggttcatgctgtccctcttagccctagctctttgctgaggatgtatagaattgctccccattcgccgtatgatcctttgcatcttgttccaaaaatgttggtggatccttcattagctgcattggactccagaggtgcgtttatcgtgcacattccttcagcaatatatgtttgggtgggtaagaactgtgaggccaccatggagagggacgccagaggggctgttggccagattgtccggtatgagaaggtacaagggcctattgtgatgattaaggaaggtgaggagcctgtttacttttgggatgctttttcagattttctgcccttaatggacaaatctggcaaatctggcagtaggatagaagatggaaaactatttgttttgcctggtaagaggagagtagatgcatacaatgttgattacgaagttttcacaaaagcaatcacgggaggcttcgtgcctccatttggttcatctggtgaacatgaaacccatttgcctgcaagggagagtagttggagtgtaaggcgtaaagtttcccatggtaacatgaaagaggttgtttcggtccctcatggtaacatgaaagaggttgtttcggtccctcggctatcgtttccaagggtttattcggattccatgttgtgtcttcgtacatcagcaaatgcaattttgtctccatcctcatccctgtcgtcatcttcatcatctatatcatcatcatcctcaccgtcttttgtttctccagattccattacttctgattctagcattcattcaaagtttttgttagaagtgtccccagactcttcatctctgtctaatttttctagtttgtcaatcacatcaaattctacttctcataatttttctagtttgtccatcacatcaaattctacttctcaaccagtgtctcacagtacagatatccttggtgtcaagttatcacatcccttgtttcagtcagcctctttaccattgaagaaaccatcaacttcccttgctgaacgcagaggtagcttgtcaaaaattctgatgttgccgctaatgaatgataagacacaagtaacagataaatcgacaacgtctcatgctagtcaagaatctgacattcttgttaatgacaatgttagctatcaacaacaatcagatagtaaagattatttttgcgggtctaacaaccatgccaaggatggaggtgtgaattccattcaaaagtgtgagccaagcattgctgatagcatgcacctcaaggaatcatcacttagtcagtctaccacattgaagggaactaatgacagtggcttactgcagtataatgtcgcacagacttcggtatatcactggcccagtatagaaaagattgagacatttggtgcaagtcatttggattctaaatctgcttttgtcatattctctcccagtatgcatgtacatgcagggaacattttatatatttgggtagggaggtctttcagttgtgacgcttcacaggttcacttagatattgataaacaatcagatgtaggagctgtcgactggaatcaaattggatgtgatctccttgctcggtttagtttgccaaagaactcagtcatcaaggtatga

SEQ ID NO: 1567 - DNA, 591 bp, Glycine Max
atggtgtcttgttttgtctttttcatatttcacttgaacttttgtctttttttaatagctatcggtctaacaattgcaggtgtgggaaagagttgtctgcttttgcgattttctgatggttccttcacaaccagttttatcaccaccattggcattgattttaagataagaaccattgaacttgatggcaaacgcattaagttacaaatctgggatacagctggtcaggagcgatttcgaactattaccacagatattagaaattggattcgcaacattgaacaacatgcttctgacaatgtaaacaagatacttgtgggtaacaaggctgatatggatgaaagtaaaagggctgtgcctacctccaaaggtcaagcccttgctgatgagtatggtatcaagtttttcgaaaccagtgcaaagacaaacatgaatgtggaggaggttttcttttcaatagcaagagatatcaagcaaaggcttgctgacacagattctaaggctgaacctcagactatcaagattaaccaacccgaccagacagctacagggggtcttgcggctcaaaaatcggcttgctgtggttcatga

SEQ ID NO: 1568 - DNA, 2577 bp, Glycine Max
atggttgacagtgttgttacttttctgctagataacttgtctcgcctgcttgaagatgagcacaagttgctttctggcgtggaggacaaaatcaactctctttgcaatgagctcaagtttatacacatcttcctcaagaattctgagggcaagcgcagtcacgagatggtgaaagaagtggtgagccagatcagagatgtttccctcaaagctgaagatgtggttgacacctacctttccaacatcgcccaacaaaaacagagaagcaaactgagcaagttattccacctcaaagaacatgtcatggtgcttcaccaagtcaactctgacatagagaagatcaggactcggatcgatgagatctataagaacagggacagatatggcattggagaaggtgatttccgaagcgaagaagctgctgcagaagcagaatcactcctcaaaagaaggagggaggtggaggaagaagatgtggtgggcttagtgcatgactcaagccatgtaattcaggaactcatggagagtgagtcacgtcttaaagttgtgtccataattggaatgggagggttgggtaagaccactcttgcccgtaagatctataacaacaatcaagtgcagctgcggtttccttgccttgcatgggtttctgtgtccaatgattacagacccaaggaatgtcttctcagccttctcaaatgttcaatgtcttccacatctgaatttgaaaaattaagtgaggaagatctgaagaagaaggtagcagaatggttgaaagggaagagttatctggtagtgcttgatgacatctgggaaacccaagtatgggatgaggttaaaggagcctttccagatgaccaaataggtagtagaattctcataacaagtcgcaacaaagaggtggcacactatgctggaactgcgtctccctactaccttcccatcctcaatgaagatgaaagctgggaactcttcacaaagaagatttttcgaggtgaagaatgcccgtctgatttagagcctctgggtagatccattgtgaaaacttgtgggggtttaccacttgccattgtggttttagcaggactcgttgccaagaaggagaagtcacaaagagagtggtcaagaatcaaggaggtgagttggcatcttacagaggataagactggagtgatggatatactgaagcttagctataacaacttgcctggaagattaaagccttgctttctgtattttggaatctatcctgaagactatgagatcagtgcaaggcaattgatccaatattggatcgcagaagggttcatacaaccacaaaaaactggaattgcagatacaacagaactggaagatgtagctgacttttacttggatgagctggtggatcgcagcttggtgcaagtggcaaaaaggaggagtgatgggggtgtcaagacatgtcggattcatgatcttctacgtgatctttgcttatcagaaagcaagtatgataagtttctggaggtttgcacaaactccaacatttttaccgtcagtaataccaatccccgtagaatgtccttccactggaaaccagactcggatgtctctgaaaccacatttaacaaatcatgcactcgttctatgttcatctttggtagggatgctaaaacgtatttagttcctattttgaaaaacttcaagttggctcgtgtgcttggttgtgatatgattcaacaggtttggtcttattcagcctcaagagatttgaagaggatgatccatctaagatacttgagaatagaagtggagcaccttccagattgtgtatgcagcctttggaatctagaaacactgcatgtaaaatatagtgggacagtatccagtaaaatttggacgttgaagcgattgagacatctttatttgatggggaatgggaagttaccactgccaaaagcaaatagaatggagaatctccaaacccttgtgttatcgggtgattatccacaacaaattattttcctgttgaacagtggcatatttcctaggttgcgaaaattagctttgcgctgttataattcagtcgaaggaccaggtatgttaccaagtctacagcgcctcagcaatcttcatagcctaaaagtaatgcgcggttgtgaacttctattagacaccaatgcgtttccatcaaatcttaccaagataaccttgaaggatctacatgcattccgtgatccccaatctttaatgaagacactagggcgacttcccaaccttcaaatcttgaaagtaagtttctgcatgcataatgatattcatcttgatattggcaggggagagttcccgcaacttcaagtgcttcatatgacgcaaataaatgtaagacaatggagattagagaaagatgcaatgcctcgacttcgacatctgctcattgaagaatgttatggattgtcagagcttccagaagaactttggtcaatgactgccttacgactggtgcatgtttcatggccctcccaagaattggctaacagtctcaaaaatgtggagcccaggaatggctgtaagctcaaaatagaactgctggaataa

SEQ ID NO: 1569 - DNA, 339 bp, Glycine Max
atggttgccgccaagaaaaccaagaagacccatgagagcatcaacaacaggcttgctcttgtcatgaagagcggcaaatacacccttggttataagaccgttctcaaatctcttaggagctccaaagggaaattgattatcattgctaacaactgcccccctttgagaaagtcagagattgaatactatgccatgttggcaaaggttggagttcatcattacaatgggaacaatgtggatttgggcactgcctgcggcaaatattacagagtgtgctgccttagcattattgatcctggtgattcggatatcattaagacactgcctggtgaacagtaa

SEQ ID NO: 1570 - DNA, 1308 bp, Glycine Max
atgtaccattttgatcacatggacgaagacgatttttttgacgaaattgatgaccaaaaccatggtaggggtgttggggatgctgctcttgatgaatatgagatgcttactaaggtgactgatacaacagctgctcaagcaagaaagggaaaggacattcagggaattccatgggaaagtttgaacatatctagggagaggtatagattgacaaggcttgagcaatataggaattttgagaacattcttaaatctggggatgctgtggacaaggagtgcaagcaaatcgagaagggtgggaattactatgaattcttctataatacaagaatggttaagcctactatccttcattttcagctgagaaacttagtatgggcaacttcaaaacatgatgtctaccttatctccaactactctgttaatcactggtcatcattaagtggtaatttgtctgagataatcaattttgctgggcatgtggcaccggcccctactgagagatatgcaggaaatttgttggaaggattttctcagacccagattagcacattggctgtcaaggataatcttcttgttgctggtggtttccaaggagagcttacttgtaagcgtttgaataagaaaggagtaagcttttgtacacggaccacacatgatgataatgctatatcaaatgcagttgaaatatatgacagcttgagtggtgcaacgcatattattgcctccaataatgattgtggtgtgagagaatatgacacagaaaggtttcagcctttgaataacttccagttctcttggccagtgaatcacacatcaatcagtccagaccggaagcttatgactgttgttggagataacctggatggactgctagtggatcctcaaaatggaaagactgttgcaacttttgttggtcatcgagattactcttttgcttctgcatggcatcccgatggacgtacctttgcaacggggaatcaagacaagacttgcagagtatgggatgttagacacttatcatctcctactgccattctcaagaataacctaggggcaacccggtctattcggttttcttctgatggtcaatatatggtggttgctgagcctgcagattttgtgcatgtttatagcacaaaggcagactacagaaaacgtcaagaaattgatttctttggggaaatttctggggtttctctgagccctgatgatgagtgtatatatattggaatctgggaccggacttatgcaagcttgcttcagtataataggaagcaccaatataaatatcttgatgcatactga

SEQ ID NO: 1571 - DNA, 729 bp, Glycine Max
atgtctgaaatggtttctgctcttgctcaagttatgggaactaccaatcggaacccatacatgccacaatcaacctcctttcctttctcaacttccgtggtcaaagatcaacctcaaccgtacccatctcaacctcctccagatcaagaggtggcaaagaagccacactacagaggagtgaggcagagaccatgggggaaatgggcagcagaaatccgtgacccaaaaaaagcagccagagtgtggctaggaacctttgaaacagcagaggatgcagcacttgcatatgacaaagcagcactcaagttcaaaggcacaaaagctaagctcaatttccctgaaagagttcatcaagatgttccctttatgcaacaacaccaacaacgttcatcaaacagaaacgtttttcccatccatgcaacttccaccactagtagtgctactgggtctgtttcttctgttgatgctgttgctcctccttcgttgtccactcatgatcaacatggccaccaagttttcccaaatctgtatcaatatgcacagattctttcaagtgatgatgcacagttaccttatttcacatcccatcttttcaatcaacaacaacaacagcaacagcaacaacctttcaattctcaattctctagcactttttcttcaacctcatcctacttctacaaccagcaacaacaatatgatcaacaaggacatgatcactcaaaccactag

SEQ ID NO: 1572 - DNA, 1701 bp, Glycine Max
atgtggagggaagggcagagttttgatgatgcttttcagtttgtgaaggcggcgagagggattgctgatccaaatatggggtttgcttgccagctgttgcagtgccagaagagggttcatgctgtccctcttagccctagctctttgctgaggatgtatagaattgctccccattcgccgtatgatcctttgcatcttgttccaaaaatgttggtggatccttcattagctgcattggactccagaggtgcgtttatcgtgcacattccttcagcaatatatgtttgggtgggtaagaactgtgaggccaccatggagagggacgccagaggggctgttggccagattgtccggtatgagaaggtacaagggcctattgtgatgattaaggaaggtgaggagcctgtttacttttgggatgctttttcagattttctgcccttaatggacaaatctggcaaatctggcagtaggatagaagatggaaaactatttgttttgcctggtaagaggagagtagatgcatacaatgttgattacgaagttttcacaaaagcaatcacgggaggcttcgtgcctccatttggttcatctggtgaacatgaaacccatttgcctgcaagggagagtagttggagtgtaaggcgttgtttcggtccctcatgggtttattcggattccatgttgtgtcttcgtacatcagcaaatgcaattttgtctccatcctcatccctgtcgtcatcttcatcatctatatcatcatcatcctcaccgtcttttgtttctccagattccattacttctgattctagcattcattcaaagtttttgttagaagtgtccccagactcttcatctctgtctaatttttctagtttgtcaatcacatcaaattctacttctcataatttttctagtttgtccatcacatcaaattctacttctcaaccagtgtctcacagtacagatatccttggtgtcaagttatcacatcccttgtttcagtcagcctctttaccattgaagaaaccatcaacttcccttgctgaacgcagaggtagcttgtcaaaaattctgatgttgccgctaatgaatgataagacacaagtaacagataaatcgacaacgtctcatgctagtcaagaatctgacattcttgttaatgacaatgttagctatcaacaacaatcagatagtaaagattatttttgcgggtctaacaaccatgccaaggatggaggtgtgaattccattcaaaagtgtgagccaagcattgctgatagcatgcacctcaaggaatcatcacttagtcagtctaccacattgaagggaactaatgacagtggcttactgcagtataatgtcgcacagacttcggtatatcactggcccagtatagaaaagattgagacatttggtgcaagtcatttggattctaaatctgcttttgtcatattctctcccagtatgcatgtacatgcagggaacattttatatatttgggtagggaggtctttcagttgtgacgcttcacaggttcacttagatattgataaacaatcagatgtaggagctgtcgactggaatcaaattggatgtgatctccttgctcggtttagtttgccaaagaactcagtcatcaaggttgttaaagagaatgaggaaccctcagagttccttgctttgctgagttcattgtag

SEQ ID NO: 1573 - DNA, 2337 bp, Glycine Max
atgtgggatcttctggaggatgaggaagtcttcattattggcatagatggaatggggggagttggaaaaacattcatggcaactcatatcaagaatgagattaaaagaaaggggactttcaaggatgtcttctgggtcactgtttcccatgatttcaccaatttcaaattgcaacatgacattgcagaaacaatacaggttaagctttacggagatgagatgactagagcaacaattttgacgtcagagttggagaaaagagaaaaagcactgcttattttggatgatgtttgggaatatattgatctgcaaaaggtggggattcctcttaaagtgaatggcattaaattgattatcacaactcgtttgaaacatgtgtgtctacagatggattgccaaccatataatataataacaatattcccctttgaagaagaagaagaagaagaagaagaagaagaagaagaagaaaaagaagaagaagaagaagcttgggagttatttttgctaaaacttggacaccgtggaacacctgcaagacttccccctcatgtactagagattgcaagatctgttgtaatgaaatgtgatggtttaccacttggaatcagtgtgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacagtctgcactgtttcctaatgctgatgaagggaaatgggctatgatgattgttgagagtgggttgttaaatggaaaggggagtttggaggaaatatttgatgaggcacgtgtcatagtggataaactcataaaccattctttgttgttaggttattggagtttacgaatgaatggtctgttgaggaagatggcgtgcaatatcttgaacgagaatcacacttacatgataaaatgtcatgaaaatttgagaaagatacctcagatgcgggaatggacagctgatctggaggcagtttctttggcgggtaatgagatagaagaaatagcagagggcacatcacctaattgtccacgcttgtccaccttcatcttatctcgtaattccatcagtcatattcccaagtgttttttcagacacatgaacgctctaacacaacttgatttatcatataatcgtagattaacatctttgccaaagtcgctgtctaagttgaggtctcttacttctttagtgctccgccaatgttcaaaattgaaagatatacctccactgggagatctacaagcattgtcaagattggacatttccggttgtaattcgctcctcagggtaccggaaggcttgcaaaatctaaaaaagttgcaatggcttagtctttcccgcaagctgaatttatcattagtaccgttatgcgtactgcccggtttgagcaatatgcaatatctggatctccgcggttggtctggtataaaagtagaagatgtaaaagggatgactatgcttgaatgttttgcagtaagctttctcgatcaggattactacaaccgttctgtgcaagaaattcaggacactggttatggacctcaaacctattttatctattttggaaaatttaaggattacacacttggattttctgagaatcttatttatggtgaattcaagcatcgaagggtatgttttggagattgcgatggattacactatttactgccaagagaccttgcagaattacttgtaagtggcaatgatcaatgggaatgcttatgtgctcctctgtcatctaatggttctctatctttaaagcacattaccattcgggactgcacaaaattgaagagtttattctgtgtatcttgtcccttatgcactaatatccaaaacctcaaatctttgacacttaataatttggatagtttaagtgtcatctgcaaggaagatgttgctggtttaacacaatctttatctcggaggggggtgttttctcatctcaaggaattgagtatcagtggatgccatcaaatagagaagttgctgacgccagggttagtgccacaacttcaaaacctgaagtctatatcggtatcgaactgccaatcaataaaggagatatttgcaggagatagttcccacaacattgcacttcccaatttaaccaacttgcaactatactggttaccagacttaaagacagtgtgcaaaggaattttactcattaactctgaggatatattgcacatcaacaattgtcccaattatgaaaaacccagaattagtcgtgtatga

SEQ ID NO: 1574 - DNA, 2151 bp, Glycine Max
atgtgggatcttctggaggatgaggaagtcttcattattggcatagatggaatggggggagttggaaaaacattcatggcaactcatatcaagaatgagattaaaagaaaggggactttcaaggatgtcttctgggtcactgtttccgatgatttcaccactttcaaattgcaacatgacattgcagaaacaatacaggttaagctttacggagatgagatgactagagcaacaattttgacgtcagagttggagaaaagagaaaaaacactgcttattttggatgatgtttgggattatattgatctgcaaaaggtggggattcctcttaaagtgaatggcattaaattgattatcacaactcgtttgaaacatgtgtgtctacagatggattgcctaccaaataatataataacaataccccttaatataataacagaagaagaagaagaagaagcttgggaattatttttgctaaaacttgggcaccgtggaacacctgcaagactttcccctcatgtgctagagattgcaagatctgttgtaatgaaatgtgatggtttaccacttggaatcagtgtgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacggtctgcactgtttcctactattattaggaaagaggaatgggttacgatggttgttgagagtgggttgttaaatggaaagaggagtttggaggaaacatttgatgagggacgcgtcataatggataaactcattaaccattctttgttgttagatcgtgggagtttacgaatgcatggtctggtgaggaagatggcgtgccatatcttgaacgagaatcacacttacatgataaaatgtgatgaaaatttgagaaagatacctcagatgcgggaatggacagctgatctggaggcagtttctttggcgggtaatgagatagaagaaatagcagagggcacatcacctaattgtccaggcttgtccaccttgattttatctcataatttgatcagtcatattcccaagtgttttttcagacacatgaatgctctaacactacttgatttatcatataattatgagttaacatctttgccaaagtctctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattgttacccggatgcgcactgcccggtttgagcaatatgcaatatctggatctccggggttggtcaggtataaaagtagaagatgtaaaagggatgactatgcttgaatgttttgcagtaagctttctcgatcaggattgctacaaccgttatgtgcaagaaattcaggacactggttatggacctcaaacctattttatctattttggaaaatttgatgattacacacttggattttctgagaatcctatttatctttgtcttgaattcaagcgtcgaagggtatgttttggagattgcgatgaattaccctatttactgccaagagaccttgcggaattacttgacattgacattggatactgcacaaaattgaagagtttattctgtgtatcttgttccttatgcactaatatccaaaacctcaaatctttgaaacttaataatttggatcgtttaagtgtcatctgcaaggaagatgttgctggtttaacacaatctttatctcggaggggggtgttttctcatctcaaggaattgagtatcgatggatgccatcagatcgagaagttgctgacgccagggttagtgccacaacttcaaaacctggagtctatatcggtatcggactgcgaatcaataaaggagatatttgcaggagatagttccgacaacattgcacttcccaagttaaccaaattgctactacgctggttaccagaattaaagacg

SEQ ID NO: 1575 - DNA, 2307 bp, Glycine Max
atgtgggatcttctggaggatgaggaagtcttcattattggcatagatggaatggggggagttggaaaaacattcatggcaactcatttcaagaatgagattaaaagaaaggggactttcaaggatgtcttctgggtcactgtttcccatgatttcaccattttcaaattgcaacatcacattgcagaaacaatgcaggttaagctttacggagatgagatgaccagagcaacaattttgacgtcagagttggagaaaagagaaaaaacactgcttattttggatgatgtttgggaatatattgatctgcaaaaggtggggattcctcttaaagtgaatggcattaaattgattatcacaactcgtttgaaacatgtgtggctacagatggattgcctaccaaataatacaataacaatattcccctttgatgaactagaagaagaagcttgggagttatttttgctaaaacttggacaccgtggaacacctgcaagacttccccctcatgtactagagattgcaagatctgttgtaatgaaatgtgatggtttaccacttggaatcagtgcgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacagtctgcactgtttcctaatcatatttttaaagaggaatgggttatgatgcttgttgagagtgggttgttagatggaaagaggagtttggaggaaacatttgatgagggacgtgtcataatggataaactcattaaccattctttgttgttaggttgtttgatgttacgaatgaatggtctggtgaggaagatggcgtgccatatcttgaacgacaatcacacttacttgataaaatgtaatgaaaaattgagaaagatgcctcagatgcgggaatggacagctgatctggaggcagtttctttggcgggtaatgagatagaagaaatagcagagggcacatcacctaattgtccacgcttgtccaccttcatcttatctcgtaattccatcagtcatattcccaagtgttttttcagacgcatgaacgctctaacacaacttgatttatcatttaatcttagattaacatctttgccaaagtcgctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattgttacccggatgcgcactgcccggtttgagcaatatgcaatatctggatctccggggttcgtcaggtataaaagtagaagatgtaaaagggatgactatgcttgaatgttttgcagtaagctttctcgatcaggattactacaaccgttatgtgcaagaaattcaggacactggttatggacctcaaatctattttatctattttggaaaatttgatgattacacacttggatttcctgagaatcctatttatctttgtcttgaattcaagcgtcgaagggtatgttttggagattgcgatgaattaccctatttactgccaagagaccttacggaattacttgtaagtggcaatgatcaatgggaatgcttatgtgctcctctgtcatctaatggtcctctatctttaaaggacattaacattaaacactgtacaaaattgaagagtttattctgtgtatcttgttccttatgcactaatatccaaaacctcaaatctttgaaacttgataatttgggtagtttaagtgtcctctgcaaggaagatgttgctggtttaacacaatctttatctcggagtggggtgttttctcatctcaaggaattgagtatcgagaaatgccatcagatagagaagttgctgacgccagggttagtgccacaacttcaaaacctggcgtctatatcggtagaggactgcgaatcaataaaggagatatttgcgggagatagttccgacaacattgcacttcccaatttaaccaaattgcaactacgctatttaccagaattacagacagtgtgcaaaggaattttactctgtaactctgagtatatattctacatcaaggattgtcccaattatgaaacacccagaattggtggtcgtgtatga

SEQ ID NO: 1576 - DNA, 2067 bp, Glycine Max
atgtgtgctggtgccgccatctcttttttgagggaccctcaaaatgtcaaggaccccaatgccattaaggttgtttctgcggattctgtgtgcggtaagtcattaggttttctcccccgtgagctagcacaatacctatcacctctaattgacaactatggctttggatttcagggacatgttacttctgttcccaaacattctcttgatattgttccaattcagattatgtgccgcagaacatcagatggtgaaagcaaatatgccaatgagacctttaaatgcttatggaaaaatgctcaacgtgttgttgaatttgcaagcaggaatcctccttcatctgtaaagtatcagctgaattttggtcttatgctacatgaagtgttaagaaataatattcaccttctaacagaagatgaaaaaacctatatggaatcattcactttactctcaaatgatagtcagaggctttttatccggctatacactagaaaaggaccttggtttcgcatgtctaatatatcatatcctgaaatagtggatactcaaaaggcagtcaagggacttgctgagaaagaatacatacattctattgaagatgcaaataaactatgtgagagtgatctgaatgatatcttgaatatcctcagcgtctgtgagttgcgtgaaatttggccacaactatcaactatgattttggatagaactggttcgtgtattaggatttcttcaaaagctgaatctcttatgtggcgcactgagagacttttcttcttaaatggagaacaggatctctcgtcctttctacttgttgatatgggaaaaataaagtatccagcttacaactgcataatatcagaaccaattttctcaaatcgcaataatctgctctcatacgaagaggccattgaagttgcacaaattacggatgaagctcttgatgcaaacaaaattgacgtggtattaaggtgcataaatatagctgaatcctgtgtatctactgattttcccatccagtgctcaacttctgaatcagtatcttcaattcgtcatgtatttacatcatcatgggtatactccaaagtggtcacagtagggatttccttccttgagcgggagcacaggtacattgatgctattaacttactccaatggttgctaaatgttttcacttgcgatgtaagaagaggatattggacactgaggttatcagttgacttggagcaccttggctacattgatgagagccttcaagtagctgaaaatgggttgctggatccatggatacgtgctggttcaagaatggcactgcaaaggcgggttcttcgcctagggaaaccaccaaggcgctggaaagttcctagtttttctaggtctgcgttgcggaagatccctgaggtttttgttcaagggagaccattgaattctgaattgggagaaaagaataggtactacaatgaagcggggaaacaatgtggagtggaagagattgctttgcattactatgccggggatggaggtggatggcaaggtgtccatgcagagagtggcatatggttaaccatttttgggcttcttatgtgggatgtcatatatgctgatgtgccaaatgtcttctatactagatttcagaatgctcctttagatttcggcactgatgacttttatactgcaagaaagagtagcatagaatcccatctgcagcaaattcgtgatggcatggctgaggagtttcttattaagtcatgggaaacacatatcggaacagcatgtagaggagttaattggggctgccattctttagatgagcttcgcgctgttgtttcttgtgttgggggcacttgcttggcatctctctgcaaacttctggctcaagactatcggagctggtctagtggaatgccggatttgctgctatggcgtttccatggagaatacagtggtgaagccaagcttgttgaagtgaaaggccccagggaccgactctctgagcagcagagagcatggctattgctgcttttggattatggatttacgattgaggtttgtaaagtgaaacctttgtag

SEQ ID NO: 1577 - DNA, 1386 bp, Glycine Max
atgtgttctctactttggagttccattgcattgtgtgtagcactcctactccttcagcttggcattgtgcacccttcaccctctcaccataggatcactcgcttaccgggtcaaccccatgttcagtttcatcagttttcaggttatgtaaccgttgatgacaaaaaccagcgtgcactcttcttctactttgctgaagctgaaaaagatgcactttccaaaccccttgttctttggctcaatggagggcccggttgttcttctcttggagttggtgcattttcagagaatggaccatttagacccaaaggagagggcttggttagaaaccaattcagctggaacaaaggagcgaatatgctgtatttggaaacgccaattggagttggattctcttactcaactgatacttcctcttacgagggtgtgaatgataaaattacaggcggggataacttggtgttcttgcaaaactggtttatgaagttcccagaatacagaaaccgaagtttgttcattgtaggagaaagctatgcaggccattatgttcctcagctggctgagcttatgctccgattcaacagaaaggagaagttgttcaatttaaaaggcattgctcttggtaatccagttctagaatttgcaacagatttcaattcgagagctgagttcttctggtcacatggattaatttcagatacaacgtacaagatgttcacttctgtttgtaactattcaacatatgtgagggaatactataatggtgctgtttctcctatctgttcaagtgttatgagccaagttagtacggaaacaagtagatttgtcgacaaatatgatgtgacccttgatgtttgtttgtcttcagtgttctcacaaaccaaagtcctcaatccccagcaagtcacagaaaccatagatgtatgtgtggaagatgaaacagtgaattatctgaacaggaaagatgtgcagtcagctttgcatgctcatcttgttggagtccaaagatggtctgcatgcagcaatgtcctggattatgagctgcgtgacttggagataccaacaatcacggttgtggggaagctagtcaaggagggaataccagtattggtttacagtggtgatcaggactcagttatcccactgactggaagtagaacattagtacataaattggcaaaagaactaggattgaacaccactgtgccatacagggtgtggtttgagaagcagcaggtgggtgggtggactcaagtttatggtaacatcctttcatttgccaccatcaggggagcatcccatgaagctccattttcacagcccgagagatcacttgtgctgttcaagtccttcttagaaggaggacctctaccacaagagatttga

SEQ ID NO: 1578 - DNA, 363 bp, Glycine Max
atgttaatctcatcagccaaacaacccttcctcgtaaccactattttcttgttattgggcccaggcccaattctcgctcgcaacgcccacgtcatcaattcccgatcacccaacctccacccggaatccctaacgtgggacccacacgagcagcacttcctcctcggatccctccacaagcgcatcatcgtcgccgtctccgacgctggcatcgctgaaaccttcatctccgatcagtcgatatcccgcacaaccgcttcctcgccgtcgtccactccagctattcgctcccgccgccacctcttcctctcctccctcccctccgactatttgtgctgccgttttatggcttcaacgttctaa

SEQ ID NO: 1579 - DNA, 315 bp, Glycine Max
atgttgaatggcagagaaaaaatatcccttcttgtactttcactattctttagtgcacttatggtttgtttctgcttcatcctagtgatccatttcgtaatggaattgtcatctgtcatgaataatagagctcgaaaaaatcaagaagtgctgtgggcaggatttggcattgctcttttcttaatattttgctttgcttttgttgtctttgctatattttctggttgtcatatggtttatataatgaatagtagcatcaagattgcacctgcacccactcctgaagaagcagaacagcagccacccatggtttaa

SEQ ID NO: 1580 - DNA, 1227 bp, Glycine Max
atgtttaggaaaaggcacaccctttcttctcttgcaagggaattgttggcatttcagccactttttcttctcttcttgttcagcttgcaccacaacactatgcagtgtcaaggaaggttgagtaaacatgtttcttctgagcctccctcaccttctaggtcaacaccatcaccaccatcttcatcaggatacaaggatgaccctaggaagataattttgagcatggttttaggagcagtcactggactagtttcttctgctctctttgcacttgtggttcgttgtgttgttcagtatctgaaccgcacaccaatcctcaagggacctgtcatattctcccccaaaattgcccccatgacactccaatcagctttggcaaaggaaaaccacttgctcggttcgagtcctaatgggaagtactacaaaactgtgcttgacaatggactcactattgcagtcaaaaggctaacaccctttgagagtaattccccggaggctaagagaaaatcagtgaagaggcagatacaaactgagcttgagcttcttgcaagccttaggcataggaacttgatgagtttaagggcctatgttcgtgagcctgatgggttctcattggtttatgattatgtttccactgggagtcttgctgatgtgttgagtaaagtgagggagaatgagttgccctttggttgggaagttaggctcaggattgctgttggtgtggtgaagggtcttcagtatcttcatttcacttgtgtgcctcagattctgcactacaacttgaagcccacaaatgtgatgttggatgctgagtttgaacctagattggcagattatgggttggctaaacttctacccaatttggatggaggaagttctctctacactcctcctgaatgtttccataattgcagcaggtacactgacaaaagtgacatctttagttttggcatgatactaggtgttttgttaactggtaaggatcctacagatccattctttggagaagcagccagtgggggaagtttgggatgttggctgagacacttgcagcaagcgggcgaggcgcacgaagctctagataagagcatgttaggggaagaaggtgaggaagatgagatgctaatggcggttaggattgctgctgcatgcctctctgatatgcctgcagataggccttctagtgatgagcttgttcacatgctaacgcaactgcacagtttttga

SEQ ID NO: 1581 - DNA, 1698 bp, Glycine Max
atgtttgtcttcaaacccacctcttctcttctctttctcctcctcagtatttcatactctgcttcttcagttacctcactcaccgtaccgccgcgagggggggccccactcgacctcaccactactccgcaacaacaaaccgatggcgatgatgattccctcacctacctctggcccctccccgcagagttcacttccggcggcgacactctctccgttgaccccgcgctcaccctctccgtcgccggaaacggcggtggctccgccattctcagagaggccttcggccgatacagagggatcgtgttcaagaacaccgctggtgtcgggtttagtttcatcagaaagctgagggaacgattggtgtcttctgtttcggcattcgacgttgacactttgaagatcacagtccattcagacaacgaggagcttcaatttggagtggatgaaagctataccttgctggttcccaaagccaaggaatcttcccaagtcacgattgaggcaaatacagtttatggtgcattgcgcggattagagacattcagccagttgtgttctttcgattatacaactaaaacagtaaaaatatacaaggcaccttggtccatccaagataaacctagatttgcatatcgtgggcttatgctggatacatcaaggcactatttacctattgatgtaattaagcagattattgaatctatgtcctatgctaaactgaatgttctacattggcacatcatagatgagcagtcatttcctcttgagatacccacatatccaaacttgtggaaaggttcatatacaaaatgggaacgttacacagtagaagatgcatatgaaattgtcagcttcgccaaaatgagaggcataaatgtgatggcagaagtggatgtccctggtcatgcagaatcatggggtgctggatatcctgatctttggccatcaccttactgtagggagccacttgatgtttcaaagaactttacttttgatgtcatttctggtattttggcagatatgagaaagcttttcccatttgagctatttcacttgggtggtgatgaagttaatacagattgctggagtagtacttctcatgtaaaggaatggcttcagagtcacaacatgaccactagagatgcttatcaatattttgtactgaaggcccaagagatggctgtttcgaaaaattggagtccagtgaactgggaggaaaccttcaatacgtttccatcaaagctccatccaaaaaccatagtgcacaactggttgggccctggtgtttgtccaaaggttgtcgcaaaaggtttcaggtgcatttacagtaaccagggtgtctggtatcttgaccatctggatgtaccttgggatgaggtatatacagctgagccactacagggaatacatacagcttccgaacaagagcttgtaattggaggagaagtttgcatgtggggtgagacggctgatacatccaatgttcagcaaacaatatggcctcgagctgctgcagctgcagaacgcttatggagtcagagagattctacctcacaaaatattaccttaatagcattgccccggttgcaaaacttcagatgtctattgaatagacgaggggttccagctgctcctgtcacaaattattatgctagaagggcacctgttggtccagggtcatgttatgaacaataa

SEQ ID NO: 1582 - DNA, 181 bp, Glycine Max
cagaatcttagttttcatagtgagaggatagctgttggttatgtgcttattagtacttcttcaggaactacacttataataacaaagaatcttagagcatgtgtgagctgttattctgccataatacttatattaaagcttgttgaaagggatggaaatcgttttcataattttaaagatg

SEQ ID NO: 1583 - DNA, 108 bp, Glycine Max
cccactaccacaaattatgacgtaggctctgccacttgggcagaccttaggaaagcacccctcctaagtgcaatggaggttacttccctaggccatggaccttattga

SEQ ID NO: 1584 - DNA, 771 bp, Glycine Max
cttatgtttggaaaaccgttagaaattccattgcacgctttccaaaaccaatttctcactttcttagacattgaacacgagtttcaccaacataatttttctgcaatgcaatcattcttgacaaataaacaatacaaaaagagagaaaaccctaacaataaaataatagtagtccataaaatcacacaatgtccaaaattgaacctgagagaggaacaggtgcaggaacatccttggcagcggctaaaagcaaaacctcgtccttctcagaatccgagaacaacccatcctcactcccaaccctccgattactatcatagaggtgcacctcctcatcccccgccgacgccgcctccgccaccgccaccggagcaatttcctctccctcctcaaatcgttcctcatgagccaaaacgactccgcttcgtccctcacctgcgactcccactccttgatctttttgtaatcgccggcgaggttgctccaccgcttccggcactgaaccggttcccggttcacgccgtgcttcttgcacaccagaatctcctgtcgcgtccaccgcggcagcctcgccgccggcctcccgtcatcgccgccgtctgcggcggagcagggcgtcgcgccgttaccagcgccatcgacggcgttgggattcgaaggctgaaaaagagagggtttaggtttattgtgtttttctctcctaagaatgaagagaggaagagaaagaaagaattgtggcttttgatagtgaaattggggttttgtttttaa

SEQ ID NO: 1585 - DNA, 735 bp, Glycine Max
gcaatttgttatccaaagggggaccctgatgctatttacatcaggaagagcgatattgagcttttacagcctgagaaatgccttaatgataatatcattgacttttatataaagtatttgataaataataaactcccaagtgataaacagaagaggtttcactttttcaattgctttttctttcctaagcttgttgatttaagcacagataatcgttcaattgcttgtgatggtaaagcagcatttcagcgtgtaagcaattggacaagaaaagtgaacctttttgaaaaggattatatcttcattcccataaactatagtcttcattggagtttgattgtcatttgtcaccctgctgaagtcatgacatgctacagagatgaagaaactaagggatctcccaaagaagcttgcatcttgcacatggattcccgaaaaggaattcatcaagatctccacaatgttttccaaagttatctatgtgaagaatggaaagagaggcacaacaatgtgagggatgatgcttcttctaaatttttagatcttccattcgtgccacttgagctgcctcagcaacaaaatgcatacgattgtggcatctttttgctccactatgtggaacgttttctggaaaaagctccaatcaactttaaccgttccctgataaccaacttcagttcttggttccctccactagatgcttctctgaaacgatctcatatacagaaactatta

SEQ ID NO: 1586 - DNA, 717 bp, Glycine Max
ggggaccctgatgctgtttgtatcagaaatagcgatattgagcttttacagcctgagaaatgccttaatgataatatcattgacttttatatcaattatttgaaaaataaactcccaactgataaacaggacaggtttcactttttcaattgctttttctttcctaagcttgttgatttaagcacagataatccatcaattgcttctgatggtaaagcagcatttcagcgtgtaagcaaattgacaagaaaagtgaacctttttgaaaaggattatatcttcatccccataaactatagtcttcactggagtttgattgtcatttgtcaccctgctgaagtcatgacatgctacagagatgaagaaactaagggatctcccaaagaagcttgcatcttgcacatggattcccgaaaaggaattcatcaagatctccacaatgttttccaaagttatctatgtgaagaatggaaagagaggcacaacaatgtgagggatgatgatgtttcttctatatttttacatcttccattcgtgccacttgagctgcctcagcaacaaaatgcatacgattgtggcatctttttgctccactatgtggaacgttttctggaacaagctccaatcaacttcaaccgttccatgataagcaagttcagttattggttccctccaccagatgctcctctgaaacgatctcatatacagaaactatta

SEQ ID NO: 1587 - DNA, 624 bp, Glycine Max
ggtgctgcgcaagagaagagagagggagtaatggacagagacgaagcagaaaccatggagaatgtggaattcgatgcttctgagattgagtacgttagttacggtggcgagcatcacctccctctcgtaatgaacctggtggaccaagaactcagcgaaccttattccatcttcacgtaccgttacttcgtctatctctggcctcagctttcattcctggcgttccacaagggtaaatgcgtgggcaccgtggtatgtaagatgggggaacaccgtaacactttcagaggctacattgccatgctggttgtcatcaagccctacagaggaagaggcattgctacggagcttgttactaggtctatcaaggtgatgatggaatcaggttgcgaagaggttacattagaagcggaagtgacaaataaaggagcactggcactgtatggtcgccttggctttattagggccaagcggctctttcactactatttgaatggagttgatgctttccgtctgaaacttttatttccccgctcagagttgcacccatctctgcctatgatggcagataaatacgagagccacatgcaaagtgatcatggtgatgcaccatttaaagaatga

SEQ ID NO: 1588 - DNA, 258 bp, Glycine Max
gtctgctttgtttggagtttggtagagaccgttacatgtctgggacataaaataccaagagtgagtctgataaatatgggtttcccatgttttatgataaaatctcttgaaaggtgtccatcgttgcccaataatatgctgttattatttgagctacatctggactccacacgtaaaacttctgctcctccgtctctcttgtgccctttttttaccttagaaattgtaaaaggagagtcatatattagtctcaagtag

SEQ ID NO: 1589 - DNA, 711 bp, Glycine Max
tatccaaagggggaccctgatgctgtttgtatcaaaaagagcgatattgagcttttacagcctgagaaatgccttaatgatactatcattgacttttatatcaattatttgaaaaataaacttccaagcgataaacaagacaggtttcactttttcaattgctttttctttgctaagcttgctggtttaagcagaaatgatacatcaattgcttgtgatggtaaagcagcatttcagcgtgtaagcacttggggaagaaaagtcaacctttttaaaacggattatatcttcattcccataaactatagtcttcactggagtttgattgtcatttgtcaccctgctgaagtcatgacatgctacagagatgaagaaactaagggatctcccaaagaagcttgcatcttgcacatggattcccgaaaaggaattcatgtacatctccagaatgttttccaaagttatctatgtgaagaatggaaagagaggcacaacaatgtgagggatgatgtttctcctaaatttttagatcttccattcgtgccacttgagctgcctcagcaacaaaatgcatacgattgtggcatctttttgctccactatgtggaacattttctggaacaagctccaatcaactttaaccgttcaaccaagttcagtgttcctccaccagatgcttctctgaaacgatctcatatacagaaactatta

SEQ ID NO: 1590 - DNA, 1720 bp, Glycine Max
tcttatcagcataaaagcttttggatgccacgggatgctggctgcatggctgaagaaaatgcgggatatgaaaattcttccagaattgaacccaagcgcagtcatcagtggtttatggatacaggtgaacctgaaatattcagcaacaagaaacaagcagttgaagctgttagtggcaggccaatttctggagtttcacatgcaaatgtttcccaatgggacaccaattcaggatttcactcagtcacaagtcaattttctgaccgtctttttggatctgatcttgctaggactgtgaatttggttgataagaatgtgccatctattgtaagtggaaatctgaacatgggaaggaaagattttgagcatcaatatggtaatgatccttctgtgggattgtcaatatcccattccatagcagacccttcatcatgtctcaattttggtggcatcagaaaagttaaagttaatcaagtcagagattctgacaactgcatgcctgctgcatccatggggccctcctatagtagggaagataatagtacaatttcagtaggtgctggctacaataagaatgatggcgacaatatttcattgggtcctacttataacaatggatatgacaacaccattgctatggggagcagaattagtaagactgatgacaatcttctttcaatggctcacaccttcagtaaaggggatgggggttttatgttgatgggccacaattatggcaagggagatgaaagtatcgtatcaatgggtcagccctttgacaagggagatggaaatttcatatcaatgggtcaatcatatgagaaggaagatggcaatttaatatctctgggcacctcatataccaaggtacatgaaagctttataccagttggtccaacctatggtaaatcaggagaaaatttcataactgttgctccttatgacaagggtactaatcatataatatcaatgggtccaacatatgataaggtggattcaaatattgcatcaacagttccatcatatgacagaggagattctagttccttacctgtgggtcaaaaccaccataagggtcagagcagttccatttcttttggaggttttcatgatgaccctgaaccaaatacccctggtggaatcattagtggctatgatctgttgataggaggccagaactcagctcaaggattggatagccagaacgacctgactgagacaaacactgaatcacttgtaaatagcattccaaaacccaatactaaaaatgatattgttgttaagaacaaagagccaaagacaaccaagaaggctcctactaacaacttcccttcaaatgtcaaaagtttgctttcaactggtatttttgatggtgttcaggtgaaatatgtttcgtggtcacgggagaaaagtcttaagggaataataaaaggaactgggtatttgtgttcatgtgacaactgcaaccagtcaaaggctcttaatgcttacgagtttgagcgtcatgctggtgctaagacaaaacatcctaacaatcacatatactttgagaatggaaaaaccatctatgctgttgttcaagagctgaaaaatactaatcaggatatgctttttgatgctattcaaaatgtgactggctctaccatcaaccaaaagaactttcgaatatggaaaggtaacaagaattttcagtttgcttggtcatgtctttgcttcagtt

SEQ ID NO: 1591 - DNA, 921 bp, Glycine Max
ttaatccttaaatgcataagaaatgttataatttgtattacctcattgattattaacagattacctgttgaagaagttaatgttgctgcatcattgttttccttgagtaacatcttgaaatgtccttatgatgttaagttttctcttcaggatacatcagactttcaagaagattccgttcattcactttgctctgaggctgacccagattccataggtagctttgaggaggcatacgaacctagtccaatttcagttttggatcccttatttggtgaagacagctctaaatgtggcaatcatgtatatgattcctctgaagtggatgatgaagaatatggtttgaatgtttcaagtgatgaagattgtgagaatgaatctgtaggtgactccgaagaaaagaaagatgtagcaggattatttagagctgaagaaagtagggatttctcgtatattgttgaggtcttaaccgaggcaggtataagtaataggagcttgtttacagacttttcaacatggcactctgcagaatgtcctattagcccttctgtcttcaaaatcctggaaaaaaaatttggcgagcagcaactttggaagagatctgaaaggaaacttctctttgattgcattaacctagggctgctggagattctgcagccatatttgtacatcccagtgtgggaaaagcccatgtcaagaaggttgaatactgaaccaagccaggacatgattgaggaggagatgtgggggttgcttgttgcacaggaaaagaaagctagtaaagggttagcagacagtatgctcgaaggggagattaggtggatagaactagttgaagatgttgaagatattgttagagagatagtgaagttgttaatagaggagctcacaaacgagatagttagcttggagaatttttga

SEQ ID NO: 1592 - DNA, 507 bp, Glycine Max
ttccggcgagacctcccaaattccgttgaagttcacaaagaagaaaaagtgaaggtgagaggaccttttgcttggattgattgggtcttaagccacctctgccttttcactcttcaatcgtgggtttttgtgttcaatgggaagaaatgggagaaattcaacagtgagaaagtggcatcactagcatatgctcgcatacaagggaaagcagctctcattgctcacttccaaaattcaagcttgatgaatgaggataagcactgcaagcctatatcctcttcaacgccgatggccctaatgccagtgatcagaatcttggcaagccatttgaaatttgcacttctctttttaccaagagatgaagctacaaaatgggtactaactttgctagcaacacaggttcctttcccagttggcattaacattcgcaacgaagttggaagattttcaaaaattaaaaaagacatggactatctttttcccctaattaataatatctcaatttag

SEQ ID NO: 1593 - DNA, 1359 bp, Glycine Max
aaaagcttagaatcacaagcaatcgagtatataggagatacagcgaaattaacgcatatccactcctcttgtccatttgtatcatatattcacacacacaaagatatagcaccaagtcacttcgatcatgtctggcataggcgattaaaagaagcaagagaagccgcaaaacaagcttacaagccgaaccccatgaaagttaccgctgagttcaatacacatttcttaatctaccaattattttgcgatatgcttcagtacaagcttgcacaggcaatgagaggctccaacaactcaagaaggggcttatcaaaccaatacgatggtccatgcaaggcgacaaaccccattgacaaatgttggagatgtgaccccaattgggagaaaaaccgcaagaggctagcagattgtgccctaggctttggccatggcacaacagggggcaaagatggcaaaatttacgtggttaacgactcttccgacaatgacctcgtaaaccctaaaccagggacattgagacatgctgcaattcaaagagagccactgtggatcatttttgatcgaaacatgaacattaaacttcacgcggagctcatgctaacggataataagaccatagatgcacgtggtgccaatgtgcacattagtgagggtgcccaaataacgttgcaatatgtgaaaaacatcatcattcacggtctgcacattcatgacattaagaaatgtagtggtggcctcatcagagactccatggatcactatggagtccgtgccatgagtgatggggatgccatttcggtgtttggatccacatatgtttggatagatcatgtttcctttaccaactgcgatgacggcctcatcgatgtcgttagcgcttcaactgctgttaccatctccaactgccatcttaccaaacataacgatgtattattatttggtgcgagtgatagctactcgggggataaaatcatgcaagtgactttggctttcaatcatttcgggaaaggattgattcagaggatgccaaggtgcagatggggcttctttcatattgttaacaatgactacacgcattggctaatgtacgccataggtggtagccaacaacccaccatcatcagccagggcaaccggtttatcgtgacaaaaagggactatgcaccagaaagtgtgtggaagaactggaattggagatcagagggtgatttattgatgaatggagccttctttgttcagtctgggaaaaacgtagcaaaaaatcccaaggcagaaatcatagcaaagcctgggaaagccgtatcgagtctcactcgctttgcaggtcctctaaaatgtgaagtaaacaagtcgtgttga

SEQ ID NO: 1594 - DNA, 966 bp, Glycine Max
aaacattatgaagatcttcattctctctaccataacctttggttaaatgaaatttccttgcatgaaagcgagaatatgatacaatatatcatagaaatcacacattccgaggcatatgggatgccaatgtggttagcctatctgaatctcatcgaaggacaagacattaagaaagaagtaaattttgcattcgttggttcaactgcacttgataagaattttttggaacaaaaaagaatcaataaagaggaagttgcttatttatgcgataattacttcacaaatgcattatttttagtgggagagattagtggaaatgacttgagtgcaattatcccatatataaatattacaaaactctgtcaaatggttccaccaattgaattgattgaagaaggagcaataaagctagtggtaccaaagaactttctaattgggtgtaattctgttgttttggcaacattgaatagtgataagaaagatgactatgatcaatttgggtgtttgaaaacttacaatactttcattgagtactataatgagcaaataaaaaaggctatagagacattgagacaaaagtactcatattttgataattatggtgctaccaaacgtttatttcaagcaccacaacaatatggtgggttgtgtttttattttctttttttacatgaatataaaaccaagacttttagagtatgttgtgaaaagagtgaaccttacaatattagtttacaaatagcctatggaagtcctgctacaatagtttcctcaaatccttcaaaatatgtaaatagggatgaaccacattttattgaagcaacatataggctaatagcaaaaggactagttgaggggtcttttgccaacccttctctcaaatctcttcctttcaagataaaaactagatcaatatgtctaacaactttgattgagaataagtttaatgacttgttggtttcttaa

SEQ ID NO: 1595 - DNA, 349 bp, Glycine Max
aaacccactcactcttcaccaccgcaaccccaatcctcttcctctttgtcttcgttcagtgctacttttgatcggtcaaaccatatcgcttttctagagagagtcttcgagttcttctccgaacacaacaactttctggagacggagagcgccgagaaggtgatagtgtcactattgcaggccgttgaagagaagtgggagtttctcaaggtggagatagaaaaggccgagaagaagcagagaaaggaccttaaggcctcagaggagaaggggaaatccgacaatatgttgaaggaagaaaaggaacccaaagccaaagacaccaacaaagacgaaagtgcctccagag

SEQ ID NO: 1596 - DNA, 115 bp, Glycine Max
aaagagattcgtgaagccatcaaagggtgtctgtggctcaatggtatttcgcattcaatcgcttacaattggtctcgacccaacatgaaaatcagtgttaggatcattcacgcaa

SEQ ID NO: 1597 - DNA, 372 bp, Glycine Max
aaagatccagctgcctatccaaatgctttgttagcaaaagttttaattgatcagattgacaggaaactggtcaaacagacagtgaggacttcagtttatggtgttacctttgttggggcacgagagcaaatcaagagaagattagaggagaaaggtcttattactgatgaaaaacttttatttgctgcagcttgctatgctgctaaagtgacattaactgcgcttggagaaatttttggtgctgcacgtgtcattatgggttggcttggtgattgtgcaaaggtaattgcttttgaaaaccagcctgtttgttggaccactcctcttggccttccagttgtacaaccatactgtaaaactgaacggcatctg

SEQ ID NO: 1598 - DNA, 333 bp, Glycine Max
aaggattttcttttccttctaataacttccaaattcttggccacacattcctactgttctacgaacactccatcatcctctttgagcagtgacttctcaacgctctcatacaatgtgctggtgaatattgcaacctcctttgatgacccaaaccttcatgcagcatcactggtatttcattcgtggtgggaggcattatggccactgcaagagataatgatgttgctacgatggggaagccatctaacctggtgcagtattacgtactatatagctatttattacatatacatctttaaactccatgaattgcaatttatttactcaatataa

SEQ ID NO: 1599 - DNA, 249 bp, Glycine Max
acagtcgacaaccctacaccgccagctccagacctctatcgagtcttaggaatcgatcgtgtcgtcttccgtatcccccctgttcccgacggcggaacccatcgcatcggccagggagccttcgaaaacatgtgtcatggcggacatcgtcgtctgcaccatctatggctcctccatcccctccctcgtcctcatcctcgctcgcggtcaccgcatcgagtccatcctagagctcccactcgtcgttag

SEQ ID NO: 1600 - DNA, 1425 bp, Glycine Max
agaaactctggcaagtggggaaacgttaatagattcagcactgcagcagcagttgaggaattaatcattccacaagttccaataacatacactaagcatttgataaatggacaatttgtggatgctgatgctgcttcagggaaaacttttccaacatatgacccgcgcacaggagaagtgattgctcgtgttgctgaaggtgatgcagaagatatcaaccgtgcagtatcagcagctcgcaaagcctttgatgaaggaccttggccaaaaatgactgcttataaacacagtgatgaacttgcagctctgaagacatggaacaatggaaagccttatgaacaatgggccacttctgaattaccaacgtttgtgcgtttgtttcgttactatgctgctgataaaatccatggtctgacagtgcctgctgatggaaattatcatgtggagacattgcatgaaccaattggtgttgcaggacaaatcataccttggaactttcctctcctcatgtttgcttggaaagttggaccagctcttgcatgtggaaatactgtcatccttaagactgctgaacaaacacctttaacagctctctatgtggcaaaagccggtcttccaccaggtgttttgaatgtagtttctggctatggtccaactgctggtgcagctctagcaagtcatatggatgttgacaagctagcattcaccggatctactgagactggaaaagttgtacttgaattggccgcaagaagcaatttgaagcctgatgctgatgttgaccaggctgtagaacttgcacactttgctctgttctttaatcagatatgcatggggcaatgttgctgtgctgggtctcgtacctttgtacatgagcgtatctatgatgagttcttggagaaagcaaaggctcgtgctttgaaacgtgttgttggggatcccttcataaagggtgtcgaacaaggtcctcaggtgtgttttgctagtactcttaggcagaatattattgattgtgttctttcttatcatttttgttccttttacagttactacaaggccacccttgaatgtgggggtgacagaattggctcaaagggcttctttgtccagcctactgtcttctcaaatgttcagggagtgttaatgacactttgttttacaatgatgcaacatttgtttaaaacttcctggtatcaattaattcgaaggtcaaatgcaacgcattatggtctagttgcaggtgttttcactaagaacagagttggaactgtgtggatcaattgctttgatgtttttgatgctgcaattccttttggagggtacaaaatgagcggcattagcagggagaagggtatctacagcctcaacaattacctgcaagtgaaagctgtggtttcaccagtgaagaatcctgcatggctgtga

SEQ ID NO: 1601 - DNA, 471 bp, Glycine Max
agagagagagagagagatagagatagagagagagtgacacacagagatagagagggagagagaaagcaagacacagagaggacgggagcatatggtagagggagggagagactgagagtcaggcatgagaggagtgcaagagagcactctctgttccgtgaccacaacctgtaccagaggaatgttggaggaaggcaacatcgtaggtggagaagcaggggagaaagggggatatctgaacacaggggttggcacaacaaaaatgagaaggaggatagctatgataaggatggaaactggacgaaggtaaccagcaagagaaataaggacgacatcacgtctttctacttcacacattttgctgatgatgttactgaggtgcgactatgggaaaattttaaaaaatggggagatgtgcgtgaggtttacattgcaaaacgacgtaacaaggacggaagacgatatgatttc

SEQ ID NO: 1602 - DNA, 455 bp, Glycine Max
agatttagggataaaaaagaggttacagaacctgaggcagacccagaaagggatcagagaactgtttttgcctaccagatgccgctaaaagcaacagagacaaatttgcttttaaatttgatatacttttgtcattggaactgtgatgacttgcctattgaactattttttctccattggaacattattgacttatgttgccaacttcttcttggacaacttgtaatggtgaaaccttctgaagctgaaaagaaccttgttcaatctaatgcttctggtggagcagccagtgtaactggcccctatggagctgtggaccgaaaattgtatgtggggaatcttcacttcaacatgactgagagtcagctgtgggagttgacatcaaaattaaattatatcattcaagaacatattaaatcaatttcccccaaaattgacttcaatttcgtgccatg

SEQ ID NO: 1603 - DNA, 909 bp, Glycine Max
aggagtacaaggatgagaaggaagaggatgttaaagcagaccatatgtgaagagattgaaagtgaagatgcttgtgccttgttctctctctctctatatatatgcataacagagcaacaaagattgcaatcagtaaattttaaatttgctactgctgcaagatatttcaaggaagctgcacgaatatctattaaagcaaagttactgtatgttgaaaaaaagaccattcagatagacatgaatatgattacattaaatcttgagccacctagaaagaaacttggaggtcattcttctccaataaactatgtatgtaacttggagtttgacaaagtgcaaaattaccagcttcctccttctccaataaactatgttgtggaggtcaatatcaaagtcgaggaaccaggtgagaagaatgttcacaataatgcattctatgctgaagagaccttgctcagatctgaattggaagccatgcgtgattgcaattctttgactgctcgacattgggttgtaaggaacacgagaacatgcaatagaactggacagttgacaagctataagctggtacatggctcaaactgcttaccattggcaggttctgaagccaagtttttaagaagagctgctttcttgaagcataatttttgggtaacaacatattcacgtcgtgttggtgaaggactagctacatgggttaagcagaaccgttgtttggaagaaattaatgtagttctttgtagtatattgaagtatgtaactgcatcaagcaatagcctattcatatttttatatattagcacattttgtcctcccttctttgtgcagcctcatggattcttcgactgttcccctgcagataatggctcttcgaaaccaattcagagtgggttaacggcaaagctttag

SEQ ID NO: 1604 - DNA, 714 bp, Glycine Max
aggttgtggagcaatccaaggctgattgtgagattgattcctaatttcctattttcttatgcagattatgccaatgggaggtggtttatatatgcctccaatgatgttaccagcaagagagagattggttgtgatataaacaagacatatgcactcaaaaacataaataaaaaacaaaagagacaagcctggattctcgaaggcaacgggaagagacaaggctgtcatgaccctccacaggcaaacctcatgctttttggcatctgcaatagagaattatccaacggcaccctggctgccatctccgaaacacatcacgatgctcatccatctcaaggaatagtaagaggaaagatggatcatctgcggcaatgctttcagggacttgaggcatgctcaaaactagggagtatgatacaaacactctttaactggttgtctacatcagaaaatctacttgtttcaattcaagagaaaataaaatgggctgatgctatgagtgaaattgagaagaagcgcaggaaggatgtggaagagaaggtacaagaactaaagtctgttatcaaggtgcccactaattctccctttttcttatttattccagccttctccatctttgtaatacaaagtcaatgttttaagatggttattagaaaaaatcgtcttagaaagtttgtaacgaaatactttctaagacggttattaccgtcttag

SEQ ID NO: 1605 - DNA, 804 bp, Glycine Max
agtaaaacttttggagctgccttgttagtaaatgaaaaagctgaatcatttgagtggttatttgaaacatttttgaaagccatgggaggtcataaacttgtcgtgatcataacaaatcaggacccagatatgaagattgcaatgaagaaggttttcacaagcgtttcacccaaattttgtatatggcacattcttaaaaaactttcagagaagctaagggcttccttgaatgccaatactgattttcatagtcattttaagtcttgtgtttcgaatttagagtcttcaaaagaatttgaactgacatggaaagctattatttgtgattttaagttagaagaaaatgatacatttttggttggaattttgagaacaacctcaagatctgagagtgaaaattcattatttggtaattacttgaataagaaccttagtttggtagaattctggatgagattcaattctgcaatagaatcacaaaggcacacagaactacttgtagataatgtcacacttaatactatgcctgaattgaagttacatagtgatatagaaaagcacggcagagaagtttacactcatgaaaatttgacatttttcaaaatgagttatggaatgcatgtgcgcattgtgggattgaagaaacaaaagaggacaattgggcaattattaatttttatacttgaccatattatggttaatggtagcaaagttaggaaaatgaaggaagttgcttataattcttccaatcatattacacattgctctcataaaaagtttgaatctgaaggcattccatgttga

SEQ ID NO: 1606 - DNA, 288 bp, Glycine Max
agtgtaggtgggaagagattcagaaacatctatgcctttaatatagctatgcttaggaagcaaggttggaatttcatgactatcctagaggctcttgttttgcacatctttaaggccatatactatcctaagggggacttcttggaatccaagctaggtcacaaaccatatgcaacatttgacaatgcagtatctctttgttcctgtcatccattcatagtcaatttttgtagacttcctccaatgattataaataatcccgcactccataattccttccaaatttag

SEQ ID NO: 1607 - DNA, 399 bp, Glycine Max
agtttccaacttgttgggggttgccatggtcgacgctctctcattgattccaacagttgtgcttttcaggtttacatggatagagagattaaatctggagaaattgttgccctgaagaaaatacgaatggacaatgagagagaagggtttcctataactgttatacgtgaaattaaaattctaaagaaattgcaccatcaaaatgtaatcaacttgaaagaaattgtgacttctacaggtttatgggtcttctccccacttatatggtgctcaacctttccacttctacccgatgtgggacttcacctcacacttgtaacccaacacatctccccctcaagtgtgagtctcttccacatggtagtcttctcctcgagcggaagtcttccacgagtatag

SEQ ID NO: 1608 - DNA, 552 bp, Glycine Max
ataaatggtgttggaattaattcaagttttctagtccaccaggatgtggatggcagagctactgatgttgctttggtatggtctgttgcccttggttctccttttacatttgcaacttcgttagagatggaatacaggagtcacatctttcgggagagaggcaagagcattttacttagggctgttcatggtattgtggaatccttgtttaggaggtacactgaaaatggaatgagtgaagatttggcctataacaacactgtcgagcccattacaagaactatatctaaaataatctcgactaagggtatggaatttgagaaagcatatagtgcttcatattattcctgcatggacattttgtatgcgtgctatgaggatattgctgctagaagtgacattcgcagtgttgtcttggatgggcggaacttttataggtatgtacgttgcttgcatttcccatggcttgtccgttctacaaggccagctggtgatctaggtccattatacccatttattgttcgggtctacgtggaattgatgaaggcccag

SEQ ID NO: 1609 - DNA, 834 bp, Glycine Max
ataattttgtttctctattctctaggttcgtacggagcgacattaatggtcaccaacaagtgcagctacacagtttggcctgccattttatctgctgccagaagcttgccggtccacaccccgggcttggttctccaaccaggggacaccaacaccatccaagtgcctccaacctggtccggcagactctggggccggaccctctgctcctacaacatcaccggaagtttcacgtgcgtcactggtgattgcatctcctccactgtagaatgtggcggcgccaccgcaccagtcactctggcagagttcactctaaatggcactggcgggctggattacttcgacgtgagcctcgtggacggtttcaacctccccctggtggtggaaccgcggagcgcaataggagccgaaaactgtagggcgactggttgccggaggaacttgaacaaaaagtgtccggtggagctgcaggtgataaaagagggcgagggcgttgtgggttgcaaaagctcgtgcgaggttcatgagccatgcagcaataattccaacttgttttcacactttttaaaaactagatgccctgatgcttatcacaatgcctctttcacttgtgtctctgccgattttaccattactttctgccccgctttctccaagaggcaaagaaaaagaaacttattagccctttccaacagtacaaatgagtgtagtgttaaaatttccagctggggtggtggaacgctcatcccactacgtcctcttgctcctgatgaagatactcatacctattgtgttctcagtttctattttaagttgttgcgcatgcaacatatg

SEQ ID NO: 1610 - DNA, 192 bp, Glycine Max
atagagatacgccgattagatagctgtcgaacttgcaatggttcaggggctaaaccagggattacaccatccgtatgtagcagttgtggaggtcaagaccgggttgtctcatcaacgagaactccattagccatcttccagcggtcaatgacatgctccgcatcttgcaatacatgttatggggatggtcgg

SEQ ID NO: 1611 - DNA, 201 bp, Glycine Max
atattaagcaggaaaccccatctggatgatgagatctacaacgagcttgttcagagagctaaggatgtaggatatgatgtgagcaaactccacaagaccccacagagtgatcctccaccagaggaagaaggcccccaagacacaaggcatttggtggctcaaatccatttttgggaaataggcctccatgatgatatataa

SEQ ID NO: 1612 - DNA, 1041 bp, Glycine Max
atcccagagcagtggttagaggccacagagtccattgcacacagttcaatgcttccgattgctcttatatgtggtgccaagaattgtgggaagacaaccttctcccgctatctcctaaacatcctcttgaacaaatacaccaaagtagcttatctggatactgatgttggccaacctgagtttactcctcctgcttttctatcactaaccattgttcataaagtaactccagatttgacagttccatgcctgaaaacaccggagaggtgccttttctttggtgatgtttcttgtaagagagatccatcaacatacttaagttatgtatttgccatatataatcattaccgaaaggagtattgcatctcagataagggagaatatcctcataagattgaggttcctcttattgtgaatactcctggttgggtgaaaggcgttggttatgatgtattagtggacatgttaaaatatatttgtcctacacatgtagttaagataagcatatccagtgaaaaaaagaatttacctgctggagaattctggtcagatggggaacatgatgaaacaattaacataattgagataaattcagctcgtcaggactcgttaaatagatcggtgcttgttcagaaggatgcacgtctactgcgtgatttacgaataatggcttatttcagacaatgcttttctagtgagtcaaatatttccacaatcaaggaacttgcacatgcgttgacctctcattgtccgtatgaagttcctattgcaagcataaagattcggcaccttcactgtgaggttccaagttctgaaatattctacagtttgaatgctaccgttgttggcttagcagttgattctgatggacctgaaaatttgccttggtgtcttgggcttgggatcgtgaggggcattgactcagtcaaaggtgtgctctatgtcattactcccgtgccaaatagttctctggaaaaagtcaacctcttgctgcagggttatatccaaattccttcttgtttattgcaggcaagaaatttc

SEQ ID NO: 1613 - DNA, 120 bp, Glycine Max
atgaaaaaacaatgggtttatttttatttgggaaacaagtgttgccttctagccttatacaaattccattattttttttctgattgtcctatggaagttaaacaaggtgtaccattgtaa

SEQ ID NO: 1614 - DNA, 279 bp, Glycine Max
atgaaaagcccaatatgcataaaagggatggatgtgtttgctgtatatttgttcaaggaccacaaactaaagctcttaattcaatttgctccaattggattagtgaacatgcttaactctggtggtgccattcagtccatggagtttgacaaccacacagacgtggtcaaaattgggttagttgtaaaatatatagatggggtagctgtaaaatttgattatgaggataaaatggctagagtgcaagttccctggccttgttcttcaaaattgtcaaag

SEQ ID NO: 1615 - DNA, 2064 bp, Glycine Max
atgaaagaattgaatatgccgggaattgttacaaacggggttcaagatgaaggggggagtaatgagatgaatggggaccaggattcaccttttaaggaacccttgaatctggttaagtccccgaggggtggttctctttatgagaatgtgtgtgatatgcagagttctgatcagtcgccgtcgaggcaaagttttggatctgatggggatgagtctagaattgattcggagttgaggcatctagttggaggacggatgagggaggtggagataatggaggaggaagtgggggaggggaaagagccagaaggaactactagttctggttccacagaaaaatctgtcaaggcattgaattcacaggtggaatctgataatactttgcccaaattgacatccaagggaagaagtcctctttcaaaggctcccattccgagaaagaatggcaagcctttgaggaaaccgattggtggggttactggttcagtgtcacaaaaccgagttgagagtatggctgagtcagcattagaaaaacctgagcgggcacctgtattgctaaagcaggcaagagatctgatttcatcaggggataatccgcagaaggctcttgacttagctcttcaagcaatggaactgtttgagaagtttggtaatgggaaaccaagtttggagctggttatgtgtttacatgttacagcagcaatatattgcagcttgggtcaatatgctgaggcaattccgattcttgagcgctcaattgagattcctgttattggggaaagccaacaacatgcccttgctaaatttgctggtcacatgcaactgggagacacctatgctatgctgggccaacttgagaattcaataatgtgctacaccactgggttagaagtccagaagcagattttgggagagacagacccaagggttggtgaaacttgtcggtacgtggctgaagctaatgttcaagctttgcaatttgatgaagcagagaggctatgccaaatggctcttgacattcataaagcaaataattcagctccatctgttgaagaggcagctgacaggaggctcatgggccttatatgtgagacaaagggaaatcatgaaacagctcttgagcatcttgttttagccagcatggcaatggtaaataatggccaggaagcagaagtggcatctgttgactgcagcattggagacacatacttgtctttgtctcgatatgatgaggctgcctttgcatatcagaaagcgctaacagttttcaagaccagcaaaggagagaatcatccagcggtgggattagtctttgtacgtttggccgacttgtataacaggactgggaagataagggaatcaaaatcatattgcgagaatgcacttaaaatatatgagaatccaatgcctggagttcctctggaggagattgctagtggtcttacaaatatctcaactatctatgagtcaatgaatgagcttgaacaggcactcaagttactgcagaaagcactggagatatatagtgatacccctggtcagcaaagcacaatagctggaattgaagctcagatgggtgtcatgtactacatgttggggaactattctgaatcttacaacactttgaaggatgctatttcaaagcttcgtgctattggagaaaagaaatcatccttctttggtattgctcttaatcaaatgggacttgcctgtgtgcagcgttatgccttaagcgaggctacagaattatttgaagaagcaaagagtattttggaacaagaatatggaccgtatcacccagaaacacttggggtatatagtaatcttgctggcacatatgacgcaattggcaggctggatgatgcaattcaaattctggagtacgttgttaacacgagggaggaaaaactcgggaccgcaaatcctgaggtggatgatgagaagaggaggttgggtgagttgttgaaggaagcaggtagagttcggagcagaaaagccaggtcactggagaaccttcttgatggcaatgctcacgctgcaaacaatgttgtcatcagggcatga

SEQ ID NO: 1616 - DNA, 807 bp, Glycine Max
atgaacaaatcgcagtcgaagaactccaagtcctcgactcagttcgactcgccgctcagcttctactccccgatgcacggggacggtaccgagtcgccggagtaccggtcgccggaaaactggccggagaagcgcgacaactccatggccatcgtgaccgccggcaagctcaagcagttcacgccggagaagcgcgcagagcaccggaagccgccggaaaatccgccgtcgacggcggtgatggtgttcaacgcctcgtcggcggaggaggctcagaggccggcggcgaaggcggctccggtgatcggaggagaacggagatcgaggtcggcggcgacggaggagacggttagcaaggcggcgctagggttccggctgagcgaggttgtggtgtgtctgatttcgttttctgttatggccgcagataagacgcaaggttggagtggtgattcatttgatcgctataaagaatataggtattgtttatctgtgaatgttattggatttgcatactctgcattacaagcatgtgatctgacatgtcaaattgccacggggaaacgcttaatcagtcaccaccttcgcaaccactttgatttcttcatggatcaggttctggcatatcttctgatatcggcatcatcatctgcagcaacacgggttgacgattggatatcgaattgggggaaagatgagttcacagaaatggccactgcttctattggaatggccttcctcgctttcgttgcctttgctatcagctcactcatctctggttacaccctatgcaaccgaagctccatgtga

SEQ ID NO: 1617 - DNA, 708 bp, Glycine Max
atgaacgaagcccaaattgaaattaccattcctcacttgttcaaatggctccaattaggtaactctgccactattgattatttagctgcacttaagcacacccttgaatcaccccaattggaaaacaagatccaagcactcgagaaaattagagtcctctttgatgagtattgctccttcaaaaaatcttacttccaccaattgagtttcttgccactacttttagaactagtttttggttcttggctctcaaaaagtcacaacagggagttcactgagctagcactttcttgcattctaaagttgttgccttttatgagtttagagcctctaaatatgatcaaagatgagtctaagttagcaacttttttgctactatttgaaaagggaactacctcggttaagactaaagaggtatgtcacatgcttggacactctcacaaactagtacatgagattgttggacttgttcgtcaaaattgtgaggtttccaaggttacaattaaggccatgttagcattatgttccttgtattcaagatggtttttagggtgtgcaatcaagagtgtagtgagaatgttgttgggatacttgcaattatttgttgtgattttgggcatgcaagagaggaagcaattgaagctggatgctacaatgctgctcaagttgctaagatccaagtggattgaggaaccaaaacaagtgtaa

SEQ ID NO: 1618 - DNA, 1257 bp, Glycine Max
atgaacgaaggaaatgatgggtttgtgagagcagatcagattgatctgaagagcatcgatgagcagctcgagaggcacctcagcaaggttctgatgaagcagaaggaagaggacgatgctggctctgatcattctcgtcactctagctcctttgccactgcaactaagttcaaaagtgttgcgggtagtgctggcgccactaccttcaagaagcagaggcaggagtgggaaattgacccttctaacctcatcatcaagagtgtcatagccaggggaaccttcggcactgtccaccgcggcatctacgatggccaagatgttgctggcaagaataacttaacccaaaatccagctcagaaagtgagagttgtccccccccccccaattcatatacattgttttggctatattactaatcaatttaaaatgctggactggggtgaagaagggcaccggacagaggctgaaattgctgccctcaggtcagcgtttacacaagaagttgctgtttggcataaacttgaacatcctaatgtcaccaagtttataggggcaacaatggggtcgtcagaattacagatacagactgataatggtctaattagcatgccaagcaatatctgctgtgtcgttgtagagtatcttgctggaggtacgctgaaatctttcctaataaagaataggaggaggaagttagcttttaaggttgtcatccagctggcacttgatcttgcaagagggctgagttatcttcactctcagaaggttgtccacagagatgtaaagacagagaacatgctgttggacaagacacgcactgtcaaaattgctgattttggagttgcacgtgttgaagcatcaaatcctaatgacatgactggggagactggtacacttggttacatggctcctgaggttttgaatggcaacccctataacaggaaatgtgatgtgtacagttttggcatctgtttgtgggaaatatattgctgtgacatgccatatcctgacctaagtttctcagagattacttccgctgttgttcggcagaatctgagaccagaaataccaagatgttgcccaagttctttggcaaacgtgatgaaacgatgttgggatgccaatcccgataaacggcccgaaatggatgaggtagttgccatgatagaggccattgacacatccaaaggtggaggtatgatccctgttgatcagcagcagggttgtttttgcttccgtaagcacagaggaccttga

SEQ ID NO: 1619 - DNA, 1074 bp, Glycine Max
atgaagaacttgaagtggcacaagcaaatttccaacagtggcaacaagttggggagaaggctttcgcttggggagtataaccgtgcagtgtcatggtctaagtatttggtgtcaccaggggctgagataaagggtgaaggagaagaggaatggagtgcagatatgtctcagttgctcattggatccaaatttgcctctggaaggcacagcagaatctatagaggggtttacaagcagaaggatgtggcaattaagctgattagtcaacctgaggaggatgaggacttggctgcttttcttgagaagcaattcgcttctgaggtgtccttgctcctcagattaggccacccaaatatcattacttttattgctgcttgcaagaaacctcctgtgttttgcataattactgaatatttggctggaggttctctgggaaaattcctgcatcaccaacaaccaaatatacttccactcaaacttgttctgaagttagccctcgacattgcgcggggaatgaaatatcttcattctcaagggattcttcatagggatctcaaatcagagaatcttcttctgggggaagatatgtgtgtaaaagtagcagattttggtatctcatgcttagaatctcagtgtggcagtgcaaaaggattcaccggaacttaccgttggatggcgcccgaaatgataaaagaaaagcatcataccaagaaagtagatgtgtatagttttggcatagttctgtgggagcttttgacaggaaagactccattcgacaacatgacaccagagcaggcagcatatgcagtttcgcacaagaatgcaagacctccattgccttctaagtgtccatgggcatttagtgatctcatcaatagatgctggtcaagcaacccggataaaaggcctcattttgatgagatagtgtcgattttggagtactacaccgaatcacttcagcaggatccagagtttttctcaacttacaaaccgagtcctactagtagtaacacaattctggggtgcctccccaaatgcaatgctcgccataaatttggtgcttgcaaagtttag

SEQ ID NO: 1620 - DNA, 573 bp, Glycine Max
atgaagaagagagtagcaagcaccagcactgagtcctctaaacttgatcgcaaaaccattgaaaagaaccgcagaattcacatgaaatccctctgccatcagctttcttctcttattcctcccaacctcaagcctgccaaatccaagttgatgctagggcagcgggaccagctggatcttgcagcaaggtatataaaacacatgaatgagagaatagagaaactgaagaggcaaaaggagcaagtgatgtcaaacaatgatgatagaaaaatgttcaacaataatgttgagtccaaattgccaatagttgagctgagagacttgggttccagcattgaagtgatgttggtgagtgggttgaacaaagcattcatgttgtacgaagtaattagtgtactcgaggaagaaggtgctgaagttgtcactgctagcttctcaactgttggcgacaagatattttacgttgttcatgcccaggttaaaatatcaagagtgggagtagagacgacgagggcatataatagacttcaagagttcattgccccaccagaaatctggccggaagatgtgtga

SEQ ID NO: 1621 - DNA, 981 bp, Glycine Max
atgaagatcttcattctctttagcataacttttgcttatggtttccttggaaatgttgtttcaaatgccaatccacttccatatgaagccattttcaacttcggtgactctataagcgacactggaaatgctgctacttaccacccacaaatgcctagcaatagtctttatgctgaggcatatgggatgccaatgttgtcagcctatctaaatcttaccaaagcacaaaacattaagaaaggagtaaattttgcattcgctggttcaactgcacttgataaggattttttgcaaggaaaaagaattcatgtacatgaagttgcttattcattgacaaagaagtgcaatacatacttcaaaaactcattgtttttagtgggagagattggtgggaatgacattaatgtgattatcccatataaaaatattacagaacatcgtgaaatggttccaccaattgttggagcaattatagataccacctccaaattgatttttttttctatttactataaattaattgaagaaggagcagtagagctagtggtaccaggaaactttccaattgggtgcaattttgctgttttgacaatagtgaatagtgataagaaagatgactatgatcaatttgggtgtttaacagcttataatgctttcattgagtactataatgagcaactcaaaaaggctatagagacattaagacaagagaaaccaaatcaccacaacaatatggtgggcttttcttctggtaaaattgagactttcagagcatgttgtggaaagggtgaaccttacaatctcagtttacaaatagcttgtggaagtccaaccgcaacggtttgccctgatccttcaaaacgtataaattgggatggaccccatttcactaaagcaacatataggctaatagcaaagggattacttgagggtccttttgctaatccttctctcagatcccctcctttcaagatagcttag

SEQ ID NO: 1622 - DNA, 525 bp, Glycine Max
atgaaggtaggagggtccagttttgaaaacgatggtttcaaagcggaggcagaagcaagttctgtgggtggtaacaagtcaagtgagcaaagcaataaaccttgtgaggcacctaagccagactatattcatgtgagagcaagaaggggccaagctaccgatagccacagtctagcagagagagcaagaagagaaaagatcagtgagaggatgaaaattcttcaggatttggtgccagggtgtaacaaggtaatcggtaaagcacttgtcctagatgagataatcaactacatccagtcgctgcagcgtcaagttgagttcctttcaatgaagcttgaagcagttaattcaagaatgaacacgaaccctactattgatgggtttccttcaaaagatgttggtactcagccatttgacattgctggaatggtatttggatcacaagcagcaagggggtatgctcagggatcatcacatcctgggtggctgcatatgcagataggtggtgggtttgagacaacataa

SEQ ID NO: 1623 - DNA, 2766 bp, Glycine Max
atgaatgcgcgaggcgaggtcggttcaccggatccgttggattcgttccctccgttacgggttcggggatcggacggtgcctcggacgattccgagttcgagcggtattgcagcgccaactcggtgatggggacgcccagcaccagcatgagcctctgcagcgccgttacgctcttccacgaattctccgattgcgatttcgcttctgccggcggcgagggtttcgagaatttcagtttgggaaaaggagccgcggagtggattggagatgtacgagaagaagaagaagtggaagaagaaaaggaggaggaggaagaaaaggaggaggaggaagaagaggagttatcggagggtgatgattctatgtatgactatggtagtgatggtgatggtggaaatgaaatgtatttgtggaaaaataaaggttattttgaggagccggaagtgagaaacgagaactctttgtttatgaattcttccgtggcatttggatcgcgagacctggatgattttttgttgcagagtggtgacatttctgtcatgcctgatctgtttcagaatcagcgaaaaaagaatgatggagtgaatatgggttctggtcgaaatgaggaagggaaagatgaaaagtacgtggtcagaggcaatgaagttgaagaaactaaagatgttggttattttgattctgtagaggaggttagggatagcgaaatttctgcagattgcgatcatgttcgagattctgatatgcttgctaacatagtggaaagttctccctcaatagattgtcggaaccatgttgaaccgcaggtccaaggttctgatgatttggttagttgtcctgaaacttcgtctattgtcaaggtcgatgaagttgatttggatatgctggcgaaagaagctcctcctcggaatatgggtttggatgttaatgatggtggtagcatggaaaaggggaatatcaacagtgaagaagctattgccgcttgtgatgctcatgaagttcttccattccatccaaccatcttgggaatgaaaacattagagaagtcttccacttcaacaaatcttttagaaaaaagtcctgtggtatctaagacagaagactttgagctaaatgaattctatgatgaggttgttcaggaaatggaagaaattttactggaatctgtggattctcctgggactaggctttccatgcgtgacagatttgctgagcctcaattttctatgccttcaagagacggtggattgactgcttctacttctagtaaagatgatgcttacctgctagttcagtgcccaagaaaaatagataggattgaagtggtaggtgcaaggcagaagaaaggggatgtttctttcagtgaaagattagttggagtgaaggaatacactgtgtataaaataaaagtgtggagtggcaaggatcagtgggaggttgaaaggagatatcgtgatttcctcactctctatcggtacatgaaaaccttattctatgagcaaggctggaaattacctttgccatggtcttcagttgaaaaggaaacccagatatttagaagtgcatcgcctgatattattgtgaagaggagtgttctcattcaagagtgtttacagtctattatccgttccaggttttctttaagtcctcccagagcattgatttggtttatatcccatcaagattcatatcctatttcacctgtgtcaaatgcaccagtgtctcagtcttcttttacaagaggggaaaataccagaagcatttccaatttaggaaaaacaatttcacttatagttgaaattccaccaaacaaatctgtgaaacagttgttagaagcacaacatcacacctgtgctggatgccataagcattttgatgatggaaaaactttgattcgggattttgtacagacatttggatgggggaagcctcgactttgtgaatacacgggccagttgttttgctcttcttgccacacaaatgagaccgcagtcttgccagccagggttttacatcattgggatttcactcactatcctgtttctcagctggcaaaatcctatctggattctatatatgaacagcccatgctttgtgtcactgccgttaatcccttccttttgtcaaaggtcccagccttgcttcatattatgagtgtcagaaaaaagataggtacaatgcttccatatgttcgctgcccatttcggaggtctatcaacagaggacttggaaacaggagatatcttcttgaaagcaatgacttttttgctcttagagatttgattgatctttccagaggagtctttgctgcacttcctgtgatggtggaaactttatcaaggaaaatcctggaacacattactgaccaatgccttatatgctgcgatgtgggagacccctgcaatgcccgacaagattgcagtgacccatcttcactcattttcccatttcaggaagacgacattgaaaggtgcaaagcttgtcagttggtgttccataagcgttgctttaaaaaacttgcaaactgtccatgtggggctcaactcagattgaatgagacaaggagcttaactaacagagcaagccaaagaggaggaggtggtgaatcgagaggagctttgaacttgttaggcatgggactgagttctgggttgtcacctaggttcctctctggattatttacgaaagaaaagccagagaagactagggagcataaagacgaaaatattattttgatgggttccttaccaagtacctctttatga

SEQ ID NO: 1624 - DNA, 516 bp, Glycine Max
atgaatggacagctaaaactttatgacataggaagaggtcatattggagcaacaatgaaagcaaaactttattacttgctattttatccgatatttttgtcattcctttatggaggggaagtggatacacgacaatgtttgttcaagctaattcatgtacttcccgagcctggagaaagagatgcagttttagttacatatataaaaagattccagacgccacacatggtttctacaggtcttgaagattacaaggccaggggaacacaagcggctccttactttattgtgtccttttacacagaatttgcagagagcaaggacttggtactgatccgtggggatgtcgtatttaccagcaagcttactgactcggaggcaaaatggcttttggaagctgctcagtctttttatttgaatgatgctaggtacaaactggttgagaggttcaagagacaaacacatgattttgagttcaaagatgtcttgcaagtattggacatgcctattttgtaa

SEQ ID NO: 1625 - DNA, 477 bp, Glycine Max
atgacccttcttagcccaagatttctggacctagtggaggatttggacacacttgcaaagcaactagctcaaaatgaagaacaggagagacagtttgagtggaatgctagaacacaaatcactatgctgtttgacaactcagatgaggaagccagtctgcttcgtgactacgctactctggaaccaacagagaaaaggaaaataaaagctatgaaacaagtactggagcgggcttctacatatgtccccagagctgctatttattttaaatatttaagagaaagcttagagaatggtgaagattttaagctaactgaatggaggagggagtggattaagcttactaatgaatggcaaaagcgtaggaatatttttaccacggaaagtaggggagatgctctaaacacttcaaggtggctttttaacaaatacccgaacctaagaaattctgaaagaaagcttatactggagtactga

SEQ ID NO: 1626 - DNA, 1137 bp, Glycine Max
atgacgactaactccgattcttcttctgctcctctccactggaagttctcccaagtactcggccagcgacttcccaacgagcctctccaaaacgacgacatcataaccgccgttgcgttcgagaaacgcggcgattacctcgccgtcggcgaccgaggtgggcgcgttgtgatattcgaacgcgacgatcggaaaaagaatgctaggaatgaccgaagagaactggagcagcgggatttcgcgacttcgcggcatcccgaatttcgtttcaaaacggaatttcagagccacgagcccgagtttgattacctgaagagtgtggaaattgaagagaagattaacaaagtaaggtggtggatgtccaacgacagtttgcaatttattctttcaaccaacgacaaaacaattaaattgtggaaggttaaggaacataaggtaaaacaagttaaagaaatggcccctcctttatgctcagaaaatatgcttttggctgaaagaagtttcgtaccagggctggaaaccacggctaatggctatcatttggaatggatagagaagacacctaagaatcatttgctgcctcaagacattgatggcgagattggtggaatggaagaccctatccgtgcaaagtgccaaaaagtgtatgcttatgctcacagtttcaatattaactccatctcaaataatagtgattatgagaccttcatctcggcagatgaccttagaatcaatttgtggaatcttgaagtcagtgatcagtgtttcaatattattgacatgaagccatcaaacatggaggatcttaccgaggttataacagcagctgaatttcatcctttgcattgtaacctcctggcatatagcagctcacaaggttttattcgtctatctgatttgcgacaggcagcaatatgtgaccatgcttctagaatgtttcaacatggagagagttctggatcaaagtcattttttacagaaatcacttcttccatctcagacataaagtttttaaatgatggccagcatcttataagtcgcaattacatgaatatgaagctttgggacatgcgtatggaatcatctccagtcgcaatattcaaaattcacgagcatctgcgtcctaaggtttgttga

SEQ ID NO: 1627 - DNA, 1314 bp, Glycine Max
atgacgactaactccgattcttcttctgctcctctccactggaagttctcccaagtactcggccagcgacttcccaacgagcctctccaaaacgacgacatcataaccgccgttgcgttcgagaaacgcggcgattacctcgccgtcggcgaccgaggtgggcgcgttgtgatattcgaacgcgacgatcggaaaaagaatgctaggaatgaccgaagagaactggagcagcgggatttcgcgacttcgcggcatcccgaatttcgtttcaaaacggaatttcagagccacgagcccgagtttgattacctgaagagtgtggaaattgaagagaagattaacaaagtaaggtggtggatgtccaacgacagtttgcaatttattctttcaaccaacgacaaaacaattaaattgtggaaggttaaggaacataaggtaaaacaagttaaagaaatggcccctcctttatgctcagaaaatatgcttttggctgaaagaagtttcgtaccagggctggaaaccacggctaatggctatcatttggaatggatagagaagacacctaagaatcatttgctgcctcaagacattgatggcgagattggtggaatggaagaccctatccgtgcaaagtgccaaaaagtgtatgcttatgctcacagtttcaatattaactccatctcaaataatagtgattatgagaccttcatctcggcagatgaccttagaatcaatttgtggaatcttgaagtcagtgatcagtgtttcaatattattgacatgaagccatcaaacatggaggatcttaccgaggttataacagcagctgaatttcatcctttgcattgtaacctcctggcatatagcagctcacaaggttttattcgtctatctgatttgcgacaggcagcaatatgtgaccatgcttctagaatgtttcaacatggagagagttctggatcaaagtcattttttacagaaatcacttcttccatctcagacataaagtttttaaatgatggccagcatcttataagtcgcaattacatgaatatgaagctttgggacatgcgtatggaatcatctccagtcgcaatattcaaaattcacgagcatctgcgtcctaagttgccagagttatataataatgactgcatatttgacaaattcgagtgctgctttagtggtgatggactccattttgcaactggttcttatagcaatgtcgtgcggatattctccccgggttctgaaaggaaggaagagatcaaactagaaattagaggaaattctcacaggtctgacaccatatga

SEQ ID NO: 1628 - DNA, 444 bp, Glycine Max
atgactacacgcttcaagaagaacaggaagaagagaggccacgtgagtgccggccatggccgcatcgggaagcaccggaagcaccctggaggacgcggtaatgccggaggcatgcaccaccaccggatcctctttgacaagtaccaccctgggttcttcggcaaggtcggaatgcgctattttcacaagctccgcaacaaattctactctccgatcctcaacatcgacaagctctggtccctggttccgcaagaagtgaaggacaaggcctccaaggagaacaaggcgccgctgatcgacgtcacgcagttcgggtactttaaggttctcggaaagggtgttttgccgcagaaccagcccgttgttgtcaaagctaagcttatttccaagatcgctgagaagaagatcaaggaggctggcggtgctgttgttctcaccgcctga

SEQ ID NO: 1629 - DNA, 419 bp, Glycine Max
atgagaaagtatacaagtggaagggacataattcgtcctgcttctactcgctttgccactaatttcattgctttgcagagtattttggctcaaaaagatgcattaagagtcatggtaacatctaaagaatgggcaagctcagcttatgccaaagaagccaaggcaaaaaaatttgtggaacaagtcttagactctgggttttggagtaaatgtgttgatgtagtgaaactaaatgagccacttgtatgtgtgttgcgtatggttgataacatgtataaagctagagaagagatggtaaagaggtttcaaagaaatacaacaaaagtagagctttacttgaaaatcttagatcattgttgggattcacaacttcacaaaaatctccatgcctcgggttattggttaaatcctgcttatcg

SEQ ID NO: 1630 - DNA, 1854 bp, Glycine Max
atgagcattcacttcttcttctgcttcttgtcgctctcatctttccatgtttctctagcaattaagggaatgcctgtgtctcagtctcaccccaaagcctcactcattcgctattggaacactcgcgtttccaataaccttccaatccctcaccttcttctctcaaaagcttcaactctcacaccacaccattacgctattctcagcaaacttctgaaccaaaaacctaaacctaatgaaaaccttcaccactctctctgctcctcaccgaacttactttgttccttcgacgacacaccgttcgctcaaacacacaaaaacgacgacgggaacttcgccgtttacagcaacaagcgcttcgccaactacggatcctcccgagtcggcggagtcgactcgttcaagaactactccaacggcctaaacgcgaacaacgacgcgttccggcggtacagcgccgcctccacacgccgcggcgagcagttcaagaactacgccgacaacggcaacgtcgccaacacgaacttctccagctacggctccaccgcgaatcaagcctccgccgagttcagcaactacgacaaaacggtgaacgttccgaatctcggattcaccacctacgactccggcgcaagtaatcacaaactctcattctctagctacgggaacgaaacgaactctggatcgcaaactttcacgagctacggaaaacgcgttcgcggcggaacgagcgagttcgcgaactacgccgacgacgcgaacattctgcagtcggagttcagcagctacggagacttgaccaccggagcgagcaacgactccttcaagttctacagcttcaacggcaacaatccgcgacacgttttcaaaagctacggcgacggatccgccgccggagttgacagtttcatcagctaccggaatcgcgccaacgtcggcgacgactcgttccagagctacgcggtgaggtcgaagtccggcgccgccacgttcgcgaactacggcatgtcgtttaacgtcggaaacgacagtttcactgagtacggaaagggagcaatggggaaaacgtctttcggttttaaatcatatgggttaggccgcgcgtttaaggtttacaacaaagacggcgcgtcgttttcggagtatcgaaatttcagcgcagccaggggcaaagttgtaaataagtgggtggagccgggtaagttttttagagaatctatggtaaaagaaggaaacgtgattccaatgcctgatattaaagataaaatgcctgcaaggtcgtttttacccctggcgatcgcgtcgaaattaccgttctcgtcttcaaggattaatgaaatgagggaagtgttccacacgcgggaggggtcttctacagagcgcgtgatggtaaaagcgctgaaagagtgcgagagggcgccgagtaaaggcgagacaaaacggtgcgtttcatccgcggaagaaatgatagggtttgcggtttcggttctgggtcccaatgttgcggttcggagcaccgagaatttgaacgggtctggatcgagtgtgatgattgggaaggttcactcaatcgacggtggaaaagtgaccaagtcagtgtcgtgtcatcagagcttgtacccttacttactgtattattgccacagtgtacccaaagtgagagtttacgaagctgaaattcttgacgtggacactctggagaagatcaatcatggggttgccatctgtcaccttgacacgtcagcatggggcccacaacatggggcgttcttggcgttggggtttggccctgggaaaattgaagtgtgccattggatattcgagaacgacttgacgtggaccactgccagttga

SEQ ID NO: 1631 - DNA, 519 bp, Glycine Max
atgaggaacttccatgtgatcaacttggagaatatcaatggtgaggagagaaagactatcttggaccaaattcaagatgcttgtcagaactggggattttttgagttggtgaatcatggaatacaccttgaacttttggatggggtggaaaggttcagggaggcagtggaaagcaaggggttagaagctgaagtaaaggacatggattgggagagcacattcttcttgcgccatctcccagactccaatatctctaaaatccctgatctcagccaagagtaccaggatgcaatgaaggaatttacacagaaattggagaagcttgttgaggagttgttagacttgttatgtgaaaatcttggattagagaaatgcaaatgtgatccatctctcgttatcttcaaagatgattctcatatcatttatgtttttgtgtatgttgatgacatcataataattgctagttctgcaaccttagtccaacagtttacaaccaagtttcattttgatttctcttaa

SEQ ID NO: 1632 - DNA, 1059 bp, Glycine Max
atgagtaaaaacaaagaagagttaagcatggtggcaatttcgctttacagagggaaccttcaccgggtaccggacgtgccccgtcgatggcccatgccagcccccaaaatcactctcaaagacttcaaatcccttctcgctcgtcgctccaaggcactttcgcgccttcaaaactcaaaccctaaccctacccctacccctctccccaacggttcccaaaccgaaccacctcccaccgttaccgttaatcacggcgaaggcccttccaccaccgtcgcccgtgaagacggatatcgcaaagaaacgccgctcgtcgccgttagttccgccaagaaaccgctcgctggatctgattcagagaaaccgcagctcgattccaagattgacgaggcttcggtgaaaaaaccatccgacggtgtcgccgcttcggaggaaaagcagaccgagccggtcgctgagaatgtggatcagcttaatgaaaagaagaaaaggaaaaaggaaattgaggagaagttgcaagggttgaatgataataaacataacctggtgttggtgttgaagcagattctgaatgcggaggaggagttgaagagacgaaatagtatgcaagtagttgcaatgcatggtccttcggtcccacttcaaggggatggaacaaatgatactggtttgatgattaggcatatgcccccgaggttgggatcccagggaaatcttgttgctgctgatgtggatggtggtgaaggggatgattttgctaactatacgatgcattctcgccatgtgcttcggacaagtagtatgtcaccttcttcagagtccccactacggaggacccctagtcttcaacagaatgtgatttcacatccttctcgggcaaatatcggggctgctggtagtccatcacgctttgctctctcaggtcatcagggaaatcccgtaaacctaccttcagtgtctgtgtcaggaactagttacattgcatcatccccttccccagcagcatctggtggcacttctgttttcagagacgcccgtcagccaagtccatggaagtag

SEQ ID NO: 1633 - DNA, 744 bp, Glycine Max
atgagtcgtttaggtttcaagcacgaggtttacgatggcgacaagcacatcggcgaactcgacatgattcctctatcgttgtcaatgacgacgccttttcataatagcttccacttctcaaacaacaagattcgcatccaccactttagtgcacagagcgagtgtttccctccactcttgatcctccaaactgttgccgcattcaacatccgttgcaagctcaattcctcaattgccactgagcaaaaggaactaatcgccatccacgccagttgcttctacgaaatgaagacgacggtggtggtggtgaacgacgaggatattcacctcattttgatgtcgagcaagaggaagaactttctgtgcttcgcagtgtcgttggggatctatgacgcgtgcttggcgatgctgaacctgcggtgtctcacgattgtgtttgatttggacgagacgctcatcatggcgaacatgataaagtcgttcaaggataggattgaggccctgaggaaaagagtgatgattccatcactggatttggagcttcatgatctccttaaatggtgcaaaaggagtgcaagatatgcactggttctggtggagagtgtggatccgttgatggaaattttcaatgtttcagcatggatggacctcattctgcttcatgcaaaggcatatatgcttgctaccttcttgatttctcagactattgtgcctcttttcatttctagtttagttagcaaacat

SEQ ID NO: 1634 - DNA, 339 bp, Glycine Max
atgatgaacctttttgctacctttatctgtgagttcttcaaggatatatggacaacgtttttggaaatgagaatgaagcaaaaacattttctaaagctcaaggctcagagtattatcgttatcacccaaggtgcaaatcttgtttgtgttgttgaggatgagaaaatgaaattataccctgtgatactactacctaaaggcaaattagttgatacaaatggagcagtttataggcaattggagatgcttttgtgggaggatttctttcacaattgctgggtgttaagcagccaatgttatcatccaaaggtcgggctgcacataccaagaaaaacctaa

SEQ ID NO: 1635 - DNA, 1971 bp, Glycine Max
atgatgaagcgaaagctagaaacgttggtgtggctaacacgaaaacgatcgattcagtttctaatcggtgtttttttcctctacctcgtacttgtcacactcgaactcccgtttgttttcagaaccgacttcgccaccgtgaccaccacgcgctccccgaggctcctaagtgaagaggattcgctacgaaaggactccccggcgcgtcctttgaaaacggtttccaacgctgactcgccgagtcaactcgcgcgccgccgcagcagcgtcgtttccgcgttggtcctaaacgacgccgcgttcggctcccacgtaaacaacgggtcgtcggagctctacaagcaagtgaagcacgcgcgcgaggttgggcggagtctctgggaagacctcgaatctggaaagccgctaacccgaaccgttgccgctcgggcggccgagaaccggtccggttcgtgtcccggttcggtctcgctttccggtccggacgttgttgacgtctcgggcgtcgtgccgttgccgtgtgggctcacgttggggtcccacataacggtcgttgggaagccgttggaggctaggccggatttcgagccgaagataacggtggtgacggaggatgagcccgtgatggtgtcacagttcgtggtggagttgcaggggctaaaaactgttgatggtgaagagcctcctagggtttttcacttcaaccctaggttgaagggggattggggtggaaaacctgttatcgaactaaacacgtgttaccgcatgcagtggggttctgctcttagatgtgacggttggaaatctaaggccgatgaagataccgttgatagtatggcaaagtgtgagaagtggattcgggatgatgaagatcatttggagggatctaaggcgacgtggtggttgagtagactgatagggcacacgaagaaagtaaccattgactggccattcccgttttctgaggggaagctgtttgttctttctattagtgctgggttggaggggtatcatgtttctgtggatgggaggcatgtgacctcttttccttatcgcgctggttttacccttgaggatgccaccgggctttcgttgacaggagacattgatgtccactctgtatttgcggcgtctttgccttcatcgcatcccagttttgccccgcagcggcatcttgaattttccaccaggtggcgtgctcagccacttcatgactctggcatcgaattgttcattggtgtcctctctgctggaaaccattttgctgagcggatggctgtgaggaaatcatggatgcagcataggctcatcaaatctggagtagtggttgctcgtttctttgtggcactgcatgcaagacaagaaattaatgcagagttgaagaaggaagcagaattttttggtgatattgttatagtgccgtatttggataactatgatcttgttgtgttgaaaacagtggccatatgtgaatatggggtacatacggtttctgctaagtatgtcatgaaaggtgatgatgacacttttgttagagtggatgccgttatcgatgaagcaaggaaggttccagatggtacgagcttttatattgggaatataaattactaccacaaacccttgcgctatgggaaatgggcagtgacatatgaagagtggccagaagaggattacccaccctatgctaatggacctggttatattttgtcatcagatatcgcacgctatattgtatctgaattcgaaatgcataaattaaggttgttcaagatggaagatgtgagtatgggaatgtgggtggagcaattcaacagctcaaaaccagtacactactcgcatagcttgaagttctgccaatttggttgcatagaagactattacactgcccattaccaatcgccgaggcagatgatgtgcctgtgggataaactgcaaaggtattcaaggcctcaatgctgcaacatgagatga

SEQ ID NO: 1636 - DNA, 858 bp, Glycine Max
atgatgcaccagcaacaagaggtggaagaagaagaagcttctcctcacaacaaggcatccccttctcccagtttcagcagctactcgtcggagacactcgccgagatcgccgccagggtaatcgaggagctccgccacgaacctagttcactctccgacgacgacgatgacgcgcttttcccgccatgggaaaacctaaatgacaacgagaacttcctccccaaaaacgacgagccgccagaacaaaacgacgacgacgatttcgaattcgcgttcgtttcgcgagacttggcttctcccgtctccgccgacgacattttctacaacggccagatcaagcccatgtacccaatcttcggcgttgttccgtcaaacgacgccgttttaagcttttttccgaatgataacaatattgcgcccactccgcggcgccgtcttcctttacggaagctaatgttcgaggagggcgaaacggcgtcgtgctcgtcgtcaacggacgagagcgttgacctggagggggtcgcggaaggcgcgtactgcgtgtggacaccgaactccgttgggagtgagcggaaaaagagcaactcgacggggtccacatcgaaacggtggaagcttcgtgttcgggatttgcttcttaggagccacagtgacggaaagaataataataaacaagagcaacaaaagcaacgggatttgtttcggattgcgacgaagcctcaaaacgggagcgtgggaacggaacagcaacatcatgtggaacagaacaagaggaagtccttcttgccttacaagccggaattggttggactttttactaacgccaatggccttggtcggaatttgcgccctttttga

SEQ ID NO: 1637 - DNA, 822 bp, Glycine Max
atgatgcagtcgttgatgagcatgaaggcttacgtgggtacgaggttaccgattttaacgaattccgagacgagtacgaggaagcagcgcgtgaattgtccgaaccgtaggaatgtgatggtttcgtgcggttcggagaggaatgggaacgaaggaataggttcgaactcaggttcgtttatgtctccgagccataattacgcgatcttgaagcaccggatggagaaagcggccaagtccgagtattacgaagaggcttcgaggattcgtgactcgctcaagtgcttcgaagatgagattcctgttctgcgtctgaggagattgttgaaggaagccgttgctgatgagaggtttcaggacgcagctagatatcgtgatgagctaaaagaaattgctccacattctctcttaaaatgctcaagtgatgcgacaaccttgggaatccgggtccaagtgaagagtgcatatatagagggcagaagtcagccttcagaggaggtatattcctttgaatatagaatcaaaattaccaataacacaaaccgccctgttcaacttctcagaaggcattggattatatctgatgctaatgggaaaactgaaaatatttggggaattggagttgttggtgaacagccagctatctttcctaggagtagttttgaattctcttctacatgcccattaagcacacaaaatggtagaatggaaggtgactttgagatgatacatgttgatcgagtaggctcaagagcatttaatgtcgccattgcccctttctcgctctctctactaggagatggtgatggtgaaactacttaa

SEQ ID NO: 1638 - DNA, 477 bp, Glycine Max
atgatgcatgtagccaccggtgaaatatgcaaatattctctcgcaacaatggaggagacagaggaccgggatatcatactcttggcagtactactggtatattctccaatttttgtgactttgagaattgagatagttccctcatttcctctgatttcattctccatgttaaagtcttcatataaaactgacaaaagtgagttgcctgaatttttaggaggtacttgtaaatgtgccaatcaaggaggtcatatgcgctttgataagagcccttggaaggatgcagaaattatgaagataggcctgcaatccattttattttgcgttttctctcttgtttctcaacttagaactttagttgataattcatgtaccatggctgataaatctgctgtgaaaaaagttgatgagaaagcttccaagcctaagaacacgactgataaaactgcagcatcaacaggtacacacggaggatag

SEQ ID NO: 1639 - DNA, 579 bp, Glycine Max
atgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaattattgttcctttgagggtgttttatactgtaagcctcattttgatcaactctttaagaagactggcagcttggacaaaagttttgaaggtattccaagaactgcaagacttgaaagatctgccgatcaggtccaaaccaatacaaaggtttcaaatttgtttgctggaactcaggaaaaatgtgttgcttgcaagaaaacagtttacccaattgaaaaggtagctgttgatggaacatcttaccataaggcttgtttcaggtgcactcatggaggatgtgtaattagcccatcaaattatgttgcccatgaacatcgtctttattgcaggcaccatcatactcagttgttcaagcagaaaggtaacttcagccaacttgacaagcaagaaaacgatgaaggggtgacggagaacagaataactgagtaa

SEQ ID NO: 1640 - DNA, 1674 bp, Glycine Max
atgatggggtgggtggcgaatcggtggacgggcgtcgccgccgccatatggatccagtggagctgcggcgcatcgtacaccttcagcatctactcctccgtgctcaagtccacgcagggctacgaccaatccacgctcgacaccgtctctgtcttcaaggacatcggcgccaacttcggcgttctctccggcctcctctactccgccgtcgccccctacacaacccaccgcgcctccccctccaagtccatatggacctcgctcagcgggccctgggtcgtcgtcgcggccggcgccgtccagtgcttcgctggcttcatcttcatctgggcctccgtcgtgggcctcgtgagcccgccgcccgtgccggtcatgtgcttcttcgcgtggctcgcgtctaacggtcagaccttcttgaacaccaccaatgtcgttaccggcttgcgcaatttccctgagtacagcggcaccatcattggtatcatgaagggatttctgggactgagtggagctatcttgatccaaatctaccatacgttttttgatggggacccagcaacctaccttttgatgcttgctgtgttgccttcgttgatctgtgtgttgcttatgttctttctgaggatttatgaagtgcatggcagtgattacaagaagcatttggatggtttctctgtcgttactgtgattattgtagcctatcttatgttcataataattttacagaacttagttagtttaccgaactggggacggatgtttgcatttgtgattcttatggttctgctagcaacaccttttggaattgctataaaggcccattgggaagagtcacggaagttttcgcaatcctacacaattgagaggggttcttctactaataagggtaccacttcctccagtcattctgcatcagtggatcaagtggagtaccatgaattgcctagtgatgaggggcaggtacaagtgacttcagatgacaaattgccccgtgaagaagaaaagaatctcttgcaagctatgtgcacggttgatttttggatgctgtttgtgatcatgatatcagggttgggttctgggcttgcaactataaataatatgagccaaataggacaatcccttggatatagcgccattgagattaataatttggtgtcactgtggagtatgtggaacttccttggtcgttttggaggtggccatgtatcagattatatcatgcacagaaaaggttggcctaggcccctgttgatgacagtgactctggggataatgattcttggccatttaattatagcatctggtttccagggaaatttgtatttgggtcctgtcctggtgggcatctgctatggtgcacattggtccttgatgcccacaatcacttctgagatatttggtgtaaagcatatgggtaccattttcaatactattgctgcagcaagtccacttggatcgtatatactttctgtgagagttgttggatatatttacgacaagcaagccgataaagaagatcattcgtgctttggcatcaactgtttcatgccgtcattttttatcctggcagctgttgcttttcttgcgtttttggttggtttggcattattcttccggacccggaggttctataagcaagttgtgcttagaagattaaaacattatgcaagatga

SEQ ID NO: 1641 - DNA, 1674 bp, Glycine Max; identical to SEQ ID NO: 1640

SEQ ID NO: 1642 - DNA, 118 bp, Glycine Max
atgattcttttgtattttttctataccgtagagttaaaactaaaaaatatttatcattttttctgttttttgacgttttcagcaaaaccctctcgtaaaagtatttttacaatgtttt

SEQ ID NO: 1643 - DNA, 1971 bp, Glycine Max
atgcaagaaaatcttttcagatggttagccaaagacaccaccattgaagcgtaccattcatttagttattttcttgaggaagaggtgaggaagaagcgaagccctttgttaacctcgtcctttgttacactaagcaagtatgtttcctcacacacccatcaacatgagttcaacaataataacgtcattgcctccaacaagctcatcgccagctacgttcggtgcggtgacatagattccgctgttcgtgtgtttgaggacatgaaagtgaagtccacggttacgtggaactctatccttgccgcctttgccaagaaacccggccatttcgaatacgctcgtcaactgtttgagaaaattccccaaccaaacactgtttcgtataacatcatgttggcgtgtcattggcaccatttgggtgtccatgatgcccgtggcttctttgacagcatgcctttgaaggatgttgcatcgtggaacaccatgatttccgcattggctcaggttggactcatgggtgaggctcggaggttgttctcggcaatgccggagaaaaactgtgtgtcgtggagtgccatggtgtctggatatgtagcttgtggggacttggatgctgctgtggagtgtttttatgctgcgcctatgaggagtgtgatcacgtggactgccatgatcactgggtacatgaagtttgggagggttgaattagcagaaagattgtttcaggaaatgtcaatgaggacattggtgacatggaatgctatgattgctgggtatgttgagaatgggagggcagaggatgggttaaggctattcaggacaatgttagaaactggggttaagcctaatgctttgagcttgactagtgtcttgttgggttgtagtaatttgtcagcattgcagttgggtaagcaggttcatcagttagtttgtaaatgtcctttgagtagtgatacgacagctgggacttcattggttagcatgtattccaagtgtggggatctaaaggatgcctgggagttattcatccagattccacggaaagatgtagtgtgctggaatgcaatgatttctggatatgctcaacatggggctggcaaaaaagctcttcgtttgtttgatgagatgaaaaaggaaggcttgaagccagattggattacttttgttgcagtattgttagcttgtaaccacgcaggattggtggatcttggtgtccaatattttaacacaatgagaagggattttggaattgaaactaagccagaacactatgcatgcatggttgaccttcttggtcgagctggaaagttatctgaggctgtggatttgataaaaagtatgccatttaagccccatcctgccatttatggaacacttctgggtgcttgtaggatccataaaaacttaaacctggccgaatttgctgccaagaatctgcttgagcttgatccaactattgcaactggatatgttcaattggctaatgtttatgcagcacaaaacagatgggaccatgttgctagtatccgaagatcaatgaaagacaataatgtagtgaagatacctggatatagttggattgaaataaacagtgtggtgcatgggtttagatcaagtgatagattgcaccctgaattggcttctatacatgagaaactaaaagacttggagaagaaaatgaagttggctggttatgtgcctgatcttgaatttgtgttgcatgatgtgggagaggagctgaaagaacagcttcttttatggcatagtgagaagctggcaattgcatttggccttttaaaggtaccattaggggttccaatccgggtgttcaaaaacttgagagtctgtggagattgccactctgcaaccaagtacatctcaactatagaaggaagagaaatcatagttagagatacaactaggtttcatcatttcaaggatgggttctgctcctgcagagattactggtaa

SEQ ID NO: 1644 - DNA, 408 bp, Glycine Max
atgcaatctatgtccctgacgctgagcaagaggctctccaattcaaagcctctcttcagaatctcttccaacctcgtcgctcacgcatcctccgccacaacctctccgccgccaccttcgccgccagtcccctctccatccgccctcaacagcctcctcaccgctccgtggtccgccactcagtcacgcggaatcacgctctctggatctgatgttcgagtcgggaatctcattggaaaccgaggacgcgctcacgaggttctcaaactgtatcgccctcttgaaggaacgggcaaagccactcttgaggttccgcctcaaagtgtagctggttatgccacagttgctactacagaggatggcgccgaaagggatcggagagattttggcagactatgttcaccatga

SEQ ID NO: 1645 - DNA, 648 bp, Glycine Max
atgcaatctatgtccctgacgctgagcaagaggctctccaattcaaagcctctcttcagaatctcttccagcctcgtcgctcacgcatcctccgccacaacctctccgccgccaccttcgccgccagtcccctctccctccgccctcaacagcctcctcaccgctccgtggtccgccactcagtcacgcggaatcacgctttccggatctgatattagagtcgggaatctcattggaaaccgaggacgcgctcacgaggttctcaaactgtatcgccctcttgaaggaacgggcaaagccactcttgaggttccgcctcaaagtgtagctggttatgccacagttgctactacagaggatggtgccgaaaggaaggaacgaaacagtggattgagtaaggcaacgaagacaaagagagagcagctcctaaaagctactgcagttgcctctcttcttctaatatacccgaacacttattcattgctcttcgcaaatttctttgtgttctggcacttatatgcagggatcggagagattttggcagactatgttcaccatgaaatgaccagagaatttgtcatgatttctctcaggttgttcttgataatcgcattgaaggatgtttgcttaaattttgtatttgtataa

SEQ ID NO: 1646 - DNA, 2508 bp, Glycine Max
atgcagaatatgttaagagcaaagcagatcagtagtaccctttcgagcaatgctaggagtattttgcttggcggttcgcgatgtaacgcagcagatggcaattcgtgcacttgccctgaggatgaaacgtgtgtgtcgaagagacagcagaggaaaaacaatgaagatttacttgcgctgaagccgccctccttggtgtccaaagccacctctcaagttgtaggaacactggtttcaggaaacttggctaatgggcctgcttcccacaaggctgggagtgttggtcaatctggccgtgtgcaacaagtccagcctacttcatatgcaccgagcaaatcggactcggctacatctgcttgtgttgttgatggtgttcaagatcatgttgctcactcatcttctcttaatgctgaccagttttatagggccggtattgcagctgttaattttatttctgatgtagttaattataagttgcctttatcagatggcatgggaatactaaactactctaaaaattatatggttgatcctgccagagccctacccaagatcagatcctccaatgtgcagcaaattaaaaaggagaacttcactgccgttcatcccaaaccgcctgttcctactcatccagggccatcaaaacatacaaataatcatcatggtgcaaagggaaaagctgataaatcaaatttagctaaaggctttaagcatgttgcttcttcagggacagagaaagccctgccacagagaacaagaacccattcaaaccactttgtggcaaattttggttccaacatgcaaagttcaaatccacagatggcagggccattcaaggaaagtttcaataaacacacaagggatctgaatatgcctgcaggaattgttccaacaaagaggcattttactaattcagggcatgttgtggaagtgatcctaaagcaacttcaagaccattcagttgctgtaggcttcttttgctggctaaagcgtcaaccaggcttctggcacgatgggcatacttacaccaccatggttggtatcctgggccgtgcaagagagtttggtgctataaacaaattgctagagcagatggtcaaggatggatgccagcctaatgttgttacttacaaccgtctaattcacagctatggccgtgcaaactacctaagggaggcactgaatgtgttcaaccaaatgcaggagatgggatgtgagcctgatcgtgttacttactgcacactcattgatatccatgcaaaagctggatttcttgatgtggccatgtctatgtatgaaagaatgcaagaagttggcctttctcctgacacatttacatacagtgtcatgatcaactgccttggaaaatctggtaatttatctgctgcccataggctattttgtgagatggttgatcagggttgtgttcccaatattgtcacatacaatatcttgattgctttgcaagctaaagcaaggaactaccagacagcattggaattataccgtgacatgcagaatgcaggatttaaacccgacaaagttacttatagcatcgtaatggaggtgcttggccactgtgggtatctcgaggaagcagaagcagtgttttttgagatgagacagaaccattgggttccagatgaacctgtttatggtcttctggtagacctgtggggaaaggctggtaatgtggagaaggcttgggaatggtatcatacaatgctgagagctggtttgcttcctaatgtaccaacatgcaattcacttctcagtgcattcctcagggttcatcgattgccagacgcatataatcttctccaaaacatggtgactcttggcttaaacccctctctgcagacttacactttacttctcagttgttgtacggaggcacaatcaccgtatgatatgggattttgttgtgagcttatggcagtctctggccatcccgcacatgcatttttacagtccatgccagcagcaggacctgatggtcaaaatgtgcgagatcatgtaagcaaattcttagaccttatgcattccgaggatagagagggcaaaagagggcttgtggatgcagtggtggattttcttcacaaatctggactcaaggaggaggctggttcggtttgggaggtggctgcacaaaaaaatgtgtatcctgatgctgtcaaggagaaaagcacttgttattggcttataaatctccatgtcatgtctgatggaactgctgtaacagcattgtctaggacacttgcttggtttcgcaggcagatgctggcatctggtgttggccctaacaggatagatattgtcactggatggggtcgtaggagtagggtgacaggttcttctcttgtgagacaggcagtgcaagaactgctgcatgtattcagtttcccatttttcacagaaaatagcaattcaggttgttttgtgggatgtggggagcctcttagtcaatggttggtccactcttatgttgaacgaatgcatttactgtag

SEQ ID NO: 1647 - DNA, 1191 bp, Glycine Max
atgcagagcgcggctttcactttctctccctctctccctctccgcaacccttcccctaactattggaggagaccttctctctccctccgtctctcggccaaacacggcaacagcaacagcgatgacgtgaactccaatggcgtttcttcaactttcttcactcgccgatcttggactcttcctccttcctcttccttcaagttcaggcctctccctccccgcgccgccgaaagcgccgttcccgaaagtgcgcccgtcgaaaacccgctcttcaaaactctcgaactcggcgccttgtttggcctctggtacctcttcaacatctacttcaacatctacaacaaacaggtgttgaaggcgtttcattacccggtaactgtgactgttgttcagtttgctgttgggactgtgctcgtggcatttatgtggggtttgaatctctataagaggcctaaactcagtggtgctatgcttggagcgattttgccgctggctgcagtgcatactttggggaaccttttcactaatatgagtcttggaaaggtggctgtgtctttcactcacactatcaaagccatggagcctttcttttcagtggtcctttctgccatgttccttggagagtttcctacaccgtgggtggttggttctcttgtgcctattgttggtggagttgcactggcatctgttacagaggcctctttcaattgggctggattttggagtgcaatggcatccaatgtgacaaatcaatctcgtaatgttcttagcaaaaaggccatggttaataaagaggattctatggacaacattactctcttctctatcataacagtaatgtccttcttcttgttagcacctgtggctatcttcatggagggtgtcaaatttactcctgcttacttgcaatctgctggggtgaatgttagacaactttacatcagatctcttcttgctgcactctgtttccatgcgtatcaacaagtttcttatatgatattgcaaagggtatcacctgttacccactccgtgggcaactgtgtgaagcgggttgtggtcattgtgagctctgtcatcttcttccaaacacctgtctcacctgtgaatgcttttggaactgctatagctcttgctggcgttttcctctattcaagggtgaagcgtattaaggcaaagccaaaaacagcttaa

SEQ ID NO: 1648 - DNA, 523 bp, Glycine Max
atgcaggggactagtttttgcagacgaaaattgaagaagctgggcactcgtttggtttcttcttggtcttcttgttcctctttcaccatatccatatgtttctcactctctgattttacagatgttgttgttgcacctccctttgtgtacatcgatcaggtgaaaaactcaatttcagataggattgaaacttctgcccagaattcttgggtgggaaaaggtggggctttcacgggagaaatcagaatgttaggcttgttggttggtgatgacagatataacacatttttctcttctcttcttatttctttcttttgtataaaaatttcttggttgtacatggagtttgaagcagccaatacagcacctcctattccagatccatctttaagtaagctgatcaagaaaaaacatatttttcatttgctccatctgctggccttctttttccatcagcaggtccaaatcttcaaaatgaacaagcttatcttggatatttttcatctacaaaacagaatatcca

SEQ ID NO: 1649 - DNA, 4509 bp, Glycine Max
atgcattcatatggagattcttttaaagggatcagatgtgtaatagttgacggtcgcaaaattagtgttggtgaatgtgctctcttcaaaccatctgaagatcgcccaccatttattggtataattcgttgtctgacatttggcaaagagaaaaaattgaaggtaggtgttagttggctttatcgatccattgaagtaaaactcaacaagggtggaccattggtggctgctccaaacgaaatcttctacaccttccataaggatgaaattgatgctgaatcgctgctccatccatgtaaagttgcatttcttcgtaagggtgctgaacttccatcagggatttcttcatttgtgtgcaggagggtttatgacattgcaaacaagtgtttatggtggctaaatgatcaagattatattaatgattgtcaagaagaagtagatcaactattatacagaacttgtgtaggaatgcatgcagcagtgcagccaggtggccgatctcctaagccaatgagtagtccaacatcaacatcacagttaaaatctgtttcagatagtgtccagaacagtacttcttcctttccatctcacattaaggggaggaaaagggaaagggctgatcaaagctctgagcctgccaagcgagaacgatcaataaaaactgaggatggagattctggtcatttcaggcatgataacattttgaagacagagattgctaaaattacagaaaagggagggcttgttgacaatgaaggagttgaaaaattagtgcagctgatggttcctgagaaaaatgagaagatagatttagctagccgggcattgcttgcagctgtcattgcagcaacagataaattagattgtcttagtcagtttgtgcagttgaggggcttgcctgtatttgatgaatggctccaagaggtccataaagggaagattggtgatggtgttgggtctagggatggtgataaatctgttgaggaatttctcttggtattgcttcgggcacttgataagcttccagtaaatcttcaggctttacaaacatgcaacattggaaaatctgtgaatcatttgcgaacgcataaaaacactgaaattcagaggaaagccagaggtttagttgacacatggaagaaacgtgttgaagctgaaatgaatataaaagatgcaaagtctggttcaggtcccactgtccactggtctgccaaatcgcgttcttctgttgttggtcaaggtgggaatagacattcaggtgcattatctgatgttgccatgaagagttcagttacacagctttctgcatccaaaactgcctctgtgaagattgtccagggagagaatactactagatctgcatcgacatccgcatttcctgggcctgcaaaatcagtgccatcacctgcatctgcgactacaaacctaaaagatggacagccccgtattgccgctgccaatggaggttctgatcttcccatggtgaatgcaagggatgagaaaagtagtagttctagtcaatctcacaacaacagtcaatcgtgttctagtgaccatgctaaaactggaggtcattcaggaaaggaggatgccagaagctctactgcaatgagtgtgaataagatatctggaggctcttcacggcaccgaaaatctattaatggattttcaggttcaactccatccgtagggcaaagggaaactggatcaagtaggaattcccccttgcacaaaaatttaacttcagagaaaatatctcaacctggattaatggaaaaggcacttgagggagtttcttgtaagctgattgttaaaattccaagccaagttagaagtcctgctcaaagtgctagtgcaggttcttttgatgatcctacaatcatgaatagtcgagcctcatctcctgtcctcccggagaagcatgatcagtttgatcaaagctcgaaggaaaagagtgacctttatcgagcaaatattgtctcagatattaatactgaatcttggcagagtaatgattttaaagacgtattgactggctctgatgaggctgatggatcacctgctgcagttactgatgaagagcactgtcagattggcaatgattgcaagaaaacattggaggtaccaaaagccgcttcctcgtcatctggaaatgaaaataaatctggaaatttgcaggatgcttcttacacctcaataaatgctttaattgaaggtgttaagtactctgaggctgatgatgttggaatgaatcttcttgcgagtgtggctgctggagagattttgaaatctgaattgttaactccagctggatctccagaaagaaacactactgctgttgaacagtcatgcacaggcaatggtgttgttaagtcctctgaagagaatcttgtccgggatgaatgccactcaaataatggtcttgatggtgaacataagaatcagggttctgtaacaggtgatttagggtatggatttgcaacagctagagatggtgacagaagcaagcagctccaggaggttggtcggggagtgaatgctgatgaaattgttgatgttaaggtcagttctgttgcagaagttaaggcagaagcaactgaaaaattgtcacatatagctgtggaagtggatgtacagagtgataactgtactactgaagtatcaactggtggtggacagacagctgctattcttgttcagtctgattcggcaagaggaaaagatgagaatgttcctgaagacttgactgaacgggatcagtctaaaaagcaaagaaatgagtgtgaaagtgatgccttgacaatgcctgaggatagaggtttatgctctattgtgactggtattgctgctgaacatgtggaggaaaatttagaaacgaaagaggttcatgaccaacctgccagagaggaacttcccaaagattcacctagtgtcctttcacaagaaatggataagcatcttgattctaaagggtcaaaattgattgccatggaagcggaggaggctgaggagtgcacctctaccactgcagatgcttcttccatgtcttctgcagctgtgtcagatgcagatgctaaggttgaatttgatttaaatgaagggctcaatgcagatgatgggaaaagtggcgagttcaactgcagtgcacctgctggttgtttggtcagtcctgtgccgtttcctgcttcatctatgtcttgtggtattcctgctcctgtcaccgtggctgctgctgcaaaggggccctttgtgcctcctgaagatttattgagaagtaaaggggaaattggttggaagggatcagctgccactagtgcatttaggccagccgagcccaggaaggttatggaaatgcctcttggtgcactaactacctctatacctgatgctccagctggaaagcagagtcgagcaccattggatattgacttgaatgtggctgatgaaagaatacttgatgatatttcttctcaaacttatgctcgtcacactgattctgcatctcttgcaactgatgatcatgatcctgtatgcagtaaaatgtcttcacctcttcgctgctctggagggcttggtcttgacttgaaccaagtggatgaagcttctgacgtgggcaattgcttgagcagtaatcataaaattgatgtgccaattatgcaggtgaagccatcattgggtggtccaccaaatcgagaagtgaatgtccacagggactttgatttgaacaatggaccttcagttgatgaagtcaccactgaatcctcattgttttctctgcatgccaggagcagtgtgccatctcaaccgcttgtttctggacttagggtgagtactgctgagccagtcaacttctcttggcttccttccagtggcaacacctattctgctgtcacaatatcttcaattatgcctgatagaggggatcatcccttttcaattgttgccccaaatgggccacaaaggttgttgactcctgctgctggtggcaacccatttggacctgatatttatagggggccagtattgtcatcttctcctgcagtgtcatatgcatctgctccatttgaatatcctgtcttcccttttaattccagctttcctcttccatcagcttctttttcttctggatcaactacttatgtatatccaacatcaggcaatcagctttgctttcctgcggtaaattcacagttaatggggcctgctggtgcagtttcatctcattatcccaggccttttgttgttggccttgcagaaggtagcaatagtggtagtgccgagaccagtagaaaatgggcaaggcagggtttagatcttaatgcaggacctggaggttcagatgtggatgggagagacgggaattctcctcttccatctaggcaactttctgttgctagttcacaggccctagctgaggagcaagtaagggtccagctggctggtagtgttcgtaagaggaaggagcctgatggtgggtgggatggccacaaccaatcctcatggcaatag

SEQ ID NO: 1650 - DNA, 4488 bp, Glycine Max
atgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggagtttcatcaactaaatgggctattgagtatgaagaacctgctggggatgcatttaaagctaatcatcctgaggcattggtgtttattaacaattgcaatgttattcttagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaaggcttcccagatagctatcaatttgctggcaatatcatacacaagcaccggcagattggtaatgctgtgcctcctcctctggcatctgcattggggagaaagctcaaggaagcagtggacagtaagagctccacttag

SEQ ID NO: 1651 - DNA, 1662 bp, Glycine Max
atgccatctcacccttcctccaaaaggtctatatatatctttggtttctctgtgtctcaatatcacattctcatctctaaccactttgcttcagctatggagtttcgttgccttccattggttttctctctcaatctgatcctgatgacagctcatgctgccatacctccagaagtttactgggaaaggatgcttccaaataccccaatgcccaaagcaatcatagactttctaaaccttgatcaacttcctctttggtatggtgctaaggaaacccaatctacagatcaaatattcctgtatgatgctaagaaaacccaatcaacagatcaagttcctcctatcttttatggtgataagaaaacccaatcaacagatgaagttcctcctatcttttatggtgctaagaaaactcaatcaatagatggagttcctcctatcttttatggtgctaagaaaacccaatcaacagatgaagttcctccatacttttatggtgctaagaaaatccaatcaacagatgaagttcctcctatcttttatggtgctaagaaaacccaatcaacagatcaaattcctccttttttttcttatggtgctaagaaaacccaatcaacagatcaaattcctccttttttttcttatggtgctaagaaaacccaatcaacagatcaagttcctccttttttttatggtgctaagaaaacccaatcaacagatcaagttcctatcttttatggtgctaagaaaactcaatcaacagatcaagttcctatcttttatggtgctaagaaaatccaatcaacagatcaaactcctctttttttatatggtgctaagaaaacccaatccgaagatcaagttcctattttttggtacggtattaagaaaactcaatccgaagatcaacctcctctttggtacggtgttaagaaaacctatgttgcaaaaagaagtctttcacaagaagatgaaacgatccttgttgctaatggtcatcaacatgacatcccaaaagcagaccaagttttctttgaagaaggattaaggcctggcacaaaattggatgctcacttcaagaaaagagaaaatgtaaccccattgttgcctcgccaaattgcacaacatataccgttgtcatcagcaaagataaaagaaatagttgagatgctttttgtgaacccagagccagagaatgttaagattctagaggaaaccattagtatgtgtgaagtgcctgcaataactggagaagaaagatattgtgcaacttcattagagtccatggtagattttgtcacttctaagcttgggaagaatgctcgagttatttctacagaagcagaaaaggaaagtaagtcccaaaaattctcggtgaaagatggagtgaagttgttagcagaagataaggtcattgtttgtcatcctatggattacccatatgttgtgtttatgtgtcatgagatatcaaatactactgcgcattttatgcctttggagggagaagatggaaccagagttaaagctgcagctgtatgccacaaagacacatcagaatgggatccaaaccatgtgtttttacaaatgcttaaaaccaagcctggagctgctccagtgtgtcacatcttccctgagggccaccttctctggtttgccaaatag

SEQ ID NO: 1652 - DNA, 1707 bp, Glycine Max
atgcctcgcgccacaacaacccaatcgcagaacataaagcagagggtactcacgtgcctaacaaagctctcagatcgcgacacacaagtcgcaggagccaacgagctcgagtccatcgcgcgcaccctggacccgcactctgttccagtcttcctctcgtgcatccactccaccgacgcctccgacaaaacccccgttcgcaagcaatgcgtgcacctcgtggccacgctctcccacgcccacggcgacgcgctctcccccttcctctccaaaatcctcgcctgccttgtccgccgcctccgcgacccggactcctcgatccgggccgcgtgcgccgactccgtcggcgcactctcggcgcgcgtcacgaggcaaccgttcgccgcggcgttcctgaagccgctggcggaggcgctgttcactgagcaggacccgagctcgcaggctggagccgctctctgtctggcctccgcgattgaagcggctccggatccggacccggccaggctggccaggttgctcccgaggctcgagaggctgatcaagagcaaggtgtttagggccaagccagcgctgctggcgctcgttggaagcgttgtcgaggcgcgcggcgcgacgagcggcgccgcgttgaggagtttggttccttgtcttctggaggcgctggggagtgaggactgggccactaggaagggcgcggcggaggcgttgaagaagctcgcgagcgtggagagggacctcttggcggagttcaagggtggatgcttgaaagtgtttgaagatcgccgatttgataaggtaaagttggttcgggaggttatgaatcagatgttggaggcatggaagcatattcctgatgtttcagatgagttctctccacctcctcaattgcagttgtcttcaaaagagaatgcaagtgatgggcgctatcctcctgtctctcaaaattcatgcagtccaggttctgtaatgagtaaattgaggaagaaatcgagcccagctagcaaatcaactccaccagatagatctgctgttaggaatgcaaaaaagagtgcattaagtggcgataggatgggttcagattttttaagcaggaaacaaaacgggctctatttgataaaaattctgatgacaagatgcataaatctggtgggtccaaagctggatctcgtgtggttccttgttctgaagagagtcaagactcaggtcctgtctgtaattgaagaattatctttgattcgtgctcaattagttcaaattgaaaagcagcagtcaagtctgcttgatcttgtacagaaattcatggggaactctgaaaatggaatgcatactttagagactcgtgtgcatggcctggagttagcattggatgagatctcttatgatttggctgtatcaagtggaaggatatctaaatctgatgctcctaagaatacttgttgcctgctacctggtgctgaatttttaagcaccaaattctggaagaaaacacagggccggtattcatcgtaccgattctctagaactggtagcactccattactagcttccagtcattacagagctaacaggaatgccaaatctaataggttggcaagccatagatttagggtccatggtgatggaagcttcatgactaatcctctggcagagattaaaattaattcaagggagatttcaggctctgcaagatcagagctagcttga

SEQ ID NO: 1653 - DNA, 1869 bp, Glycine Max
atgcctcgcgccacaacaacccaatcgcagaacataaagcagagggtactcacgtgcctaacaaagctctcagatcgcgacacacaagtcgcaggagccaacgagctcgagtccatcgcgcgcaccctggacccgcactctgttccagtcttcctctcgtgcatccactccaccgacgcctccgacaaaacccccgttcgcaagcaatgcgtgcacctcgtggccacgctctcccacgcccacggcgacgcgctctcccccttcctctccaaaatcctcgcctgccttgtccgccgcctccgcgacccggactcctcgatccgggccgcgtgcgccgactccgtcggcgcactctcggcgcgcgtcacgaggcaaccgttcgccgcggcgttcctgaagccgctggcggaggcgctgttcactgagcaggacccgagctcgcaggctggagccgctctctgtctggcctccgcgattgaagcggctccggatccggacccggccaggctggccaggttgctcccgaggctcgagaggctgatcaagagcaaggtgtttagggccaagccagcgctgctggcgctcgttggaagcgttgtcgaggcgcgcggcgcgacgagcggcgccgcgttgaggagtttggttccttgtcttctggaggcgctggggagtgaggactgggccactaggaagggcgcggcggaggcgttgaagaagctcgcgagcgtggagagggacctcttggcggagttcaagggtggatgcttgaaagtgtttgaagatcgccgatttgataaggtaaagttggttcgggaggttatgaatcagatgttggaggcatggaagcatattcctgatgtttcagatgagttctctccacctcctcaattgcagttgtcttcaaaagagaatgcaagtgatgggcgctatcctcctgtctctcaaaattcatgcagtccaggttctgtaatgagtaaattgaggaagaaatcgagcccagctagcaaatcaactccaccagatagatctgctgttaggaatgcaaaaaagagtgcattaagtggcgataggatgggttcaggtgttttgcagaaactgaaccataaccattgggatgttcgaattgctgtgtcaaatgttcctgatcgtggtgaacgccggcagaaggatgaagatgttttggaaagaagcaaaaaggataaaagcagattttttaagcaggaaacaaaacgggctctatttgataaaaattctgatgacaagatgcataaatctggtgggtccaaagctggatctcgtgtggttccttgttctgaagagagtcaagactcaggtcctgtctgtaatgtaactaaggatctccataggaatgacaaagagagtgaagaattatctttgattcgtgctcaattagttcaaattgaaaagcagcagtcaagtctgcttgatcttgtacagaaattcatggggaactctgaaaatggaatgcatactttagagactcgtgtgcatggcctggagttagcattggatgagatctcttatgatttggctgtatcaagtggaaggatatctaaatctgatgctcctaagaatacttgttgcctgctacctggtgctgaatttttaagcaccaaattctggaagaaaacacagggccggtattcatcgtaccgattctctagaactggtagcactccattactagcttccagtcattacagagctaacaggaatgccaaatctaataggttggcaagccatagatttagggtccatggtgatggaagcttcatgactaatcctctggcagagattaaaattaattcaagggagatttcaggctctgcaagatcagagctagcttga

SEQ ID NO: 1654 - DNA, 783 bp, Glycine Max
atgcgagcacagacgctgatgacacagtggtgcacaagagcagcaacgtgtggccaattgaggatgagcactaacaccaacacccccaaacacgatggtctcgacgccattttcaaacataagcgcttacttcgaacgcaggtcagaaaaaccctaaaatccatccaaccctccctccgatctcaccaagataacaccgttcaagacatagttttgggagctccgtggttcaaatccagtcgcaggctatgcgcgtacataagctgcgctgctcttcgcgaagtcgacactttaaaaatattgtcacaaattttgcaacataacaatgctactgatggaaagaaactctatgtgccgcgcgtggaggataagaatagtcacatgcgtatgctccacatatcgggaattgatgatctcattgcaaactcaatggacatcttagagcctgctccggttgatgttgatggaaatgcgcgtgaagatgttatgcaggcaaatgatccagttgatttgttccttttacctggactggcatttgacagatctggaagacgtttaggtcgtggcagaggttactatgatacattcctgaagaattaccaagaccttgcaaagacgcggaattggaagcagcccttgcttgttgcactgtcgtattccgaacaaatactggatgaaggactaataccaatgacttcatctgatcttccagttgatgctcttgtatctccggaaggtgtgattcccatcagtaaaactgccttaaacagcatggatctctga

SEQ ID NO: 1655 - DNA, 867 bp, Glycine Max
atgcgcttgcaatccaatccttctaaccatagcagcactcatgaactcatacagttttctgattggttactagacataggtgatggcaaacttggccaacctaacaatgtacattgcgaaatcaccatcccagatgagtttcttataatggtttttgaggatcctatccaagcaattgttgatgcaacgtatccagatttattacaaaactacaacaatgcagatttcttgcaaaagagagctatcctagcctctacaaaagatgttgttgacaaaataaatgactatgtcctgtctttgattcctggtgacgagaaagagtattgtagtgctgatagtgttgacaaatctgatgaactactcaatcctacttttggagtactaacacctgagtttcttaacaccttgaaaacatcagggatacctaatcacaagctaagaatcaagattggtactcccatcatactactccaaaatttggaccaggcagatggtttatgcaatggaactcgactaattgtcaccaaacttggaaccaatgtagttgaagcagaggtaatagctggacccaatataggtcataggacatacataccaagaatgaatatgtctccttccgattctccatggccattcaaattaattagaagacagctttcattcatcgtttcatttgcaatgactataaacaagtctcaaggacagtccttggcacatgttcgattgtatttgccaaacccagtattttgtcatggccaactatatgttgcactttcacgagtgcaaagtaaaaaaggactacgtattcttattcatgataaacaaggcattgcaaaaaatactaccattaatgtggtatacaaagaa

SEQ ID NO: 1656 - DNA, 885 bp, Glycine Max
atgcggttgcaatcaaatcctactgaccattccaacttggatgaactaaaacaattttctgagtggttactagacataggtgatggtaaacttgcagaaccaaatgatggttatggtgaaatcaccatcccagatgagtttcttatcaaggactttcaagatcctatccaggcaattgttgaagcaacatatccaaacttattacacaactccagcaatggggatttcttgcaaaaaagagttgtctttgcctctacaaaagatgttgttgataaaataaatgactatgtcctgtctttgattcctggtgaggagaaagagtattgtagtgctgattctgttgacaaatcagatgaactactcagtcctgcatttggagtactaacagctgaatttctaaactcattgaagacatcaggcataccaaatcacaagctcagaatcaaggttggtacgcctatcatcctactacgaaatttggaccaagctgatgggttatgcaacggaactaggcttattgttacaagacttggttcaagtgttgttgaagcggagattattactgggcctaacataggtcatagaacatacataccaagaatgaatctttttccttctgattcaccatggccattcaagctaattagaagacaattttcattcatggtttcatttgcaatgacaattaacaaatctcagggacaatcgttggcacttgttggattgtatttgccaaccccagttttttctcatggccagttatatgttgcactttcacgagttcaaagcaaaaaagggctccatattcttattcatgataatcaaggcactcccaaaaatactaccattaatatagtatacaaagaagtttttgcaaacttataa

SEQ ID NO: 1657 - DNA, 864 bp, Glycine Max
atgcgtttacaaaacaacatgcaagcaatagatcaagaagaaactgcagcttttgcacaatggattatagatattggtgatggtattattggagatgaaaatgatggctatgctactattgaaattccacaggaactattaatcacagaatataatgatcctattcatagtataattagctctacatttccagatctatctcatcatcacaatgatcctgaatacttccaaaccagagcaatattagcttccacaaatgaaacagtgcaacaagttaatgattatatgcttacaatgataccgagtgaacaaatggaatatctaagctttgattcaattgacaaatccgaaaccattgaaagttgtcgtttccgctcactgacaactgaatttctgaattcattgacaacatctggcttacccaatcaatgtctcaaactcaagattggaacaccaataatgctattaaggaacttagaccaaactcaaaggttgtgtaatggtactaggttaattatcacaagactagcaaaacatgttattgcagctgacataatttctgggacaaatatcggagatcatgtttatatcccacgaatgtctatgtcgccttcacagtcaccatggccttttaagctattgaggagacaatttccgataatgctttcttatgctatgacaattaataaatcccaaggacaatcactatcttcagttggactttacttgcctaaaccagttttttcacatggccaactatatgttgcattatcaagagtcaagtcaaagaaaggacttcgaattttaatacatgatcagaacaaaaaaaaaatgacttcaaccacgaatgtggttttcaaatag

SEQ ID NO: 1658 - DNA, 777 bp, Glycine Max
atgcttcggcttcctcttccgatctaccccggaaatcagcgtttcaaatttcaattcagcgaggggagaaattggagggcgggaaaagaaacggcgttggaagttgaggttgggagagggagaaggaagacgaggagtgaagggagagaaaagagcgtgttcatcaaacaaaactcaatactctcactcacccttgatgagttctattgcaagaatggaaagagcttaggatccatgaacatggatgaattcctttctagcatttggaactctgatgataacaaccaagttaacccaccactacccacccttgatgaaatccacaaaagccaaccacactacaatgaagctaacaatagccttgccaggaatgagccactgctcaaaaggcagcaaacacttgaggaaatgactttggaggatttcctagtaaaagctggggtggtacaagaatcatcatcactattcaagtcttcattattatatcagaatcaaattggtaacattgcaagtaatggaccattgagtgcaagttataggatgtcactacaaatgacactgtggaaaatgtccaagcttaggagaatcaatggcaatagagagaaggtagcgcaaaatgttgaagaatcaagaatcggtggcacgttatataagaaaagagtgtacataagaaacaattatgctaaaattatgcaacaatggaagaatcattcaagaatctggaaaggaatattaattactcacgaatttatccaaactcgcccgagtctacgctaa

SEQ ID NO: 1659 - DNA, 879 bp, Glycine Max
atgcttctatcctcctcctgctccgccgccggctccgccgtctccggcgagatcatgctgttcggcgtgagagtcgtagtggactccatgaggaagagcgtgagtatgaacaacctctcgcagtacgagctccctcgcgacgccgccaacgccaaagacgacgtcgctgccggctacgcctccgctgacgatgccgctccgataaactccggcaagaaccgcgaccgcaagcgagggattccatggacggaggaagagcacaagctattcttggtggggttgcagaaagtggggaaaggtgattggagagggatctcaaggaactatgtcaaaacgaggacgccaacacaggttgctagccatgctcagaagtactttctccgccgcaccaacctcaatcgccggcgccggagatccagcctctttgacatcaccaccgactcggtctctacaacccctgtggaggaaggacagatccagcatcaagataatgtgtctctctttcgtcccgtttaccctgtaacccctgaaggaagctacatgaatggttttccaatgatgtccatgtatccaaaggatgttggttctcgagtcatgtcagttcaagctgggaatccaatggaaacactcactttagaacaaggaaatgtggaacagaatgatccaagtactaagcttgtttgtacaatccctattgttccagatcatagtggctccacagtgtctgatatcactgcaagtttgagttccattgatccaccaacactgtctctcgggttatctttgtcatctagtcaaagacaaacatcatcaacacattctgctttacatgcactgccatgcttcaacaatcaagatagcatcataagtgttgcttaa

SEQ ID NO: 1660 - DNA, 1128 bp, Glycine Max
atggaacctcccttcgaccacctcctccgccgccttcaccctcccgtcaccgccctcgtcgccgacgtcgagcttcacttccctgtcgccgtcgcccgccgcagtaatattccggtcgcgctgctttggaccatgtcggcttccttttacctcacgttgcatcaactaggaagcttggttcgtaaccactctttgaaggttgatgttttagatgattatgaagagcatataccaggaatttctgcagcacaattagctgatcttcgaacggtgcttcgtgaaaatgacttgaggtttttgcagcttgagttggaatgcatttcagtagtgccaaaagcagattgtcttatagttaatactgttcaagagttggaagctgaagtaattgattctttgagagccatgttccactttccaatttgtcgcattgcctttccttacttcaaacacgaaacatgtcattttgtgaccaacgacagtgattacaacgttgactacttaaattggctagatcatcagccatccatgtctgtattgtacatttctctcggtagtttcctttctgtgtcatgtgcccaaatgaatgaaattgtttcagctttgaacacgagtggtgtttgttacttgtgggtggttcgtggagaagtttcatggttaaaagagaaatgtggggataggggtttagtggtgccttggtgcgaccaattgaaggttttgtcacatccttctgtaggtgggttttggagccactgtgggtggaattcaactctagaagctgtttttggtggtattccaatgctgacattccctcttttcttagaccaagttccaaatagtaggcaaattttggaagagtggaagaatgggtgggagcttaaaagatcagatttgggaagtgcagaattgataacaaaagatgaaatagtgcaagtgattagagagtttatggatcttggaaagcgaaaagaaattcgagacagggcactagaatttaagggcatttgtgaccgagcagttgcagaaggtggatcctccaatgtgaaccttgatgcatttataaaagatgttttgtgtgttcaaaggtcattgagaggcaggggatatgtgatgtacaaaataggcaaataa

SEQ ID NO: 1661 - DNA, 993 bp, Glycine Max
atggaactaacattccctcatcaagacgaagatgattccgttgtttctgattgcgagagcggtgtttcgggcagtggagtcgtggtggcaccaccaccaccaccaccacaacaacaacaacgtggttttttcgttaggcttggagaaggtgacgtggttcacgatcttatcaagacaaggtttattcgtggcctcggcatgctcgggcctaaaaccgaggttgtctccgttcgccgaaacgcgtgctccgacgtcgtttcacaggcgcgccttcactcgtttcatgctcacgccagggcggtggcgaggctccgcggcggcgggaatcatgccaacgtgaagtacgcctggtatcgtacgaacggcgaggacgacgtgaacgacatcgtttcgcaaggcttcggcttcgcgcacggcccgaaactcgttctctcccctgacgacgctcctctccaaagtgcgagagggtgtggggttgggaaggacggtgtgaggcacgcgttactgtgccgcgtgattctagggagatcagagattgttcgtgataacacagaacactgctatccgagttgtgaagagtatgattctggagtggatagtttttcggggcctacaaagtacatcatttggagcaatcgcatgaacactcatgttttgcctgcgtatgttgtaagcttcagagtttcttccttcaaagggatggagaagagtgaagaagaacctttgagacctacttcgccttggatgccattcccaactctgatttctgcgctttccaaggttttgcctccatgtgatattgccctcatctccaagttctacaaagataaaaaagacaagaagattttacgacatgaattgatacaaagagtgagagaaatagctggagataagttgctagttgcggccatcaaatcttatagagacaacaagaagaaaccaagctttctacaatcaaggtcaaagaatggcttagcaacgaggataaaataa

SEQ ID NO: 1662 - DNA, 1083 bp, Glycine Max
atggaagaacccgtcatggaacaacaaccctccgctgctgcctctgggaacactgccagacccaggcttcagaagtacgcactccgatctgccaataagttgaaggaagagaagtcagaaactcccaattgctccattcctacttctgaaaccatgagggggagaagtgtaggtgcttcaagtgtaagtaaaagtgtgagtgttcttgatttttctggcaaggacaagtctggtagtgccaagccacccagaaggctctcaattcctgccaaaacaccagccacttcaagacccaagctgggtggcaacagtaccccaatcactgagactagaactgggaggagtgcttttggtcaaggcagaagcaaaacaccaatttcagacatttccaagacatcttcacgaaccaagttaaatctcctaacttcggcttcgtattggttaaaccagatcaagctctctgaatccgcggccaagcactcaatttcacttggcttcttcaaactagctttggaggcaggatgtgagcctctcgggccaatgcaagaagggctaaaatcatatgtgggcagacatcagcttgatggtcttgaagaaactgtgaaagcattgtttgagagctataacatctcagaaacaatggagcagtggcaggtgtctgagactatttcacatgtgccagaagagggaactcggtcttccgatgatgatgtgcgtagctcttcttctaccatggggactagaaaactgaaaccaaagtgcttaaacactgattctactcaactcacaccttcgacagagtcagcaaagaaggagacaagtcaaaagagtaatcctggatccaggttgagagggaatctcagcacaaacaccacaactccaaggcctgctctagacaacaggaataataggttggttaaaaaatctgagaagccaagcaagcaagaaccaaataaggaaaagggcatgataaagaggcagggaaagaaatctgatgttaaagaagttagcactccaaagggaggcaaagaaaatatggaagctcggaccactgaagaaaacagcgtgacagaagtggtgtaa

SEQ ID NO: 1663 - DNA, 1257 bp, Glycine Max
atggaataccaatacccatcatcttatagcgtctcttcctcttctcactccaaccaccatcagcaaggctcaacaacgaaatccctctcttcatcacaacgcagccttatctcagtcccctccctcaaccaccaccacctccacaccccaaatccctccgtctaccaccactgcctcacaaccctcaagggccacacctcctacatctcctccttaaccctctccggcaaattcctctacaccggctcctccgaccgcgaaatccggtcctggaaccgcatccctgaaaactcatcaaccgacaacagtaataataataacaataacagcaccgtactcgccggtaagggtgctgttaagtcgttagtaatccaatccaacaaactcttcagcgcgcaccaagacaacaaaatccgcgtctggaaaataagcaacaacgacgacgaccaccaccaccagaaatacacacacgtggccacgctccccaccctcggcgatcgcgcctctaaaatcttgatccccaagaacaaggtccaaatccgaaggcacaagaaatgcacgtgggttcaccacgttgacaccgtctctgccctcgccctgtccaaagacggagccttgctatactccgtctcttgggacagaacactcaaaatctggaaaaccaaagacttcacgtgcctggagtccctcgccaacgcgcacgacgacgccatcaacgcggtcgcagtctcctacgatgggtgcgtctacacgggatcagcggacaaaaggatcaaggtgtggaagaaattcgcaggagaaaagaaacacaccttaatagagaccttggagaagcacaactctggggtgaatgcgttggctctaagcagcgacgagaatgttctatattctggtgcatgcgatagggctattttggtttgggagaaagagggtgatgatgggaaaatgggggtggtgggtgcgttaagggggcacactatgtccattttgtgtttatctgttgctgcggatttggtgtgtagtggctctgcggataaaacgattagagtttggagaggttctgttgatgcgcatgaatattcttgtttagctgttttggaagggcacaggggttcaatcaagtgcataagcgcagtggttgaccactgcaacaacaccaacacatggtcgcagtcggaagcattatcttttctagtctatagtggcggtttggactgccacattaaggtctggcagattttagttcctgctatctaa

SEQ ID NO: 1664 - DNA, 585 bp, Glycine Max
atggaatccaaacccgctcaaactatcaagcttctctgtagctacggcggcaagattctcccacgcgccaccgacggcgaactccgttacgtcggcggccacaccagagtcctcaccgtcgaccgttccatttcctttccagaattgatggtgaagctacgcgtattttgtggttcgtctgtgatcttgcggtgtcaattacccaagggagacttggagaccttgatatccatcaccaacgacgaagatctcgctagcataatcgaagaatacgaccgttcctcgttgaaattggcgcatccgttgaagatcaaagccgttctctcgccgccgaaatcgatgaagaaagcttcgcctgttccatcgtcggcgtcggcgtcgtccagcgccacacactctccgtccggatcgccgcacacctccaccgaatcgctgccgtacgcggcgttccaccgcatcggccgccacaaccgcccgccggttgtgtatgctatcggcgcggcgaaggcatgttgctacacgcagttcgatgggagccctaggttcctgtaccgtggacctcactgcaattattactgccactga

SEQ ID NO: 1665 - DNA, 1059 bp, Glycine Max
atggaatctggaggtaggttctactcagttgacgagttcagattggaccccaaatggctgattgatcctaaccatctctttgttgggccacagattggagagggagctcatgccaaagtctatgagggaaaatataaaaaccaaactgttgcttttaaaattgtacataaaggagaaacgacagaagacattgccaagagagaagggcgctttgcgagggaggtggcgatgttgtctagagtgcaacataagaacttggtgaagtttattggtgcttgtaaggagccagtaatggtgatagtcactgagctgttattaggaggaacattgcgcaagtatttgcttagcatgcgccccaaatgcttggatagacatgttgcgattggttatgcacttgatattgctcgggctatggagtgcctgcattctcatgggatcatccaccgagatcttaaacctgataacttgctattgactgaagaccagaaaacagtcaagctagcagattttggtttagcaagagaagagtcattaactgagatgatgactgctgaaacaggaacttaccgttggatggctccagagttgtatagtactgtcacactaaggcaaggggagaagaagcattacaaccataaagttgatgcttatagttttgcaattgtgttgtgggagctcttacacaacaaagttccttttgaaggcatgtcaaaccttcaggcagcatatgctgcagcctttaagaatgtaaggccaagtgcagaaaatcttcccgaggaattggctgtaattcttacttcatgctggcaagaggactcaaatgctcgacccaacttcacccagataatccaaatgctcctaaattatctttacactgtcgcaccgcctgaacccatgactccttcaagaatattcaattctgagaacacagtcttgccaccggagtcccctggtactagctccttaatggcaaaacgtgatggcacaggtgatacaccaagagcaaaggacgaaatcaagcctaacggctttctttgctgctttagtcagtgttattaa

SEQ ID NO: 1666 - DNA, 696 bp, Glycine Max
atggaatttcttgcgtacaacatccctcccccataccttcgcatagcgaagagcctctgggcaatggggtacgaagttttagagggcgagccctggtgcagcgacaaatcatgccagcttaagtttattcatggaatgccaaacttaaaaggaaggctacagaaacagcattatgctctttttgttgtctctgaggatcagtcacaatactgtgagctcgaaacaactgctttagtgctagaaaacagcaatacagttgcagaagacatctctcctgcaagcaactcatattttcatttatcaggtagtgatggaaaaccagatttcctcatattattcttcacagaagcaattttctattgtggtgttggggtattcctttatctactagaccatgtaagaagacccttgctagtggatatcgctgcaaacaatagtgatactctacccccacaattgggacagagagtctcttctgttgctaccctggtgcttagtcttgtaattccaatggtgactatgggtttggtctggccgtggactggccctgcagcctccgcaactcttgctccataccttgttggtatagttgtccaatttgcatttgagcaatatgccagatatcgaaagtctccttcatggtctgctattccattaatctttcaagtaaggacaatccaattccctgttgattag

SEQ ID NO: 1667 - DNA, 5298 bp, Glycine Max
atggaccagtcaatggtggtgactcacttcccaaggcaaccaatctccagtcacattctccacacgtcgcctcaccttcctgtgacgttatcattctccctgcccgtgctgcccgcactgcccgacccctaattctcgctccgaattcgttccttcgtttgttcctttttcgcattcgtcttcgcgcggatccgagtgcgtcaattcgaatttcgaaagcctagggtttctggaaagcatggttgcggagctagggttttgcgcggatctagggtttcgcgggttctgagggcttcgggtgtcgaattaggagggggatttgatggtacgcgttggggaaaatgcgaggctatgcatgggcgtggaggtgagaagggtaagaggactcggcacatgtggaaatcctccacacgtggcgactcgtctctgaacgccgatgtttcttcgtcttcttcttcgtcgtcgtcgtcagtgaagtcgttctcttatttgagtttatgtggaaatgaattgtgggtttttgacgagtgcgttgtgtacaagtatgtgtctagggcagggattaagatggaaactactgaattggacggtcgcaaaattagtgttggtgaatgtgctctcttcaaaccatctgaagatcgcccaccatttattggtataattcgttgtctgacatttggcaaagagaaaaaattgaaggtaggtgttagttggctttatcgatccattgaagtaaaactcaacaagggtggaccattggtggctgctccaaacgaaatcttctacaccttccataaggatgaaattgatgctgaatcgctgctccatccatgtaaagttgcatttcttcgtaagggtgctgaacttccatcagggatttcttcatttgtgtgcaggagggtttatgacattgcaaacaagtgtttatggtggctaaatgatcaagattatattaatgattgtcaagaagaagtagatcaactattatacagaacttgtgtaggaatgcatgcagcagtgcagccaggtggccgatctcctaagccaatgagtagtccaacatcaacatcacagttaaaatctgtttcagatagtgtccagaacagtacttcttcctttccatctcacattaaggggaggaaaagggaaagggctgatcaaagctctgagcctgccaagcgagaacgatcaataaaaactgaggatggagattctggtcatttcaggcatgataacattttgaagacagagattgctaaaattacagaaaagggagggcttgttgacaatgaaggagttgaaaaattagtgcagctgatggttcctgagaaaaatgagaagatagatttagctagccgggcattgcttgcagctgtcattgcagcaacagataaattagattgtcttagtcagtttgtgcagttgaggggcttgcctgtatttgatgaatggctccaagaggtccataaagggaagattggtgatggtgttgggtctagggatggtgataaatctgttgaggaatttctcttggtattgcttcgggcacttgataagcttccagtaaatcttcaggctttacaaacatgcaacattggaaaatctgtgaatcatttgcgaacgcataaaaacactgaaattcagaggaaagccagaggtttagttgacacatggaagaaacgtgttgaagctgaaatgaatataaaagatgcaaagtctggttcaggtcccactgtccactggtctgccaaatcgcgttcttctgttgttggtcaaggtgggaatagacattcaggtgcattatctgatgttgccatgaagagttcagttacacagctttctgcatccaaaactgcctctgtgaagattgtccagggagagaatactactagatctgcatcgacatccgcatttcctgggcctgcaaaatcagtgccatcacctgcatctgcgactacaaacctaaaagatggacagccccgtattgccgctgccaatggaggttctgatcttcccatggtgaatgcaagggatgagaaaagtagtagttctagtcaatctcacaacaacagtcaatcgtgttctagtgaccatgctaaaactggaggtcattcaggaaaggaggatgccagaagctctactgcaatgagtgtgaataagatatctggaggctcttcacggcaccgaaaatctattaatggattttcaggttcaactccatccgtagggcaaagggaaactggatcaagtaggaattcccccttgcacaaaaatttaacttcagagaaaatatctcaacctggattaatggaaaaggcacttgagggagtttcttgtaagctgattgttaaaattccaagccaagttagaagtcctgctcaaagtgctagtgcaggttcttttgatgatcctacaatcatgaatagtcgagcctcatctcctgtcctcccggagaagcatgatcagtttgatcaaagctcgaaggaaaagagtgacctttatcgagcaaatattgtctcagatattaatactgaatcttggcagagtaatgattttaaagacgtattgactggctctgatgaggctgatggatcacctgctgcagttactgatgaagagcactgtcagattggcaatgattgcaagaaaacattggaggtaccaaaagccgcttcctcgtcatctggaaatgaaaataaatctggaaatttgcaggatgcttcttacacctcaataaatgctttaattgaaggtgttaagtactctgaggctgatgatgttggaatgaatcttcttgcgagtgtggctgctggagagattttgaaatctgaattgttaactccagctggatctccagaaagaaacactactgctgttgaacagtcatgcacaggcaatggtgttgttaagtcctctgaagagaatcttgtccgggatgaatgccactcaaataatggtcttgatggtgaacataagaatcagggttctgtaacaggtgatttaggggtaaatgatgaaagtgattctgattttcgagcttctgaagagaaagctgcaagagagctaaataagtgtgttaatgcatgtagtatggatttgcaacaggtttctgaaactattttagaaagcaaaggaaaattaaacaaaaaatctgtatctactgcattgggtggcctttctgaaagttctgtacaagaagctagagatggtgacagaagcaagcagctccaggaggttggtcggggagtgaatgctgatgaaattgttgatgttaaggtcagttctgttgcagaagttaaggcagaagcaactgaaaaattgtcacatatagctgtggaagtggatgtacagagtgataactgtactactgaagtatcaactggtggtggacagacagctgctattcttgttcagtctgattcggcaagaggaaaagatgagaatgtactccattcttctgcttatagtgttgataaggttcctgaagacttgactgaacgggagtttgaaaaagctgatgatgttgatgctgagaatcattctagtcagtctaaaaagcaaagaaatgagtgtgaaagtgatgccttgacaatgcctgaggatagaggtttatgctctattgtgactggtattgctgctgaacatgtggaggaaaatttagaaacgaaagaggttcatgaccaacctgccagagaggaacttcccaaagattcacctagtgtcctttcacaagaaatggataagcatcttgattctaaagggtcaaaattgattgccatggaagcggaggaggctgaggagtgcacctctaccactgcagatgcttcttccatgtcttctgcagctgtgtcagatgcagatgctaaggttgaatttgatttaaatgaagggctcaatgcagatgatgggaaaagtggcgagttcaactgcagtgcacctgctggttgtttggtcagtcctgtgccgtttcctgcttcatctatgtcttgtggtattcctgctcctgtcaccgtggctgctgctgcaaaggggccctttgtgcctcctgaagatttattgagaagtaaaggggaaattggttggaagggatcagctgccactagtgcatttaggccagccgagcccaggaaggttatggaaatgcctcttggtgcactaactacctctatacctgatgctccagctggaaagcagagtcgagcaccattggatattgacttgaatgtggctgatgaaagaatacttgatgatatttcttctcaaacttatgctcgtcacactgattctgcatctcttgcaactgatgatcatgatcctgtatgcagtaaaatgtcttcacctcttcgctgctctggagggcttggtcttgacttgaaccaagtggatgaagcttctgacgtgggcaattgcttgagcagtaatcataaaattgatgtgccaattatgcaggtgaagccatcattgggtggtccaccaaatcgagaagtgaatgtccacagggactttgatttgaacaatggaccttcagttgatgaagtcaccactgaatcctcattgttttctctgcatgccaggagcagtgtgccatctcaaccgcttgtttctggacttagggtgagtactgctgagccagtcaacttctcttggcttccttccagtggcaacacctattctgctgtcacaatatcttcaattatgcctgatagaggggatcatcccttttcaattgttgccccaaatgggccacaaaggttgttgactcctgctgctggtggcaacccatttggacctgatatttatagggggccagtattgtcatcttctcctgcagtgtcatatgcatctgctccatttgaatatcctgtcttcccttttaattccagctttcctcttccatcagcttctttttcttctggatcaactacttatgtatatccaacatcaggcaatcagctttgctttcctgcggtaaattcacagttaatggggcctgctggtgcagtttcatctcattatcccaggccttttgttgttggccttgcagaaggtagcaatagtggtagtgccgagaccagtagaaaatgggcaaggcagggtttagatcttaatgcaggacctggaggttcagatgtggatgggagagacgggaattctcctcttccatctaggcaactttctgttgctagttcacaggccctagctgaggagcaagtaagggtccagctggctggtagtgttcgtaagaggaaggagcctgatggtgggtgggatggccacaaccaatcctcatggcaatag

SEQ ID NO: 1668 - DNA, 1527 bp, Glycine Max
atggacgcagattctgaatatcgtgaaaatagtgattcttcatttgtttgggatgagaattcacaactttacttccacgccagtagtggattctaccatgaccctaatgctggctggtactatagcaacaaagatggtgcttattacaaatttgaggatgggaattatgtgcttttaggtaccaaagaggatgataatgtagaaatgtatcagtgcaaggaaactacaaaagaaaatcctcaacaaatatatgatggtaacaacaatgaggatcacccttccttccttgaaagtaaatttgaaactaaccaacagataggaaccctggctgatgaagcgcctgctgataccccaaattccgtgagtagtccaacttgtgaagatcctcctccaccaccatcagaatggttagaggacacgcttatcgatctttacttatctggctacaagaacatagaagttagtgaagccgatgcagtgacagtgccatttgaaacagatgatagatataactcgttagcagctgatgcttacagcaaaacttacgaagtggaaggcgagtggatcctagaaccaggagatgaaaatggcttagctgataatagaagtactgtggatgaaggtataccttatagcaacacttatgaactggaagaaggtgaatggatcccagacatggaggacgaatatggcatagctgatagaagtaccatagatgaagccatctcattggatgaagagaaatggcgagctcaatatggtcaagttactgaatcagggaaagatctggtttcagaggttccaattgtggacttgtgggattgggaaatggttacgggatccaaaagagatggaaaagataagatggcaaggttggttggtagactggttaaaccatctgcaaagcaacatccatctatccctttcagtggagggaaattaagatctgctcccatctgtgaagcacatctcgatctggtacgagttaaaacaggacaattgtacagattgcgaaatcctagcgcaaaatatgtggcttcattatcaacttatgattcttccaatccaacagaacattgggattttccccagttatcacctaatagaaaaatcaaacgtcactctaagtccagtgaaagctctgcttcagctttggatgaaacccctattgagaaggatttgtctgcattgccaagtcagctctctgcctctaagaaaataaaacatcaatacagagatagggctgctgaaagaagaatattgcatggtggcttcggcatgggtccaggacagaagaatctgtcggacatttataatacaccatcttcacctgttgatgattgtccacaagaagctacggcagaggccttggagatgtcatttggagctggtagttatgctagaaaacttctaaaaagcatgggttggaaggagggggaagggcttggcagttctacgaagggcttggtagaacctattcaaccagttggaaacgttggtacttctggtttgggatggtctcgttga

SEQ ID NO: 1669 - DNA, 885 bp, Glycine Max
atggagaagaggttcagggaggcagtggaaagcaaggggttagaagctgaagtaaaggacatggattgggagagcacattcttcttgcgccatctcccagactccaatatctctaaaatccctgatctcagccaagagtaccaggatgcaatgaaggaatttacacagaaattggagaagcttgttgaggagttgttagacttgttatgtgaaaatcttggattagagaaatgtcgttggacagcattgttgcagaccttgccagtcatgaaggagttgttaagggataaaagaaggcagtccagcaatcatcatcgaaatctcagatgtaaacttactaaaacaggatcagatatattctcagatcccattatgtacagattagtggttggagcactgcagtactccaccataaccagacctgagcttagttttgttgtgaacaaggtataccaattcatggctaatcctcttgaagctcaatgggtagctattgggtttttgatctcgacgatagaaggtcaacatcaagggatgccattatgacttagctcctacactgcactagagagatgcaaaataagcagcaatgatgatgatggttatgatgaagacatggaagtggatttgactctaagcataggaggaggaagccaagttaataataagaagaatagtagtagtaagaaaccttatttgcttccattaggatgctcagactcacccaatgggaaaactagggagctaaattcttctgtctctttccaatcagatagggtgggagatttcagtgaccccaccacccctatgagcagctcaagtgtgacatttgatcaagagagaaaggggccacattgtctttctcaaggtttaaagcttaaatag

SEQ ID NO: 1670 - DNA, 873 bp, Glycine Max
atggagagcagcctctacgacttttactattcagccacttactcagacgagtcaacaatggctccatttgcgccgtctaacaagcctgtctttgggaaggaagaggatgtttcaaaagtacttcgtgctaaagttgcttcccatcctctatttcctcacctccttcatgcctacatggattgccacaaggtgggagcgccgcaagatgtggcacacctattagaaggaatcaaaggagagcatacatctggggtgtgtcagatatctgaatctgaaggcttcttgggtacggatcccgagcttgatgatttcatgggaacgttttgcgatttattggtgaagtacaaatcagatcttttaaagccctttaacgaggcaacaatgttcctcaacctcatggaaactcagcttcactccatctgtgcaatgtttttcatggtgggaccatggttgaatgggcatgcacaccaaacagccaaacgcatattggttcatgatgggcaaatgaacttaattaatttggtgaagaaagaggcaattgagggcaagaggatggaagttcaagagctgaaggataaccttctacgtagatatagcggttatattactaatctgaggcatgaattttccaaaaagaagaagaaagaaaaactaccaaaagaagcaaagcaaatcttactttcatggtggaatgttcactttaaatggccatacccaacggatgcggataaggttgccttagctgaatggactggtttagaccaaaagcaagtaaataattggtttataaaccaaaggaagcgccattggaaaccaacagaggaaatgcacgctgaaattttggatggtctctatggatccctggacgagtga

SEQ ID NO: 1671 - DNA, 2136 bp, Glycine Max
atggaggaaacatttgttcccttacgtggcattaagaacgacctcaaagcaagaattccgtgctatagacaagattggactagtggattccaagctggaatcaggatccttgccccaactacatacatattttttgcttctgcaattcctgttatttcttttggggagcaactggagagaaatactgatggaagtctcactgctgtgcagactcttgcatcaaccgcactatgcggtattatccactcaatcattggagggcagcctctcctcatactaggtgtagctgagccaacagtcctgatgtatacattcatgtataactttgctaaggatcgccaagatttgggacacaaactattcctaccttggactggatgggtctgtgtttggactgccctgttgctgttcttgctggccgttcttggtgcatgctcaataatcaatagattcacacgccttgctggtgaattatttggtctgctaattgcaatgctctttatgcagcaggctataaagggtcttgtggaagagtttggtgcacccaagaaccagagagaaggtaccaatcagattgcacttcaatcatcttggctatttggcaatggaatgtttgctttagttttgtcatttggtcttctttttactggtcttcaaagccgcaaggctagatcctggcgttatggctcaggttggctacgaggattcatagctgattatggagtcccactaatggtcctcatatggactgccgtgtcttacataccagtcaatgaggttccaaggggaatccctaggcgacttttcagtccaaacccatggtctcctggtgcatactcaaattggactgttgtcaaggaaatgttgaatgtgccccccttatatattgttggagcatttataccagcaactatgattgctgtgctttactactttgatcacagtgttgcatcacaacttgctcagcaaaaggagttcaatctaagaaaaccctcatcttatcattatgacttgctgctcttaggatttttgaccatattgtgtggacttattggaatccctccttccaatggtgtgattccacaatctccaatgcatacgaagagcttggctactctaaaacatcagcttttacggaataagcttgtatctactgcacgaaaaagcatgcggagaaatgttaatttgagccagttataccaaaatatgaaagaagcatatgatgaaattcagactccattggttccccaaatgccaactacattggggctgaaagaactgaaggaatctactattgaactggcttcaagtcaaggatatattgatgcccctgttgatgaggttgtctttgatgtgaataaggatgtggatgaccttttgccagttgaagttaaagaacagcgcctcagcaatctactgcaggcattgatggttgcggcttgtgttgctgctatgcccgttttgaagaagataccaacttcagtgctttggggctactttgccttcatggccattgaaagcttgccaggaaatcaattttgggagagaatattgtatcttttcactgctccaagtcgaagatacatactgttggaggaataccatgccacctttgttgagaccgtgcccttcaaaacaattgccatgtttactgtgttccagacagtgtacttgcttctctgcttcggcataacctggataccaattgctggggttcttttcccattgttaatcatgcttcttgtccctgtacggcaatattttcttccaaagtttttcaaaggtgcccatcttcaagagctggatgcagcagcatacgaggaagcacctgctattgctttcaacatgtcctttgaaattagtataaaaatgaggaagcatgcagtctttttgacttatttcagtaaggtcattttattaagcctcaaaatcaagcttattactaagtttacattcgataagagctcattgaataagttgcaaacaacacctttgaatacttcggtggggaaattcttgatgaagttattacgaggagtcgtggtgagtttcgccgcactcaaagccccaaaacaacaagggaaagcagcctcagaccaaccgggaaggagatcaattaccaaagatttgccttga

SEQ ID NO: 1672 - DNA, 1542 bp, Glycine Max
atggatcccaaccccggaaccttccctctcctctcctacatcatgtcgcgcctcccttccctcactcccagacccgccgccccggcaccctccgattccgaccaattcgacatcgaacagccaccggagattgtgggccaaatgccgcacctggcggacccggagctggtggcctctatgggccgggccgtggcacaggtgacgcaggcccgctcggtcctcaccctcatcggggagcgacccacgcacgaggaggtcgacaatgcccgggcaaagttggccgacgtcgaggcccagctctcccgagaactggaagagatcgtgctgcaggcccggcccgcggagatcgagatccaggggtggcgggcccagcaggccgagagggagagggagtgcagggagcgggccgagacggagaggcgggtgtggagatcggtgctgcagctggacgagatgcacgaggcttacgagaagcttctgaaggacgcggagaagcggttggtgaagatgtacgagtccaaagaagacggcggcggcggcgatgccgacctggcttatggcgaggaagtcaacgaagaggttgtggggattctgcaggaggcttacggcaaaggaatggaaagaattgatctttctggacgccagttgaagctcttgcctgaggcttttggtcgcatttctggcttgctcgtttttgatctttcaaccaatcaactctcggcaattcctgattcaatagctggattgcaaaaccttgaggagcttaatctgtcttcaaatcttttggaatcattgccagattcaattgggttgttacaaaagttgaaattgctcaatgtctctggaaacaagctgactgcgcttcctgattccatctgtcagtgcaggtcattggtggagttggatgtaagctttaacaatctctcatatttgccaacaaacattggatatgaattaccgaacttgcagaaactcatgatttatttgaacaagattcgatcttttccctcatctatctgtgagttgaagtccttgcactatttggatgctcactttaatgagctacatgggcttccaattgcaattgggagactgactaatcttgaagttctcaacctgagcagcaacttcagtgacctcaaagaacttcctgagacatttggtgatttggctaacctcagggaattggatctcagcaataatcagattcatgctcttccagacacatttggtcgccttgataatttaatcaagctcaacttggagcaaaatcctcttgaattgccaccaatggagattgtaaatcaagggcttgaagccataaagacttttatggccaagaggtggcttgatatattgttggaggaagaaaggaaaagcaaccaagaaatgcaagaaccagaacagggtggttggttaacacgaagcaccttctggttgaagaatgtttctggaaatgtaatcgggtatattggaactaccgttggatctcccatgtcacccaaatctcccagagatgcatatcttgatcagcagctatga

SEQ ID NO: 1673 - DNA, 732 bp, Glycine Max
atggatcctcctctcatcagcgactccacattctcccccgcttactccctcgccgagatttggcctggaatgccccattttcccgatcactctcacctcaccgccaccgctcccaccaagggaaaggactccaccgccgccgacgaggtcctctcctccaccaccactgccaacctatccaataatgattctggtagcaacaaacggatgaaggtaggagggtccagttttgaaaacgatggtttcaaagcggaggcagaagcaagttctgtgggtggtaacaagtcaagtgagcaaagcaataaaccttgtgaggcacctaagccagactatattcatgtgagagcaagaaggggccaagctaccgatagccacagtctagcagagagagcaagaagagaaaagatcagtgagaggatgaaaattcttcaggatttggtgccagggtgtaacaaggtaatcggtaaagcacttgtcctagatgagataatcaactacatccagtcgctgcagcgtcaagttgagttcctttcaatgaagcttgaagcagttaattcaagaatgaacacgaaccctactattgatgggtttccttcaaaagatgttggtactcagccatttgacattgctggaatggtatttggatcacaagcagcaagggggtatgctcagggatcatcacatcctgggtggctgcatatgcagataggtggtgggtttgagacaacataa

SEQ ID NO: 1674 - DNA, 537 bp, Glycine Max
atggatgcaaataagcgtagagtgacatatttctacaaaccgaacatcgacgcccactatcatggtgaagagtacccaatgaatccttttcgtgttgacattacccacaacctcatcgtccactatgggctacatcgactcatgcaaatcaatcgccctttccttgccgacaaggttgacattgctcgcttccattccgatgactatgtcgagttcctgtccactgtttcaccacagatccttgctgaaaactttgattccaactattgccaacttaagcgcttcaacatcggtggggatttccctatcttgaacggccttttcgacttttgtcgtgtctctgctggcggctctatcggtgctgctgtttgcctaaactgctccaatgccgacatcaccatcaattgggctgggggttggcaccatgctaaaaagactaaagcctctggattttgctacgtcaacgacattgttcttggcattcttgaacttctcaaagttcatagggtattggaattttgtgattttggtccctaa

SEQ ID NO: 1675 - DNA, 195 bp, Glycine Max
atggatgttaatgccatcaacaagcagcaggaaacagccttggctttggcagataaactgccgtatgcagaatatggtgctaagcatgccaggcatgtgggcaaatacccctgccgacgggtttctggtattgccaaagaactgaaaaaagttcatagagaagtagttcaaaacaccataaaatgtatgaatgtt

SEQ ID NO: 1676 - DNA, 270 bp, Glycine Max
atggcaaaccgctggctcagacccgaggtgtatccactgttcgctgcggttggtgctgctgttgggatctgtggattccaactggttcgtaatatctgcatcaaccctgaagtcagggtgaacaaggagggaaggaaggcaggagttttggagaactttgctgagggagagaagtatgccgagcacttcctgaggaagtatgtgcgcaacagaactccggagattatgccctccatcaacagcttcttcgctgacacaagtcgcaactaa

SEQ ID NO: 1677 - DNA, 1203 bp, Glycine Max
atggcacaagcacacgctctattttctcctttcaatcctcgccttcttccttcttcctcccccattctccgacgccgtttcttttcccttccaatttctccgttaactcaccggaccgtgattgcctccgaaaacgtcgccgtttcgcctgatgccgcctcgtctactcactctctcccccagcaggtgattgaaaccctgatttccggagtggatttatcggaggaggaagccgaagcgtgtctcaacttgctgctgcacgaaccaaacgaggccttaatcagcgctcttctcgtgcttctcagagccaaaggagagacctatgaagaagttgtggggttggcgagggcaatgtttaaacacgcgacgaaggtggagggtttggacgatgtggtggacatcgtgggaaccggaggggacggtgccaacacggtcaacatttcgaccggtgcttcgattctcgccgcggcttgcggtgccagagttgcaaagcaagggagccgttccagttcttctgcgtgtgggagtgccgatgtgttggaagctttgggagtggtcattgacttaggtccacagggggtgaagaggtgtgtggatgaagctgggatggggtttatgatgtctacaaagtatcacccatcaatgaagattgtcaggcctgtaagaaagaagctaaagataaaaactatattcaatatattgggtccaatgttgaatccagcacatgccccttttgccgttgttggagtatacacagaggacttggtccttaaaatggccaaagcactcaatagatttggcatgaaacgagccttagttgtccactctgaaggtttggatgaaatgagtcctcttggacctggtatagtgcttgatgttatggctgacagggttgataagtttgcatttgatcccttggagtttggcattccacggtgcaatattgaaagcttaaaaggtggtggtccagaatacaatgcagaggttttgaagcgtgttctaggtggagagagagggccaattgcagatgctttgattctcaatgccgcagcagctctcttagtcagtggctgtgtaagtaacctagctgaaggggtttctgtggcacgtgaaacacaacaatcaggaaaggctctgaaaacactcaacctgttgaaggatgtctcaaataacatcaaagatgagttgggcatggatgcctga

SEQ ID NO: 1678 - DNA, 1200 bp, Glycine Max
atggcacaagcacacgctctattttctcctttcaatcctcgccttcttccttcttcctcccccattctccgacgccgtttcttttcccttccaatttctccgttaactcaccggaccgtgattgcctccgaaaacgtcgccgtttcgcctgatgccgcctcgtctactcactctctcccccaggtgattgaaaccctgatttccggagtggatttatcggaggaggaagccgaagcgtgtctcaacttgctgctgcacgaaccaaacgaggccttaatcagcgctcttctcgtgcttctcagagccaaaggagagacctatgaagaagttgtggggttggcgagggcaatgtttaaacacgcgacgaaggtggagggtttggacgatgtggtggacatcgtgggaaccggaggggacggtgccaacacggtcaacatttcgaccggtgcttcgattctcgccgcggcttgcggtgccagagttgcaaagcaagggagccgttccagttcttctgcgtgtgggagtgccgatgtgttggaagctttgggagtggtcattgacttaggtccacagggggtgaagaggtgtgtggatgaagctgggatggggtttatgatgtctacaaagtatcacccatcaatgaagattgtcaggcctgtaagaaagaagctaaagataaaaactatattcaatatattgggtccaatgttgaatccagcacatgccccttttgccgttgttggagtatacacagaggacttggtccttaaaatggccaaagcactcaatagatttggcatgaaacgagccttagttgtccactctgaaggtttggatgaaatgagtcctcttggacctggtatagtgcttgatgttatggctgacagggttgataagtttgcatttgatcccttggagtttggcattccacggtgcaatattgaaagcttaaaaggtggtggtccagaatacaatgcagaggttttgaagcgtgttctaggtggagagagagggccaattgcagatgctttgattctcaatgccgcagcagctctcttagtcagtggctgtgtaagtaacctagctgaaggggtttctgtggcacgtgaaacacaacaatcaggaaaggctctgaaaacactcaacctgttgaaggatgtctcaaataacatcaaagatgagttgggcatggatgcctga

SEQ ID NO: 1679 - DNA, 1596 bp, Glycine Max
atggcaggaggaggagctccagctaaagcagatgagccacagccacatccaccaaaggatcagttaccaaatatttcttactgcattactagtcctcctccatggcctgaggccatacttcttggttttcaacattttcttgtgatgcttggcacaactgtgttgattcccactgctcttgttccccagatgggaggtggcaataatgagaaggcaagagttatcgaaaccctgctttttgtagccggtattaacacattgttgcaaacaatgtttggaactcgactgcctgcagtaattggagggtcttacacctttgttccaaccacaatctcaattatccttgctggccgattcagtgatgaaccagatcctatagagaaattcaagaggataatgagatcaatccaaggtgctcttattgttgcttcaactcttcaaatagtactgggcttcagtggtctctggcgtaatgttgcaaggttcttaagtccactttcgtcagttcctttggtatctcttgttggttttgggctgtatgagttagggttccctggggttgctaaatgtgtagagatcggcctgcctcagcttatattgctagtatttgtttcacagtatgtgccccatgtgctacattcggggaaacatatcttcgaccgttttgccgtgttatttacaattgtaattgtgtggatatatgctcatctacttactgttggaggggcctataatgatgctccacataaaactcagatatcatgccgcactgatcgtgctggacttattgatgctgctccttggataagaattccatatccctttcaatggggagcaccttcatttgatgcaggtgaagcctttgccatgatgatggcatcttttgtttctcttgtagagtccagtggagctttcattgctgtatataggtatgcaagtgcaacaccattgccaccatctattctcagtcggggtattggttggcagggagttggcattctgttatcaggattatttggaacagtcaatggatcctctgtatctgtagaaaatgcaggtcttttggctttgacacgtgttggaagtagaagagtggtgcaaatctctgccggatttatgattttcttttcaattcttggaaaatttggagcagtttttgcctctatcccacctcccattattgctgccttgtactgcttgttctttgcttatgttggtgctggtggtcttagttttcttcagttctgcaacctcaacagttttagaacaaagttcattttaggcttctcaatcttcataggcttgtctgtgccacagtacttcaacgagtacacagcaattaatggctatggtccagttcacacaggcgcaagatggttcaatgatataatcaacgtcccattccaatcaaaaccatttgttgcgggtgttgtggcatattttctagacaacactttgtttaagagagcagctgatattaggaaggacagaggtaaacattggtgggacaagtacaagtccttcaagggtgacacaagaagtgaggagttctattcacttcctttcaatctaaacaagtactttccctctgtttaa

SEQ ID NO: 1680 - DNA, 1596 bp, Glycine Max; identical to SEQ ID NO: 1679

SEQ ID NO: 1681 - DNA, 897 bp, Glycine Max
atggcatcaatttgcgacaaagatatccctcttcgactacacaacatcgacgctttcatcgcttcttacagaaactccctccactcgctcagagccaccgcactcgaagccgcgcgatctcaatccgaattagccgaggttaaagctaaactgcgagaggctgaggatgaattggtaaaggcacttgcagttaagactcggagagaggcgaagcgaatggccttgaaagaggcgattgtttctgtgaagggaagaattgaggatctgaagacgagtattcagaagcagagaacccaaaacgaggaatgtgccacggttgtgtcgcatcaccgtcttgttttggaagtgtctgaacagaaatcaaatgaaagcagtgaacatagagatgaagtccaggaggccatatcttggtacaataggatccttggttttcagattgaaggtggacgtggggtaaaattcagcttcaagaatattaatgtggacaacccaaatgaggagttcttttttaccatccgccacgaagatgacgtgtatacattgctaaattgtaaaccatctgtcaaagatactgacgagttgatccatgaattaaacaacacaaatgggctatttaaatttgtcagaacaatgaggaaaaagtttcaagaagtagtggcacaaggccgtttatctatgacaacaaatgaacatcaagaatctgcctttatctctgcatctggtccagttttatcaatatcaaccattactgaagataatgatcatcaagatgaacccaccaaaggtaatgcacatctccagaaacaagttaatcgaagaagggtaaaatcagcaattctatctcctggatctgcatcatctgtccgtcaatctcctcgtttgaaggtcaggaaatga

SEQ ID NO: 1682 - DNA, 549 bp, Glycine Max
atggcatcatcaagctcctacaattctccatgtgcagcctgcaaattcttgaggaggaagtgccttcccgggtgcatctttgcaccttacttcccaccagaagagcctcaaaaattcgccaacgtgcacaagatcttcggtgccagcaatgtgacgaagctcctcaatgaacttctccctcaccagagggaagatgcagtgaactctcttgcatatgaagccgaggcacgcgtgagagaccccgtttatggttgcgtaggtgccatatctttcctccagagacaagtccaaaagctccagaaggagcttgattccgcaaatgctgatctccttcgctttgcctgcaatgacatgcctccaccctctctttctgtgccaccacaaatcccccaaaggtcttttagtgcagggtttggtaataataatgaatcagcaagtggaggagagttctataggccttctcctaccaccacttactcttacccttattctcttccatggactgatacctcttctgaggatatcaatgatggaggaggtaacttgtga

SEQ ID NO: 1683 - DNA, 297 bp, Glycine Max
atggcatggagaggaaatcttttgaaaaacataaaagaacttcggtttttgatgtgccagtcatcacctgcaagctcacccacaagggcttttgtggaaaggaattataaggaactaaagacattgaacccaaaattgcccatattaatccgtgagtgcagtggagttgaaccccaattatgggcaagatatgatttgggtgttgagaaaggcatcaaattggaaggcttgtcagaggcgcagatctttaaggcacttgaagatttggtaaaagcaggacagtctatgaaagcttga

SEQ ID NO: 1684 - DNA, 297 bp, Glycine Max; identical to SEQ ID NO: 1683

SEQ ID NO: 1685 - DNA, 222 bp, Glycine Max
atggccaccgaaccaaaagcagccactgaggacgtcaagattgatctcttcgaagacgatgacgaatttgaagagtttgaaatcaacgaagagtgggatgacaaggaggaagggaaagaagtgactcaacagtgggaggatgattgggatgacgatgatgttagtgatgatttctctcttcagttgagaagggagttggagagcaacaccgagaagaactaa

SEQ ID NO: 1686 - DNA, 222 bp, Glycine Max; identical to SEQ ID NO: 1685

SEQ ID NO: 1687 - DNA, 222 bp, Glycine Max; identical to SEQ ID NO: 1685

SEQ ID NO: 1688 - DNA, 1149 bp, Glycine Max
atggccatcagaggcgtcaatttcaaatggttcgatggctttttcttgtccatgctcgccaccagcatagctattgtggcaattaattggaagcggtatcaatcttgtactcaccctttgcacatatggactgtggttgactacgctgctgttttcactttccggcttttgatgtttgttgataacgggcttgcttcgggaatgggtttagattttgggtggccgcagagatatgctcgcttctgtggaagagtagttgtactttcaattcttgcattgcttctctatccatttctttgggcttggacaataattggtaccctgtggttcagcaacactaaaatctgcttgcctggagggggccagaaatggggcttccttatctggttactttttagctactgtggactcctctgtattgcttgcttggcaatgcggaagtggttaaaacgaagacaagcacgcatgttaggtgctcaagagggtatccctgtatccgcatttggggtaagttctatcgttactgtatgcctattgcctagtgaattctgctttctttcgctgtcagatttatgcttggctgtccttagatctgttataatgcactctatgttgctgaggcacagcaacttgatatgttgtaacaaaagagaagcagttgaagctttaattcaggaactcccatcgttcaggttaactgctgttcctactaattgcagtgaatgcctcatctgcttagaagaattccatgtaggaaatcaggtccgtggcctgccctgtgctcacaattttcatgttgaatgcattgatgagtggcttcggcttaatgtgaattgtcctcggtgccgttgctcagtatttcctaatcttgatctcagtgctctgtccaatatccgttctgagtctgaacagtcttctgccactgctgtgacaagcagagatatgacaggacaaacttctagtcagagttaccttctgagattacaggggcctctccacccagtttgtgttgactttgcagggccagctggtgagacagacaatgctttggaaaatgctgaaaatggtgggtttgataacttgatacaacaacaaagcttcatcccattagacgaggtcgattacatgaatcacacgacaccattttga

SEQ ID NO: 1689 - DNA, 237 bp, Glycine Max
atggccatggaactagatcgcaaaaacaaggtcaaatctgatctcgaatccttcctcagagcgaaacggtactaccaccgcctcggtcgtgtctggcaaaagagcttccttctgtacggtacctccggcaccggaaaatcgagcttcgtcgccgccatcgtcaatttcctctcctacgacatcgacctctgccaaatccctagcgattcggatctgaaattgctcctcctcaaaacg

SEQ ID NO: 1690 - DNA, 999 bp, Glycine Max
atggccttcgtagcacatcaacctcagggtttgtttgtgacatcttcctcgaggcgtttgccatggagcaaaaggctgaagttgaagcagtgtttaacaaaacatcacatgattggaagaactgaccggcattgcctagtaaagtggaatgcttgtttaagtttagggcctccttgcttttgtgtatccaagttcaaacctttaaggatttcaggcttcaaaggcagcacccaaaatgatgattcaggaatcagagctaatcggttgaaggcacccaatacttctgttagattaggagagagcggggaggctcacaatgttccactgtcttatgcatctgaaacaaatgatagcattgcaacatcatctgctattcatagacttttcaataaatggctgacaatgttgcgcacgcaaccatcaagccaagaagtggagaaattttttgaagaacctacatcagcaggaattttaccaaaaactcaacaagggactcaaattaaggaaagccgtgcggttttgaaggtggcatggtcccattttctggccctcgatgcaacaataaagattcctttgctggtatttgttcctctctacctggctgttaatgtaaaatatggtgctgaagtttccaaggagctaactcctttatggattttgggcccatttattgtggctacccaagtcttggcaatccgatggttatgtgcactctatgttttcagcttcaaacagactgtcaaattactcaagaattctccctcttactgcattttggcccacagctacgttttccgtggcaagctcaaagaggatatctcaacttatgttctgcagcctatattgagcgtaaaaaatagagactataaacagctaacaagaaaaaagttgaaagaattgcaggaatggatagtggagatgtatcttgattatgtggaatcgatctggccctactattgtcgaacaatcagatttttgaagagggctaatcttatttag

SEQ ID NO: 1691 - DNA, 1285 bp, Glycine Max
atggcgaaagtcacttccagagacgtgcaagagatcgtggaaaaactctcctccgataaagccaaagctcgcgaacattataccttttctttttcatgttgtactactaagaaattgcaacattctggattaagaatgcttataagctacatatttgaagggatcaagttgttaaacacttggttagaaggagaaagatcatataacttctgcaaatttattggatcaaatactgcaaagcttaggccagatgaagttcctcattctgaaacatggccttttcttatttctttactaattaaatctgcatcggcggagatatcctcaagtaagcggagaaatccaaaaatgatatatgcaaagactcttagaattgttgtgcaacgtgcggaggatgccaagtgttcaggaaaaatgttaccattgtcatctgtagttaaaccacttttcaatcatgtttgggatgttctgagcaatgttccaagctttcagtctgaatatgggattatccttcggcatctattgtcagttagagattatagtttccagatgaggaagcgcatatactgcaacctggtgtttctgtacattgagaaagtggaagcaagcttgaatggaaaaaatattagcaattgtacttccaaggaggaggtcttccgctatatcttgacacttcattctcttttaaagtatcctcctggagactaccctgataatgcaagagaagacattgtgaaggggtttgttagaatatgttcattcatcagggaagaggggaagatatcacgtaaacttgttgagtgtattaatacatatttattaaatgatggtccaaatttgggctttcagttgtttgagattcataatgccatgcaacagtttgtgttccgcagttggctgacaacacatgatcgagttctcaaggattcacttgtgttctatgcaaggattcagttgaatttaatcagtggtgctgctgataggtgtttattggtagaacagcttttggatgtgatttgtaaggatcttgatcaaggtagcatgtctagtacttcaatgctgcggggtgatgggaataaagatgacaaattaggagctttgagtagctcacaatgtggattggtggaacttgcagctgttctattttatagggactataagaatcttcgtggtttgtcttgtgctttctttttccttcattgttttcatatggtgtgcttgatgaatattacttttgctggtatactatggactgtggagcagtttcttatgggttgtttgaaat

SEQ ID NO: 1692 - DNA, 1395 bp, Glycine Max
atggcgagaggggagagagcggagacagagagtggcgtttcgttgccctcggtgggcacggacgcgaagaagcggagagtaacgtacttctacgagccgtgcatcggcgactactactacgggcaagggcatccgatgaagcctcaccgcattcgcatggcccacaacctcatcgttcactacggcctccaccgccgcatgcaggtcaaccgccccttccccgcggcggaggccgacatcggccgcttccacgccgacgactacgtcgacttcctctccaccgtctcgccgcaaatcctctccgagaattcccactcccactaccgtcagctcaagcgcttcaacgtcggcgaggactgccccgtcttcgacggcctcttcgacttctgccgcgcctccgccggcggctccatcggcgccgccgtccgcctcaaccgcgaagacgccgacgtcgccatcaattgggccggcggcctgcaccacgccaagaaggccgaggcctccgggttttgctatgttaacgacattgttctcggcattctagaacttctcaaagttcataggcgtgtgctgtatattgatattgatgttcaccatggagatggcgttgaggaggcattttacactactgatagggtgatgacagtgtcatttcataagtttggggattttttcccaggaactgggcacattaaagacattggggtgggtgctggaaagaattattctctaaacgtcccactcaatgatggattggatgatgagactttccgtggtctgtttcgccccatcattcaaaaagtcatggatgtttatcaaccggatgcagttgttcttcaatgtggagctgactcgttgtctggtgatcggttgggttgcttcaacttgactgtgaagggccatgcagattgccttcgtttccttagatcattcaatgtccctctaatggtcttgggtgggggaggatatacggttcgcaatgttgctcgttgttggtgttatgagactgcagtggcagtaggagtggagcctagtcctaagttgccttacaatgaatattatgaatattttggcccggactataatcttcatgttgagccatccacaatggaaaacctaaacacacccagggatctggaaaaaattcggaatacattactggaacaactttccaggcttccccatgcacccagtgcaccttttcaaacaacaccatcggtcatcgaagttccagaagaggaagaggaggacatggatgtaaggccaaaacgtcgtatatggagtggtgaagattttgattcggatcatgatgatgacatggctagttcaaagaactctgatttaactgcacaaacgaggtctgttgcagatgacatggacgaagataaagattaa

SEQ ID NO: 1693 - DNA, 411 bp, Glycine Max
atggcgagcgtgccttcaccttctcctcctccacgctcctccccaaacaaccaggtggaagctgctacaaataatggggcttctcacgtcgatgataaaaaacctaacttcaccgatggtcttgatcacttggacagtccacagtgcattgagaggttcaaaaaatatgatgatgattatgctcatcgtttgctggcaaaatatttctctaacaaaaactttaatggaggcaacatatttgatttggaaataacagtaaatgatgaaatcataaagtcaagcagcttgacttgttacaggtcttatgcagatcctgtagtaggttttgaagagcaatccagcaatggatcaactccaccagcagattcccaagctaacatccccaatgggaaacatgtggtgaagaactga

SEQ ID NO: 1694 - DNA, 354 bp, Glycine Max
atggcgccacgcgtatttcttgtgttggggatgttgctgatggtgtgccttgttaaggtttcgtctgatccaaagagagaagaagaaatactggaagaagaactacattttcccgataacgagccacttattgtgagagacgggaacagaaggctaatgcaagacatagattgtggtgggttgtgcaagacgaggtgcagtgcacattcgagacccaacttgtgcactagggcgtgtggcacgtgctgtgtgaggtgtaagtgtgtcccacctggcacatctggaaatagggaactatgtggaacttgctacactgatatgactacccatggcaacaagaccaagtgcccttag

SEQ ID NO: 1695 - DNA, 2445 bp, Glycine Max
atggcggatccaacctcatctaaccctgataaggatcaatcctctacggaaccgaaaagtgaaaagaaggattattccacagcaatattagaacgcaagaagtctcctaaccgacttgttgttgatgaagcaattaatgatgaaaattctgtggttactttgcaccctgaaacaatggagaagcttcagtttttccggggtgacactgttctgataaagggaaagaagcgaagggacacaatttgtgttgttcttgctgatgaacaatgtgatgaaccaaaaataagaatgaataaggttgttcgggctaatcttagagtgagacttggagatgttgtctctgtccatcaatgtcccgatgtaaagtacgggaaacgagttcacatccttccaattgatgacaccattgagggtgtaactggcaacttgtttgatgcatatctgaagccttactttatggagtcataccggccagtgaggaaaggtgacttgttccttgttcggggtgggatgcgcagcattgaattcaagctaatagagactgaccctggtgaatactgtgttgtggcacctgatactgaaatcttctgcgagggagagccaatcaaacgggaagatgaagaaagactaaatgatgttggctatgatgatgttggtggtgttagaaaacaaatggctcaaattcgtgagctggtagaacttccacttagacatcctcagctcttcaaatcaattggagttaagcccccaaaaggaatcttgctttatggaccacctggttcaggaaagactctgattgcgagagcagttgctaatgagactggtgcattcttctttttgattaatggaccagaaatcatgtcgaagctggccggtgagagtgaaagcaatctgaggaaggcatttgaagaagctgaaaagaattccccttctatcatttttattgatgaattagactcgattgctccaaagagagaaaagacacatggtgaagtggagaggcgtatcgtttcacaacttttgactcttatggatggcctcaagacccgatcacatgttatcgttattggagccacaaataggcctaatagtattgatcctgctttgagaaggtttggaaggtttgatcgtgagattgacattggtgtaccggatgaagttggaaggttggaggttcttagaattcatacaaagaacatgaaactttcagacaatgttgatcttgaaaaagttgccagagacacccatggttatgttggagcagatcttgctgctctttgcacagaggctgcattacagtgtatccgggagaaaatggatgtgattgacttagaggatgaaacaatcgatgctgaggtgttgaattccatggctgtgactaatgaacactttcaaactgctttaagttcttcaaacccatctgctctgcgtgaaacagttgtggaggttccaaatgtttcctgggatgatattggaggcttagagaatgtcaagagggagcttcaggagactgttcaatacccagtggaacatcctgagaagtttgagaaatttggcatgtcaccttccaaaggtgttctcttttatggacctcctggctgtggtaaaaccctgcttgcaaaagcaattgctaatgagtgccaggccaactttataagtgttaagggacctgagttgctgacaatgtggtttggtgaaagtgaggcaaatgttcgcgagatatttgacaaggctcggcagtcagctccatgtgtgcttttcttcgacgaacttgactctattgcaactcaacgaggcagttctgtaggggacgctggtggtgctgccgatagggtgttgaaccaactcttaacagaaatggatggtatgacagctaagaaaacagttttcatcataggggcaacaaacagaccagacattatagaccctgcattgctcaggcccggacgtctggatcaattgatttacatccctttaccggatgaaagttcacgtcttcaaatcttcaaggcatgcttgaggaagtcaccaatctcaaaggatgttgacctatcagctcttgcccgttttactcatggattcagtggtgcagacattacagaaatttgtcaacgagcgtgcaaatatgccattagggaagatattgaaaagggtattgagaaggagagaagaaaaagagagaatcctgaagccatggaagaagatgacactgatgaggtccctgagataaagcctgcccactttgaggagtctatgaagtttgctcgccggagtgtcagcgacgcagacataaggaaataccaactctttgctcagaccttgcaacagtctcggggatttggatctgagtttcggtttccagatcaaaatgagaacactgcagcaggtgcctcagaccctttctcatctgttacagctgagggagatgatgatttgtacagttag

SEQ ID NO: 1696 - DNA, 700 bp, Glycine Max
atggcgggaacgggaatgggaagaggaagcgattcgcagaaacaactgtggagccttatccgtaatttcgctgctgagaaatctcaaggagaacgaagagtggtgaatctgagaaagcaaatcgagaagcttaaatctgagctgagcgaggccaatgcggagcttgaaaatgcgaagcgctgcaaagaactcgtcgaacaggatcttaaaggcttcgaagttcaattgatgttgactgaatcttccgctcaaacgctagaggcgagagtatctctaattcaaaaccacatctctgccgtcggatctgatttggaaactctcaagagtgaagaagcagatttgcgtgagcaattcttccacaacatgcttcatatgaatggcaagataagtaaatgcaggaaatttcaagagagcattattacttgcgacattgattcaacagcttccacagatgcatcacaagtaacaatgaaagagaatgatgctgaagtagctataatggctcttgaaagtacacttttagaggtagtatctcaaattgctaaagaggatgaggaataccaagcagaacaaaaaaattatgagaatgttcagcagcaattgattgattgtgaaaaaaaggtgtctttaatgagcatgatagtcatggaaacaaaagaattgcaggatttgaccttatatccttacaaatatttaacta

SEQ ID NO: 1697 - DNA, 639 bp, Glycine Max
atggcgggttcaagatctatagtgagttttggagatgttcaaggagggaaggggtgcaatgactcgttcttcagttcctacgatgagcatggggatcatgaggacatggacgagtacttccaccagccagagaagaagcgcaggctctcggtagagcaagtgcggtttcttgagaagagctttgatgaggagaacaagctcgaacctgagaggaagattcggctagccaaggaactcggcttgcagccgaggcaggtggcgatttgcaccctgcaggctagctacaatgatctcaaggccaattatgacaaccttctcagggaaaaggttaagctcaaagctgaggtggcaaggctcactgagaaggtgcttggaagaaagaaaaatgaggggaacttggaacaggctgaaaccaacggattgcaggagccactgcagaagtctttggctgattcagcctcagagggtgaagggtccaaagtgtctattggggcttgtaaacaggaggacattaattcagccaagagtgacatatttgattcatcagaaagcccacattgcactgatggaatccactctgcacttctagagacaggaggatcaagccatttggtcttggccttactgaattttctgtag

SEQ ID NO: 1698 - DNA, 585 bp, Glycine Max
atggcggtccctgctacatcctcagcccctgtccttcgacccatccgcaccaatcactccttctcttcccctttccgctctctcccctctcccgccgccagaaaacccctaaccgtcttcgccatggcccccaaaaagaaggtgaacaagtacaatgataagtggaagaaggagtggtttggagcggggatattctacgagggaagcgaggaggtggaggtggacgtgttcaagaagatagagaagaggaaggttttgagcaacgtggagaaagctggcttgctctccaaggcagaggacttgggattcacgctctcttccatagagaagctcggcgtcttctccaaagccgaggagctcggcttgctcagcttgctcgaccgagccgccagcttctccccctccctcctcgcctccgccgccctccccgccttcgtcgctgccattgccgccattgtgctcattcccgacgactctgccaccctcgtcgccgtccaggctgttgttgctgccgcgctcggcgtcggagccgtcgggcttttcgttggctccgtcgtgctcggcggcttgcaagaggctgattga

SEQ ID NO: 1699 - DNA, 585 bp, Glycine Max; identical to SEQ ID NO: 1698

SEQ ID NO: 1700 - DNA, 1899 bp, Glycine Max
atggcggtggcgggtgtgtcccaagccatctcctccaccaccgccaccagaaccccctcttgcatcgatttccactccaaaaaacctttccttttgggcctggcccactctccccagcccaacctctcaatctccgccagaaggagccgcaacacccactgttgccgctgcaccctcaattccgacgacacctctctcagctgggattggaaccgatggtgccgccacttctccgacattgaacaggccgaaaactttgcctctgtcctcaagtttcaacttgatgatgctattgagaaggaggactttgaagaagcggttaagttgaacagggctctatcagaagcaacgtccaaggacactgttgctgaaattatggatcagttgaagagtgctatagatgatgaacggtatcatgatgcttcgagattgtgtaaatgcactggaagtggactggtgggttggtgggtagggtactcaaaagcctcagatgacccctttggtagaattatacatataagtcctggtatgggtagattcattggcaagagttacagtcctagacagttgatgcgagcatctacggggactccaatttttgaaatttatgtggtaaaaaatgctgatgacacgtatcatatgcaggtagtgtatttacgacaagccaaaggaaagtcaaggagaaaccctcaatctatacctgctaaaggcccatccaaacctgaggtggagaatgcatcttcagttgaggtgcaagaacctgaagagaagattgagagaaatgatgagaaaaacagtaatatcgagggagtaactgaggagggcattaaaagtgtcataaattttcttaaagaaaaaattccaggattgaaagtcaaagttatgaatgttaacgttgaagaggaagcagcagaaaacaatgattctattaagcaattgatggaggaagatagtaatgaatctggctccagtgagaatcacgaagaggaagttaataatctagatgaacctgatgcggtcactctagaaagagatggagatgtcacagaagaagaaaaggattttgaaatgaagctttttattggtggggttgtacacaataatgaagatactcctgtcaaggatgaatttatacgtcttccagctgaaataaaaaatattgaaaaggattcttttgtctttcattttgctagtggaaatgtagattatggtatcaaagaagataaaattcccaacatcaaagtagcagccctagcagcacaaggaatctccgagcttatgcctcctgatgttgctaatgcattttggagttctgacaaagtctcttctaaggtctccaaaagcatgcgtgatattgtcagagttgctatgagtcaagcacagaaaagaacaagattatctggggatacaaattttagccggattatctgttcaagaggggattctgatccttttgatggactctatgttggtgcatttggtccttatggcatggaaatagtgcatttgaggcgaaaatttggacattggaatgaagtgaacaatgaaaacaacacttcagatgttggattctttgaatatgtagaggctgtgaagttaactggggatcttaatgttccagctggccaggtgacattccgtgctaaaattggaagaggcaatcgcaacaccaaccgagggatgtatcctgatgatttaggagtggttgctagttataaaggccagggaagaatagctgactatggttatcgaaatccaaagtgggtcgagggagaactgctccaacttaatggcaagggcatgggaccatacatgaaaggtgcagatcttggtttcctttatgtcgtgcctgagcaaagttttctcgtcttgttccaccggttgaaactacccgagtga

SEQ ID NO: 1701 - DNA, 288 bp, Glycine Max
atggcgttcttcttgaaccaaactagtatcgcttcccattttcgatctcactctcagaagactgaagatttggcttcttttcctcgccgtcgattccacgtcgaaccaggggctcgtgaaaaagctctcttggcagaagatgcaactctgaaaccgttcaaatcgtacaagaagagtgtaaaaaagcttagaaaaattgggaatgcccttacaattgttgttgttgcaggatgctgttacgaagtatatgtcagagcttttacaagagaggaagctcagaaactgtaa

SEQ ID NO: 1702 - DNA, 1575 bp, Glycine Max
atggctaagcttcctaccatgttctctttgaggcactttctggtactctccctcgccttgaacgtcagcctcttactcagattaatgatgcaccaaggtgcacaaaaagctcacaaagaaagaaccaattctgtaactgaggagcaccacaatatccataaatcacgcatggttatatcatcatcatcatcatcgtcatctacttcgtctttcgccaattctacttccaccacaggaggctacaatagagtgatcaacctcgaccattggaaaaataccacagaagttggtggggtcaaatgccctatgtgcacactgcatgaagacactctttcggccatgaccacaacactattattatggaagtgcttctttggttcgctcagtctaatgagttttttacaactttttgccgccccaattgccctgcgtaattggaaatccacctccaacatattttgtccccttcactcttcggctgtgcatggctcccatttattaattggagacccgacagcgtatgagaggttttggcgacaaacgggtgacaagagcacgatcacaatccagggatggcagtctatgagttatttttctgatgtgaccaacatttgctggtttttggaggcagagtttgggagggaagtggtgaggttgcacaatgtggtgggaaatgcagtcacagaagggcgtcacattgttgttggaacaggttcttctcagctctttcttgctgctctttatgctctctccccaactgattcacctgaaccaatcagtgtcgtttgtgccacaccctactactcgtcatatccatcaatgacggatcacttgaaatcagggctttacaaatggggtggtgatgcagaaagttatgagaaagagggtccctacattgagctggttacttctcccaataatcctgatggacacgtaagaagatctaaggtcaacagaagccagggatttttggtccatgaccttgcctattactggccacagtacactccaatatcagcacctgcagatcacgatcttacgcttttcactgtctcaaaaagcactggccatgcaggaatgcgcatagggtgggctcttgtgaaagaccaagaggtagcaaagaaaatgactaaattcatagagctcaatacaattggagtgtctaaggattcccaactcagggctgctaaggtcttaagggcagtttctgatagctgggaactaggaaactccaaagagagcgagtcattcttcaaattcagccacaaactcatggccaacaggtggaagcaattgagactagttgtggagagtagcgagttgttcagtttgcccaaattttctccagcattctgcaccttcttcaatcaggtcttggagcctcaaccagcttttgtatggttaaagtgtgaggggaacgtggaagactgcgaaagcttccttcgaggacacaacatcttaacgagaagtggaacacactttggggttagcccaaaatacgtaagaattagcatgttggatactgacgaaaattttaaccagtttctagatagactctctgccataatgtcgtga

SEQ ID NO: 1703 - DNA, 1773 bp, Glycine Max
atggctaatcgatcattttctcaatttgttgagcaagaaatggggaagttcacacactttgtgatctatgtgttgcttgaatgggtgctgatattcatactcttccttgatgggtttctggcatttttggccaatgagtttgccagattctttgaattgcacatcccttgctggctgtgcaccaggtttgatcatgttatggttcacagaaatcctgatttctattacaacgagtccgtgtgtgaggctcacaagaaggacatgtcgtctttggcattttgtcacaaccacaagaagctttctgacataaggaagatgtgtgaggggtgcctgctttcatttgcaactgagaaagaatcggattgcgacacctacaagtcccttgtggggattttgcataaggatttggagtgctttgttcaggatgaccaaccaattcagttgagtttgaaggatgatggggtcatgcaggttgatagaagcagcaaccagaagtgttcatgctgtggagagccattgaaaatgaagtcttcttctaattctaatataaaagtgaagcactcgtcatcatttgcgcgagccccaactccttcaccgagagcttttccattttcaacatcaaaaagtgaggaacctaatggtctagaattgcatcacatcaggtacaaagaactcaaatttatgtcggatccggagcttcaagaggatgagtttggcttcaatgttaatagtccgattgttaaatcaagcggagacaccaaatctacctctttgcctctattgggagaagttgaagatttgaacgatgagtccagcaaattcaccccaacttttacaaggggcaataagttctttggaatcccactcaccgattctgcaaacaacagtcccagatggacttacaggattaacaggaaatcaccactggaaaagacagaattttcctctgactctaatgatgtaaatccccaaactgattttgatgatgccatcttaaacaatttgaagaggcaagttcgtttggatcgcaaatcactcatggctttgtacatggagctggatgaagaaagaagtgcttcagctgttgctgccaacaatgcaatggccatgatcacccggttacaggccgagaaggcagcggtgcaaatggaggctttgcagtatcagagaatgatggaggagcaggctgagtatgatgaagaagccctacaagcatctaatgatatgcttctcaaacgagaggaagatctcaaagctttagaagctgaattggagatttatagaaaaaaatatggaagcttagcagaagaaaatacttttagtagggaatctaactcatctattggtgataatagctcttcattcaagctcaatgaaggggaaggtaatgcagaaaaaggcctcaattctaatcaagttgtatcatctcaggcagaaaatggagggaaaacatatcttcttggccggatgaagaaaacagaaaatagaacacccttagcagaaagtggaatttattccttactgtctagctctgacagtgttaataatttagacagcgagacaggaaaaggaggtgaagcctttctaccaaaagaactgtctttccttactgaaagggtgaaggctctgaaagccaacagtcggttcttagagcttgtttccattagagatgagaaagatagtgaaggaaccaaaattttatcagagatatcacagaatctagagaaactcagccaccttgttatgacctcatttgaggtagcgaatgcatga

SEQ ID NO: 1704 - DNA, 660 bp, Glycine Max
atggctctgagattcgcagcagctgcttctgcttctgtctcacgaatatcaaggccacaaaacccaccattcttttcacttcaacaccgcaacaacggtactctcaaattccatagcccaccttttcatcatccacttcccacaccctcaaaacgctgcaacgttcgagccataagcgaggtagctgtggaacctgaaatttcaaagaaagaacaaaatgagtcacctaaagattggaagattaaaatgctctatgacggagattgccccctctgcatgcgcgaggtgaatatgctaagagagaggaataagagttacggcacaatcaagtttgttgatataggttctgatgaatactctcccgaggagaatcaaggccttgattatgaaactgttatgggaagaattcatgctattctctcagatggaactgtggctacagatgttgaagcatttaggagattatatgaacatgttggtcttggttgggtttatgccattacaaaatatgaaccaattgcaaaaattgctgattccttatatggtgtttgggctaaatatcgtcttcaaattacaggacgacctcctatagaagaaatattagaagcacgaaagaataagggtgaagtatgcaaagacagcgatgcttgcaagatgtaa

SEQ ID NO: 1705 - DNA, 807 bp, Glycine Max
atggctgaatcagcaaactcaatccacaacagtggccagaaaaagttagccggcaaagttgccataatcaccggcggagccagcggcatcggcgaagagacggcgcgtctgtttgctcaccatggtgcacgaatggttgtgattgcagacatccaagatgacctgggtatccaagtagcagcatccattggctctcacaggtgcagctatgtccgttgtgacgtgacagacgaagaccaagtcaaaaacctcgtggattccacggtcaacgctcacggccagctggacatcatgttcagcaacgcgggcatcctcagtccctccgaccagacaatcctcgacctcgacttctccgcgtacgaccgtctcctcgccgtgaacgcgcggggcacggcagcgtgcgtgaagcacgcagcgcggtcgatggtggagcggcgcgtgaggggcagcattgtgtgcacggcgagcgtgtcagcgtcgcacggcggcctgcggcgaaccgactacgtgatgtcgaagcacgcggtgaaggggctcatgcgcgcggccagcgcgcagcttggagcgcatggtgttagggtgaactgcgtctcgccgagtgggttgaccacgccgctgacacgtgccgcgcatgccgcgatggagacgaaggagttgcagaagcagtacgcgcagagctctaggttgaaaggtgtctttttgacgccgaagcatgtcgcggatgcggtgctgtttcttgcgtgcggtgactccgagtttgtaaccggacacgatcttgtggtggacggttgttttgacggtgtttag

SEQ ID NO: 1706 - DNA, 639 bp, Glycine Max
atggctgctgcaactgccccaagattcatcaagtgtgtgaccgttggcgatggagctgtagggaagacctgcatgctcatttgctataccagcaacaaattccccacggactatatccccactgtgtttgataatttcagtgcaaatgtggttgttgaaggcataactgtcaatttaggcctttgggatacagctgggcaagaggattacaacaggctgaggcccttgagctacaggggggcagatgtctttgtcttggctttttctttagttagtcgcgcaagctatgagaatgtgctgaagaagtggatccctgaactccagcattttgcccctggcatcccattggtattagttggcacaaaattggatctgcgcgaagacaggcactatatggctgatcatcctggcttggtgcccgtgactactgagcaaggtgaggaactccgtaaacatattggagctacctactatattgagtgcagctcaaaaactcagcagaatgtgaaggcagtttttgatgctgcgatcagaatggtcatcaagcctccacaaaagcaaaacgagaaaaggaagaaaaaaccacgtggctgtttcctaaatgtcctctgtggaaggaacattgttcgtcttaagtga

SEQ ID NO: 1707 - DNA, 510 bp, Glycine Max
atggctgctgcaactgccccaagattcatcaagtgtgtgaccgttggcgatggagctgtagggaagacctgcatgctcatttgctataccagcaacaaattccccacggactatatccccactgtgtttgataatttcagtgcaaatgtggttgttgaaggcataactgtcaatttaggcctttgggatacagctgggcaagaggattacaacaggctgaggcccttgagctacaggggggcagatgtctttgtcttggctttttctttagttagtcgcgcaagctatgagaatgtgctgaagaagtggatccctgaactccagcattttgcccctggcatcccattggtattagttggcacaaaattggatctgcgcgaagacaggcactatatggctgatcatcctggcttggtgcccgtgactactgagcaagtacaaatctcccttcattatgtgtatagagttcaacacgcattaattttaaaactgttggtcttttgttcataa

SEQ ID NO: 1708 - DNA, 1839 bp, Glycine Max
atggctggagggttgcttggagataaccttggattgaaggaagatgtgatcaagagggtgtgtggtttggcctccaaagctcacaatcacaagtcaacggacaagctctacttttacgataaggttcggacttcttcggggacataccatgttttcagcttctcgggatcttgggatcccgctgaatggttttttagcaaaccctttggcggatccaagatagatcctacccaatttccttcactcagaagtattggtaacgatgaacctgctttggtgaacgaaggcttcgcaaagagattcgatcgcgtattgaaaactagctttaaagccgaggtgaataaggctattggagatgggaagcaagtagtgtttacggggcactcctctggtgctgcaatagccattcttgctaccttttgggcattggaagagtatcttaaccctacaaaaatccaaaaacccacgccacccttttgtgtcacttttgggtctcccttaattggcaatcatatattctctcacgcttcaaggagagaaaattggtctcgctatttcatacactttgttttgagatatgacatagtgccaaggattttgctttctcgcttggcttctattaagcaaacttttggttctgttctccaattcttgaatcccaattccaaaacttccacccaggatccaacaagggctagtttaatttctgaattttacaaaactgtgatgacaaacgcagcgagtgttacaagccatgctgcgtgtattctcatgggaagcacaagtttgttacttgggacagtggcgaattttgttgagttgagcccttataggccctttggaacatttattttctgcaacggaaatggacaattgattgtggtgaaaaactcagatgctgttttgcaactcttgttccacactgctcagatgagcgatttggcagaacttccagaagttgccaatgttagcatattgcaacaccaggcctatgaggctgaattggatgatagcttgggaatgcagaatgtagtgtacttggagcaactagagcaacttccgttgtctgctgatggttctaatagcgatgttgcaacaatcagtgcagccttggatggccttggactgagcacaagagcaaggctgtgtctacgagcagctggtgagttggaaaagcagaagctaaaaaatgaggagaaaatcaagaaggagattcaggagaaagccgtgccaagcatgacgaagcttcaaaattacaaaacaacatgtgagatgcacaaggggaagggctattacgatgccttcaaggtgcaaaatgaggaaaacgacttccaagcaaatgtgaagaggcttgtgttagcaggggtatgggatgaagtgattgagatgctaaagaggtatgaactcccagacgagtttgaagggaattcaaaatggattgaacatggaactgaatttcgtcgccttgtggagcctctagacattgcaaactatcaccgccacttgaagaatgaggacacaggaccttacatgataagggccaggccaaaacggtataggtacactcaaagatggttggagcatgctaaaagggtgccaaaacctgctcctatcactgaatcaaccttttgggctgaagtagaagagctttatagctggattaacagcaagaggcatcttgatgatgaagtaaagcaaagggttgtgcagcttcagaaagaccttaaaaagtggactgatgatgagaaggtactaaccaaggatacgttcttgaaggatcctaactttattaggtggtgggatattctacctcaggaactcagggtcacttccttctag

SEQ ID NO: 1709 - DNA, 1065 bp, Glycine Max
atggcttcccctactcatttcgacgatgacttcgatttcggaggcggatttggcggaaggcattcaggtaataagaggtcgtctcccgattacgacgacgaggattatgacaacgatccttttgcaccgaagaaggctataacaaaagctgaagaagcttctggtgtaacaacaggaatgatcttgtcacttcgtgagagtctccagaactgtaaggatacacttgcaacatgccaaaatgaacttgaggctgcaaaatcagagattcagagttggcattctacacttaaaaatcagccatccatacttgccgggatcactccagagcccaagatgttgattaattatctgcaggccttgaaatcctctgaagagtctttaagagagcagcttgaaaaggcaaagaaaaaggaagctgcattcattgtaacatttgcaaaacgagaacaagagatagcagagttgaagtctgcggtgcgagatctgaaagtgcaactcaagccaccatcaatgcaggctaggaggttgttactagatccagctgttcatgaagagttcacgcgtttaaagaacttagttgaggaaaaggataaaaaagtaaaggagttgcaagataacattgctgctgtaagttttactccccaaagcaagatggggaagatgctgatggctaaatgtagaaccctgcaagaggaaaatgaagagattggaaatcaagcgtctgaggggaagatgcatgaattagggatgaaacttgcattgcagaagtcccaaaattcacaacttagaaatcaatttgaagggttgcagaagcacatggaaggactgacaaatgatgtggaaagatccaatgaaatggttcttatgttacaagaaaaattagaagagaaggatcggcagatacagagactaaaacatgagattaaacagaagaacttggaggatcaaagactaaaacatgagcttcaacagaaaaacttggaggatcaaagactaaaacatgaacttcaacagaagaacttggaggatggaaatgacaataatgccggggaggctgctaactaa

SEQ ID NO: 1710 - DNA, 615 bp, Glycine Max
atggcttctgccggcgatgttttcaggcagggtttgccggaagtttgtgctgccgggaagttacacgtgcttgctgttgatgacagccacgtggaccgcaaggtcattgaacggttgctcaaaatctcgtcttgcaaagtgacggtggtggagagtggaagcagggctctgcagtatctggggttggatggagaaaaaagttccattggtcttgatagtgtgaaggttaatttgataatgacggattattccatgcccgggatgacaggatatgaattgctcaagaagataaaggagtcatctgtttttagagaggttccagtggtggttatgtcgtctgagaatatcttgaccagaattgatagttgcttggaggaaggagcagaggagtttctgttgaaacctgtcaagttgtcagatgtaaaacgcgtaacagatttcataatgagaggtgaagggatgaaaggagtaaaaatatctaaaaaaagaagccgatcagatgattgcattccatctctatcaactgcattctcatcagtttctcatccctgtgatatatcatcacctccatcgccatgtgtattgcaaccgaagaaatctagattgagcatatag

SEQ ID NO: 1711 - DNA, 1605 bp, Glycine Max
atgggaaactgcaacgcctgtgcgaaagctgataaagagcagaaccagaaaaaaccgaacccgttctcagacgaaccggcccggtcggcggctccgatccgggtcttgaaggacgtgattccaatgagccaccggacgcgcataagcgacaagtacatactgggccgggaactgggccggggcgagttcggcatcacctacctctgcacggaccgcgagaccaaggaggccctggcctgcaagtcgatttccaagcggaagctccgaaccgccgtggacatcgaagacgtgcgccgcgaggtcgccatcatgtccacgctgccggagcaccccaacatagtgaagctgaaggcaacctacgaggacaacgagaacgtccacctcgtcatggagctctgcgagggaggcgagctcttcgaccggattgtcgcccgcggtcactacagcgagcgcgccgccgcttccgtggcacgcaccatcgccgaggttgtcaggatgtgccacagcaatggggtcatgcacagggacctcaagcccgagaatttcctcttcgctaacaagaaagagaattccgctctcaaggccatcgatttcggcctctccgtcttcttcaagccaggggagaggtttgtggagattgttgggagtccttactatatggcgccagaggttttgaagcggaattacgggccggaggttgatgtgtggagtgctggggtgattctttatattttgttgtgtggtgttcctccgttttgggcagagaccgagcaaggtgtggctttggcgatcttaagaggtgtgattgacttcaagagggaaccttggccacagatatcggagagtgccaagagccttgtgcggcgaatgttggagccggatcctaaaaagcgcttgacagcggaacaggtgcttgaacatccctggctgcaaaatgcaaagaaagctccaaatgttccattaggagatattgtgaggtcaaggcttaagcagttttctgtgatgaatagattcaaaaagaaagctctgcgggtaattgcagaacatttatctgttgaagaggtagaaataatcaaagacatgtttacattgatggatactgacaaagatggcagagtaacatttgaggaactgaaggctgggttgaggaaggttggttcacaattggctgagccggagattaagatgctgatggaagtggctgatgttgatgggaatggagtacttgactatggagagtttgtagctgttacaattcacttgcaaaaaatggagaatgatgagcatttccacaaagcattcaagttttttgacaaagatgggagtgggtatattgagttaggtgagctagaggaagcattagcagatgagtcaggagaaactgatgctgatgtattgaatgacatcatgcgggaagttgacactgacaaggatggttgcatcagttatgaggagtttgtggcaatgatgaaaactggaactgactggagaaaagcatccaggcaatattcaagggagagattcaagagtttgagcctaaatttgatgaaagatggctcgcttcagcttcatgatgaaattactggtcaagctgtggtggtttga

SEQ ID NO: 1712 - DNA, 522 bp, Glycine Max
atgggaaattgccaagccatcgatgcagcaacactagtgattcagcatacaaatgggaaagtagacaagttctatgcacctttgagtgccacacatgtcatgaaaaccaaccctggtcactacgttgctcttctcatctccaccacattgtgtccaaccaaagacattcaaaattgctccaacgccaacaacccggttcgaataactcgaatcaagcttctcaagcccactgatactcttgttcttggccaagtttatagactcatcacaactcaagaggtaatgaagggattgagggaaaagcaaaaggcaaagatgaggcaaaacgtgccagagtcagctctcaagctagaattggagaaggagaaagtagcaaggaggtctgaaatggaggacaataaggcaattaccaatcctgaaagagctcgaccaaggataacagcaacaactaataatggtgccactgctaagacaagattttggcaaccctctttacaaagtatctcagaggctgccagctga

SEQ ID NO: 1713 - DNA, 207 bp, Glycine Max
atgggatccaacggaacatcttgggctgaccagtgggataacgggcctgacccagtgactgtctccaacgaatcgaagaaaaagaataacgccctcggcaagaccaaggcagtggcttccactggcgtcaagaagttgaaggagggtacctccgttggcttccaatggatcaagaccaagtaccacaaaactacccagaaacattaa

SEQ ID NO: 1714 - DNA, 1056 bp, Glycine Max
atgggcatggactactacaacatactcaaagtgaatcgcaacgccagcgacgacgatttgaagaaggcttacaagagactcgcgcgtatatggcaccccgacaagaatcccgtcaacaacaccgaagcggaggccaaattcaaacgaatctccgaagcctacgacgttctcagcgacccgcagaagcgccagatctacgatctctacggcgaagaggcactcaaatctgggcagtttccgccgccgcactcctcctcctcctcgtcgtcctcgcgcgccttccaccaccgtcagaacaacaacaacaacaacaacaacaacaacaacaacaaaaacaacagcaaccctcccccggccgcctcgtcgttccgattcaacccgcgcgatgccgacgacatttacgccgagtttttcggcccggaggacatcggcgccggcggccccgacgccttcttccggacctccaacggcggtggcgcgttcggcgcctccgctgcggcgggacggaaggctgccgcggtggagaacgcgctcccgtgcagcttggaggacctctacaaaggcgtcaagaagaagatgaagatttccaggaacgtctacgatgcctttggcaaatgtcggaacatggaggagattttgactattgagataaaacctggctggaagaaaggaacaaagattaccttcccagagaaaggtaaccatgagccaggtgtcatcccagcagatcttatttttgtgatagatgagaaaccgcatgctctttatagaagggatggtaatgatttggtgatcaaccaagagataacccttcttgaggcccttactggtaaaacattggatctcaccaccttggacggaaggagtctcatgatcccattgacagatattgtcagacctggtgctgaggttgttgtccctaatgaaggaatgcctatatcaaaagagcctgggaggaaggggaatttgagaattaagctcgacgtcaagtatccttcaaggctaactccagagcagaagtctgatctgagaagagttttaggtggaatctcataa

SEQ ID NO: 1715 - DNA, 2067 bp, Glycine Max
atgggccctacagaagttgtgtatttatctagtgatgatgaaagtgaaaaggaagttgctttcaaagctgttaagttggaggaagattttgttttggatgcaaaacaatataatgagactaacaaaggtcaactagccaagcacaagagatctcaaagtcatactactggacaagattctgaagaaaatttaagttctaatggtccaagtacaggtcatagtaactccagtgtgttggagcagggaccgtcgcctgttgatgacacaggcatttcttatgcatcatccattggtgtagcacccctgtgtaggcagttttggaaagctggaaactatgatgatggacttggttctaaagtcaccgtccaaaatgccaaaaattatctacatgtgcaccccatgttccttcactcaaatgcaacttcgcataagtgggcatttggtgccatagcagagcttcttgataatgcagttgatgagatccaaaatggggctacctttgtcattgtagataaaacttcaaatccaagggatggaaatccagcattgttgattcaagatgatggtggtggaatggatccggatgcaatgcgtcgttgcatgagttttggattttcagataagaagtcacagtttgctattggacggtatggaaatggcttcaagaccagtagtatgaggcttggtgcagatgtcatagtcttcagttgccatctaaataataggattttgactcaaagcattggacttctgtcatatacatatttgataaaaacacagcttgacagaatagtagtacccatggtgaattatgagtttgatacatcaactggatcattgaaaatattaaatggcaatgagcattttgtgtctaatttatccttgctgttgcgttggtcaccatattcatcagaagcagatcttctgaaacaatttgatgacattggatctcatggtactaaagttattatctataatttgtggtgcaatgatgatgcaaatttggagctagactttgatacagatcctacggatattcgtattgctggggatgtcaagcagattgatacacttaaagcctggaaaagtgtaaatgaggagcacattgctaatcggcttcgttactctttacatgtatatatgtccatattatacttgaagataccagaaagttttcaaatgatattgcgagggcaagttgtgaagccacacaacattgctgatgatcttaagttccctcaatttgttaaatatgcaccagtaattggtggatccgtaaagggaacagctttgacagtcacaacaattggatttcttaaggaagctcctcaagtcaatatccatggtttcaatgtatatcacaaaaatcggcttatactgccattttggcaggttgtaagctatttggacagtaggggaagaggagttgttggaatcctgcaagcagattttattgagccaactcataacaaacaagattttgagagaacttccctgtttcaaaagcttgaagggcgattgaaggagatgacatgggaatactgggacacacattgtacattgtttgggtataaggataaggacaagaagaagcttccaccgagggttacgtcaatgcagaaaccacttgctatagaaaaaccggtcatgctgaacagaagttgctcccctgttgtcaatacaaaaatagaatatgggaattctgaacagtgttccacaaaactgcaaataagatccgaacaaggttctcataataagaggaagacacatgaactggtagaccttcagaatacggaaaaacatgcaaggacagagaatgtaacctgtgttggtttcagtcagaataaacagatcattgctactccagctgaccaggtgttcgaccgaaagactatgcacttggtgcaacaaaacaagaaactgcatgcaaaatgtttagaatttgaaaagacaggagaagaacttaatctcaaggtgacgatgcttaaaagtgaaatacaagaagctcaagatgagtataaacggcttttggctgaagtgaagtccctagacctgaaagaagagtag

SEQ ID NO: 1716 - DNA, 949 bp, Glycine Max
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatggaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtctcacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaaaggttcccatagaaaaacaaaactgtcacaagcgaaggagatccgagtatggagggagttcaagcgctgttgggatcaacaatcaaggcaatgttctggaaaatctttctgttggcattgggactattgctgtgaattttgaaaaaatatccaacatgatggagaaaagagaaaaagatagagatagagagctcgagggtattatttgggatgttataaaagaaattccaaatttggatgacataacgcgtttcaagacagctgaattgttaaatactaaagcaaaaaaaggattttttcttgaagatgtcacaggaagaacgctcatcttggata

SEQ ID NO: 1717 - DNA, 1416 bp, Glycine Max
atgggtcccatcaacataaagggtgaaatagagagagtgaatgggaaggaactgagttacagtgaatttgtgaagagatatatggagaagaaccagccagtggtgctcactggcctaatggaccctcattattggaggtcttccactgattgggtcacccttcagggccaacccaactttcaatatttctccactcactttggtgcttctaaagttcaggttgctgattgtgacaccagagaattcactgatcagaaaagagaggagatgatggtatcagattttatagcacgtgttataatgaaaatagttcaagtaatggattggcattttgtaaaggagtatcctgaatatgtagcgtacgtcactccaatgttcttttgtgatgactggctcaacctgtatctggacaacttcagaatacatattgattctgacacacaacaaccagataaggaaatatgttgctctgactatcgatttgtttacatgggggtgaaaggatcttggactcctcttcatgctgatgttttcaggtcctatagctggtcaggaaatgtctgtggaaagaagagatggctttttctagatccttcccagtgtcatcttgtatttgacaggaatatgaaaaattgtgtatataatatctttgatgaagtatcaaactcaaagtttcctggttttagcgaggctatctggttagaatgcacacaaaatgcaggtgaaattatatttgttccaagtggatggtatcatcaagttcataatttggaggatacaatatctataaaccacaattggttcaatgcctataacctttcttgggtgtggaatttacttttaagggactacaatgaggccaaggaatacatagaagacatcaaggatatatgtgatgattttgaaggtctctgccagcgcaatcttgctgctaacacagggatgaatttttatgacttctttactttcatctcgtactttgccttggccaacttggtgttgcttcgttatatgaataggagatatggaaatggcactggaagttcatcaacaatatctcagcatttttccatgaatcttgggtgtttaaggaagattgcatcagagatgaaaagcatgcatgctctagaaggaaatcatgattatgttgtggatatgattgaagcatttgaagatcctaggttttccaaattatgcatgcatgtaggaagaacatatataatgatacaagagcaatcttacttgtccttggattttgagtgcacttcaatgtgtgatttggtggacctcaatgatatgaaatcatacacatctcagatctacacacctgaagatctcattaaatttatagacaatggtgttgcagaactgggtgactgtttcattgaggagcaacctatactccatgttgcttga

SEQ ID NO: 1718 - DNA, 1080 bp, Glycine Max
atgggtcgccattcctgttgtttaaagcaaaaactaaggaaaggcttatggtcccccgaagaagatgagaagcttttcaactacataaccagatttggcgttggctgctggagctccgttcccaaacaagccggactccaaaggtgtggaaagagttgcagattgagatggataaactatttgaggcctgatttgaagagaggaatgttctctcaacaagaggaggatcttataattagtcttcatgaagttctaggaaataggtgggctcaaattgcagctcaattaccagggagaacagataatgagattaagaacttttggaattcatgtttgaagaagaagctaatgaagcaagggattgaccctgcaacacacaagcctctcctcagtgctcaagaacacataattataaaggaagagaaggaaaccattttggagacaccaccacctatgttattaccaatgtctcaagggattttagcttcctcacaagagtcaccacttgtagtgaacaattcaagttactgtgatggtggattaaatgtaacagaagctgcttcaagggaagttttcatgagcaagaatgctgctttagaccctttgtcctactttgaattccaaatgggttacaacccaataagacaatttgatcagaaccatgtggggaccaactcaagctatggattctcctcattgccgtgtctgaatagttcttctgatcacgggaacgtgtcggtggcggcggagttttcagataacaactcagcttcaaaaatcagttctttgatgaaggaaagttccagcaatagctcaagtatgagtgtttatccagctgggggagggtgtcaaatgatggaaaatgcagggttctcatgggatggtgagaacaataatactaagatcgatcctttgttacagttccatgtcaatgtgctaaaatctgaagagttcaagacaagttcgtggcaagaagagcagattctgactcagaatttgatagatttcactaactatccgttaatgtcactgtctgaggatctaaccggagcaaattttgatgtgttccagcagatgtga

SEQ ID NO: 1719 - DNA, 2871 bp, Glycine Max
atgggtgacaagtctcaagtattggaggctgtgttgaaggaagctgtagatttggagaacattcccattgaggaggtttttgagaatctgagatgtagcaaagagggtctcagcagtgaggctgctgaggagaggctggtcatttttggccacaacaagcttgaagagaaaaaggagagcaagttcttgaagttcttggggtttatgtggaatcctctgtcttgggttatggaggctgctgctataatggcaattgcacttgccaatggaggggggaagccccctgattggcaagattttgttggtatcatcaccttgcttctcatcaattcaactatcagtttcattgaggagaacaatgcaggtaatgctgcggcggctctcatggctcggcttgctccgaaagcaaaggtcctccgcgatggtagatggaatgagcaagatgcctcggtcctggttcctggtgacatagttagcattaaacttggtgatattataccggctgatgctcgtcttcttgaaggggatcctttgaaaattgatcagtctgctcttactggtgagtcccttccggtgacaaagggccctggcgatggagtatattctggttctacctgcaagcaaggagagattgaagctgtggtcattgccaccggcgtccataccttctttgggaaagctgctcaccttgttgataccactaatcaagtggggcactttcaaaaggtgttgactgcaattgggaacttctgcatttgttcaattgctgtggggatggttattgagattatcgttatgtatcccatccaagatcgagaatatcgccctggaattgataaccttcttgtgcttcttattggtggaattccaattgccatgcccactgtcctctcagtgactatggccattggttctcataggctatcacagcagggggctatcacaaagagaatgacagctattgaagagatggcaggcatggatgtgctttgcagtgataagactgggaccctaacactaaataagcttactgttgacaaaaatcttattgaggtttttacaaaaggagtggatgcggatactgtggttttgatggcagctcaagcttcaagacttgagaatcaagatgcaatagacactgccatagttggaatgttggctgatccaaaagaggctcgtcttggtatccaagaagtacattttcttcctttcaatcccactgataagaggacagcattgacttatattgatcgtaatgggaaaatgcatagagtaagcaaaggtgctccagaacagatccttaatcttgcacacaataaatcggacattgaacgtagagttcatgcagttatagataagtttgcagagcgtggtttacgatcccttgcagtagcattccaggatgttcctgatggaaggaaagagagtacaggtggcccatggcagtttattggtcttttgcctctgttcgacccacctaggcatgacagtgcagaaacaatacgcagggcactaaaccttggagtgaatgtcaaaatgattacaggggatcagctagctataggaaaggaaaccggccgtcgcttgggaatgggtaccaatatgtatccttcatctgcattgcttgggcaggataaggatgaatccatatctgctttacccattgatgaactaattgaaaaggctgatggatttgctggtgtttttcctgaacacaagtatgagattgtgaaacgcctgcaagctaggaaacatatttgtggaatgaccggtgatggagtgaatgatgcgcctgcactcaagaaggcagacattggtatagctgttgctgatgcaactgatgcagctcggagtgcatctgatattgttttaacagaacctggtcttagtgttattattagtgcagtgttgacaagccgagctatcttccagagaatgaaaaattatacaatttatgctgtctcgattacaattcgtatagtacttggtttcatgttactggctctcatatggaagtttgattttccaccttttatggtgcttattatcgccattctaaatgacggtactatcatgactatttcaaaagatcgagtaaaaccatcacctctgccggatagctggaagctagctgagatatttacaactggtgttgtgcttggaagttacttggcaatgatgacagtcatattcttttgggcagcatacaaaaccaatttcttcccgcgagtatttggagtttctactcttgagaaaactgctcatgatgatttccgaaaactggcctctgcaatctatcttcaagtgagcactattagtcaggccctaatatttgtgactcggtcgcggggttggtcttatgttgaacgtcctggtattttgctagtgacagcttttgtgattgctcagctgattgccactttgattgcagtatatgccaattggagctttgctgcaattgaaggcataggttggggttgggctggtgtaatatggttatataacataatattctacattccacttgaccccatcaagtttttaattcgatatgctttgagcgggagggcttgggagcttgtcatcgagcaaaggattgcattcacaaggcaaaaggactttggaaaggaacaaagggaacttcaatgggcccatgcacaaagaacattgcatggacttcagccacctgacaccaagatgttcaccgagcgcacacatttcaatgaactcaatcaaatggctgaagaagctaaaaggagagccgaaattgcaaggctgcgagaactgcatacactaaaggggcacgtagaatcagttttgaaattgaaggggattgatgtagacacaattcagcaggcatacacagtctga

SEQ ID NO: 1720 - DNA, 1578 bp, Glycine Max
atgggtggcaacggcaagcacaggtggaaattctccttccaccgttcctcatcccaaacctccaatcccgacccgaaccaagttcccaaggagttcacctgccccatttccggctcactaatgtccgaccctgtcgtcgtagcctcgggccaaaccttcgaacgcctcgccgttcaactctgcaaagacctcaacttctccccgaagctggacgacggcacccgacccgacttctccaccataatccccaacctcgccatcaaaacgacgatcctccactggtgcgacaattcccgcacccaacccccgctcccaccggattacgcctccctcgagcgccacgtcagagaagaaaaagaaaaacaagacctaattagggtttccgaaaaggagcttctcaacgcggtggccgacaaccctcctgtcatcttctcccacgccgccaccgagttaggcccccgagtcaatcacttcaactccggatcctcctccgaggaatccgtcatcatccctccgagtccgggaacgccgttgccgttaacgattcgtccaacgtgcttctcttcctcctcctcctcctgcgagatcgaaatcgaaaaccccaacacaccggcatcggaggaggaagaagggatattgaagaaattgaagagtaacgaggtgtttgagcaagaagaaggcgcaatcgcgctgaggaagatcacgaggtgcaaagaggaggctagggtttcgctctgcacgccgcgggtgctgttagcgcttcgtggtttactcgcttcccgatacggcgtcgttcaggtcaacgcagtggcgtctttggtcaacctttctcttgagaagcagaacaagttgaagatcgttaggtcagggtttgtgccgtttttaatcgatgttttgaaggggggattgggtgagtcgcaggagcacgctgcgggcgcactttttagtttggctttggacgatgacaacaagatggcgattggcgttctcggcgcgttgcatccgttgatgcacgcgcttcgtgccgagtccgagcggactcggcacgactcagcgctcgcgctgtatcatttgtcacttgtacagagcaacagattgaaattggttaaactcggggctgtccccacgctcctctcgatggtggtggcggggaatttggcgagccgggtgctgctgattctctgcaacctcgccgtgtgcaccgaggggcgcacggcgatgctggacgccaacgcggtggagattctggtggggttattacgagggaacgagttggactcggaggcgaatcgggagaattgcgtggcggctttgtacgcgctgagtcatagaagcttgaggttcaagggtttggccaaggacgcgagagtggtggaggttttgaaggagatcgaacaaacgggaacggagagggcgagggagagggcgaggaaggtgttgcatatgatgaggactgtgggagatggggacggtgatgagattgacgagttttacgactcggccggattgactcggaatcggtaccgagttggtgctgccaggaataacaacaacctcgtcaacacgaccacgttttag

SEQ ID NO: 1721 - DNA, 1035 bp, Glycine Max
atgggtttatcttctttgcacgtctgcatggattcatcagatcattggttgcagggcacaattcacgaggagtctgggatggattcttcttcttcaccctctggggatatgcttacatgctcaaggcccatgatagagaggaggctaagacccccacatgaccaagctcttaagtgccccaggtgtgactcaacccacaccaagttctgctactacaacaactacagtctttctcagccaaggtacttctgcaagacctgcagaaggtactggacaaaaggaggcactcttcggaacattcctgttggtggtggctgcagaaagaacaaaaaggtctctgccaaaaaatccaatgaccaccaattagttaacaacaataatattaaccaaacacggcccccacaccaccaccaccccaaagaccttcaactctcctccttcccagatgtgcaattttctcacctcagcaacttgcttgggaccaatgcaaaccctagtttcatggagggcaaatatggaattggcatgattgagaaccctaggcctattgacttcatgatggagagcaagctggagggcataattgggagcggcagtagttctagaaattttgatttttttggaaacaatgacatgtctatgggtatggctagtgttgggctgggagatatgaacggtgctactactcatcaaaatgggttgccaccaaatttatatcatcatggtctttcagcatttggtggcatgtctatgtcccttgatcatggcaacaacaacaacagtgataataatggtgctaataggtacttaatggactcttgccagcgtttgatgctgccatatgatgtcagcaatgaggaccataatgcccaaattgatgtgaagccaaaccctaaacagctattgtcccttgaatggcaagaccagggttgctctgatgcgggaaaagactcatttgggtatctcaacggtccaggatcatggactggcatgatgaacggctatggatcttccaccacacaccctttggtctaa

SEQ ID NO: 1722 - DNA, 1248 bp, Glycine Max
atggtagctgcaaatgagagggtcgtcgctgtgatcatggttggaggacccactaaaggtactagattccggccattgtcgttcaacatacccaagccactttttccattagcaggacaacccatggttcatcatccaatttctgcttgtaaaaggattcctaatttggctcagatttatctgcttggtttctacgaggaacgtgaatttgccttatatgtatcttctatctcaaatgagcttaaagtccctgttagatacttgaaggaagataggccacatggttcggcaggtggtctttatcattttagagatctgatcatggaagaggatccgtcacatattttcttgctgaactgtgatgtatgctgcagttttccactgccagatatgctggatgctcacagaagatatggtgggatgggaacaatactagttgtgaaggtttctgcagagtcagcgagcgagttcggggaattagtagctgatccaaccactaatgaactattgcattacacagagaaacctgaaacttttgtaagtgatcgaataaactgcggtgtgtacatatttacacccaatatctttacagccattgagggtgtttctactcaacggaaagacagagctaatctaagacgtgtctccagctttgaagcaatgcagccagacacaaggagtcttccagtcaattatgtcagattggatcaagatatcctctcacctcttgcggggaagaagcagttgtacatttatgaaaccaatgacttttgggaacaaatcaaaactccggggatgtccataaaatgttccggcttgtatcttgcccaatttcgttacacatccccccatttattagcaaatggagatggtattaagaaagccagcatcactggtgatgtttatattcacccatcagcgaaagtgcatccatctgctaagattggtccaagtgtatcaatatctgcaaatgctcgtataggagctggtgcaaggctcaaacattgtatcatccttgatgacgttgaaatcaaggaaaatgctcttgttggtcatgcaattgttggatggaaatcatctattggtcgatgggcctgtgttgaggctagtggagattacaatgcaaagctcggggtcacaatacttggtgaatctgtgactgttgaggatgaggtagtggtttttaatagcattattttgccacataagaccctaaatgtgggtgttcaggatgagattcttttatag

SEQ ID NO: 1723 - DNA, 1107 bp, Glycine Max
atggtagctgcaaatgagagggtcgtcgctgtgatcatggttggaggacccactaaaggtactagattccggccattgtcgttcaacatacccaagccactttttccattagcaggacaacccatggttcatcatccaatttctgcttgtaaaaggattcctaatttggctcagatttatctgcttggtttctacgaggaacgtgaatttgccttatatgtatcttctatctcaaatgagcttaaagtccctgttagatacttgaaggaagataggccacatggttcggcaggtggtctttatcattttagagatctgatcatggaagaggatccgtcacatattttcttgctgaactgtgatgtatgctgcagttttccactgccagatatgctggatgctcacagaagatatggtgggatgggaacaatactagttgtgaaggtttctgcagagtcagcgagcgagttcggggaattagtagctgatccaaccactaatgaactattgcattacacagagaaacctgaaacttttgtaagtgatcgaataaactgcggtgtgtacatatttacacccaatatctttacagccattgagggtgtttctactcaacggaaagacagagctaatctaagacgtgtctccagctttgaagcaatgcagccagacacaaggagtcttccagtcaattatgtcagattggatcaagatatcctctcacctcttgcggggaagaagcagttgtacatttatgaaaccaatgacttttgggaacaaatcaaaactccggggatgtccataaaatgttccggcttgtatcttgcccaatttcgttacacatccccccatttattagcaaatggagatggtattaagaaagccagcatcactggtgatgtttatattcacccatcagcgaaagtgcatccatctgctaagattggtccaagtgtatcaatatctgcaaatgctcgtataggagctggtgcaaggctcaaacattgtatcatccttgatgacgttgaaatcaaggcaggaaaatgctcttgttggtcatgcaattgttggatggaaatcatctattggtcgatgggcctgtgttga

SEQ ID NO: 1724 - DNA, 1845 bp, Glycine Max
atggtccaaaggtccaaagtatccaagcctgaaattccacaggcatgtgaatctccaagtgttgttggtcatgagaatcaagttaagccagtgtcacaaacatcatcagtttcaacatcactagcaccaagacaaaacttgccacaatcacctcagctagcacctccacttcaaccacttccacaatcttcaccaatgattcttgagaacaagaaaactcaaccatcatcaccaccacctcctcctcctcctcctcctcctcctccaactcgccctccgccaccaccacctggtccacctccacttcctaaagccagtggcttcatttcatcactgaaacccccacccgctcccaaagggaaaacaaacataagaagcactaaagagggtatgataggggagagttcaagagagaagggtgttggtcaaacaaggctgaagcctctacattgggataagattgtagcaaatgttgatcattcaacagtgtgggatcagatcaatgatggctctttcaggtttgatgatgaactaattgaatcactctttggatattcaagcagctacaaaacccaagaaagaaacagaacactttccactttggccaagtccaattccaatgcgccaactcaaatattcattcttgagccaagaaaatctcaaaacacagcaattgtgctaagatcacttgccatttctcgcaagggaatcttggaagcagttcttgatggtcagggactaagtgttgagacactagaaaggctcagtaaaatagcccccacccaagaagaggaagccaaaatcatccaattcagtggcaacccggatcagctcgccgatgctgagtctttcctatactacattcttaaatcagttcctacagcattcaaccgtttgaaagccatgcttttcaggtcgagttacgattgcgaagttctgcagctcaaggaacacctacaaacacttgaaatgggttgcaaggagctgagaactagtggcctgtttttgaaactccttgaggccattctcaaagccgggaaccggatgaatgccggaacttcaagaggcaatgcacaaggtttcaacctgagttctcttagaaaactttctgatgtgaaaagcacagatgggaagactagtttgcttcacttcatagtggaacaagtggttcaatcagaaggaaaaagacaagcaatctatcaaaagcacaaacttcacataagcaatggtgaaacaagcaatgtgaatagaccttattcatatagcctcatacaacaagaggcagaaaaagaatatgtaatgcttggtttgcaagtgttgggtgggctaagtgaagagttgtctgaagcaaagaaagcagctagtattgagtatcataatttcatcactatgtgttcaactctcaatgctcatgttagtgaaattagacagattataacttgctgtggcaacactagaagtggcgaatttatcaatgaaatgaaagggttcctagaggaatgtgagggagaacttgaggtggtgaaagaggagcagacaaggatcatggagcttgtgaagaaaacaaacgagtactatctagcaggagcatccaaagacaacatggtaaatccttttcaactgtttgttattgtaaaaagttttgttgacatggtagatcaggcttgcatagaactaaaaaagaaggtagaaaagaagaatattgtgggaggagaggctgtgtcaacaacaccacctttgtcaccatcaaagaggacgccactcagattccctaactttgatttgtattttctgtcaaatgtgtcagaatctacatcttctagccaatcagaagatgatttctga

SEQ ID NO: 1725 - DNA, 198 bp, Glycine Max
atggtgagaaaacaggattggaaagccaagatgagaggaatatacaatagagggtataggaaggagaagctggtgatgtgtcaattcttatgtaaatccataacttattttcttttattcttacttcttttctgtttgggttttttgggtatgaatactacttggcaatgttgctggactggccttgtaaccttgtaa

SEQ ID NO: 1726 - DNA, 768 bp, Glycine Max
atggtgatagtcactgagctgttattaggaggaacattgcgcaagtatttgcttagcatgcgccccaaatgcttggatagacatgttgcgattggttatgcacttgatattgctcgggctatggagtgcctgcattctcatgggatcatccaccgagatcttaaacctgataacttgctattgactgaagaccagaaaacagtcaagctagcagattttggtttagcaagagaagagtcattaactgagatgatgactgctgaaacaggaacttaccgttggatggctccagagttgtatagtactgtcacactaaggcaaggggagaagaagcattacaaccataaagttgatgcttatagttttgcaattgtgttgtgggagctcttacacaacaaagttccttttgaaggcatgtcaaaccttcaggcagcatatgctgcagcctttaagaatgtaaggccaagtgcagaaaatcttcccgaggaattggctgtaattcttacttcatgctggcaagaggactcaaatgctcgacccaacttcacccagataatccaaatgctcctaaattatctttacactgtcgcaccgcctgaacccatgactccttcaagaatattcaattctgagaacacagtcttgccaccggagtcccctggtactagctccttaatggcaaaacgtgatggcacaggtgatacaccaagagcaaaggacgaaatcaagcctaacggctttctttgctgctttagtcagtgttattaa

SEQ ID NO: 1727 - DNA, 2598 bp, Glycine Max
atggtggccaggtcatgcttgaatttgttggatctggtatcaggggatacactaaatttccctcggactcccagatcccttccgcgagttatgactgatccagtaatcatgtctgatggagatgttaaagaaagtaatgatgatgatttgagctttttctcgtcagaacaccatcggaagataattatagtatcaaattctctccctctcaatgcaaaaagggataaaatatctggcaaatggtgcttcagttatgacgaggattcaatcttttggcagttaaaggatggtctctctcctgatgctgatgttgtttatgtgggatctctcaaggttgatgttgatgcaaatgagcaagagaaagtttcccttcagttgctggaggaattcaattgcgtgcctacttttattccttcagacctctacaaacaattccatgatggtttctgcaagcaacaattgtggcctctattccattacatgatgcccgtgtatccaggcaatcgccactttgataggtcacagtggcaggcttatgtttctgctaacaagatatttgcagataaagtcatggaggtccttaatccagaagatgattatgtatgggttcatgattatcatcttatggtccttccaacatttctgcgaaagcggtgtagtcgagtcaggcttggttttttcctccacagtccatttccttcatcagaagtttataaaactctgcctgtcagaggtgaaattttgaaagcattgcttaatgcagatttagttggtttccacacctttgattatgctcgccattttctctcctgctgcaggcgaatgctaggcttggaacatgaatccaaaaggggttacattgggcttgaatactttggccgtacaatattcattaaaatattgcctgcggggattcacatgggtcgacttcaatcaaccttagatcacccttcctcttccaacaaagtcagagaaatccaccaacaatttaaagggaaaaagcttatagttggtgttgatgatatggacttattcaaaggtatcagtttaaaattcttggccatagagcaactcctgcagcaatatccagaatggcaaggtgaattaatattgatccaaattttaaatcccccaagtagttctgacaaagatgttgaggatgcaaaggaggatgcctacattacagccaaaaggataaatgaaaggtttggtttggaaggttatgaacctatcatcatcattgattgccatgttcctttctatgagaaggcagcctattatgctttggcagaatgttgcattgtgaatgcagtgcgtgatggtttgaatttggttccatacaggtacactgtgtgtaggcagggaagttctaaactagacgaagctttagaaattgcttctgacttcccgcgtgtaagtgcacttgtcgtttctgagtttataggttgctcaccatctcttagtggggcaataagggtaaacccatgggatattgatgcagtagctgaagcacttaatttggcaatcacaatgcctgatggagagaagcagcttcgacatgaaaagcactatcgatatgttagttctcatgatgtggcatactgggctcgaagctttgagcaagatctagtgttctcgtgcaaggatcactatagtaaccgatgctggggcattggctttggcctgaatttcagaattttgtccctctctcctagtttcaggaggctatccatagaccacattgtccctgcatatgagaggtgcagttgcagggcaatatttttggattatgatggtacagttgtacctgaagcttccattgttaaagcacccagtcccgaagtcatatctgtgctaaataatctctgcagtgatgttaacaacactgtgtttattgttagtggcaggggaaaaacctcactgagtgaatggtttgatcagtgtgagaatcttggtatagcagctgagcatggttatttcataaggtggggtaaacatactagttggcaaatgagtcatgcagatacagattttgcatggcaaaagattgctgaacctgtgatgagatcttatatggaggccacagacggttcctctgtagagaccaaagagagtgccttggtgtggcattaccgtgatgctgatcctgattttggatcttggcaagccatggagctgctggatcaccttgaaaatgtacttgcaaatgagcctgttgttgtaaaaaaagggcaacatattattgaagtcaagcctcagggcattactaaagggtcagttgcacaggaagttctttcttccctaaccaagaagggtaaatcgccagattttgtactgtgcattggtgatgatagatctgatgaggacatgtttgagagcatactagccgaaccttatagtgctaactccttctcagcaccacaaatctttgcatgcactgttggacaaaaaccgagcaaagccaggtactacctagatgacactgtggatgtgatgacattacttgagggtcttggtgcggcttcagggcctaaatcaagatgctctacagaaaccccttttgagaaaagagaagtatgttttgagaatgatgtttaa

SEQ ID NO: 1728 - DNA, 1857 bp, Glycine Max
atggtggtgatttccaccactgttttgtgcccttcttctcttgctctgacgctagatggattggcattgttggaggtcaaaagcactttgaatgacacaaggaattttctcagcaactggagaaagtctgatgagtctcactgtacatggactggtatcacttgtcatcttggggaacaacgagttcgatcaataaatttaccttatatgcaactgggggggattatatctcccagcattggcaaactcagtagactgcatagactggcacttcatcaaaatggcttacatggagttattcctaatgaaattagcaattgtactgagcttagagcactgtacttgagagctaattatttacaaggaggcatcccatcaaatattggaaatctttcctttttacatgtattggatttatcaagcaactcattgaagggtgctattccttcttctattggccgtcttacacagttgcgagttctgaacttgtcaaccaatttcttttccggtgaaatccccgacattggagtactgagcacctttgggagcaatgcgtttattgggaatttagatctttgtgggaggcaagttcagaaaccatgtaggacatcacttggtttcccagtggtgctaccacatgctgaaagtgatgaagctgcaggcaagaagatgttgtattgttgtattaagatccctaacaaaagatcttcacattatgtagaagtgggtgctagtaggtgcaataacactaatgggccttgcacttgttataacactttcattactatggatatgtatgctatcaaagaaggaaagagctgtcatgagatatatagaagtgaaggatcaagtcaatccagaatcaataaactggtcttgtcttttgtccaaaactcatcaccttccatgttggagtctgttgatgaagatgatgtggtagggtctggaggatttggtaccgtttaccgaatggtgatgaatgattgtggtacatttgctgtaaagaggattgatagaagccgtgaaggttctgatcaggggtttgaaagggaactagaaatattgggtagcatcaagcacattaatctagttaacctgcgtggttactgcagcctaccttctactaagcttctaatatatgattatttagccatgggaagcttagatgatctcttgcatggtatgattcattatctaccacctttgaatcttgtcaaaagtctagttgaatcctataaaaaatttcttgaaaatactgagcaatcactgaattggagtactcgcctaaagatagctctcggttctgccaggggattggcttacttgcaccatgactgctgcccaaaagttgtgcatcgcgacataaaatccagcaacatccttcttgatgagaacatggagccccgtgtctctgattttggtcttgcaaaacttttggtagatgaagatgcccatgttacaacagtggttgctggcacatttggttatctagctccagagtatctacaaagtgggagagccactgagaaatcagatgtgtatagttttggagtgctattgctagaacttgtaactggaaagagaccaacagatccttcctttgcaaggagaggtgtaaatgttgttggttggatgaacacattcctgagagaaaatagactggaagacgtagtagacaaaagatgcactgatgcagatttggaatctgttgaagtaatccttgaactagcagcaagttgcactgatgcaaacgcggatgaacgtccatcgatgaaccaagtgttacagatactggaacaagaggttatgtctccatgcccaagtgatttttatgagtcacattcagatcactgttaa

SEQ ID NO: 1729 - DNA, 528 bp, Glycine Max
atggttgaacaaaaaaatcaggtcatccctcttcttactccttacaagatggggaacttaaatctttcacacagaatcgttttggcgccactatttagagcaagatcttacaacaactttgctcagccgcatgctattctatattactctcaaagagctaccaagggaggtcttctgattactgaagctactactatttcacccacttctaaatttttattgaattttaaaagatttaaaccacttcgtgtttcaggaattaaaaataaaaaagaagtcgccttcctctcactcactctccctcactcactcactctctctctcttgccgccgctcactcactctccctcgccgctgctgagacacgaagaggactgcgtctctttagttagaaaaagaagtcaagaggcaaaacccggtgagagttgctgtatgttcatctttgccggtatctttgctaatgtcagaaatgccgaaactggtatctttgctagccccgtaactctgtttctttcttcattgaattag

SEQ ID NO: 1730 - DNA, 978 bp, Glycine Max
atgtacactaaagacaaatcatgccagcttaagtttattcatggaatgccaaacttaaaaggaaggctacagaaacagcattatgctctttttgttgtctctgaggatcagtcacaatactgtgagctcgaaacaactgctttagtgctagaaaacagcaatacagttgcagaagacatctctcctgcaagcaactcatattttcatttatcaggtagtgatggaaaaccaggtttactatcattttataaccgtccatacagaagagatagtaagatcctcttaccaaattcagagagaagtcaaaacagcatattgtggtttttgggccctgcagtcctcgttgcgtccttcatttttccttcactctatttacgcaaagtgctatccatcatttttgaggactctttgttaactgatttcctcatattattcttcacagaagcaattttctattgtggtgttggggtattcctttatctactagaccatgtaagaagacccttgctagtggatatcgctgcaaacaatagtgatactctacccccacaattgggacagagagtctcttctgttgctaccctggtgcttagtcttgtaattccaatggtgactatgggtttggtctggccgtggactggccctgcagcctccgcaactcttgctccataccttgttggtatagttgtccaatttgcatttgagcaatatgccagatatcgaaagtctccttcatggtctgctattccattaatctttcaagtgtatagattgcaccaactaaatagagcagcacaactggtgacagctttatcatttactgttagaggagctgaaatgacctcacacaacatggctataaacagctctttgggtacccttctaaatgtcctacaattccttggtgtgatttgcatttggtccctatccagcttcctcatgagatttatcccttatgcttcaacaactaagcagtaa

SEQ ID NO: 1731 - DNA, 522 bp, Glycine Max
atgtatttgattctaatatatttttgtcactctaatttttctctattatgtttaaaacttgacggttttttagagaaccagtgtagaatccgagattttaagacaacaattagaaaccatcatgaaaaaccacaaacaaccatctttgaaaacattttttttagtagtgtaaggaatgtggattccaagggagctaaaacaaataaattagtggatggatgttattccttttggcatggaggtattgttgctctattgcaaagattatcttccattatcaataaacaaatggaagaggcatcacagacttttaagatatctcatgagcaagagggtgaactgagagacaaaccaagtaaacttagagatcactatcacacatgttattgtttaaattctccaccgctgtcttacctagtattgggcccctactctgatctcttagaaacaatccatcccctctttaatgttgtcttggatcgatttcgtgaagcccatgagttcttctttactgagtcctga

SEQ ID NO: 1732 - DNA, 310 bp, Glycine Max
atgtcaagatttgttgaggaatgggacactaacaaagggaacaaacatgctattagagttctttttaacttatctatcaaccttgtaaataaaggtagggccattagacctgccattgtgtcacctttgcttcaattgctaaaggacacaaagttgggcatgattatagaggcattctacagtttgttactccttataatatgtaatatgcctgctattatttgtcaaaaagtcctaaaatctataaagatgaacaatacatataaaatgcaatgcaaatggtgtttgacaagtttctatgaatattttt

SEQ ID NO: 1733 - DNA, 340 bp, Glycine Max
atgtcagtttatgggtgtgaaattgttcaaacattgattgttgatatagagtcagatgaaaatgcaaagtgggccatgaatgaaattttgacggtggaagctaatgagaagtcagagacagagaatatcttgcaaattaagcgagccgacggtgaggcgagtctaagtatctctctgggttggataatgtgctgggattctcagttaatatgtcttatacatgatccttgtcactcagtacttgacactttgaaagaaattggtgctgcctccaagtcttctgctgttttcattccccaaggatgtggttctgtttgtgatatagctactacccaaatta

SEQ ID NO: 1734 - DNA, 537 bp, Glycine Max
atgtccaattctcaacagaatgagcttcattattcaaccgccaacggggacgagaggtcaaacccttgtttagccaacacgcgctgcagcttctgctttccctgttgcttcggttcccgtcgcgactcggccaccctcgggttcgggtggtgggagcgcgtgcgagccacgtcgtcatggtccgagtcgcgctccgaggcgcaaccggtgaccgggagtcccggtgggcggtggtggtctggcggcgtgagggcctttatgaaggtgcgcgagtggtcggagctcgcggcggggcctcggtggaagactttcatccggcggttcagccggagccggagtggcgggtcgcggcacgcggcggggaagtaccagtacgaccccttgagttacgctttgaacttcgacgaggggcataacggggatttcggcgatgacggctacgacgggttacggaatttctccacgcgttacgccgcgcctcctccgattaagtccgtttcctcggattcgaatcaagacgtcgccgttttgggataa

SEQ ID NO: 1735 - DNA, 2214 bp, Glycine Max
atgtcccaaggatctcccccacaagacaccaccgaaccctcgccggaacccgattcgtataaggaggaaacaaccgccacaaccaccaacagcaccgccgccgatgctgctcctcccgcccccacccggagcccccccacccggagccgcccctcccgagcctgcaccatgcgcacggctgcacgcctctacgcggcgtcgcagccggcgaggccaaaggccgcgaggagggagcctcgccgcgaggagtcgccgtcgccgccgtctccgaagctgcagcaatgcagcaagatcgtgacgccgctggtggaaccgcccccgccggtgcagttgccgcgctacaacctccggtccatgtgggaattggcttcaatactcaattttttgaatctgtttaggccacttttgaatatttcagtagaattttcggctgaagagtttgagacggctttgctcaccccgaatgacacattgggtgatatacatatgcctttgctaaaggcaattcctcccattacgcgaatggcactttcacgtgatacttggataactgtgttatgcagaaaattgagagattggtggcactgggttgccgatggggatctacctattgttgcttcacatggagcggaggttgaagtatataaatcacttgatccaggggttcgtgtgatcatcctaaaagcattatgtgacattcgtgttgagcaagaagatatcagaggttacattgacagatcaatcaaacatggcattccactttcaacattccgtaaggagcgtattggtggtgattcacacggaatttcttattggtatgaagacgaccaaattattggtcataggttgtatcgggaaataaggaaaactgaggtggttcaaatgaagaaagggaaaccaagaggttcccaggttttttctaatacaacctaccagtgggaaacagttgctaccaattttgatgaatttcaggatgtttctgagaagcttttcacaagtaaaaacagaacggaggcatctgtagggaagaaggtgaagatagacatgctccctgaaatcgagaaagttcacaggagaaaggagaagttgctgaaaaaacaacacagacaagctcttcttcttgataatttcttgggtgttgatgggcttgcccctgggcgttcacttcgtgatagaaaacctgttacctacacttttgatgattacgatcgatccatcagtgaagcaattaagataaccaaacggaaaccaccatccccagaacttatacccaggagagaagcaggagcaaaacatgcagctttaaccaatggtaaatggagtggtccttcacatgaccctcaagacctgaattttggcatgccatcaccaaaatcacctgacttcgatgatatggaggaagataatcaaactgacatgttggacttggatcgaagcaatcggcgaagacagaagcctaaacggtattcggagaaagagtttgttgaagcactgtcggataatgaggctgactatgacagcgatgatgatattgttggagaagccgtgtatgatgaagagtatctccagaaacgtaagcagagaaagaaggcttctagtagctctgggtctgaaggagatgaagaatatcattgggatgaagataatgttgaagatgaagaagacgatgacgaagattccttgagtgccagtgaggatagtgacaagcctcgtaaaatcaagcaactgccaggccgtactaggaaggaaactaaactcaggtctgtgggtgagattcaatcaggtctaagacgcagtaagagggcaacaacaaaaagccgtataaattatcgaaggtacgagatatctgattcagaaacagagttcattaaatccgacaagtccaatgcatcagacgatcactcagatcctactgagaatggggagtatatgatggaaagtgaagactccgacagcaatgacgaggaagaacaagaaaccaaagcagttgagcctgttacttaccctgcagaagaaaacaaccaatctcctgctgtaggggagaatgaacaaaaccaaaaccagcctcctgaaaaagccagtagcccaggtcaggaagttgagggcactgcaaagcgacgcttccttgatttgaatgagcttgcccctagctcaggttttgatgatggtccaaatacaacaacactgaaagatgaaggcaatgatgataactga

SEQ ID NO: 1736 - DNA, 459 bp, Glycine Max
atgtcgactcctgctaggaagaggctgatgagagacttcaagaggctgcaacaagacccgcctgcagggatcagcggtgccccccaggataacaacataatgctgtggaatgctgtcatatttggtcctgatgatactccatgggatggaggcacgttcaagttgactctccagtttactgaggattatccaaataaaccaccaactgtgcgatttgtgtctcgcatgtttcatccaaatatttatgctgatggaagtatttgtttggatatactacaaaatcagtggagtcctatatatgatgtggctgctatactcacatctatccagtcattgctttgtgatcccaacccaaattctcctgcaaactctgaagcagctcgaatgtttagcgagaacaagcgtgaatacaatcgaagagtgagggaaatcgtggagcagagttggacagccgactaa

SEQ ID NO: 1737 - DNA, 459 bp, Glycine Max; identical to SEQ ID NO: 1736

SEQ ID NO: 1738 - DNA, 1023 bp, Glycine Max
atgtcttctttgtctacgcatcacacctatagccgaaagcaaaaatctctcggcctcctgtgcaccaagtctctctctttccttctctttttattttttgagtttgtacaacaaggaaggtgtgcgattaatcggtttctgttttatcttctcagacacgactatgttaagtatgctatttctgattggattgctcacatgttgtgctcacatgtgctagctagaaaagctaagaatcaatgtacctggaaagggttttctgcaattcatgtagccttgcaagaacttaaggatgagggtttgaaggagaatcctggatcatccgatgactccaatccatccattaatttagtattaaccgttttaggcagaagggaaaaatctctggcattgcttacacagaattttgtcaagctttttgtctgctctaattttgaaatgatctcccttgatgaagctgcaaagttgttgcttggaaatgccaataatagaacaaaagttagacgcctatacgatattgcgaacgttttatcctccatgaacctaattgagaagacccatacaacaaacacaagaaaaccagcatttaggtggttgggtgtgagagggaaaacatggagtgaatcagctcagacaaatgttaaagagtcacagaaaaggatgtttggatctgacataacaaacataaattttaaaaggaaagttgatttgtccatggatggccagaactttaaaacgcaaaaccaacaggaaaatattagtcccagagctcagctggagaaaaaaagcttaaaaaaagatgcaaaacagacttcaatgagctatcagtttggccctttcgctccagcttatgtgcacaaagttggaacctctgaaaataatagtgtgaaacaggtgcaagactgggaaagcctcgcacaggagcatcgtcctcaatatcaaaaccaagctttgaaagatctattctctcactacatggaagcatggaaatcttggtactctgaagctgctaaaactttataa

SEQ ID NO: 1739 - DNA, 954 bp, Glycine Max
atgtcttctttgtctacgcatcacacctatagccgaaagcaaaaatctctcggcctcctgtgcaccaagtctctctctttccttctctttttattttttgagtttgtacaacaaggaaggtgtgcgattaatcggtttctgttttatcttctcagacacgactatgttaagtatgctatttctgattggattgctcacatgttgtgctcacatgtgctagctagaaaagctaagaatcaatgtacctggaaagggttttctgcaattcatgtagccttgcaagaacttaaggatgagggtttgaaggagaatcctggatcatccgatgactccaatccatccattaatttagtattaaccgttttaggcagaagggaaaaatctctggcattgcttacacagaattttgtcaagctttttgtctgctctaattttgaaatgatctcccttgatgaagctgcaaagttgttgcttggaaatgccaataatagaacaaaagttagacgcctatacgatattgcgaacgttttatcctccatgaacctaattgagaagacccatacaacaaacacaagaaaaccagcatttaggtggttgggtgtgagagggaaaacatggagtgaatcagctcagacaaatgttaaagagtcacagaaaaggatgtttggatctgacataacaaacataaattttaaaaggaaagttgatttgtccatggatggccagaactttaaaacgcaaaaccaacaggaaaatattagtcccagagctcagctggagaaaaaaagcttaaaaaaagatgcaaaacagacttcaatgagctatcagtttggccctttcgctccagcttatgtgcacaaagttggaacctctgaaaataatagtgtgaaacaggtgcaagactgggaaagcctcgcacaggagcatcgtcctcaatatcaaaaccaaggttag

SEQ ID NO: 1740 - DNA, 645 bp, Glycine Max
atgtgcaagagccaatcaacgtattgcaagaatctctgctcatctttagccttcaaatttctagggagatataaagttgattgggtggttaagaaagaagaggaaaaaggtcatggtaagggagtaatgttctttaagagaggtgagtgcagagcaaaaggtggggcacttggattcaaagttgcaattttgggggctactggaggaattggtcaatccctttctttgctaatgatgatgaacccattggtttcagttcttcatctttatgatgttgtcaacacccctagtgtcacaactgatgttagccacatggacactggtgttgtggttcgtggcttttcggggcagcaacaacttgagagtgcactcactggcatggacttggtaatcatacttgctggggtgctaaggaaacctaggatgacaagagattatttatttaaaataaacgttagaattgtgaggatcctttctagaggaattgccaagtgctgccccaatgcaattgtcaacttgattagtaatctagtgaattccacagttgctattgctgcggaggtttccaagaaagtcggtacatatgatccaaagcgactactgggtgttacaacccttgatgttgtgagggcaaatacttttgtg

SEQ ID NO: 1741 - DNA, 885 bp, Glycine Max
atgtgcttacaatccaatccttctaaccatagcagcactgatgaactcaaacagttttctgattggttactagacataggtgatggcaaacttggccaacctaacgatggacattgcgaaatcaccatcccagatgagtttcttataatggattttaaggatcttatccaagcaattgttgatgcaacatatccagatttattacaaaactacaacaacacagatttcttgcaaaagagagttatcctagcctctacaaaagatgttgtagacaaaataaatgattatgtcctgtctttgtttcccggtgacgagaaagagtattgtagtgctgatagtgttgacaaatctgatgaactactcaatcatacttttggagtactaacacctgagtttcttaagaccttgaaaacatcagggatacctaatcacaagctaagaatcaagattggtactcccatcatactactccgaaatttggaccaggaagatggtttatgtaatggaactcggctaattgtcaccaaacttggaaccaatgtagttgaagcagaggtaataactggaccgaatgtaggtcataggacatacataccaagaatgaatatgtgtccttctgattctccatggccattcaaattaattagaagacagtttccattcatcatttcatttgcaatgactataaacaagtctcaaggacagtccttggcacatgttggattatatttgcgaaacccgatattttgtcatggccaactatatgttgcactttcacgagtgcaaagtaaaaaaggactatgtattcttattcatgataaacaaggcattgcaaaaaatactaccattaatgtggtatacaaagaagtatttgcaaacttataa

SEQ ID NO: 1742 - DNA, 1053 bp, Glycine Max
atgtgtttgcatagtctaaccttcaaatgtcatttgtccttgcaacactctaaagccatgaaggcaacactaagatacttagcaggaatggcaggccctagtggttttggctcaaattcaacagctgaacaagtcactgaagattgttcttccttccttccttctgcagctctaaccgctctcatcactggggcgagttctggtattggagctgaaacagcaagagtgttagcaaagagaggagtgagagttgtgattgctgcaagggacttgaagaaggccacggaagtgaaaaagaacatacaaaaggagactccaaaagctgaggttattctgttggagattgatcttggctcttttggttctgtgcagagattttgttccgagtttttggctttagaacttccccttaatattctcataaacaatgcagggatgttttctcaaaacttggagttctctgaggataaaattgagatgacatttgctacaaattacctaggtcatttcttgttaacagaaatattaatagacaaaatgatagagacggcagagaagacatgtattcaaggaagaataataaacgtttcttctgtcatacatagctgggagaaaaaagatggttttcgtttcaacgacatactcagtggaaaaaaatataatggcacacgtgcttatgctcagtcaaaattggcaaatattttgcatgcaaaggaaatagccaagcaactcaaggcaaggaatgcaagagtaactatcaatgcagtgcacccaggcattgtgaagacaggaattattagagctcataagggcttaataacggattccctattttttattgcatcaaagttactcaaaacgacatcacagggtgcatcaactacgtgttatgtagcactgagccccaaaacagaagggataagtggaaaatactttgcagattgcaatgagtgtaaatgctcgagcctagcaaatgacgaatcggaagctcaaaagctatggaacaacacacatgccttgcttcacaaacgactgcgtcaagcaacgatttga

SEQ ID NO: 1743 - DNA, 300 bp, Glycine Max
atgttacagttcccggcgtatatgacgcagtacccattgtccacgatgaccattccgacgtcgtttctgctacccgctcagtggccccagccccaaaacgaagaactccttctcgccatggaagagtccgatttcgaagaaaagtgcaacgagatcaggaagatgaacagcaacctaattgtgataggaaaaaccactaacgaaaatgataaggaagactttgacaatgaggcagatgacgatgatgctgacaatgcagaggaatctgagggcgaagaatttgagcaagaaactggttga

SEQ ID NO: 1744 - DNA, 3045 bp, Glycine Max
atgttgagactttacgtgtgtgtattggaagccaaggaccttcccgtgaaggatacttacgtgaagcttaggctgggaaagttcaagtgcaggacaaggatattgaggaacacaagcaaccccgtttggaacaaggagtttggtttcaatgtgcatggtgctgaagacatgcttgttgtctctgttgttaatcatgataatattaatgagtgcagagtgaccaatggttctgtggagtttgtgggtgaggtacggattccggtaggttcggttgcttttgaggataagcaaacgtttttgcccacgtggttctctcttgaaagccccaagagtgggaagtttttcaatgaatattgtgggaaaattctccttaccgtttctcttcatggtaaaggtcgttcttcttttatcaatcataagcattcttcaaattcaactattgcggttgacaactcaagagacttggaaggtctgcacgttgcgtgtcaggtaccttgtgataaaatgggtgcaggcaaacaattgttgaaggctattgctaatggtctgcataggattttcaaaaagaaagaagaaaactcaaaatctggtgattcttcagaactatctacttcattatctgattatgaagatagtgtacaggaaaattcatctccttgtagctttgaagaagccattgcactaatggaatcaggagatgacaaaccagaaatgcctgaaaatttgcctggcggtgttctagtagatcagatttatttagtctctccgaatgaccttaatgtgtttctttttgcacccaattcacagtttagtaaagatatggttgaactgcagggaacaacaaatgtgcaagagggaccttggacatggaaaaatggagacatgtcgtgtttaacacgagttgttacctatacaaaagcggctacgaaattgattaaggcagttaatgcaattgaggagcaaacctacattagagtgagcagaaaggaatttgctatacttgttagtgtaagcacaccagaggtcccatatggaaattcatttaggattgaattgctttacaagataatgccaggggaggcatcttcaggagaggaatcctcccatctagttgtgtcttggggaattgtcttcctccaaagcacaatgatgaaaggcatgatagaaggtggggcaagacagggattgaaggagagtttggtccagttctcggaccaacttgcgctgaattttaaggtgctagataaagcagatttaccagacaaggaacatttgttggcaactttgcaaactgaagaccagtggaattggtggcagacaattacatacttttggaatttcactgtggcttccaccattttcatgtttttgtatgtgttggtgcatattttaaggtgtggtccaagtctacctcagggcttggaatttagtgggcttgaattgccagatagttttggggagctcattacaagtggaattttaatcatccagttgcagcgtgtttataatatggtgtctcactttgtgcaagctagatttcaaatgggaactgaccatggcctcaaagccaatggtgatggatgggttcttactgtggctttaattgagggggttgacctggcctccttggagtccgaaggattgtcagatccctatgtagttttcacctgtaatggacaaacaaggtcaagctctgtcaagcttcaaatgcccgatcctctatggaatgagatattagagtttgatgctatggaagaaccaccatcagttttacatgtggaagtttttgattttgatggtccattcgaccaggatgtttcacttggacatgctgagatcaattttctaaaacacacatcaactgagttggcagatatgtgggtcatgcttgaaggaaagcttgcccaatcttctcagtcaaagttgcacttgagaattttcttggataacaataatggagttgaaacaatcaaggaatatttggagaagatggaaaaggaagtaggcaaaaaattgaatcttagatcacctcaaaggaattctacattccagaaattgtttgctttgcctccggaagaatttctcatcaaagatttcacttgttacctcaagagaaaaatgcctttacagggtcggttgtttctttcagcaaggattctggggtttcatgccaatttgtttggacataaaaccaagtttttcttcctttgggaagatattgaagagatacaagtgcttcctccatcattggcaacattaggaagccctacattggtcataattctgcgaagaggtcggggtcttgatgcaaggcatggtgcaaagactcaagatgaagaagggagacttagatttcattttcaatcatttgtttcatttagtgctgcctccagaacaataaaggccttgtggaggacaagaatactgaacccctatcagaaagaacaaatttcagaagagcatgaagatcaagaaagctttgtaattctggaagactctgcatctatcttagaggatgaagaaaaaatgtccagaattttctctgcagaacttccaattaagatgaaatcagtgatgggaatatttgatggaggaaacctggagcataaaattatgcagagaacaggatgtatgaactatgaaacaacatcatgggaacaagtaaagcctgatttcttcgagaggcatgtttcttaccaattcaatcgacatgtgtcagtttttggtggtgaagtcacatgcacacaacaaaaatttccaaatacaaacactggaggttggactgtgattgaagttatggctcttcacagtgtcccatttgctgatcacttccatattcattttaggtatgaaattgagaaatcctctcttggtgactgtgcatgcaagtgtgatgcttacattggtattatgtggctcaagagctctaagtttcagcagaggatcaacaggaacataacagccaagtttaacctccgattgaaggaaatatttgaactggttcagaaagagattttgttaatgtctcagaactctcacggataa

SEQ ID NO: 1745 - DNA, 840 bp, Glycine Max
atgttgattccgtttgattggctccattccgaactcagcaacatttgtaagtccctcttgcgagcgaagcagttacacgcattccttttgaagacccatctctcacaagaccccttttacgcaacaaaaattgttaggctgtacgcagccaacaacgacattaagtcagcccatcacgtgttcgacaaaactcccaaccgaagtgtctacctttggaattccatgattcgagctttcgcgcagtcccaaagatttctcagtgcaatttctctgtttagaaccatgcttggggatgacataagtcctgatgatcacacttatgcttgtgttatacgtgcctgtgctgacaactttgatttcggcatgctaagacgtgttcatggaggtgctgtggctgcagggttagaaatggatcctatttgttgcagtgcacttgtggctgcttattcaaaactaggccgtgttcaagaagcatgtagagtattcgatgggattgctgaaccggatttagttttgtggaattcattgatttctggttatgggggatttggtctgtgggatgtggggatgcagatgtttagcatgatgagactcgttgggatgaagcctgatggatatacactggctgggttgcttgtgggtattgcagattctggaatgctggcggagactgtagcacagcagctttttgaaagtagtcctgccgataatgtttacagtgttatgctttctaatatatatgctggtgatgggaggtgggatgatgtgaagaagttgagggataaaatgacaggaggtctgagaaaaatgcctggactaagctggattgaaggcagttag

SEQ ID NO: 1746 - DNA, 538 bp, Glycine Max
atgttgggaattttcaaggagaagttggttaaagcacccaaagagctgaacaatccagcttctttgaattcatgcactaagcctaagccaagtcatgaaatcctgaaggatttcatgccctgcaattcctccaatgctttctccatgtgctttgggaatgatgctttgctagcctattccccttcaaacaagccttccattcatcataggttgtttagtggtttggataacatatattgtgtcttcctgggtggcttgcacagccttagcatggtcaataagcaatatggtctatcaaagggaacaaataaggccatgtttatcaccgaagcgtatcaaactcttcgtgacaggggtccataccctgctgatcaggtcctcaaggaacttgaaggcagtttgggatttgtgatctatgacaacaaggatggaacaatttttgtagcatttggttctaatggccagattgggctctactggggtgttgtagcttatagttccatagttatttatgaaaatatggagcttataaaagcaa

SEQ ID NO: 1747 - DNA, 852 bp, Glycine Max
atgtttaaacacgcgacgaaggtggagggtttggacgatgtggtggacatcgtgggaaccggaggggacggtgccaacacggtcaacatttcgaccggtgcttcgattctcgccgcggcttgcggtgccagagttgcaaagcaagggagccgttccagttcttctgcgtgtgggagtgccgatgtgttggaagctttgggagtggtcattgacttaggtccacagggggtgaagaggtgtgtggatgaagctgggatggggtttatgatgtctacaaagtatcacccatcaatgaagattgtcaggcctgtaagaaagaagctaaagataaaaactatattcaatatattgggtccaatgttgaatccagcacatgccccttttgccgttgttggagtatacacagaggacttggtccttaaaatggccaaagcactcaatagatttggcatgaaacgagccttagttgtccactctgaaggtttggatgaaatgagtcctcttggacctggtatagtgcttgatgttatggctgacagggttgataagtttgcatttgatcccttggagtttggcattccacggtgcaatattgaaagcttaaaaggtggtggtccagaatacaatgcagaggttttgaagcgtgttctaggtggagagagagggccaattgcagatgctttgattctcaatgccgcagcagctctcttagtcagtggctgtgtaagtaacctagctgaaggggtttctgtggcacgtgaaacacaacaatcaggaaaggctctgaaaacactcaacctgttgaaggatgtctcaaataacatcaaagatgagttgggcatggatgcctga

SEQ ID NO: 1748 - DNA, 183 bp, Glycine Max
attagcgggctaggattggtatgcttcgtgttagttagtgtcttcattctgattctcttattgtatgttgtgcgattcagttcgttgtcgtttttgttatgtggatggaaaagcgaaaatatccactcaccctatgaggaaagatctcccaaaattgataggaagtgccgtatgacactctaa

SEQ ID NO: 1749 - DNA, 651 bp, Glycine Max
cacacacacccaccccccaaggccacctcccaaggcacttgtagaaaagaaagcataccatactttgaagtaacaaaaaaggataattatagtgaggtgtgcttacatgccactttgttctgttttatgaacaagcatatgggtggcctagttgtgaagcagattcttcataaagcaaaggaagaaagatttgataatctcatgaaaaatacaataggaattttaagtattgttttttatagcttcccacattttggtagcaaacttgcagatatgtcctcgcaaatgggctttgtgcttcgtcctgctccaacaataggagagctaagaagtggatcttcaagactgatagagcttaatgactatattcgtcaccttcataagaaagggttgcttaatgtacgtcctcggcttttcaaggtaactccaatagttgaaggttatggtggatgggcctttcgaactgaaattgtaccaattgattgtaaaaatttattggagtcaactgatcacataaattcttgcaaaccagtgagtcgtttagacccttcttacacggagacattaaattatatgtcacaggcatgggaagtccatagatcttgtgagtttgacttgatacaacaactaaaaccttatcttactaggtga

SEQ ID NO: 1750 - DNA, 873 bp, Glycine Max
cagaaagaagtatcccgtttgcgtggtctagttggtggaggagaaattcaggataatgacattttagttgtcaacttcccaggttctcctggatccttcaagtgggagggtgtgcaaggatcattcactccattaacctctgttaaaaggatatctcagaaaaaagactatgacattgcccttgttggggcctttagaagggaaaaggacaaagagatggaattacaggcactaagagatgaaattcaagcgtccatgaagctggtgagacaaagagaagatgacatacaaattttttgtgcttgcattttaaattttctgttaaagtcattttgtatggaaggtgaacgagaacggatgagtgaacaaatcatggtattggaaaacaagttgttggaagcactagattggaaatttatgcatgaaacagatctgatgtacataatgatggtaatctcatctccaaacaggagtcaagttgaaaatcacgatggcagtctttggttagggaggaaaatgagtttctcaatattcagagatatctgtggagatctaggcagcaaggtgaagcaaactcagaataggtcactgcaaggaaggcatagtattttttatatgtacggaagacttaatgccccacgacactttgggaatgataatagaaattatttgccatcatctgtgtttatggaacaaacaccttatgaaatcagtgctcatggctcttcaagaaaagcagaggctcatgagacagcaattatgctggcaaaggagaatgatgaactcaagatgaaacttaaagccttgattgaggataatagtaaactaattgaattgtatgaacaagctgctgctgagaacaataatagaaat

SEQ ID NO: 1751 - DNA, 799 bp, Glycine Max
cagaaccagattatggaaattgtgatttccttgatcatactctttgtggggatagcaattttggtggtcatccatgtctgcgtcgtggggagggccttcagagggaacaacaacgaagaagaagaagaaggtactcatcgcagcatcaatgccatgaagagaatgtttggcggcgacagcgttggtgacctgaaaaaccttccttgctttccttatgaagagccaaaagagagtactaaagggtgttgtggcctagtggattgtgctgtttgcttggagaatttcaaggttggtgatgtgtgcagattattgcccaattgcagccacagcttccatgtgcagtgtatagactcatggatactgcagacacccgtttgtcccatttgtagaacatgggttcattcaccagttcaccccaaatttgcctttgtgtcagatttttattttttttatcagcaaagaaaagtaaatcaaatttacgcacggttaaaccaaccgagccatacccgttatatcaaatttgcctttgtggatattaacacaataatttcagttctaggaatattcttaaatataatatgtatgaaaataatagaatatcctagaactatagaatatgaaagacctaaagtaatattcaaattatgcaatggatcaactaccagtattatttttgttttctggttggtgtgtgtgaaatgcttatccttccagacagctgggtatcgtggacagattttcagccgaaggagtgaatgtttctttgtctttttcgtcctatcatatcgaatggacgcaa

SEQ ID NO: 1752 - DNA, 466 bp, Glycine Max
catcactgtttaatagacatgactgccacaagaaatatgcaaatatcaacagtcaaaaatcaatatgctgatgtgtttttttcatattatcctgaccatggtttaatgaacttcgatgatggcctttctgatggtcttcataggtatattcctagcttcgaaagtctagtgaatgatgccatcgagcatttctcaaaaattaaagatgtaccaagcttcttgttgggtgaatcaatgggtggaaccatttctttgaatattcacttcaaacaacatactgcatggaatggtgttgctcttattgcacctttgtgcaagcttgcggaggatatgattccacattggttggtgaagcagatactaattagagtagccaaagcaccttataatgtgttactctacaatgataaaccaagactgggaactgctgaaagccacacaggagctagaacaacatttggaagaa

SEQ ID NO: 1753 - DNA, 1338 bp, Glycine Max
cctctaacggggcttggtagagtggcggtaactgcagccacaattaatgaattctacaattgggcaatgtttgtgctgctgattccttttgccactcatagtgaaaaaccctgtgtcagtgatgttgactatgatctttgtcattttttgctactatgtgttgcgcccttcacttacccggttgatagagaaataacggacaagaatgagtgggacaactacaagttatcctatgtgttcataggcattatgttttgtgcacatattactgaaatgttaggcactcactccattgttggggcattggtgtttggtttgattcttcctagggaaaaatttgtggacatgttgatggaaaggtcagatgatcttgtctctacgtatctggaacccttgttgttcattggctgtggtgtaagattcgacttcacaactttcaaaaaaagaaagttgcgtgatgccatgataatcacgctcttgtcatgctgcacaaagattgtaagcactgtgatagccactggcttctatcgtatgccttttcgagatggcgtggcacttggagagcttttgaacaccaaaggcctcttgccattagtaatgctaaacatattgcaaattttgagtagggatttatatacaatcatggtgacggctaatgttctgatgaccatactagtgtctccaatcatcaactacatatacaagccaagaaagcggtttgagaaggataagctgaggactatacagaacctgagggctgatgcagatatcccagtaatggcttgtgtccacaagccgacactgagggcattgcaaatattttcgcagaaatttcgccggaacaagggcacacaaacaccagtcttgagactctcagcgccgtgtcctcctacgagacagattcacaaggatgtgtactacaattttttttggcaaataaatcgaatccgcatcaaccagaacgtgatgcaccacgcgccgtgctccgtggggatattggttgatcgcgggcacgggtggttatcgaaggtgagtttgcgtgtctgcatcgtcttcattggcggccccgatgaccgcgaagcacccggggattcatctctgttgaagtggacacaaatgcaacaacaaatgatgaagccaatgggatatttgaacaatggggattcaataacctatttggatagagggagctatgatttgtacattttagggcatggaaagggaaggaactttttggtgttgtcgaatttgatggactggactgattgccctgaacttggggtcataggggacatgctggcatcaaatagctttggttattgctcttcagtgcttgtg

SEQ ID NO: 1754 - DNA, 341 bp, Glycine Max
cctgcgattcctttgtcagatgttgaattgctaaggttcgcatctccttggttgaacactctagtggtaaatgttttgaataagtggatcattgatctccatgaaggcttcaatcgggtggtgtttagtaatacggaggattataatttcgtgttttttgaaggaccgtggatgtttgtgaaccactacctcattattcaaagatggagatcattcttcccaatgcatgcagaagagacgaagaagatagcggtatgggtcaagattcagtgtctccttattgaattatataatgatgtgttctcgtcaagaattaggatgagtttaggcaagtttctcaa

SEQ ID NO: 1755 - DNA, 158 bp, Glycine Max
ctagctcttaggatagttgaagacaatacttactatcctaagctcaaagaattctgcaaaccacacaaatgttatgttgatgagcactattttcagacaatgttaacaattaatactcctcatcttttggcaaatagaagcctcacttatgtggactg

SEQ ID NO: 1756 - DNA, 198 bp, Glycine Max
ctagtgatcttaggcttagcgaatgtattatatgaaaattatcctcaatacagggcttatttgcaagattcagtcatagagctgctaggaacagaaaagtcattctgtaatgtggtgatagagcatactaaagatggatctggaataggaggtgctgtattggctgcttcaaactccatgtacaaccaagacttatag

SEQ ID NO: 1757 - DNA, 699 bp, Glycine Max
ctatggaatttcatatctgactgtacttcctttgatgatgtatctgttggagtagaagaactggtgcatggactaaggggccttttcacattcttgattttcattgcgtctaactattttttgggatcaaaacgatttcgaatacagttggaaattcaacacttgagtagattcagtggatttagtgcaagcattggattatcgggagaggcagaaaaaggatataaccctgttgcaaacatctctggtcatataggaaccagaattctcaccctgggagctaatcttgcctatgacttatcagcaagctcatcagcaaagataactaacaatctgaatgctgggttgagcctgaacagtccctaccttgttgctgccgcaaccttgcatgacaattttcaaaccttgaaaggttcctgttattttgaagtgaatcccctgaccaagactgcaattgcagcagaggtgaagtatgaccttgcagattatgagactatcggtgtcaccgtgggtgctcagcacgcattatttccttggacactgctaaaggcccgacttaacaacaatggcaacgtaggtggtctcattcaacaaaagtttgggagaaaattttccataaccgtggcgggagagatgaattttaacgaagaagataaagaaaagtttcctaaggttggagtctccatggctctaaaataa

SEQ ID NO: 1758 - DNA, 123 bp, Glycine Max
ctcaagcccactcacgtcttcaatgtcgctagcgtcacggaccgccccaacatcgactggtgtgagtcccacaaagttgagagcatccgaaccaacgtcattagaaccctcaccctcgtcgac

SEQ ID NO: 1759 - DNA, 1548 bp, Glycine Max
ctccttaactcgaagtggggatcgacggtggcgagcatatggatccagtgcaccagcgggtcactctacacattctccatctactcacaaaccataaagtcaacgcagcgctacgatcagtcaacactcgaattcgtatccgtctccaaggacatcggagtcaacgtcggcgtcctctccggcctcctctacgacttcctggcccgcagaactacgaccgggccctggctcctccaccttttgggctcggcccaatgcttcttgggctattttctcatgtgggccgccgtcgccggactcttacccccggtgcccttgcccgtcatgtgcttgttcatgttcgtggcggcgcacgggcagagcttctttaacacctctaacgttgtcaccggcgtgcgtaatttccccaacaatagcggaaccatcgtcggcattatcaagggatttcttggtctgagtggagcaatattaattcaaatgtacggaacaatattcaacaacaagcctatgtcatatcttctgacgctagcgctcttaccacctataaatacattgctacttatgtggtttgtaagaatccacaacactcaggaggcggaagaaaggaagtacctgaatatgttttcttcgatggctctggttgttgctgcataccttatggttgttataatcctagagaacatctttagtctgcaatcatgggtgcgcatatttatatttgttgtgcttatggtgttgctagcctcacttctttgcattgcatttgaagcacatgaaaagaactccggtagaagttttctagatgaggggtcaccactaattgtcgagccaagccccgaggatactacagaaaaggaggatgcaaggaaagattctttcaacaatcaaaggactaatttgcaactaggagaaaacctgaatcttttccaagcagtgaaaactgtgaacttttgggttttgtttgtttctgtggcatgtggtatgggatcaggacttgcaactgttaacaacttaggccaaataggggaatcccttggttataccagccatgagacaggttccttggtttctttgtggagcatttggaatttcctgggacgcttcggagccggttatgtgtcggattattatttgcacacaagaggatgggcaagacctttattcatggtcatcactttactgatcatgagcattggccatgtggtgattgcttctggacttccgggtgccctgtatgccggttcgatattggttggtatttgttatggctctcagtggtcactaatgcccacaatcacttctgagatatttggtgttggaaatatgggcagcatattcaacaccattactatagcaagtccagtgggatcttatatattctctgtgagagtggttggatatatatatgacaaagaagcatgggatggaaatacttgcattggaactcattgttttatgttttcttttctcataatggcttctgccgctattctgggttctctgtcggctttaggtttgtttttccggacaaaaaacttctatggtcag

SEQ ID NO: 1760 - DNA, 2478 bp, Glycine Max
ctgagaaactggtctccaacaacaactcaaatttgtagctggaatggactaacatgtgcacttgatcaggcacgtgttgtaggccttaatttgtctggctcaggactatcaggttccatttcaggagagttcagccacctcatttctcttcaatcacttgatttgtcttcaaactccctcacaggctcaatcccttctgaacttgggaagcttcaaaatctaagaacacttctgctttactcaaattatctctctggtgccattcctaaagagataggtaatttgagcaagttgcaagttcttagactaggagataacatgttggaaggtgaaataacacctagtattggcaacttgagtgagttgacagtgtttggtgtagccaactgcaacttaaatggaagcatacctgttgaggttggtaagttgaagaatcttgtgtctcttgatttgcaagtgaacagtcttagtggttacatacctgaagagattcaaggctgtgaagggctccaaaattttgcagcatcaaacaacatgcttgaaggagaaataccctcctctttggggtctctcaaatcattgagaattctgaacctggccaataacactctatcaggatcaattcctacctctttgagtcttctctccaatttgacatacctgaatttgcttggaaacatgttaaatggtgaaattccttcagagcttaacagtttgagccagctacagaagcttgacttatccagaaacagcctttctggaccactagccctcctcaatgtcaaattacagaatcttgaaactatggttctgtctgataatgctttaacaggtagtattccatataacttctgcctcagaggttctaaacttcagcaactgttcttagctaggaataagctttctggaagatttcccttggagcttctcaactgcagctcaatccaacaggtggacctttctgataacagttttgaaggtgaacttccatcaagcctggacaagctacagaacctcacagatcttgtgctcaacaacaacagcttcagtggatctctacctccaggaattggaaacattagtagcttgagaagccttttcttgtttggtaactttttcacaggaaaactccctgtggagattggaaggcttaagaggttgaacaccatttacctctatgataaccagatgtctggacctataccaagagagttaacaaactgcacaagattaactgaaattgacttctttggaaaccatttttctggtcccattccaaagactataggtaagctaaaggacttaactattctccatttaaggcaaaatgatctgtcaggtccaatcccaccaagcatggggtactgtaaaaggcttcagttattggccttagcagataacaagttgtcaggttccataccccccacattcagttacctttcacaaattagaaccattaccctttacaacaactccttcgaaggaccactacccgattccctctctcttcttagaaaccttaaaatcataaacttttccaataacaagttcagtggaagtatctttcctctgactggttcaaattctctcactgttttggacttgacaaacaacagcttctcaggttccatcccttctattctaggcaactccagagatctcacgcgtctcagacttggaaacaattatctcacaggaaccattccttctgaacttggccacctcactgagctaaacttccttgatttgtcattcaacaacttgacaggacatgtgctacctcaactctcaaactgcaagaaaattgaacaccttctactgaataataacagattgagcggggaaatgtcgccttggctgggaagcttacaagaacttggtgagctggatctctcattcaacaactttcatggaagggttcctcctgagcttggtggctgctcaaagttgcttaagctttttctccatcacaacaatctctcgggtgaaatcccgcaagagattggaaaccttacttcactcaatgtcttcaacttgcaaaagaatggtctctctggcctcattccatcaacaattcagcaatgcaccaagctgtatgagataaggctctcagagaacttcctctcaggtactataccagctgaactaggaggggttactgagttacaagtcatattggacttgagtagaaaccacttttctggtgagattccatcatctcttggaaatctcatgaagctagaaagacttgatctttcctttaaccatcttcaaggacaagttcctccttcacttggtcaacttaccagcctgcatatgctaaatctctcatataaccatcttaatggcctcattccctcaaccttttcagggttcccattaagctcctttctgaacaatgaccacttgtgtggccctccactaacattgtgcttggaagctacgggtaaggagcgaatgcagctatcaaacgcacaa

SEQ ID NO: 1761 - DNA, 2028 bp, Glycine Max
ctggatgatgcgatcacatcagtgtgcacaaatggaaaggttacatacaaaagcttggaggatggaaatcatacttttgaagtctgcaccagacatcaaggacttggctgtgccacctataactggactgttgatactactcccccaacagcagatgttacagcctcagcatcttttacaagttctttaaatgtgtctgtaaacatatctttcacagaaccctgtataggtggaggtggctttggatgcaagtcggtaaatgcctgcaatcttcttgtctatggtgctggccaggtcataccatcttcctttagaattatacagccaaacctcacgtattctcttcttgttagtctatcgtctacagttcaatatggccgggcaatccttgtaatggataggaacttctgcactgaccgtgctggcaacagctttatgagaatgccaaattcaactgtttatatacattttgacagaagaaaggtttatgtcaacatcaggactcatgtaccagaagagctacttcaacttgacagcgaaactagaacagtacaggcaactaatgaccatgataggctaaagatatatttgtacttctcagctccagttctgaattcttctacagaaattttgaattctatcaacattagtcagggttcacttcttctaaataatgcaaaaagtcttggaaatcgtagatttggattcacgattgctaatatctcctctactgctataatatcagttgacttcaattcggagtctataatatccagacaagggactcaagtttctccaattgcaccaaggcctgctgtgatgttgaatacatatagcatgaggacgagagagcacaatctccagatattatttaaatttgtgaagcctgtttttggcttcaactcctcttgcatatcaatttctgggggtttattaaaaagtttccatgaaataagtcggagcacatacatggttgagttacaagcagatgatgatctagtatttattagtgttcctgagaatgtaacacgagatgttgctggaaacaaaaatctagcttccaattttctacaagtgaggcactactctatgcctctcatttcttctgtggtctctgcatttgcaactgcttgttttgtgctgacatctattgttgcgggctttcttactatctcaactgcaaacctacaatctgttggtacatttacaagatcatcatctttcttggtctttgatccggcaaggaatcttcttagaattttgagccatattcaggtgtttgcactatctagatggttaacagttaaattgccagtcgagttttacgaatttgccagacatttacaatggaccgtaccctattttcctgttccatgggaagctgaacctatgaacctgtttatggtaggctctaatccttttgggagctctaacttcatcaccaaagccccagcaacaatcccaaagaagttcttggacaagagtttgaatttggccgcttcagtgtatggatcaccacttacttcttccgagtacctgcaatactttgagagcgaaaatatgaaaccagaagctgaatatcttttggattcacaacattccgctggatggacagaattttatagaagcatgttttggttagctgtgatctgtggtggtttaatggttctgcatgcttttctcctcattgtcctgaaatttgggaagagaaattctgagaaggataaaatacatggagcactcacattccctagatttgaaatgtttcttatatttcttgcactacctaatgtttgcaagtcctctggtgtgcttcttcaagtggcgtcaaccacattagagtgttttatgaagcatgggaaaaactctgctggtcattcatttcttttattatcatcctattatcccaccatgcaaacagtaattagtgttattattacatatgtcatctattttattatacaacagcattatagaagagttagatttgacaagccttcctatggatgcttgagtcaaagttcgtag

SEQ ID NO: 1762 - DNA, 480 bp, Glycine Max
gaacaaatgaaatacttaagctctgattatatagagaagtcagaaaccattgacagttggcatttccaatcaatcacaactgaatttctcaattcactaaacacatatggtctgccaaatcatcgtatcaagctaaaaatcgatagtcctataatgttgctaagaaacttagaccaaacactagccaaacatgtcattgcagctgaaatcatttctagcaaaaatcttggcgataatgtttacatcccaagaatgtcaataagacaatttccaatcatgctatcttatgcaatgacgattaacaagtctcagggccaatcactttctatggttggactttatttgccaaaaccagtctttagccatggacaattatacgttgcattatcaagggtcaattcaaggcaaggattaaaagttcttattcatgataaagaccaaaaaaatatgacttctactactaatgtagtcttcaaagag

SEQ ID NO: 1763 - DNA, 216 bp, Glycine Max
gaaccaaagggacaacttctatcaattgatggcaaaacagaggaggaggtttgtaggagtttagagagagtgctccgtactatgcggataactacctcagaacccaaggatgtggcttttgttgttgatggctgggcacttgagattgcacttacccactatcgtaaagctttcactgagctggcagttttgtcaaggactgctatatgttgtcgt

SEQ ID NO: 1764 - DNA, 122 bp, Glycine Max
gaactattgaatattggagactatcaatttggggttgaggcgctctctcgttactggaatttcccagtaagagagatagacacaaagatcttgctggtctcatactcgaaaaatttaaggaa

SEQ ID NO: 1765 - DNA, 768 bp, Glycine Max
gacttgcttggtgcccctgctgaattgattaggaggggaaagcatggaagcctctacaaggttatgctcgataatggggtgctgttggcagtgaagaggatcaaggattgggggatttccaagcaagattttgagagaaggatgaatttgatagcccaagtgaagcatccacgcgtattgccacccgttgcatactattgctctcagcaagagaagctcctagcatataaatatctgcagaatgttgtaagcaaagtaaggtgtcattacattcatttgatatggaaatcactgctaaacggaagaactattaaactaggaaaaagcagactaaatgttgctgctaagatagctgaggctttggcatatgtgcatgaggagtttcttgagaatggaatagcacatggtaacttaaagtcaagtaacattctgtttgtccattctcacaacaaaggtctcaaaagcaaagatctaattgcatccatcttcaaagctgatgtacatgcctttggttcgatacttctcgagctgctgacagggaaagtaattaaaaatgatggatttgatctagtcaaatgggtgaattcagtggtcagagaggaatggacttttgaagttttcgacaagtccctaatctcacgaggtgcttctgaagagagaatgatgagtttgttgcaggtagcactaaaatgcgttaatccttctcccaatgataggccaagtatgagccaagttgcagagatgacaaattctttgatagaggaggaa

SEQ ID NO: 1766 - DNA, 228 bp, Glycine Max
gagctggttctgcaatacttgaagcgcaaggtcttctcttaccctttgccagcctctatcattcctgagcttcatgtttgcaagtctgatccttgggatttgccaggtgatttggagcaagagagatacttctttagcaccaaagtggccaaatatcccaacggaaatcgctccaacagagccacaaattcgggttattggaaggcaactggcttggacaaacaaatt

SEQ ID NO: 1767 - DNA, 121 bp, Glycine Max
gatgaaaagtattggccactgatgcctccattgcctttatatgggtatgggagggagcatcctgggcctcgatatggcagtttgattcatggtcaacatcttacagatgttgtgataacag

SEQ ID NO: 1768 - DNA, 435 bp, Glycine Max
gcccggtcaggttttaaatcccatggtgaagggagtacacaactttcaggttctatccaattatcatcaaaagaatcattctttggcaagactgaggcaaagactattgctgacattaacaccatctctgaagaaattgtttgtgtcactgttggcacaattactaggattgttctggacaatcattcatggtgttatatagcttgcattcagtgccataaaaaaagtgatgcagagatggggccctttacatgtgcatgcggcaaatacaataaggaagctgtgcttaggtataggcttgaggtgatgatcaaccagggaaatgaaagcacaaaattcctactttgggaccgtgaatgcagtgaattaattggccaatcagctgatgcagttaataagcttaaaattgaagtgtgtttttggattcaaccttaa

SEQ ID NO: 1769 - DNA, 417 bp, Glycine Max
gctgctttcctgtctgctttggctgggtcagaggttgcacaagctgctgctcaagctgcattgacaactctgtctgaggtttacaaagcaactaaaataaattatcggtcgtttccaaggaatacattgctgcaagatgttggtatcacgtctaacgatggtaatacttcagattcatttcaaggatctcgattgcatgcaaacatacagcttgagaaggaagagttagatgtggaaaaagcaatttatgagattatagaaatgaaaaatatccaagataagcttgttcattttgaagatttggacctgctgatggaaaaagaaggccagcagatggagcaaatgaaaaatatgttttttcttgatcagcttactcttttatttcataaatcatctgcaccaaaaactggagaatga

SEQ ID NO: 1770 - DNA, 1479 bp, Glycine Max
gctgttgatgaacttgaaactgccaaagccgaaatgggtgaagtgatggaagaaaatcaacgactaaagacgtgtttgagccgaatactaaacgattaccgcacactccaaatgcaattccacaacagagttgaacaagagacaaaagactcttctgatcagaaagtgaacaacaacaatgaccatcaaagagaggaatcagacctagtttccctcagtcttggaagacttccaactagaaacaatgagaaagttaataataaaccattgaaagaggaagaaaaagaagataaagaaggctttgttgaagaagtgccaaaggaagaagcagcaggtgagagttggccacaaaggaagggacacaagacagctagagatactactggtgaggatgaagtttctcaacaaaatcctgcaaagaaagcaagggtttgtgttagggcaagatgtggcaccgcaactatgaatgatgggtgtcaatggaggaaatatggacagaaaatttcaaagggaaatccttgccctcgagcttactatcgttgcacggttgcaccatcatgccccgtaagaaagcaggtgcaaagatgtgctcaagacatgtccatattaatgaccacctacgaaggtaaccacaaccaccctcttccactttcagccacagccatggcctccaccatttcagcagctgcttccatgctattatccggctcatcaacctcacactccggatcaaggccttcaacagccatgaccaccgccgcttcctatcagacggttccaaatcaaagcaatacttacttgtcccatcctgcagcactctcatcttcaccttcacaccccaccatcactctagacctcacttccaataataatccatcctcatcttctgttcctcttgttaaattcacttcgaattcaacctttaataacccacaaaggtaccctctttccacaagcctaaacttcagttactcagaatccaataatgcaacttcttggagcaataatgggttcctcagctacaacaacactctaccatataatagcaatagaaatgtgacaaatgtccttagcaacataaaccttggaaaacaacaacaacgaccattggaaaacatctacaattcctacctgcaaagaaacaacaatattaatccaatcccgccaccacaacattctctaccagacaccatagctgcagcaacaaaagaaaacctgagtcagcaaatgaaatggggtgaattgtttccttcatcttcttctgcattaccttcatcttcaacaaaagtcaatggttgtgcatcaagcttcttgaacaaatcagccgctaatacaaaaccaggaacaactttgatgtttcttcagccacttttgcctctttctagccccaaaagcgcttctggaacatacgcatgtgatgttcacactttcatcaatttcaaaaattatagtatgaaaagtagtctaacaatcttatag

SEQ ID NO: 1771 - DNA, 185 bp, Glycine Max
ggaacttataacactatcacggacaagagtgatgtgtatagcttttgggttgtgcttattgagatgatatcatcaatgccagcagttttagcagccagggaaagagatgaagttaacttggcaaatattgcgatgaaaaagattcaagcaggaaagcttagtgagcttgtagacccatcctttgg

SEQ ID NO: 1772 - DNA, 457 bp, Glycine Max
ggagtttcgttacatggaaaagatgtggaagaagacgaggatgagttttgtggactgaggattgaagaaaggaagttgggggagtatgagtgtttgacgcttattctgtctgaaagcgaagagaagaggatacaaagaccctggtctacttctgttattgtaaagttgttagatcgaaaaataaggtttaaggccctagagacgagacttaagcaaatgtgggtaaggaatagggttatccatttttttaatagggaggataagactaaagcgttgattgagggtccacggttgatatatgaccattatttaatagtctcaatagagaaggtagaagtgtgtgtccgcctatctgagttaccaattgagtattatgatgcaaatgtcttgtatgttatgggtgacaaaattgggaggatagttagagttgataagaatattttttctcaagaaaggg

SEQ ID NO: 1773 - DNA, 243 bp, Glycine Max
ggatattttcctttcttgttattttcttctttcagctttcttccaatgggaacattacagagccgtttggatgctgactttctcctatctcatatgtgctctgttaagtttaaggaatggatagttgtcctggctactctcttaagacgttttgaggtatgtttggcttctctatgtacaggacaaaatatgtgggagagaaatatagatgggcaacaagaaactaattcaggcaacaagtaa

SEQ ID NO: 1774 - DNA, 317 bp, Glycine Max
ggccgagcacacttcttgaaggtagaaaagatttgtttccaagggaaatctgaataccagactatgctagtttttcagtcatcaacatatggtaaggtttttgtccttgatggagcactccaactcacagagaaggacgaatgtgcttaccaagaaatgatgactcaccttcctctttgctctatccttaacccaaaaaaggtgctgcttattggtggtggagatggtggcattctaagggaaatttcccgccactcgtccgttgaacaaatcgacatatgtgaaatagacacaatgctgattgatgtaaataaaat

SEQ ID NO: 1775 - DNA, 78 bp, Glycine Max
gggaaattgattatcattgctaacaactgcccccctttgaggaagtcggagattgaatactatgctatgttggcaaag

SEQ ID NO: 1776 - DNA, 507 bp, Glycine Max
ggtcttgagcttctgaagattgccattgctaaagctggttacattggaaaggttgtagttgggatggatgttgctgcttcaaaattttatgatgacaaggacaaaacctatcacttgaattttaaggaagagaataatgatgaatcacagaaaatcttaggagacaacttaaagaatgtgtacaaatcatatgtggcagattatccaattgtgtccattgaggatccatttgatcaggatgattgggagcaccatgtgaaattaatagttgaagttggccaacaagtccatattgttagtgatgatctcctcttcaccaacccgaagcgtgtggacaaagcaatcaaggagaaggtttgtaatgcccttctgttgaagaaacatacatacccaaatcatttcttacacattgaatctattgatattcttattagacttaataagaaggcccctgttggaccattttttttgtgccaactcaatggtttttataggattaggacgtga

SEQ ID NO: 1777 - DNA, 162 bp, Glycine Max
ggtgctggttctgtggttattaaggatgttcctccaaggactattgttgtcgggaacccagcaaagctggtaggagggaagaacagctctgttaagttggataagatttctatcttcaccatggaccatacttcacatattgctgacttttatgattattgt

SEQ ID NO: 1778 - DNA, 762 bp, Glycine Max
gtaaccaaaggctatgtcaagttattgaagtatggtgactcgctttaccggtgtaagtgtgttaaggttgttgctcttggccacatgtgcactgtgatcaagagggttgacccgagtttggcttatttagaacaggtcagacaacacatggctaggcttccctctattgatccaaatacgaggactgttttgatctgtggatatcctaatgttggtaagagctcgttcattaacaagattatgagagttgatgtggatgtccagccctatgctttcactaccaagtctctctttgtaggtcatattgattataaatacatgaggtaccaagtaattgatacgccagggattttagataggccttttgaagattataatattattgagatgtgtagtatcactgctctaacacatttgagagctgcaatcttgtttttcttggacctggcagtgctgtttcacaacattaagtctttgtttatgaacaagtcgttgattatagtctgcaacaagacagacttgcagccactagaggggatatcaaaggaaaacatgaagttggtcaatgagatgaaagctgaagccttgaagactctagttggtcaaggaggtgagcctacagacaataacagtgtattgttgaccgtgagcactttgacagaaaaggagcaattgctggtggagataaagatgaagtcaaagaaaattaacaactgcttgaacaaaaggaaaagcctccatgtattcctgaagcagttttag

SEQ ID NO: 1779 - DNA, 438 bp, Glycine Max
gtctataaacaatttttcccggacgtggctgttggatacaaggaccctcgagtcaatcttcatatcatagatggaactctttttttgaattctgttccaagagaaacctatgatgcaataatagtggatgccttcggcccaataaggcctgatcatgagctttttgaatctcagttctttgaactggtttcaaaggctcttcgtccaggaggagtattgtgcatccaagcagagagtatttggtttcagtccttggatattgaagaactcctcaccaaactttcaaaggctccacttatgcatggacaacttggggtcattggtttcttgctatgctccaccgaaggtccatatgtcgacttcagaaatccaattaacccgatcgatcccgaaaattatggcatatcaaagcaacccttgaagttttacaactcagaa

SEQ ID NO: 1780 - DNA, 121 bp, Glycine Max
gtgatgcttaaacaagcagatggttcttatgcttgcatagcagaaaatgcaaaccgcttcagccttggcgaggccaaagaggaattgttgagggtcttgggacttcaagaagaagagggaa

SEQ ID NO: 1781 - DNA, 1493 bp, Glycine Max
gttgtactggacaaatgtgagctgattggagaacctgtcccagcaccaaaagatgcacctacagaatctgcaactggtcaatcaggagtcacatatgggaatccacaacttttgaatagcagttcacacactggtggcatgcctgctagaccaaatatagcttcaccatctccagatcatccaaaagcaaatccttatgccagtagtgtttattctagtaatgcccttcctacttatcctaaagtagagcatgaaattaaacacaggtccttgcaaaactcatatgctcgtccacctcagcagcctatgtaccgtcatccatctccaatgtacactaacaaagcgccaatgggaagaaatgaagctgcccccaggataattccaatagcaacattgaatccataccagagtatgtggactattaaagccagggtaacatttaaggcagaactcaggcactataccaatgctagaggtgatcgcaaggtgttttcttttgatcttctggattctgatggcggagaaattcgggcaacttgcttcaatgttgtggctgatcagttctacaatgttattgaagctggtaaggtatatctaattttcaggggaagcataaagccaactcaaaagaattttaatcaccttcccaatgatcaagagctgacccttgatgtggcatcaattatacaaccatgccttgatgataatgactcaattacatcacaaacatttaattatcgccccattagtgaaattgaaagtttggaaaacaacaacattgtggatgtgattggtgtggtgacttctattagtcctaaaacatcaatcatgagaaaaaatggcactgaagttcagaagagaactctccagttgaaagacatgtctggccgaagtgttgagttaactctacggggaaatttttgcattgtagaaggacaaatgttgcaaagtatttgtgatgttggggaatttccagttttggctacaaaagctatcagagtaaatgatttcaatgggaagtctgtcgggactatagccactagtcagctatatgtggaggctgattttcctgaggcttgtatactgaaaatatggtttgaaaatgaagggaagagtgtcccaactctctctatttccagagaaatgtctaatctaggtaagactgatgtgcggaagactatatctcaaattaaagatgagaagttagggacttcagagaagcctaattggatatctgtctttgcagcttttcacacattaagggatagacaatgtaacaaaaacgtgactaataacgcagatgggacatggcattgtgaaatatgtattcagtctattgacgcatgtgactttaggtacttactgtcaatgcagatacaggatcacactagcataacatgggttactgttttccaaaagagtggtgaggagatcatgggtatacctgcaaaatatttgtattatatgaagtatgaagagcaagatgatgataa

SEQ ID NO: 1782 - DNA, 402 bp, Glycine Max
gttttctttttttgttattctaggtttaccactttcttgtcccacactcaaaatcaaaccctagaaatcgatttatctaacgaagaaagcaaaagacgtttgtttaatcagctattatatagaagcaaccagcgagggttcctggaactagatttggtcctcggaaaatgggttgaggacagcattcactccttggatgaaattctgattaaggctctcgttcatgttctcgacatgctttggggtagttttgttggagctagttactgggaggtcacctgttcaacctttggaacaaggtgggcacaaccgatgcagaatggccaggattctaagacgggcgtgcttcgagacccgtcttcgaacccaacccattctaaggcggttcatcaaccgatgtag

SEQ ID NO: 1783 - DNA, 216 bp, Glycine Max
tactttgtcgctgtgatgaggcttcgcaacatgaccatggtgaccatgaccatgaacatggtggctccgaacaacaaggccgttgcgctgcgggggctcatgccgctgcacatgtcgctattcgacaacattgttgatttggtgcggtgcgagcgcaccatgaaccggtggattccattgacgatgatggagtttctgctactggatgtggacagg

SEQ ID NO: 1784 - DNA, 378 bp, Glycine Max
tatctcctccttacacaggtgacatatgcattgcttatggtgggtgaggatctagacaaaaatgttgatgtaaagaacattcttgttgagatgggaacatactttcaagatgattatttagattgttttggtgatactcaaacaattggaaagataggtacagatattgaagatttcaagtgctcgtggttaattgtgaaagccgtggaacttagtaatgaacaacaaaagaaagttctacaagagaactatggtgtatttgaggagtacgagagtgggagctatgcgaaggttgtatcctccattgaagctcatcctagcaaagcagttcaagctgtattgaagtcctttttggctaaaatttacaagaggcagaag

SEQ ID NO: 1785 - DNA, 276 bp, Glycine Max
tattattccataaaaatgattatcttgaaatttgccgttgctacaaggcaatatatgagattccatctgtcaaagaaaattcctgtcgagtggatttcaatcctgaggaaaatatgttggtatttggttttatcaccgcatgatccaatgcagtcaagtcttatcaattctaccttggagaataagaatgttaaacaatggacaactctttgggattcatacaaggatgagtttgagaatgagactcaagatctgagggaaagagtaattgaacat

SEQ ID NO: 1786 - DNA, 138 bp, Glycine Max
tcagaagataggttctatgtagatcagcgtgagaatcgccagtttatatcaagaatttcagatggtcaaaaggttcttgatatttgctgctttagtggcggttttgctctaaatgttgtgcgtggaggtgctctaaat

SEQ ID NO: 1787 - DNA, 2034 bp, Glycine Max
tcatcccacttcagcagcttcccgaaatccttctccctccggaagaaagtcccgtggtggtaccagatcctcgacccacgttcgaggttcgtggcgcgatggaaccgcacgttcctctacgtgtgcatcgtggcactgttcctggaccctctctacttctacttccccatcaccggggacaaggcctgcatgcagaccgacatcgtcctcggcgtgttcgtcacgttctctcgcaccgtcgccgacctcttcttcctcttccacatggtcctcaagttccgaacagctttcgtgtctcccctctcccgcgtctatggccgcaatgagctcgtcaccgatcctcgccagatcgcgtcgcgctacctcaggtcggatttcgctattgatctcctcgccacccttcctctgcctcagatagtgatctggttcgtgattccggcagtgaaagattcgacggcggctcatgtaaatcacaccctgtccttgattgttctaattcagtttattcctcgcttgttccagatttttcctctgcaacggagaatcttgaagactagcgggcttattgccaaaactgccttggcaggggccttatacaatcttggttcctacatgctagccagccatgttttaggagcttcatggtacgtttcgtcaattcagcggcagtacgagtgttggagaataacatgcaaaaaggagatgaacagaacgcattctccatcttgcaacccttcgtttctcgactgtggtaccatcaccaactacgaaaggcaagcttggttcaaacgaaccagagttctcagtgattgcgatgccctcaatgacaaaaacgagtttcagtttggaatgttcgctgatgctttcactgatcatgtctcctcatcaagattctttcagaaatacttttactgcctctggtggggtttgaagaatctaagttcatacgggcaaaatcttcagactagcacttacagtggtgaaacattgttttccagtttcatatgcatcgcaggtctaattctgtttgcgcatctcattggtaacatgcagaattatctgcaatcctcaactgctaaagttgaagagtggagacttaaacagaaagacacagaagagtggatgaatcaccgtcagcttccaccagaactgcaacaacgtgttcgcaggtttgttcaatataaatggcttgccaccagaggagtagacgaagaagccattttgcgtgctttgcctctggaccttcgccgccagattcagaggcatctctgtctcgacattgttcgtcgagttccattttttggccaaatggatgaccagcttctagatgcaatatgtgaacgccttgtttcatcgttaaacacaaaagacacattcatcgtccgcgaaggagatccagtgagagaaatgcttttcatcatcagagggcaagtagagagttccactaccgatggtggaagaacaggattcttcaactccatcaccctaagacctggtgatttttgcggtgaagaattgctaacatgggccttgatgccctcctcatcaagtctcaaccttccatcttccactcagacagtcaagactctcaccgaagtggaagcatttgccctaagagccgaagacctcaaattcgtcgccagccaattcaagcgcctccacagtaagaaattgcagcacgcttttaggtactattcgcatcagtggagggcttggggggcacattttatacaagctgcgtggagacgccaccgcaagaggaaattggcgatggagttgctggagaaggagaacttgtactacacaaatgtaatggaagatgatgatgaagaagaaggtagtgcaggtgagagttcaatggcagggcatgctcagaattttggggccacatttttggcttcgaaattcgctgcaaacactaagaaaggggcagttaaaaaggtgactattaatcttccagatgctggtagtttgaagatgcctaagatgttcaaacccacggaacctgatttctcaatattccatgatgattag

SEQ ID NO: 1788 - DNA, 2043 bp, Glycine Max
tccaatgggggcaaaagcagcaaaaaggaaggcaaaaaaaaaaagaacaaaaatcttttgatgttgttatcacacagctatggaagacataataagaccaaagcaaaagtcgtagaagatctttcacatgccaggaaagaccgcaacaagttaaaggaaaaagagatgttgatgaagaaaagagaaatcaactttcaaatcctctacaaggatattactgctaagaacactttttctcctcacggtttttctccaccacgcagtcacgcacgcgcacaagtcatacgactctttcccttaaaaggaaaacaaaacgtgactcacactcacacaatcatgcgacacaccacagcggcacagcctcagcccaccaccgcaccaccatgcaaaattttaaatatggattcttttgaagttaatgttgatgagaatgacaatgagagtattgatgtggatgtgcatgaaaatatgatatctatgatgattattgagcatgatcttccattctcttttgttgaacatagaaggtttaaagagttattacgatatttgcatcctgatgtgaaggtaccctctaggtgtgttgctaccatgaatgtgaataatctgtatgaatctgaaaagaaaaaaatgaaatgcatgttgtctaaagtccctagtagaataagtttgacatctgatgtgtggacatcttgtacttctgagggttatatttcattaactgcacattatgttgatgcaaattggaagttgaatagtaaaatgcttaatttttctcattttcctcctccacactcggggcgtgagaaggctaaagttatatatggttttttggaagaatgggggattgagcagaaagtattttcattaactctagataatgcttcttccaatgataaaatgcaagactatttgaaggaaagactttttttgcatgctaatggtttagtaagtggtggtgaattttttcatatccaatgttgtgctcacattttaaaccttattgttcaagaggggttgaaagtagccggtccttctgtaaacaaaattagagaaagcattaagtatgttaagggatcagagggtagaatgcaagtttttaaagcttgtgttgcaaaagttggtggtattcatacaaagatgggtttgcgcttagatgtcattactaggtggaattctacttttctgatgcttgagagtgcccttgtatatcgacgtgctttttgtagtcttgcatttgatgataggagctattcaagttgtcctactaatgaagaatgggagagaggacaaaaaatgtgcgattttttgcatcctttttttcaaatcacagagttgatatctgtgtggaaaattgaatgtttattgcttcaaaatttgaagaatgaagatgagttgattagaacaatggcaattgatatgaaaacaaagtttgataaatattggagtgattatagcaatgtgctttcctttgggagtttatacaatttgaagatgaagatatgtcacaagtgggtaaaccttaaccagatacatatttggaagaggcaaatctttcaaataaatatcatcccaatcttgatgttttgcaatattggaaggataatcaagctcggaaaagaagatgaagatgtggagatggagaaggctcaagctacttcaaatatggaatcatttgttgttggagataagagggggcagactggcccagtccactgccaatgcggacttatgcgggcaggccttacgtgggacgggccgacccgcttacccacccctaattattggaaaacattagaaaaaccaaaaagaggtatgcaaactttgaaaataagggttcgggagttgtttatgcatagggaaggtattagcaccccacgcgcccgtcacaagggacgacaacctttaatcgagtgtgcacaacatttttattttatttttttagggtcgacaagggtgttgccctttctcctacgtatcctcaagtgcgatgaggaattcagacctacgcgttggaccttgaaacgatgctttaaattttga

SEQ ID NO: 1789 - DNA, 519 bp, Glycine Max
tcggaagaggaagccgaagcatgtctggacttgctgctgcacgaaccaaacgaggccttaatcagcgcccttctcgtgcttcttagagccaaagaagagacttatgaagaagtgagttgtagggttggcgagggcaatgctgaaacacgcgacaaaggtagagagagggtttggacgatgtggttgacatcgtgggaaccggaggggacggtgccaacaacacggtcaacatttcgactggtgcttcggttctcgctgcggcttgtagtggcagagttgcaaaggtctcgaggaaagcgtttgagttcttctgcgtgtggaagtgctgacgtcgtattagaagctttgggagtggtcatggacttaggccctcagtgcatagatgaaaatgaaagagctatgaaaagagatgaaagaataaaattcaaacatttccaaatatataaggacaaaaaatatattttaatcaaagatttatttagacaatattcaacacttagtaagagagaaaaaatatag

SEQ ID NO: 1790 - DNA, 993 bp, Glycine Max
tctcacaaagactcatggaagccaattatgactgcaaagacaaacactcaaagctactggcttaattggagagttttgctttgtgccatatggattctggtttcagtaatcttctcaaccttgcttttatggaagtatgagcgtttgagaaaaccagcaaggaatggtagccgggtgacacaacaagaaacatcagcaactttgtatgaggatgaaacttggaggccttgcctaaaaggaattcaccctgcatggctcatggccttcagagttgtggcgtttatcatgcttttggtgcttctcataatcaatgcaactgttgatggaggaagcattttctactattacactcagtggacttttacttcaatcaccatctattttgggcttggatctttgctctccatatatggatgttaccaacatcataagaaagcaactggggataaggttgataatgtggatggagatgcagagcaaggaatgtatgatgcttctgcactcccacaaagctctaatccatcagaccaagagaaaagcctcggcttttggggttacatttttcaaataatattccagattaacgctggttccgtcatgctcaccgattgtgtattttggttcataattgttccatttctaaccatcaaagattacaacctaaattttttgatagtcattatgcactcaatcaacgcagtttttcttataggtgatacagctttaaattgtctgaggttcccttggtttcgaataggatacttttgcctgtggacagtcacatatgtgattttccagtggattgttcatggttgcattaatctctggtggccatatccatttcttgatttatcatcctcttatgctccactatggtactttgcggtggcattactgcatattccatgctatggaattttcgctttgttaatgaagctgaaacaccatgtattgtcaacgcggtacccggactcatatcaatgcgttagatga

SEQ ID NO: 1791 - DNA, 117 bp, Glycine Max
tggccactgtttacggaacagagaatgaatgcggttctgccatgtgagggtctcaaagtaggagtgaggccaagagttagtgaaaatggcttggtggaaagggaagaaattgtgaag

SEQ ID NO: 1792 - DNA, 415 bp, Glycine Max
tgtgaaaaaatcaatgtcaaaaggggtgtgtggactacagaagaagatacaaagaagcttgcatttggctccaagcatagatctggtaattggacctctgtccccaaaaaatcaaggctcaaaaggtgtggaaagagttgtaggcttaggtggactaactaccccaggcctgatcttaaagacgacaacttcactacccaagaagatctaattatgaagcttcatgcagccataggtagcaggtggtctatagtagcccagcaacttcttgggagaacagacaatgatgtaaagaactattggaacacaaagctgaaaaagaagctctctcaaatgggaattgaccctgttacccacaagcccttctctaaactcatttctgactatggaaacattggggattgccagaaaccaa

SEQ ID NO: 1793 - DNA, 558 bp, Glycine Max
ttcaggaaggaggaggtgacccttcaagttgatggttccactggccgtataattgtgaaaggcgaaaggcaaacaaatgaacagaaacgagttcagtttgagctggcctttccattgcctccagattcagatgtggataacatatccggaaactatgacagtgaaatccttcacgtgcatgtccccaagcaagcttcacatcaagagcacaacaaagaaagtagtgatatagagaaagcttcaaattatggcagtgttgaaatgccacaagaaattgaaagtgaggaacacaatgttgttgatgagggaaggaatcatggtcatgaacaacataaggaagatagagagaagaagaaagaaagaagaaatgaaaatgcacaacacatggatgattattattctaaaaaattgacaagtaagttggagcaaaaacgcgacatgtcaagagctctagaggaggttttgatgagaaacaagggagttgttacaactgcagttgtggccttttcttttgggttgtatgtatctaataagttccattcatggaaagaaccataa

SEQ ID NO: 1794 - DNA, 2058 bp, Glycine Max
ttcttgttttgttgtgtgctgctgcttttggattcttcaatttcacttcctctatgtgttgattcaagggctccttttaccttgaataacacacttgtattttgtccttacaatgtacacacgtgtggcaactccacagaagatgcgcagatagagaagcaattccgagcgagcaacgtatcagatcctggctgtgcctcggttttgaaatcaatactttgtgcgaggtgcgacccattttcaggggagctatttacagttcaatcctcacctagatcagttcctgtgctttgcaattccaccataccagcaaattcttctcaatcaaagacagaggtgcacgttttttgctctcaagtatgggacacatgcaatgatgtatccatagtgaattctccatttgccccttcattacaaggtcaagcaggagcaccagctcacaccaatgctaccaaactcactgatttatggcagtccaaaactgacttttgcactgcatttggtggagcatctgataattcatcagtgtgctttgaaggtgaacctgtttcactgaataaaactgagacctctattagcccccctcacggcttgtgccttgagagaattggtaatggatcttacctcaacatggtggctcaccctgatggctctaaccgcgcattcttctctaaccaaatgggcaaggtttttctggcaacacttccagatgtgggatcaggaggaacaatgaagcttgatgaatcgagtccttttgttgatctaacagatcaagtttattttgatactcaatttggaatgatgggcatggcatttcatccagattttgctaaaaatggacgattctttgcttcatttacatgtgataagtctaagtggtcaggatgtactggaagatgttcttgtaattcagatgttaactgtgatccatcaaagttaggtactgatcacggtgcccaaccatgccaatatcaaactgttattgcagagtattctgctaatagcactggatctcagccttccttggtggaaagtgctaaaccaactgaagtgagaagaatatttaccatggggctcccatttacatctcaacatggtggtcaaatactcttcggacctaatgatgggtatttatacttaatgatgggatatggaggaggtgcaggtgatccttacaattttgcacaaaacaagaaatccttgcttggaaagattatgaggcttgatgtagacaacatcccaagtgcagcagatattagtaaactcggcctttggggtaactactccattccaaaggacaatccttttagtgaagataaagatctgcagcctgaaatatgggccttgggactaaggaatccttggcgctgcagttttgatgcagaaagaccttcctactttttgtgtgcagatgttggacaggatgtttatgaggaggtggatctcatcaccaagggtggaaactatggctggcgtgtttatgagggcccctatccattccaaccaacacaatcacctggaggaaatacttcggtaaattcaataaatccaattttcccattaatgggatacaaccattctgaattaaacaagaatgaaggatcagcatccatcactggaggatatgtctatcgatctaccactgatccttgcatgtatggaagatacttgtatggagatctatacgctggagcaatatgggcagccacagaagatccgcaaaatagtggcaatttcagcaccagcagaattcccttcagctgtgcacgtgattctcccatacagtgcgactctgcacctggaaaccttcctgctttaggctacatcttctcatttggcgaagacaacaacaaagacatttacatccttgcgagcaccggtgtataccgagctgttcgtccaagtcgctgcagttatgcttgctctcaggaaaaggcaactactactacaacttcagctccctctcctacttctcatgctacacgttggagggtcctttctggatatctggttttgcagtgctcatttttcttgctgcttttgttgggttttatgtag

SEQ ID NO: 1795 - DNA, 384 bp, Glycine Max
ttgcctcgcgaaatagcacagcatatactattctcatcaacaaagataaaagaaatagtggagatgctttttgttaaaccagagctagagaatgttgagatggtagagggaagctattcatatgtgagaagggcctacaataactggagaagaaaagctttgtgccacttcattagagaccatgctagattttgtcatttctatacttgggaagaatgcccaaaaatacttagtgaaagatggagtgaagatgtatcaaatactactgcacattttatgcctttggagggagaaaatgggactagagttaaagctgcagctgtatgccacaaagacacatcagaatgggatccatataccatttttctttttacaaatgcttaa

SEQ ID NO: 1796 - DNA, 747 bp, Glycine Max
tttatattgaaattggtgtctttcctatacttatcttttaaaggaccaagaacgcataatcagcttcattgcttaatcatattggcatgcaggcctgttatgcattattttttcttggagagatttttacagccagctgagtggtttgaaaagagacttgcttatacccgaagtgttgctgctagttctatggttggttacattgttggccttggagatcgacatgcaatgaatattttaattgatcaggccactgcagaggttgttcacatagatcttggcgttgcttttgaacaaggcttgatgcttaagaccccagaacgggttccatttaggcttacaagagacataattgatggaatgggggtaactggtgtagagggggttttccgaagatgttgcgaggaaacactctctgttatgcggacaaacaaagaagcattgctgacaattgtggaagtttttatccacgatcctctttataagtgggctttatctcctctgaaagctttgcagcgtcaaaaggaaatggatgatgatttggatacaagtttggaggaaccacaacatgattgccaaggaaataaggatgctgcacgtgcacttctccgtgtcaagcaaaagcttgatggttatgaagatggcgaaatgcgaagcatccatgggcaggtacaacaactcatccaagatgcaattgattctgagcgattgtgtcaaatgtttcctggttggggagcttggttataa

SEQ ID NO: 1797 - DNA, 96 bp, Glycine Max
tttatgctgggtttgagaatcaagttggatcataatcgctatgaaccccaaaaatctataaagctagttctacatattaattggcctcaagcgtag

SEQ ID NO: 1798 - DNA, 1083 bp, Glycine Max
tttcaccatattgatcagtttcatcacgtgaatatctcctcatccaatacaatccaaactccaaattttgatgcttttgacaatttcacaaatacaggttcatcacctgattttgattttatgattgtaagccttttgtggagaatggtgcttgaacctccctcaaagagtcaaaggaatcaactagatatgatggttgcaaatcaaagatttttgccttttaatcctcaagaaatcaagccctccaattttgttgtaccatatgaagtttcatgcacatccccggtgtattattacaaaagagttggcgtgaacaaaaataataaatcctacccaaccactagaagaacattcaaagttcgcaagaagtccaacatagtaaaggggaagtggacaatagacgatggaaaaatacagaagacttcaaaaatcttcacattgcgaccaaaattgcggaggcaaattaatttttcaaaccttttcatttatactatattgcccggaagaattggaaaacagcgcagagagagatggcataaccatctaaggcctgacattaagaaggacacatggactgatgaagaggataaagtactaatcgaagttcatgatgaagtaggaaataaatgggcagagattgctacgaggttgccaggaagaactgagaactcaatcaagaaccattggaatgcaaccaagagaaggcaacattccaaaagaaagtgtcgctcaaagtaccttagaggcactcttctgcaagagtacatcaaaagcctgaacttagacaagaaccccccaagatattataggagaaaatgttcttctaattatgagtggtcccggatttcttctttggtgagaatttgtttgaagaagggtgtaacgttgattctcttctggatgaaagattttgaagaaaaattgcaatgtgatgatcttacaatgtgtgttccttttgtcaatatcgatgaaaatcatattgagacagagatgccactagagatgttggaggttgaacttaagaaggagctggatttggttgagatgatgtctcagattaataatgaaattcttcatgtatga

SEQ ID NO: 1799 - DNA, 874 bp, Glycine Max
tttgatggagagaaggctaatttgctagttaaagatctccaaaagagctttgattcaggcatgattaagagctatgaatggaggctttcccagttggaatccataactaagatgttagaagagaaagagaaggaaattactgaagctctatataaggaccttggaaaacctcatgtgaatacttcaatcacaatatatccatcatcagtagagattgtgccagaaccactaggggttgtgctgaagatgttcccttttcacactattcacatatctaaaccgtacttggttataattaagaacatgttttcttcatctcattcaatttcatcactgtggagctcttgtagtaggatgtatttgtctttgttatcaatggatccaatcattagagccatttccataggcaatgttgtgttgttgaaggggctattcccaaaacatttgtactcttggatcagaagtgggataagatactttatacaaaaatttcagttgacactgttgaagctttcacttgattataaagttacatgtagtgctagagtaggtcgcattgtcatggctgctactgtaaaacatcttactccaatgattctggaacttggaggaaagtgcccaactgttgttgaatcagatgtcaacttacaagcatgcaataatggacaagcatgcatttctattgattatatcatcacaagaaaagagtttgccccaaagttggtagatgccttaaaagaagaattggaacaatattttggtaaagatcctatggagtcaaaagacatgtcaagaattgtgtctccaaaccagtttgtgaggcttgtgaatctcttagatgaggataaggtatctaacaaaattgttttgcgag

SEQ ID NO: 1800 - DNA, 166 bp, Glycine Max
aaaattaatttaaatagggacattcgtggtgtggctgttgatggtgttgagggagagccagttaacctcactgaacccgttgccgaagcaataggagctgcttttgctgcatggttagtagagaaaaagaaagctcatgattctcagcatttgagagtttctattg

SEQ ID NO: 1801 - DNA, 268 bp, Glycine Max
aaagaaaaacacaacagctcctacaacaataataataaagtccacgtcaagagtactagttggtattatggaggaagtggaggcggaggaggtggaggtggaagtggtggagggtggaaatgtggtaaaaggaagggaggtggaagaggagcacatcattatcaatataaaccatataataagaaagggataacccgatgccagggcatgaggttggaatgctctcttcattgtagtggacctcgttaccatgattgtcaccatatgt

SEQ ID NO: 1802 - DNA, 552 bp, Glycine Max
aatattctgaagaggcttggtggttctgctgacaccattagctataatttcattattgagagtcattgtagggatgagaatcctgaagaggctgtgaaggttctcaatttgatggtcacgaaaggggttgctcctaatgcgtccactttcaattttatttttgggtgcatagctaagttacatgatgtgaatggtgcgcattggatgtatgctagaatgaaggagctgaagtgcctgcccaatacattgacttataatattttgatgaggatgtttgctaagtcgagatctactgatatggttctgaaaatgaagaaggaaatggatgagaatcaggttgaacctaatgtgaatacttaccgaattttgatttcgatgttttgtgaaatgaagcactggaacaatgcgtacaagttaatgaaggagatggttgaagaaaaatgcctaagaccaaatctatcagtttatgaattggttctggagctgctgagaaaggctggacatttgaaaaagcatgaagagttggtggataaaatggttgcgagaggattt

SEQ ID NO: 1803 - DNA, 1608 bp, Glycine Max
acttaccaagtgttagtggctgccactcaagattggggcatcggtaaggatgggaaattaccctggagattgcccactgatctcaagttttttaaggacattactgtgaaaacatccgatcctgggaagaagaatgccattgtaatgggaaggaaaacatgggagagtatccctcttgagtacaggcctctttctggtcgccttaatgttgttcttactcgctcaggcagctttgatattgcaacagcagagaatgttgttatatgtggaagcatgtcgtctgcattggaactgttagctgcttctccttactctctgtcaattgagaaagtatttgttataggaggtggtcagatatttagagaggctctcaatgcgcctggatgtgaagctatccacttaacagaaattcagtcaagtattgagtgtgacacttttatgcctccagttgatttcactatgtttcggccatggtactcatcctttcctaaagtggaaaacaacatccgctattgtttcaccacttatgtgcgtgtgcggagttctgctccagagtccccgggtcagaacattgatcaacttcttgataataattctgagtccatgaaatttgaggtcaaggaattttcttttcttcctaaaatgatttctgagagacatgaggagtatctatatcttaagctggttcaagacatcattgctgaaggtacaactaaggatgataggacagggactggtaccttgtcaaaatttggttgccagatgaggttcaatctgcacggaagctttcctcttctaacaactaaggcatgggaatatctatttagagtattttggcgaggggttgttgaagagcttctttggtttatcagtgggtcaacgaatgccaagttttcacttgcttatcttctgattctttatcagtgtcttagaaataaagggtatggactaaactttcaatcgcagtatttcacttgcatgaggtgttttatttttcagttatcaaggaatcttttactgttatgtgttggtttgacagagagggaggagggcgacttgggacctgtttatgggtttcaatggaggcactttggtgccagatatactgacatgcatcatgactactccggtcaagggtttgatcagcttttagatgttattaacaagataaagcataatcctgatgatcggcgaattattctctctgcatggaatccatctgatcttaaattaatggcacttccaccctgccacatgtttgcacagttttatgtagcacacggggagttatcatgtcaaatgtatcagcgatctgctgacatgggcctgggcgttccatttaatattgcatcttatgcccttttgacatgcatgattgctcatgtttgtgatctcattccaggtgattttatccatgttattggggatgcacatgtttactgcaatcatgtgaggcctttgcaggagcagctccataaccagccaaaaccttttccaactttggagataaatccaaaaaagaaagatatagattcttttgtggctgctgatttcaagctcataggctatgatcctcaccagaagattgatatgaagctggctgtctaa

SEQ ID NO: 1804 - DNA, 1032 bp, Glycine Max
agatccagaaagaaagaacacgaagaaggtagcttttgcggcacgccaaacgtgaatggagaatacctcgaggcattcagaacaaagtcttacgttgaaatatgcaacatagcacacagggaactgggaaatgcaagcactaatactaattcctttaagatgcaccttaccgaatatcttctagaaccaccccagcaagaaattgtagcaaacatgaaggtgcaccgtcttctggtggactacttcgaagccagcttagaagcatgccgttgttgcgagacaatcgttcaagctatccatcaaacaagacttgcttacgcaagagtcaccaatgtcgttgtcaagctaagccaaacagcgccttattatgaccaatcccaaaaccctatccacacacaactttcttccttcgtattattacaaaataaccctttgtctattgtgcagttccatgacattcacgacagatacatgaccctcttaagtaggctgttatcaaagaaaaggaaaattcaaagaatattaaccataaagagcgtttgcaagaaggttggaggaatcggtttaatcgtttcgcaaggcgttcttatggtggctttattggtatttgcgtttcatagtgtaattgggtttgtggctgctgcaccgtgcatagttggtttggtcatgaagaagagatttaagaggagttgtgaaaggttcaacactagaaactcttgtatgaaattgtgtgagcaacttgatgttgctgccaaaggggtttatgtggtgatcaatgagttggacactatgagccgaatggttaagaggttagatgatgaggttgaacattggagacaggttgctgatatttgtgtgaagaattactgtaagtgtgaaatattgaagcgggttgtgaaggaatttcaggacaacgaatctaactttttggatatgttggaagaacttgaagagcatatctatttgtgctttctcaccgtaaacagatttagaagattggttatggaagaaattatggggaaacaacgttaa

SEQ ID NO: 1805 - DNA, 113 bp, Glycine Max
atagatacaaatacctatgaatggttcaaagtggatagctgggataacctcacaacaaataagcaagaagctcgggcatattcaaaagatatatcttcttattgtggaaggta

SEQ ID NO: 1806 - DNA, 186 bp, Glycine Max
atcctcaaaatctattctgctggtgaaatcgtctttgaagcagttgcgaagcttgctgaggggatcaatggtgctgatcttcgtaatgttttcactgaagctggtttgttcgccattcgggcacaacgtgattatgtgattgatggagatttcgtgaagaaactggaatcaagcgcccattataat

SEQ ID NO: 1807 - DNA, 639 bp, Glycine Max
atgaaaagctctctgcacaatcgcagtaacagcatgcccactgcaccacgccccactgtatcacaagttgaggagcatttgcacaggttgaaggatactgaagccaccacttcttcgttgtcatcttcaataagtcacagactcaacgacttgcaggatttgcaagaaagcactgatgagttgcttcaattgagaatctcccaacaagcattggcacaagaatgcagcagcaaacagattgatgaactattagatgggtctgtgaggcttggatatttcatgcacgaacttgtgccagttattcgcaggaagagagatgctgaaatgggatccacaattgagggtggaaaatacctggcatgtaggaagaagatgaaaagggaaattgctaaggccttgagagacttgaaagcaataaaaaatgagttcacagagatcattagaatctgtgttgtgtttcattactggccccaaaagtcacttaaagcagagcaggtggtcggtaatctccaagctgtgtccgacactaatgaattcgaaatgcttgacaaagtgttgaagcttctcatcagttcaaagccttcatctactgagaattttcaaaggcatttggagtttaacgcctatcaagacaactaa

SEQ ID NO: 1808 - DNA, 702 bp, Glycine Max
atgaaaatgttgcaggtggcaatagtgcaattggctgcgttgcaggtttttgttatttttttgagtggtggtgctgattacataccgccttcaaggttggatgggttcgtctaccaaaatgggtacttagatttggatactgttttgatagaagcgttttatgatccggtgtgcccatacagcagggattcatggcctccactcaaacaagctcttcatcactattcttctcgggtttcgttcctccttcatctcctccctttaccttaccatgacaatgctttcgtcgcgacccgtgctttgcacattgtgaacacattgaacgcatctgcaacgttccccttgctggaatggttcttcaagcatcaggagaaattttacggggcccaaacacggaacttatctagggcttctattgtagatgagatagtgaagtctgcaacagaagcagctgggagctcttattataacgccataaagcatggcttcaatgacacaaaaactgattatcagaccagagtttctttcaagtacgctgcttcgagaggggtgtatggaacgccttctttctatgtcaatggattcttgttgcctgatactggagctaccgctgactacaagacttggaggaaggtcattgatccattggttggtgtgaagaagagtatccagaatgaagagtcccttcgtttcttcttgtaa

SEQ ID NO: 1809 - DNA, 1272 bp, Glycine Max
atgaaagcggagatgaaggatggagctcctcaagttgtgatgaatcataatggtaaccacggcaaattctcacacctacttgcttcccaagatcgtgactatcttctctctccaactggggctcaggtgaaagtttctgatcttgaagggaaagtagtgggtctattattcgctgcgaattggtacccaccttgccgtggattcacccaagtcctagctggaatctacgaggagctaaaaagcagagtccctcaatttgagattgtgtatgtgtcctcagatgaggacttgaatgcctttaatagcttctatggaagcatgccctggattgcaattccgttctctgatttggaaacaaagaagtctttgaccagaaagtttgacgtggaagccgttccatgcttaattttgttgcaacctgacgatcgtaaagagcacgcaacagttcgtgatggggttgaacttatttaccgctatggaatccaagcttatccattcagtaaggacaggttggagcagctgcaaaaggaagacaaagtgaagcgtgataaccagactctcactaatttactagcaaaccaccatagagactacgttttgagtcacactcacacgggactcaaaaaggtacctgtagcttccctagtgggtaaaacaattggactctacttctcagcggaatggtgcgtcccatgcgccaagttcactcccaagctgatttccgtttacgagaagataaagcacgagctagccgaaaagggagaggaggacttcgaagttgtgctaatatccagcgaccgcgaccaagcatcctttgactcctactacagcaccatgccttggttggccttgcctttcggtgacccagagatcaagaacctcgttagacactacaacgtgcaaggaattccttggttggtgattataggtcctgatggtaaaacaataaccgtacacgggaggagtttgataaacttgtaccaagagaatgcgtaccctttcaccaaggccaaagtggaggagctggagaaacagctggaggaagaggccaagggtcttccagcattggtgtatcaccaagggcatcgacatgatctgaatttggtgtctgatggaaatggtggagggccctttatctgctgcgtgtgtgatgaacaagggtctagctgggcctaccagtgtctccaatgtggctatgaagtgcacccaaagtgcgtcagaactgtggaacgcgatgacaatgtcttggtggacaccactggttgcttctag

SEQ ID NO: 1810 - DNA, 2310 bp, Glycine Max
atgaaaggaaataatacacttttgttgcctttattctacactctcttgctgtttcttggagtgtcagcagggaatggaagtaacgatgacactaaccgtaaagaagtttatatcgtctatatgggagccgcggattcaacaaatgcttatcttcggaatgaccacgttcagattctgaattcagtgctaaaaagaaatgagaatgccatagtacggaactacaagcatggtttctcaggattcgcagctcgtctatcgaaagaggaggcaaactcaatttctcagaaacctggtgtggtgtctgttttccctgaccccattctgaagctccacacaacacgttcctgggatttcctcaaaagccaaactcgtgtcaatattgacaccaaaccaaatacggagtccagttcttcttcctcctcagacgtcattcttggcatcttagacacaggtatatggccagaggcggcgagttttagcgacgagggttttggtcctgttccatcccggtggaaaggcacctgcatgacatcaaaagacttcaattcctctaattgtaacaggaagctaattggcgcaaggttttaccctgaccctgatgggaagaatgatgacaatgacaaaacgccaagggattcgaacggacatgggacccacgtggcgtcaacggcggtgtgtgtggctgtgagcaacgcatcgttctatggtctagccacggggaccgcgaagggtgggtcccccgagtcaagattggcagtttacaaagtgtgttataggaatgggtgtcgtggatcagccatcctggcggcgtttgatgatgccattgccgacggagtggatgtgttgtcgctatcgctgggcgtattacctctttcccgaccaaagttgacatccgacacgattgctattggagcattccacgccgtgcagcgcggcatcttggtggtctgcgccgctgggaatgccggacctctcaagtactcagttgtaaacgatgcaccttggattttaaccgttgcagcttccaccatcgatcgggatcttcagtccaacgtcgtcttgggtactaaccacgtcgtcaagggcagagccattaatttctcccctctttcaaattctcccgagtatccaatggtatatggtgagtctgccaaggcaaaaagagccaacttaggtacagcaagaaaatgccacccaaattcattagatagaaataaagtcaaagggaagattgtgatttgcgatggcaaaaaggatccgaaatatataactatggaaaaaattaacatagtgaaagcggcaggaggaattggtctggctcatattactgatcaagatggatcagtagcatttaattatgtggacttcccggcaacagagataagttcaaaagatggcgtcgcactcctgcagtatatcaattcaaccagcaatccagtgggaacaatactagctacagttacagttcctgattataagcctgctcccgtggtgggtttcttttcatcaagagggccttcaacgctttcaagcaatattctcaagcctgatattgccgcaccgggagtgaacattctcgctgcatggataggagatgacacatcagaggttccaaaaggaagaaagccctcactatacaacataatctcaggaacttccatggctactccacatgtttcagggcttgtatgcagtgtgaaaacacagaacccctcttggagtgcctctgcaatcaaatctgccatcatgacttctgcaattcaaaatgacaacttgaaggctcccataacaacggattcagggtcgatagccacaccctatgactatggagcaggggaaattacaacatctaaaccattgcaaccagggctagtttatgaaactaacaccgttgattacttgaactatttgtgttacactggtcataacctaaccacggttaaggtcatctccggaactgtccccgataatttcaattgccccaaggattccacctctgatctcatatccaacatcaactacccttccatagcagtaaacttcactggcaaagcaaacgtggtcgtgagcagaactgtcacaaacgttgccgaagaagatgaaacagtgtactctgccgttgtcgaagctcccaaaggagtatttgtcaaagtgactccaaataaacttcagtttacgaaaagtagtaaaaaattaagctaccaagttattttcgcaccaaaggcctccttgaggaaagatttgtttggatctatcacttggagtaacggcaaatatatagttcgaagtccatttgtattaactaaatag

SEQ ID NO: 1811 - DNA, 4788 bp, Glycine Max
atgaaaggaaataatacacttttgttgcctttattctacactctcttgctgtttcttggagtgtcagcagggaatggaagtaacgatgacactaaccgtaaagaagtttatatcgtctatatgggagccgcggattcaacaaatgcttatcttcggaatgaccacgttcagattctgaattcagtgctaaaaagaaatgagaatgccatagtacggaactacaagcatggtttctcaggattcgcagctcgtctatcgaaagaggaggcaaactcaatttctcagaaacctggtgtggtgtctgttttccctgaccccattctgaagctccacacaacacgttcctgggatttcctcaaaagccaaactcgtgtcaatattgacaccaaaccaaatacggagtccagttcttcttcctcctcagacgtcattcttggcatcttagacacaggtatatggccagaggcggcgagttttagcgacgagggttttggtcctgttccatcccggtggaaaggcacctgcatgacatcaaaagacttcaattcctctaattgtaacaggaagctaattggcgcaaggttttaccctgaccctgatgggaagaatgatgacaatgacaaaacgccaagggattcgaacggacatgggacccacgtggcgtcaacggcggtgtgtgtggctgtgagcaacgcatcgttctatggtctagccacggggaccgcgaagggtgggtcccccgagtcaagattggcagtttacaaagtgtgttataggaatgggtgtcgtggatcagccatcctggcggcgtttgatgatgccattgccgacggagtggatgtgttgtcgctatcgctgggcgtattacctctttcccgaccaaagttgacatccgacacgattgctattggagcattccacgccgtgcagcgcggcatcttggtggtctgcgccgctgggaatgccggacctctcaagtactcagttgtaaacgatgcaccttggattttaaccgttgcagcttccaccatcgatcgggatcttcagtccaacgtcgtcttgggtactaaccacgtcgtcaagggcagagccattaatttctcccctctttcaaattctcccgagtatccaatggtatatggtgagtctgccaaggcaaaaagagccaacttagtgaaagcggcaggaggaattggtctggctcatattactgatcaagatggatcagtagcatttaattatgtggacttcccggcaacagagataagttcaaaagatggcgtcgcactcctgcagtatatcaattcaaccagcaatccagtgggaacaatactagctacagttacagttcctgattataagcctgctcccgtggtgggtttcttttcatcaagagggccttcaacgctttcaagcaatattctcaagcctgatattgccgcaccgggagtgaacattctcgctgcatggataggagatgacacatcagaggttccaaaaggaagaaagccctcactatacaacataatctcaggaacttccatggctactccacatgtttcagggcttgtatgcagtgtgaaaacacagaacccctcttggagtgcctctgcaatcaaatctgccatcatgacttctgcaattcaaaatgacaacttgaaggctcccataacaacggattcagggtcgatagccacaccctatgactatggagcaggggaaattacaacatctaaaccattgcaaccagggctagtttatgaaactaacaccgttgattacttgaactatttgtgttacactggtcataacctaaccacggttaaggtcatctccggaactgtccccgataatttcaattgccccaaggattccacctctgatctcatatccaacatcaactacccttccatagcagtaaacttcactggcaaagcaaacgtggtcgtgagcagaactgtcacaaacgttgccgaagaagatgaaacagtgtactctgccgttgtcgaagctcccaaaggagtatttgtcaaagtgactccaaataaacttcagtcatcggcagggaatagtagtaacgatgacacgaaccgtaaagaagtttacatcctgtacatgggagctgcggattcatcaaatgcttctcttaagaatgagcacgctcagattctgaattcagtgctaaaaaggaagctaattggcgcgagggtttacccagaccaccctgatgcgaagaatgacgacaatgacaaaacgccaagggattggaacggacgtggtgggtcatgtcttgggtcagccattctagccgcgtttgacgatgccattaactacggagtggatgagttgtcgttgtcgctcggtccattcggtgggatccaaaccgatttgacgaccgacccaatttcgatcggagcagtccatgccgtggaacgcagcatcgtggcggtctgcgccgcccggaacgatggacaaccatcgaccgttgtgaacgacgcgccttggattttaaccgttgcagcttccattatcgaccgtgatcttcagtccaacgtcgtcttgggtaataaccaagtcatcaagggcagagccatacatttctcccctctttcaaattctcccgagtatcctatgatatatgatccaaatgaagtcatagggaagattgcggtttatgatggaaaagatgatgattattcaactagtgaaaaaattgacatagtgcaagcgttgggaggaataggtctagctcatattattgatcaagatggatcagtaacatttaattatgaggacttcccagcaacaaagataagttcaaaagatggcgtcgcaatcctacagtatatcattcaaccagattcgtgccaccattggaaaaaaaaggttcccggtgttggggagcctagggttagggtttctgagacatgtgggatgttccatgcattcgtgagccttatcgcacgcggttggaagctgttcgagcacagtgatgacgccggtaatgccgccgccgccaccggaagagaatgcaaggatggcctcctctggttccacgacatcggaaagttcgctgccggcgattcctccatggtcgtcgtccaggccaaccaggtcctcgaggaccagagccagatcgagtccggcggcttcagcaccttcatcggcatctacgacggccacggcggccccgattgctcctgctatgtctgtgataacttgttccgcaatctccaagaactgtacaagatggtttgcgaacctgatgaaactgatttgaacatatgcatacctgctgtcatgcttccactagatgcagtgtctgtgcagctgtactcgccacttcgaccagctgttgacgtagcagaagtatttctttggatgatggcagttcttaccatattgtgtgcatcatattggtcagcttggacgacccgagaagcagctattgaacatgataagttgctaaaggatgcttcagatgaactcccaaacactaaatatgctagtgttagtggagttgtaaatatgaatgtgaaagctacagtcctttttgttgtatttgcttcgtgtttcctgtttatgctttacaaactgatgtcgtcgtggttcattgatgttttggttgttctcttctgtattggtggtattgagggcttgcaaacatgcttggttgctcttttgtccaggagggcgagccctggtgcagcggtaaagttgtgtcttggtgacttgttggtcatgggttcgaatccggaaacagcctctttgcatatgcaaggggcgagccctggtgcagcggtaaagttgtgccttagtgacttgttggtcatgggttcgaatccggaaacagcctctttgcatatgcaagggtggttcaagcatgctggagagtcatacatcaaagtacctttcttaggagctatctcatacctgactttggctgtttctccattctgtataacattttccattctctgggcagtttatcgcaacgaatcctttgcctggattggtcaagatatacttatagtatatagtgccaaaggaaagcaaattgtagtttttcttgactacgatggaactctctctccaattgttgtagatccagataaggctttcatgactagaaagcctgatattgccgcaccgggagttgacattatcgctgcatggattgcaaatgacacatcagaggtttggaaaggaagaaagccctcactatacaacataatctcagggacttcaatggctactccacatgtttcagggcttgcatgcagtgtcaaaacacaaaaccccacttggagtgcctccgcaatcaaatctgccatcatgacttcagcaattcaaaacgacaatttgaaggctcccataacaacagattcagggtcgatagccacaccttacgactatggagcagggacaattacaacatctgaaccattgcaaccagggcaactagtttacgaaaccaataccgttgactacttgaactacttgtgttacattggacttaactcaaccacgataaaggtcatctctggaactgctcctgacaatttccattgccccaaggattcgagctctgatctcatatccagcatcaattacacttccatagcagtaaacttcactggcaaagcaaacgtggtcgtgagtagaaccatcacaaacgttggcgaagaagatgaaaccgtgtacttccctgttgttgaagctcctagtgaagtaattgtcacacgatttccatacaatcttcagtttacgagaagtattaaaaaataa

SEQ ID NO: 1812 - DNA, 459 bp, Glycine Max
atgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattag

SEQ ID NO: 1813 - DNA, 459 bp, Glycine Max; identical to SEQ ID NO: 1812

SEQ ID NO: 1814 - DNA, 459 bp, Glycine Max; identical to SEQ ID NO: 1812

SEQ ID NO: 1815 - DNA, 546 bp, Glycine Max
atgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggtttgttttcatacgtttttcatcattgtcttgtgggtttttatcatttttgcagttttcttattttgtgctgtttatttcatgcaggaggaggatgacgattag

SEQ ID NO: 1816 - DNA, 456 bp, Glycine Max
atgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggttggtcctactggtggggatgaagaagaatctgagaagtctgtatctgaggtgaatgatgaggatgatgacgaggaaggcagtggcgaggaggaggatgacgattag

SEQ ID NO: 1817 - DNA, 297 bp, Glycine Max
atgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgtatgttgttcaatgtttttttgtttataa

SEQ ID NO: 1818 - DNA, 297 bp, Glycine Max; identical to SEQ ID NO: 1817

SEQ ID NO: 1819 - DNA, 2313 bp, Glycine Max
atgaaaggcaataatacacttttgttgcatttattctacactctcttgctgtttcttggagtgtcagcaggaaatggaaataacgatgacactaaccgtaaagaagtttatatcgtctatatgggagccgcggattcaacaaatgtttctcttcgcaatgaccacgctcaggttctcaatttagttctaagaaggaatgagaatgccctagtacggaactacaagcatggtttctcaggattcgcagctcgtctatcaaaggaggaggcagcctcaattgctcacaaacctggtgtggtgtctgttttccctgaccccattctgaatctccacacaacacgttcctgggaattccttaaataccaaacccacgtcaaaatcgacaccaaaccaaatgctgtctccaattcttcttcctcgtcagacatcattcttggcgtcttagacacaggtatatggccagaggcggcgagttttagcgacgagggtatgggtcctgttccatctcgttggaagggcacctgcatgaaatcacaagacttcaattcctccaattgtaacaggaaattaattggcgcaagattttacaccgaccctactggaaacgatgacgacgaaggggacaacacgccaagggattcggtggggcacgggacccacgtggcatcgacggcggtgggtgccaccgtgactaatgcatcgtactatggtctggcggcggggagcgcaacgggtgggtcctcagaatcaagattggcagtttacagagtgtgttctaactttgggtgtcgtgggtcggccattcttggggcgtttgacgatgccatttcggatggagtggatgtgttgtcgctgtcgctgggtgcatctcctgggttccaacccgatttgaccactgatccaattgccctcggagcattccacgctgtggagcgaggcatcctggtggtctgctctgccggcaattccggacccagctcctccacggttgtcaacgacgcaccttggattttaactgttgcagcttccactatcgatcgggattttcagtccgacgtcgtcttgggtgtcgacaaaaccgtcaagggcagagccataaatttctcccctctttcaaattccgccgagtatccaatgatatacggtgaatctgctaaggcggccagtaccagcttagctgaagcaagacaatgccacccagattctttagatgcaaataaagtcaaaggaaagattgtggtctgtgatggaaaaaatgatggatattcaactagtgaaaaaattggtacggtgaaagaggcaggaggaataggtctggttcatattactgaccaaaatggagcaatagcatcatattatggagatttcccagcaaccgtgataagctcaaaagatggcgtcacaatcctccagtatatcaattcaaccagcaatccagtggcaacaattctaccaacagctacagttcttgattataagccagcgcccgtggtgccaaacttttcatcaagagggccttcatcgctttcaagcaatattctcaagcctgatattgcagcaccaggagtgaacattctcgctgcatggattggaaataacgcagatgatgttccaaaaggaagaaaaccctcactatacaacataatctcagggacttccatggcttgcccacatgtttcagggcttgcaagcagtgtcaaaacacgaaaccccacttggagtgcctctgcaatcaaatctgccatcatgacttcagcaattcaaattaacaacttgaaggctcccataacaacggattcgggaagggtagccacaccttatgactatggagcaggggaaatgacaacgtctgaatcattgcaaccaggcctagtttacgaaaccaacaccattgactacttgaactacttgtgttacattggacttaacataaccacggttaaagtcatctccagaactgtccctgctaatttcagttgccctaaggattcaagttctgatctcatctccaacatcaactacccttccatagcagtaaacttcaccggcaaagcagccgtgaacgtgagtagaactgtcacaaacgttggtgaagaagatgaaacagcgtactctcccgttgtggaagctcccagtggagtaaaagtcacagtgactccagataaacttcagtttacaaagagtagtaaaaaacttggctaccaagttattttttcctcaactttgacctctttgaaggaagatctgtttggatctattacttggagtaacggcaaatatatggttcgaagtccatttgtattaactaaatag

SEQ ID NO: 1820 - DNA, 600 bp, Glycine Max
atgaaaggcggtttgaatgcgagtcgtggggaccttgagttttcggagaaatcaaagaaggagaaggtgagaagcttgagcgctgttgatgaagctttatcaatgggttgccgtgtctctcactctcataaaccaaccaagaaatttaagcttcccagaaagtttctgaaggactgcaatggcgttgatcatgcctctgttccacggaagatacgttcagctgtgaagaaacggggtcgcgaatccatctttggtgattctgaaaaggtgaaccataggatgaacggaatggaatctccccaaaaagatggcataaagaaatccaaaaaacaaagaaccccgggctggtccacgaggctagtctcaccggggcccatcacaaaggatgaggaagaggttgtggagactctctatgcattggctggaatgttccctgcagataatgcctccaatgctattaagagtgaacttggcagtgaatctttaccagaaaactccacggttttacaggaccaagaggagagtcagagtgctaatgttactgttgaagcctcgggagctactcaggatggaggagaaagatcacctagggggtattaa

SEQ ID NO: 1821 - DNA, 2217 bp, Glycine Max
atgaaaggtgccgtcctcgtcgccattgccgcttccatcggcaatttcctccagggatgggataatgctaccatcgccggggccattgtttacattaagaaagaccttgcgttgcaaacaactatggaagggcttgtggtggccatgtccctgattggagcaacggtaatcaccacatgctctggtcctatagcggattggctcggtcggcgacccatgatgataatctcatctgtgctctatttcttgggtggtttggtgatgctgtggtccccaaatgtgtatgtgttgtgcttggcgaggctacttgatggatttgggattggccttgctgtgactcttgtcccggtctatatatctgaaacggcgccgtctgaaataagggggtcgttgaatacgcttcctcagttcagtggctctggaggaatgtttttgtcgtactgtatggtttttggcatgtcattgagtcccgcgcctagctggaggctcatgcttggggttctgtctattccttctctcttgtattttgcattgaccatttttttcttgcccgagtctcctcggtggctggtcagcaaaggaaggatgctcgaggctaagaaggtgctccaaagattgcgcggaagggaggatgtgtcaggcgagatggcattgctggttgaaggtctcgggattgggggtgatacatctatcgaagagtacataattggccctgctgacgaggtggctgatggtcatgaacatgcaacagagaaagataaaattcgattatatggatcccaagcaggcctttcttggttagcaaaacctgtcactggacagagttctattggccttgcgtcacgccatggaagcatcatcaaccaaagcatgcccctcatggatcctctggtgacactgtttggtagcattcatgagaagctccccgagacaggagcaggaggaagcatgcgaagcactctgtttccaaattttggaagcatgttcagcactgctgagccgcatgctaaaaatgaacagtgggatgaagagagcttacaaagggaaggtgaggactacatgtcagatgcagccggtggggactctgatgataatttgcacagtcctttaatctcacgccaaacaacaagccttgaaaaagacttgcctcctcctcctccttcccatggcagtatccttggcagcatgaggcgtcacagtagtctcatgcaagggtcaggtgagcaaggtggtagtacaggtattggtggtggctggcaactggcatggaaatggactgataaaggtgaggatggaaaacaacaaggagggtttaaaaggatttatttacatgaggagggagtttctgcatctcgtcgtggatccattgtatcgattcccggtgaaggcgaatttgtccaggctgctgccttggtaagccaacccgctctttactccaaggagcttattgatggacacccagttgggcctgcaatggttcacccatctgagacagcttcaaaggggccaagttggaaagctcttcttgaaccaggggttaagcatgcattggttgttggagttggaatacaaatacttcagcagttttcagggataaatggggttctatattacacacctcaaatccttgaagaggccggtgttgaagttcttctttcagatataggcattggctcagagtcggcatcattccttatcagtgctttcacaaccttcttgatgcttccctgtataggcgtagccatgaagctcatggatgtttcaggcagaaggcagttgttacttactacaatccccgtgctgattgggtcactcattattttggtcattggaagcctggtaaattttggcaatgtcgcccatgcagcaatctcaacagtatgcgttgtggtttatttctgctgctttgtgatgggttatggaccaattccaaacatcctttgctcagagattttccccactagggtgcgtggcctctgcattgctatctgtgcattagtgttctggattggagacatcatcatcacatactcgctgcctgtgatgctgggctctttaggacttggtggtgtattcgccatttacgcagttgtttgtttcatctcgtggatatttgtgtttttgaaggttccagaaacaaagggcatgccccttgaagtcatctctgaattcttttctgttggagcaaagcaggctgcttctgccaagaatgagtga

SEQ ID NO: 1822 - DNA, 1167 bp, Glycine Max
atgaaatttcttttgttattttttatgataagattcaattcattttttgctccttgttttatttcctgttctctaatgttcctcagttttgcttgcttcctttctattcaggctgtgcttaaacagtttggggctgggggatatggaggatcagataatatggttactgatgaggtagagcttcagcaacatcagaaacttgagaagctttacatatcaacacgtgctggaaagcattatcaaagggatattgtccgtggtgtggaaggttatattgtaactggatccaagcaagttgaaataggaacaaagttatcagaagataacaggaaatatggtgcagataatacgtgtaccagtggtagtacattatcaagagctgcgctaaattatgcacatgcccgtgcacaaatggagaaggagcgtgggagcttactaaaagctcttggcacacaggttgcagagcccttgagagcaatggtgatgggagctccattggaggatgcccggcatcttgctcaacgttatgacagaatgcggcaggaagccgaagcacaggctattgaagtttccaaacgccaggcaaaagtaagagaaacaccaggcaatgctgagaatgctatgaagctggaagcagctgaaacaaagctgcaagacctgaagacaaacatggccatattgggaaaagaagcagctgccgcaatggctgctgtagaagcacagcaacagaggttaaccctccagcgtcttatagctatggttgaagcagagcatgcctatcatcaaagagtactccaaatacttgatcagcttgagggagagatgatatcagaacgacaacgaattgaagcccctcctacacctagtgtggatagcagcatgacaccacccccatcatatgaagaagtaaatggtgtatgtgcttctcaagcacataatggctcaacagatagtatgggttacttcttaggagaggtgttatttccctaccatgctgagtctgaagttgaattgaatctatccgtcggagattatattgtcgttcgaaaggtgacaaacaatggatgggctgagggtgaatgcaaagggaaagcaggttggtttccatttggttacattgaaagaagggagcgagtcctcgcaagcaaggtggctgaagtgttttga

SEQ ID NO: 1823 - DNA, 630 bp, Glycine Max
atgaacatggaaggtggtgtcttgctggtcagaaaggcagagatagacacaagggcaccattccggtctgtcaaagaggctgtctcattgttcggtgagaaagtcttagctggagaggtttatgcaagtgcaaacaagctcaaaaagatacagagtggagcaaatgaaaacggcgttgatttttggagaattgaaaacgttgaagctgagttagaggagacgagggaaaacctgcagagggcaaaggaagaaagcatggtaatggcccattgcctgtcttctctgcaggaagagcttgaacgcacgaagcaagagctccaacaactgaagcaacgggaaacagagaagcacccggtggaatctgaaattgaagatgtcaagtttgtggagaacttaacgacgtttggagtgcaaagttcgagattcgaccaggaaaatatggagttccaaaagaaaaggtacgtcacgttcgcgaatccgccatcggtgtctcatcacgtgatgctaccgcaacacggggttgaaaagttggaaaggcacccttctctcaggaagaagaacaagaagtcgttcattcctttgattggaggcattttttcaaggaaaaagggaagccaagaaattccatga

SEQ ID NO: 1824 - DNA, 2049 bp, Glycine Max
atgaaccttttaccaccacaactaacaacaacccccttcccttccccatccacccaccgccacagccaccacaacaacatccatttcctcccgccgccgcaatcctccgcaagccccataaccgccaaaccaaccatcctcgaagaaggccccgacgacatcctctcccttcacaaccgccgctacgacttcacccccctcctcagcttcctctccaccacttccaactcaagccctcccacctcactcgactcaaccgagttccaactcgccgagtcctaccgcgccgtccctgccccactctggcacgccttcctcaagtctctctgcgcctcctcctcctcctcctcctccatcgccctcgcgtacgccgtcgtttcatggctccagaaacacaatctctgcttctcctacgagctcctctactccatcctcatcaacgccctcggccgctccgaaaagctctacgaagccttcctactctcccagcgtcaggtcctcactcccctcacctacaacgcgctcatcggcgcgtgcgcccgaaacggcgacgtcgagaaagccctaaacctaatgtccaaaatgcgccgcgacggttaccagccggacttcgtcaactacagctccatcattcagtacctgacgcgctccaacaaaatcgactctccaattctccagaaactctacgccgaaatcgagaccgataaaatcgaaatcgacggccacctcatgaacgacatcattgtaggattctccaaagccggcgatccgactcgcgcgatgcggtttctagctatggctcagagcaacggactgaaccctaagccctcgacgcttgtggcggttatcttggcgcttgggaattcgggaaggacgcatgaggctgaagcgttgtttgaggagattagagagaacggcttggaaccgagaactagggcttataatgctctgcttaaaggttacgtgagaacgggttcgcttaaggatgcggagtttgtggtctctgaaatggagaaggctggggtcaagcctgatgagcaaacttatagtttgttgattgacgtgtatgcgcacgcggggaggtgggagagtgcgaggattgtgttgaaggagatggaagcgagcaatgtgcaacctaattcttatgtttttagtagaatcttggcgaattatcgcgacaaaggggagtggcagaaatcgtttcaggttctgaaggatatgaagagcagtggtgtgcagcctgataggcatttttacaatgtgatgattgatacgtttgggaagtataactgccttgatcacgccatggccacgtttgagaggatgttgtccgaggggattccgccggatatcgttacttggaacacgctgatcgattgtcattgtaagtcgggacgccacgatatggccgaggaattgttcagtgaaatgcagcagaggggatactcgccttgcatcactacttataacattatgattaactctatgggggagcagcagaggtgggagcaagtgactgcgtttttgagcaagatgcagagtcaggggttgcagcctaattcaattacttacacaactctggtcgatgtgtatgggaagtccggaagatttagcgacgctattgagtgcttggaggtcttgaaatctactgggttcaagccaacttcaaccatgtataatgctctgatcaatgcctatgcgcaaaggggtttgtctgaactagcagtaaatgcattcaggttgatgacaactgagggtctgacacctagtctcttagctctcaattcattgatcaatgcattcggtgaagacagaagggatgctgaagcctttgctgtgctgcagtatatgaaagaaaacaacattgaacctgatgtagttacttataccacactaatgaaagctttgattcgtgttgaaaagttccaaaaggtacataaattagcattgtcacggtcagtttgtcatctatgttttcatgacccttcagtcttgcacttcatcaaaggaaattatcatggtttatttttgcccgcggtacattcttag

SEQ ID NO: 1825 - DNA, 2043 bp, Glycine Max
atgaaccttttaccaccacaactaacaacaacccccttcccttccccatccacccaccgccacagccaccacaacaacatccatttcctcccgccgccgcaatcctccgcaagccccataaccgccaaaccaaccatcctcgaagaaggccccgacgacatcctctcccttcacaaccgccgctacgacttcacccccctcctcagcttcctctccaccacttccaactcaagccctcccacctcactcgactcaaccgagttccaactcgccgagtcctaccgcgccgtccctgccccactctggcacgccttcctcaagtctctctgcgcctcctcctcctcctcctcctccatcgccctcgcgtacgccgtcgtttcatggctccagaaacacaatctctgcttctcctacgagctcctctactccatcctcatcaacgccctcggccgctccgaaaagctctacgaagccttcctactctcccagcgtcaggtcctcactcccctcacctacaacgcgctcatcggcgcgtgcgcccgaaacggcgacgtcgagaaagccctaaacctaatgtccaaaatgcgccgcgacggttaccagccggacttcgtcaactacagctccatcattcagtacctgacgcgctccaacaaaatcgactctccaattctccagaaactctacgccgaaatcgagaccgataaaatcgaaatcgacggccacctcatgaacgacatcattgtaggattctccaaagccggcgatccgactcgcgcgatgcggtttctagctatggctcagagcaacggactgaaccctaagccctcgacgcttgtggcggttatcttggcgcttgggaattcgggaaggacgcatgaggctgaagcgttgtttgaggagattagagagaacggcttggaaccgagaactagggcttataatgctctgcttaaaggttacgtgagaacgggttcgcttaaggatgcggagtttgtggtctctgaaatggagaaggctggggtcaagcctgatgagcaaacttatagtttgttgattgacgtgtatgcgcacgcggggaggtgggagagtgcgaggattgtgttgaaggagatggaagcgagcaatgtgcaacctaattcttatgtttttagtagaatcttggcgaattatcgcgacaaaggggagtggcagaaatcgtttcaggttctgaaggatatgaagagcagtggtgtgcagcctgataggcatttttacaatgtgatgattgatacgtttgggaagtataactgccttgatcacgccatggccacgtttgagaggatgttgtccgaggggattccgccggatatcgttacttggaacacgctgatcgattgtcattgtaagtcgggacgccacgatatggccgaggaattgttcagtgaaatgcagcagaggggatactcgccttgcatcactacttataacattatgattaactctatgggggagcagcagaggtgggagcaagtgactgcgtttttgagcaagatgcagagtcaggggttgcagcctaattcaattacttacacaactctggtcgatgtgtatgggaagtccggaagatttagcgacgctattgagtgcttggaggtcttgaaatctactgggttcaagccaacttcaaccatgtataatgctctgatcaatgcctatgcgcaaaggggtttgtctgaactagcagtaaatgcattcaggttgatgacaactgagggtctgacacctagtctcttagctctcaattcattgatcaatgcattcggtgaagacagaagggatgctgaagcctttgctgtgctgcagtatatgaaagaaaacaacattgaacctgatgtagttacttataccacactaatgaaagctttgattcgtgttgaaaagttccaaaaggttccagctgtgtatgaagaaatggtcgcatctgggtgcactcctgatcgaaaagctagagcaatgctgcggtctgctcttagatacatgaagcagacactaaaatcatag

SEQ ID NO: 1826 - DNA, 774 bp, Glycine Max
atgaagagcaaaatcttgaaggcactaccaaaagcagttgcagcagtcaccgtgacatttcaaaaccatccattcagcccaggcagggatcacaaatcaaagcctatcgtatctatgattccccatgaagctagaagaaaaacccacgatagaggcaataacggcattgatgaaatttattcccaagaacccacttcaccaaaaatctcctgcatgggacagatcaagcacaagaagaaacaaatcaaaaaatcaaagtcaaagagcaagtccatgacaaaagaagcgaggaacgttgctagcaaaaaaacatcctcagcttccagagacatagaggtaaaaaagcacgtttccacgtttcacaagatgttattattccatggggcaaagccaaaatctgagggaaggaaatccaacgcttctgcgcctggagatattaacaaggatcttgctcttgcggacgcagcacgcgcaccgcgcgtgagtcagatgagaaggttttctagtggacgtgacgctcttgctgaatttgattggaaggtgtcgccagatgaagaggaaattgattactattcggatgaatacagagtggatagtgatggcgaagaagaggaagagattattatccctttctctgcaccccttttggttggtggtggagttggtcatactcgtgggggtgtgcttaatttgaagccacgaaaagaaattaacctgtggaagagaagaaccatggctccacccaggcctcttcaattggacagagcaaactga

SEQ ID NO: 1827 - DNA, 801 bp, Glycine Max
atgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagaatagtgatgacatgttgtcgctgtttggtgagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtaa

SEQ ID NO: 1828 - DNA, 585 bp, Glycine Max
atgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagcaattgatcatagtttaa

SEQ ID NO: 1829 - DNA, 960 bp, Glycine Max
atgaagatccagtgtgctgtgtgtgacaaagtggaagcctccgtcttctgctctgcagatgaagctgctctttgccatagttgtgaccgcaccattcaccacgccaacaagcttgcaaccaaacacccacgcttctctctccattaccccacctcccaagacttccctctttgtgatatttgccaagagaggcgtgcatatctattttgccaagaagacagggcattgctatgcagggagtgtgacgttcctatccacagggcgaatgagcatacccagaagcataacaggtttcttctcaccggagtgaagctctctggtacttctttggatcctgctgcgtcctccaccaattgcacccatggctctgaaggaagaaacaacgctcgatctagaatgaacagacccagatcatcagtttccaatgaagaaaatgcaagtaattcttcttgcaaggttgaagacaacgtggctagtgacactggttcggtttcaactagcagcatttctgagtacttgatcgaaacaatacccggttactgttttgaagaccttcttgatgcttcatttgcacctaatggtttctgtaagaaccagaactatgatcgtcataggcgtttcaggaccaagatcttcaagttattaggacgtgtttggtttgagttaaggagattccaaaatcttaacgctatcgatgatcaactgtttgtaaaaatctgttggaaaatatcttcttttgtttttgttatttgcatttctttttgggctccctgctgcattctttatgatttttttttcattctctattcccgaccactgtttcggcctcttattttagtatttttttcaattttcattgggttaattaataatattttttgggggggggtccatgcttttattgacatgaacatgaattcattgaataacgcaactgaatattatgtgccactttcttaa

SEQ ID NO: 1830 - DNA, 417 bp, Glycine Max
atgaagatgttgcgaacgacaatactgcaattcgctgcgttgcaggttttgtttattctgttgggtgttggtgccgattacataccgccttcgagatttgatggcttcgtctacgggaaggggaacttgaatttgttggatacggttttgatagaagcgttttatgacccagtgtgcccagatagcagggattcctggcctccactcaaacaagctcttcatcactacgcttctcgggtttcgctccttcttcacctcctccctctaccttaccatgacaatgcttttgttacgtctcgtgctctgcacattgtgaacaatttgaacgcatctgcaacgttccccttgctggagtggttcttcaggagaatttctatggggctcaaacacggaacttatctagggcttctattatag

SEQ ID NO: 1831 - DNA, 711 bp, Glycine Max
atgaagatgttgcgaacgacaatactgcaattcgctgcgttgcaggttttgtttattctgttgggtgttggtgccgattacataccgccttcgagatttgatggcttcgtctacgggaaggggaacttgaatttgttggatacggttttgatagaagcgttttatgacccagtgtgcccagatagcagggattcctggcctccactcaaacaagctcttcatcactacgcttctcgggtttcgctccttcttcacctcctccctctaccttaccatgacaatgcttttgttacgtctcgtgctctgcacattgtgaacaatttgaacgcatctgcaacgttccccttgctggagtggttcttcaggtatcaggagaatttctatggggctcaaacacggaacttatctagggcttctattatagaggaagtagtgaagtctgcaacacaagtagttgggagctcttattataaaaccataaagaatggcttcaatgacacaacaactgatattcagaccagagtttcttttaagtatgctgcttcgagaggggtgtatggaacgccatttttctatgtcaatggattcttgttgcctgatactggagctgctgttgactacaagacttggagaaaggtcattgacccattggttggtgctaagaataagaagagtatccaaaatgaagagtcccttcatttcttcttgtga

SEQ ID NO: 1832 - DNA, 246 bp, Glycine Max
atgaagctcttccaacgcttccgcaagatcttcatgcgcctaatgttctcggtacctaattctcgtcgctcaaaggattcgaagcacaaagttaatgaccggtttgaaccgcccaagacttcatgcagttcctactattcctctcaatcgcattacagcgaggccattgccgattgcatcgagtttttcaataagtcagcacaagatggcgttaacaatatatcttttttaggtgctatgcattaa

SEQ ID NO: 1833 - DNA, 819 bp, Glycine Max
atgaagggtagcaagaggcccatccacgccgtcacgacatgggttcggcgccaaccgcccaagataaaggcctttctcgcggtgctgtctgcccttgcggccttgctcttcctcagaatcgtcgttcacgaccacgacagcctcttcgtcgccgccgagtttgtccatgcattaggaatctccgtcctcatttacaaactcaccaaggaaaaaacctgtgccgggctttcgcttaaatcgcaggagctgacggctatgtttctgggtgttagactttattgcagttttgtgatggaatatgatatacacaccctactcgatatggcaaccttggccaccaccctctgggttatttatatgatacgtttcaaattgaaatctagttatatggatgataaggacaaccttgcaatatactatgtggtaataccttgtgctgtgctgtccttgttaattcatccaacaacccggcatcatccacttaataggattctctgggcattttgtgtttatcttgaagctgtttctgttctccctcagctgcgggtcatgcagaacactaagattgttgaaccattcacagcacactatgtttttgctcttggagttgcaaggttcttgagttgtgcacattgggtcctccaggtattagatactcgtggacgtctactgactgcattgggttatggattgtggccttctatggttcttctatcagaaattgtccaaactttcattctggcagatttttgctactactacgtcaagagtcttgttgggggacaacttgttcttcgacttccttcaggagtggtctaa

SEQ ID NO: 1834 - DNA, 294 bp, Glycine Max
atgaagtccaattttgctgttttcgtagtcttctctcttctcctgattgccaacttgagctgtgcaaggaaagacctgggatggtattggaagaatgtgatgaaggagcaacctatgccacaagcaattaaagaccttgttgaggattcacaagcatcagctgcagggaagaaggatcgttttatcagggacttcgatgtaaagcctaatgtcatattatatcacacccatgttgtgcccatgaagcagaagcataagcataagcagaatccttttgtcaagaatcaagattga

SEQ ID NO: 1835 - DNA, 701 bp, Glycine Max
atgaatgacactactcctactgccgattctccaagttgtggccatgggcagaaaactagaagccaagatgatgtctgtgaaattatggagagctcagcaaggaagcaatggagtctatggttgcttttttctgtaatgaattcagtgagtaaagaaggtgccaaggaagaagaatctgtaggttctgaaaccagctgggataaatggaagcgtggaggtatcataggagtagctgctgtaactggacgaaccataatggttataactggtggcttgactgccccagctattgcgcatggattgggtgcattggctcctacactaggaggcattgttcctgccattggtggtggatttgctgctgcagcaactgctacaggatctgctggtggatctgtggttgttgctgcatcgtttggagggtgcgcacaaaaagaacctgcaactaaaaagaagcaaaaaacaccaagcctggagatggggtccacatggatctcggaacatggtgaaactcctgaggtggggtcgcaccagggaggcgagatcatagcaggaagcgttgccgaaaaggacgtcgtacgcactggcgaaaggtgttgtttggcgcatcaaaggggtcgcgcggctcaccggaagaaggatggcgagcgaaatggctcaccagggatagtgggtcgtcggaaaagtgacggcagtcagtg

SEQ ID NO: 1836 - DNA, 2319 bp, Glycine Max
atgaattctcgagctctacaatttattggtgccggtgctcaaaattataaagactggttttcttttattggtagaaaagctgcccctcatggtcttggttcaccttatgcaattacattctggccaaatgcaaccgcatcatctgacatgaaacctatgaatgtttcaacttattcatgtggtgatatttctcttggctgttcttgtggtgactgtccttcgtcttcagtatgctctaattcagcttcaactaccaccaataagaaggattcctgctcagtgaaagttgggactttaatggtgaagtgtgttgacttgagtttagcagtcttatacattatattgatttgcgtgttcttgggttgggggttgtatcatcggataagggaaagaaaaccgacgtacagaacaaaatcagtgtccaatgtcattagtgatggtctaatccgattcaaggttgagacacgacctgagaagctctgggtaggacctgggagtaaagcagcacaagagaagcagttttttgacactcatcttgctccattttacagaattgaacagctcattctggccactgttccagatcatgtaaatagtacatcaacaagaattgtgtcagaggacaacattaggtttctgtttgaaatacagaaaaaggttgatgcaattcgtgctaattattctggcttgacggtatctctccaagacatctgtatgaagccactagacaaagattgtgccactcaaagtgtccttcagcattattcctcagcagaccattgtatgagtgcatttaaagctcctctggatccaagcactgtattaggaggtttttctgggaatgattattctgaggcatctgcgttcatcgtaacatatccaataaataatgctattaatgaagaaggtaatggaaccagaaaggcagttgcttgggagaagacctttattcagttggtgaaggatgagctgttaccgatggtacaatcaagaaatttgacactggctttttcatctgaaagctctgttgaggaagaattgaaaagagaaagtactgcagatgctattacgatattggttagctatcttgtgatgtttgcttacatatctcttactttaggggataccctccacccttcgtctttctatatttcatctaaggtgatgcttggtctttcaggagtaattcttgttatgctgtctgtcattggatcagttggattttttagtgtgcttggtataaaatctactctgatcatcatggaagttatcccatttcttgtcctagctgaggttcatgctcccattctgagtatttggggagtaaaaatagttgtcatagctatttttgtgggatttgcattggctagcattattgctagagcggcccttgtaccagacacaagttatattgccaagccagctgcctcatggcttgatgattttcttgtgtgggtgtctccagaagcatttgggtgctgcaggaagtttacaaatgggagttattgccctcctgatgatcagtgtttccgtcactcagatctccataatgatcgtccatctacaacacaatttagggagaaactgccatggtttcttagttctctgccatctgctgattgtgcaaaaggtggtcatggagcttacaccagcagtgttgaactgaaaggctacgacaatggcattattaaagcatcgtcatttcgtacttatcataccccactcaacaagcagattgagatctttccatattcagtgttttatatgttttttgagcaataccttcatatatggaagactgcactggtcaaccttgctatagctattggtgcagtatttattgtgtgcttggttatcacgagcagtttatggagctcatcaatcattttgttggtattggcaatgattgtggttgatcttatgggtgtgatggccattctgaatatccaattgaatgcactctcggtggtcaaccttgttatgtcagtgggcattgctgttgagttttgtgtgcatatgactcattctttcactgtagcaagtggagacagagatcaacgtgctaaggaggctttgggtacaatgggtgcttcagtgttcagtggtatcacactaacaaagctggttggagttattgttctttgcttctcaagaacagaagtgtttgtgatttattactttcggatgtacttgtcattggtacttcttggtttcttgcatggacttgttttcttgccggtagtattaagcatctttggtccaccttcaagatgttcaatcattgagcaagaggaagatcgttcatcaacctcttcatag

SEQ ID NO: 1837 - DNA, 156 bp, Glycine Max
atgaccatgacaatggagttttgtgatataaatgtgagtttggccaataaggatctgagtaggaccatggcagctcaggcccgccagaatatgcttcaaaaatacaggttcaagaatccaattggaattagtaaaccccgttactcttgtagatga

SEQ ID NO: 1838 - DNA, 372 bp, Glycine Max
atgacgaggatgacccgtgattttggggatactatgcaaaaagatgcagtgccggcggtgtcggctgatataatatttgcttctcttcggtttcctaattacaaaatcggagttaacaatcagatcatggagacaaaggatagtccaaaagtgctatctatgaaggaggttgttgcgcgagagactgcacagctgttggaccagcagaaacgtctgtcggttcgcgatcttgccagtaaatttgagaagggtttggcagctgcaggggagggaagagcaacagtgaaagggaaaatggtccttgccttgccacataatattgctgacttggactcaaacctgccacattggatgcttacatttgccaaatag

SEQ ID NO: 1839 - DNA, 195 bp, Glycine Max
atgacggcggagagggcggctccggcggtgcctcaagtgtgtggacgcggggaccagaagacgaagaaagggaagaggttcaagggttcgtacggtaacgctaggccgaagaaagagaagatgatagagcgcatcaaggacaaggtcgaagttcccaggtccactccttggcctctccctttcaagctcatctga

SEQ ID NO: 1840 - DNA, 285 bp, Glycine Max
atgacgttttgcaaacgtgcttttcatctgtgttccaatcatcgtcaatccctcgtcaagcactgcgacctcgtttctttactcccttttacgagacacctatcgcaggccggcaatgtaaagcgcgtcttcctcgtcgatacccttgggctggtaaggggcttagaggcaaaaggagttccgtccaaacaggccaaagcaataacttctgccattaccgaagttctaaatgatagcctggaaaatgtaactcagtctcttgttccaaaatcagaaaagcaaaag

SEQ ID NO: 1841 - DNA, 1464 bp, Glycine Max
atgactcaagatctcgagatgagggatcgctcaacgccttccaactctgtttctttgcctgctccatctactttgcagcatttgaaggagatagcgtctcttatcgagaccggttcgtactcgaaggaagttcgtagaattgctcgcgctgttcgccttacaattgcgttgaggcggaaattgacagcatccgctatctcttcttttctcgaccttgttctcactccaggctctgaagttcacgccaaattgtctgcgtatcttcccaaggaggatgatcatgagatggaagtggacgccgcaacatctgctattcaaaccccagccaaacacttgttgcctgagctagaaatctactgttacctgcttgtactactttttctgattgatcagaaaaaatacaatgaggccaaagcttgttcctcggctagcattgtttggcttaagaacacaaacaggagaactgttgatgttattgcatccagactgtatttttactattcgtatagctatgagcttacaggagatcttgctgaaattcggggcaacctccttgcattgcaccgatttgcgactctccgccatgatgagctgggacaggaaacacttcttaatttgttacttcgaaactaccttcactacaacctatatgatcaggctgagaagttgaggtccaaggctcctcgatttgaagcacattcaaaccagcagttttgtcgttatctcttctaccttgggaaaattcggacaattcagctggagtatacagatgcaaaagagtctctcctgcaggccgcccggaaagctcctgttgctgcaaggggttttcgaattcaatgtaacaagtgggctgtgatagtgcgtttactgttgggagaaatacctgagcggactgtcttcatgcagaaaggaatggagaaagctttaaggccttactttgagcttacaaatgctgtgcggattggagacttggaactgtttaggaatattgcagacaagtttgccactacctttaatgcagacagaacccataatttgattgttcgtttgcggcataatgtcatcaggactggtttacgcaacatcagcatctcctattctcgcatctctctagctgatgttgctaaaaaactgaggctgaactctgcaaatcctgttgcagatgctgagagcattgtatcaaaggctattcgtgatggtgcaattgatgctacattggatcatgccaatggttggatggtgtccaaagaaactggagatatttactccacaaatgagccacagtcagccttcaattctcggattgctttctgtcttaacatgcacaatgaggcggttcgagctcttcgttttccaccaaacacacacaaagagaaggaaagtgctgaaaagagaagagagagacaacagcaagagcaagagctggctaagcatattgcagaggaggatgacgatgatttttga

SEQ ID NO: 1842 - DNA, 555 bp, Glycine Max
atgactcgtgccttgagatatttaggcgagcgaaactcgtccaccgactccgctgtcgtcgattccgacttcgtcgtcatcctcgccgccctcctctgcgctctcatctgcgttctcggcctcgtcgccgtcgcccgctgcggctgtctccgccgcctccgcctctcctcctctgcaaccactccccagtctcctacctccgccgccaacaaaggcgtcaagaagaaggtcctccgctccctccccaagctcaccgccacagcggaatcggcggtcaagtttgcggactgcgcgatctgcctcacggagttcgccgccggagacgaaatccgagtgctgcctcagtgcggacatggcttccacgtcagctgcatcgacgcctggctcagatcgcattcctcgtgtccgtcatgccgtcagattctggtggtttctcgctgcgacaagtgcggcgggatcccggctccggcgagctccagctccgatccgccgccgccggactccgaggccagatttaagggaagggaggacgacgccaataggtttttgccttag

SEQ ID NO: 1843 - DNA, 1320 bp, Glycine Max
atgactcgtttatattccctttctcttttacaattcctgtctctgattctccttttcacacttttcttcttgtctgcctctgacacctccgaactgttcgaaaagtggtgtaaggaacacagcaaaacatactcttccgaggaagaaaaactgtacaggctcaaagtgttcgaggacaactatgcctttgtcgcccaacacaaccaaaacgccaataataacaataataattcaagctacactctttccctcaacgctttcgccgatctcacccaccatgaattcaaaaccactcgtctcggtcttccccttaccttgcttcgattcaaacgtccccagaatcaacaatcccgtgaccttctgcacattccttctcagatcgattggagacagagcggcgcagttacacccgtcaaagaccaagcaagctgtggtgcatgttgggcgttctcagctactggtgctattgaaggcataaataagattgtcacagggtctcttgtaagcctttctgaacaagagctgatagattgtgatacatcctacaacagtggttgtggaggtggactcatggattttgcataccaatttgtcatcgacaacaaagggattgacactgaggatgattatccgtatcaagctcggcaacggtcctgcagtaaggacaagttaaaaaggcgtgctgttacaattgaggattatgttgacgtgcctccgagtgaggaagagatactaaaggccgttgcatcacaacctgtaagcgtaggcatatgtggtagtgaaagagaattccagttgtactcaaagggtatcttcactgggccatgttcaacttttttggatcacgcagtattgatagtaggatatggttcagaaaatggagttgattattggattgtaaagaattcatggggaaaatattggggaatgaatggctacatacacatgatacgaaatagtggcaattccaaaggaatatgcggaattaacacattagcttcatatcctgtcaagaccaagcctaatcctcctatccctcctcccccaggtcctgtaagatgtaatttgtttactcactgttcagaaggagaaacatgttgctgtgccaagagctttcttggaatatgcttttcttggaaatgctgtgggttaacttctgccgtgtgctgcaaagacaagcgccactgttgcccccaagattatccgatttgtgatacaagaagaggtcaatgtttaaagagaactgcaaatgggacgacaacaatcacttctgagaaccaagatttttcccacaagtcaagaggttggaaatctcagtga

SEQ ID NO: 1844 - DNA, 2688 bp, Glycine Max
atgactcttgaagatttctttaccttgtctgagatgaaagatgggctcacagcaccttctcgggtgcaggagctggtctctgtgatgcaaaaggagaaagatagtgaggttaaaaatgctgctgatgtgacaaggcagtgggctgctgttgcaagcactattgctgctacagagaataaagattgccttgatctttttattcaattagatggactttgcttcattaatagatggttaaaggatgcccaagattttggggttgatgcaaacgacagcttcgttgaagaatcaatcactgcaatgttacgtgcagttgaaaagctgcatatagacagtgagaagtcaatgtcttcaggaattcgcatcactgtaagtaatcttcttggccatcatagtgctagggttcaggatagagcaagaacgttgtttgacagctggaagggagttggaaatggtgatactgaatctcatgatattgtcagggaggaaacacagccatctgctgcaaatgaagctggcaatgataatgatcctgcatcaggactaattggaagtgagaaatctctgttgaaaagctcggataatttaccggtacatatgggatcggaaaaccatgttgctggtgttccatcttctgctcaagaagttgctcccgctcatgaaggattgcctatatgcactacaggtgagaccacttcggctggaacctgtaactttcccattccaaatcaaagcagttttgaaggacagtcagatgtggtacagttaagtgacttagctaaagtggaaaagcaggagcaaaacattaatgaccctccagaaaaattaggagcaccagagatctctacagaaaatgataatgattgttgttctaatgcattgcagggcgcatcagtcagtgacagtaacttgggaaagactgaggtgttagacgtgtctgtctttggaacagaatatgtcacagcatcaaaggaaggcaagggccatgaagaagatacatcaattggttctgattctagtaaacccggaatagatttcagaagctctaacataattgacaagagaggttctgacaatgaacttgactgtggcattgtggatgctttagaatttgctcgaaaaattgctcaggaagttaatagagaagtcagctgttcttcagaaaaagtctcagaacacagaatcaggcaaccatgcagtccagattctgtaagaaaagaggacgagctcactcctgtcccacccaaggaggtttcctccagacaaagccatgctactgaggcatgttcaatggaggggcatgtgagtattttagacaacaatgaggctgagccggaatgcagaccctatgtggtgtccttagaggtgactgaaaaagctcaagattcaggaggtaattcagagaaacgactctgcggctttgatctcaatgaagttggtgctgatgatatggatgtttctgtaaatactatgtctaccccaataccagttgtctctgcttcaaggcctgcaccaactcctgggttgactggggcccctttgcagtttgagggaacacttggatggaaagggtcagctgccaccagtgcctttcgacctgcgtcgcctcgtaaaaattgtgataatgataggaatctttctgttgatatgaactttgatacttccaagcagaggcaggattggcttgattttgatctaaatgtggctgagggtgaagaaggcaatgtaaaacctactgctgaatcttcaggcaggccttctgggcaatcgtcatttgaatttagtcctaaaaaatcaagcaggcttgaatttgatttgaacagtaccggtgatgatggtgacacccaaccttcagatcaaagaatggagggacaactctttcttggaagaaatggctgttggagcccatcccctgcatcgtcgtcctcatcaatgcagccatctgttagaaacattgatttgaatgacaggccgtgccttcaaaccgatttggtagaccagggccccattaagtctgcccatcttatcaatgcatttggttctaaatcatcaaatgctcctgttatctctcttctgggtgccaaggtagaagttggtaaaaaagaatgtgttcctcaaaggttgtctttgcagaatggcaaggctactgaacctgcaatagaactaacaatgtcaagagcaggtagcgttttagggatgaccccaacagtacccttcaatcattcatctgtttttggctataatggagtggcgtcagcatcagtgacacccgcaatgtctttttcatcagccatgtacggatcaggtggcacaattccatacatggtggactcaagaggagctccagttgtccctcaagtgggtggatcttcatcaactgtcctttcatcttactctcagccaccaatctttatgaacatggctggtacacaacttggtctgaatggatttggaccttcacgtcctaactttgacctgaactctagcttcatgattgagggtgggaatagagacacattggctgcaaggcaatttttctttcctgttcagggaagggctgtggaggagcaagtaagatccatgccgcaaccctccagttcgggggttagtgggaaacgaaaagaaccagacagtggtttggaaccctacccatttatctacaaaaatccgcaacctccatggaagtag

SEQ ID NO: 1845 - DNA, 613 bp, Glycine Max
atgagacttggatttgcttcttggagattcatcctatgcaccctagttgtctttttgattctacaagacagtgtagctagaaagatagctacaacatctgggaatgaagttcaactgaaggaagtatcctatgatttgcaaaagcttgcaacagagggtcttgtacttgacagtattattcagcttgaaggcgctgatataaaaaggaagaataagcatgtccataaagacgaggctagagtgaagaaaggaataggatttgacatagaagaagaggaggataaaaatgatcacaaaaagatagttggaaaggatgtgcatggttataagccatctcatgaggatcacaaacacatggaccttgaactgaatgtgtttttcaccccaaatgatttgaaggttgggaaaataatgcccatctatttttccaagaaaaactcctcaacatctccaaaatttctgaccagagaagaagctgatcagattcctttctcatcaaaacacctaccatcgcttctcaaattcttctccatcccaaaacactctccccaagccaaggcaatgaaatataccctcaaacaatgtgaatttgaatccatggaagagagaccaa

SEQ ID NO: 1846 - DNA, 1350 bp, Glycine Max
atgagagagatcttgcacgttcagggaggccaatgcggtaaccaaatcggttccaagttctgggaggtgatctgcgacgagcacggcatcgatcccaccggaaagtacaacgaggaaggcaacagcagcatccaactcgaaaggatcaatgtgtattacaacgaggcctctggcggaaggtacgttccccgtgccgtgcttatggatctcgaacctggaaccatggacagcatcagatctggcccctacggcaagatcttccgccccgacaacttcgtcttcggccagtccggcgccggtaacaattgggccaaaggtcattatactgaaggcgccgagctgatcgactccgttctcgacgtcgttcgcaaagaggctgaaaactgcgattgcttgcaaggttttcaagtttgccactctcttggaggaggcacaggttctggcatgggaacactgttgatatcaaaaattagggaggaatacccagacagaatgatgctcactttctctgttttcccatctccaaaagtttctgatacagttgtggagccatacaatgccactttgtctgtacaccaactggttgaaaatgcagatgagtgcatggttcttgacaatgaagcactttatgacatttgctttaggacattgaaactcagcacccctagctttggtgatctcaaccatctgatttctgcaaccatgagtggggttacctgttgtctgaggtttcctggacaactgaactctgacctcaggaagctggctgtcaatctgattccatttccccgtcttcacttctttatggtggggtttgcacctctcacttctcgtgggtctcagcaatatgtctcccttactgtcccagagctgactcagcaaatgtgggatgccaaaaatatgatgtgtgctgctgatccccgacacggccgatacttgactgcatctgctatgttcaggggaaagatgagcaccaaagaggttgatgaacaaatgatcaatgtgcagaacaaaaactcgtcatactttgttgaatggattcccaacaatgtgaagtccagcgtttgtgatattccacccaggaatttgaagatgtcatccacatttattggcaactcaacatcgattcaagagatgtttaggagggtcagcgagcagttcactgctatgtaccggcgcaaagccttcttgcactggtacactggggaggggatggacgagatggagttcaccgaggcagagagtaatatgaatgatttggtagcagagtaccagcagtaccaggatgcaacagcagaggaggatgaatacgaggatgacggtgatgagcagcagtatgatgaccagtag

SEQ ID NO: 1847 - DNA, 927 bp, Glycine Max
atgagaggggtgaagagagcagtatttgtaggcagagccctaagaagcaattccaacaccgccgtgtacggtgttggtgccacccttcatcgagatcgaatggctccccatggctgcttaaccccatcaaatccaaatccttctgtttctgttactgggtttagatacctttctgcttctgctgctgccacgtctcttgcccaagacgctcagaccaaggccttcaaacccaaggaacttgtcctctttcagtaccaggcctgtccattctgcaacaaggttgcagcgtttctggactattatgatattccattcaaagtggttgaggtgaatcccataaacaagaaggagatcaaatggtccgactacaagaaggtgcctatcctcaccgttgatggtgaacaaattgttgactcttcagacataattgataagttgatcaaaaggatacatccagattatgacctaaatgctgaagaagagaagaagtggcgacagtgggtggataatcacttggtgcatgtcttgtcaccgaatatatatcggaatgttcctgaagctcttgaatcatttgattacatcaccacccaaggaaatttcagtttttctgagagattagtggcaaagtatggtggggctgcagctatgtattttgtgtcaaagaaattgaagaagaaacacaacatcactgatgagcgtgcagcactgtatggagctgccgaacaatgggttgatgctttgaagggccgaaaatttcttggtgggttggatcctaatttagcagatcttgctgtgtttggtgttcttagacccatccgccatctcaagtcaggtagagatatgctagagcacacccggattgggaaatggttttctcagatggatcgtgtggtaggacagtcttctagggtgagtgagcagagctag

SEQ ID NO: 1848 - DNA, 90 bp, Glycine Max
atgaggaatccgttttttaaaatacagagaagtagggccttaacaaaacttcgactaaagcccacatatggcattagccttagaatttag

SEQ ID NO: 1849 - DNA, 1041 bp, Glycine Max
atgagtataagactcccaccaccaataatccacgcccttctcccccagctgcataagagattggtgaaggaaacagtggaagaaagaggtgagcgtccacaaaacaacagcgttccaaagcttataaagtacacgttggatgagttgagaagtgcgaccagaaacttcagaccagacacggtcctaggcgagggtggttttggacgtgttttcaaagggtggattgataagaacaccttcaagccctcaagagttggtgttggaatccccgtggctgtgaagaagtctaaccccgatagcctccagggtctagaagaatggcagagtgaagtgcaacttttggggaaattctctcatccaaacctggttaaactaattggctattgctgggaggaaagtcaattcctgctcgtatacgaatacatgcaaaagggcagcctcgaaagccacctctttagaagaggcccaaaaccactttcatgggatataagactcaagatagccataggagctgccagaggtctagctttcttgcatacatcggaaaagtctgtcatctatagagacttcaagtcttccaacattttgcttgatggggattttaatgcaaaactatcggactttggattggcaaagtttggccctgtcaacggaaaatcccacgtaaccacgcggatcatgggcacgtatggttacgcggcccctgaatacatggccacaggccatctgtatattaaaagcgatgtatatggatttggcgttgttctgctagaaatgctaacaggtagagcagctctagacacaaatcagccaacgggtatgcagaatttggtagagtgcactatgtcatctctacatgccaaaaagagactgaaagaggtaatggatccaaacatggaggaacaatattcattaagggcagcatttcaaatagcgcaacttattttgaaatgtttagaatctaagccaaagaaacgaccgtctatggaggaggttttggaaaccttagaaaaagttgaagccataaaatacaaacccaaa

SEQ ID NO: 1850 - DNA, 543 bp, Glycine Max
atgagtataggaatggagacagtgatggaagaggaagaatacaactatagagaagtgaggcttccttctctgatagcagtggtgggcgagccagagctggggagggaaacaggggaaaggagaagaggaagggacataataatagccatagatcatggccccaataccaaacatgctttcgattgggctctggttcacctttgcaggctcgctgataccatccatctcgttcacgccgtttccgacttgcataaccaagttgtctacgacataacccagggtcttatggagaaattagccattgaggcttttcaagtactaatggtgaaaacagtagctcgaattgtggaaggtgatccaggaaaagtaatttgcaaggaagcagagaggatcaaacctgcagctgtggttatggggacccgaggcagaagcttgattcaaaggtttggttcaacaatccctctatctgaaaccagcagttatcatgttactgaagcatcttcttgtgattttcttcagtgtgctacagggaagtgttggtga

SEQ ID NO: 1851 - DNA, 546 bp, Glycine Max
atgagtataggaatggagacagtgatggaagaggaagaatacaactatagagaagtgaggcttccttctctgatagcagtggtgggcgagccagagctggggagggaaacaggggaaaggagaagaggaagggacataataatagccatagatcatggccccaataccaaacatgctttcgattgggctctggttcacctttgcaggctcgctgataccatccatctcgttcacgccgtttccgacttgcataaccaagttgtctacgacataacccagggtcttatggagaaattagccattgaggcttttcaagtactaatggtgaaaacagtagctcgaattgtggaaggtgatccaggaaaagtaatttgcaaggaagcagagaggatcaaacctgcagctgtggttatggggacccgaggcagaagcttgattcaaagtgtgctacagggaagtgttggtgagtactgctttcaccactgtaaagcagcacctgttgttattgttcctggaaaagaggctggagatgcgtcaatcctctag

SEQ ID NO: 1852 - DNA, 564 bp, Glycine Max
atgagtataggaatggagacagtgatggaagaggaagaatacaactatagagaagtgaggcttccttctctgatagcagtggtgggcgagccagagctggggagggaaacaggggaaaggagaagaggaagggacataataatagccatagatcatggccccaataccaaacatgctttcgattgggctctggttcacctttgcaggctcgctgataccatccatctcgttcacgccgtttccgacttgcataaccaagttgtctacgacataacccagggtcttatggagaaattagccattgaggcttttcaagtactaatggtgaaaacagtagctcgaattgtggaaggtgatccaggaaaagtaatttgcaaggaagcagagaggatcaaacctgcagctgtggttatggggacccgaggcagaagcttgattcaaagtgtgctacagggaagtgttggtgagtactgctttcaccactgtaaagcagcacctgttgttattgttcctggaaaaggtaggctggagatgcgtcaatcctctagtcgaattatgttgtaa

SEQ ID NO: 1853 - DNA, 633 bp, Glycine Max
atgagtataggaatggagacagtgatggaagaggaagaatacaactatagagaagtgaggcttccttctctgatagcagtggtgggcgagccagagctggggagggaaacaggggaaaggagaagaggaagggacataataatagccatagatcatggccccaataccaaacatgctttcgattgggctctggttcacctttgcaggctcgctgataccatccatctcgttcacgccgtttccggttccttccttactttacttactccaccactttttttttgtctcttattgtggaaattcatttatcttttctttaatattttttcagacttgcataaccaagttgtctacgacataacccagggtcttatggagaaattagccattgaggcttttcaagtactaatggtgaaaacagtagctcgaattgtggaaggtgatccaggaaaagtaatttgcaaggaagcagagaggatcaaacctgcagctgtggttatggggacccgaggcagaagcttgattcaaagtgtgctacagggaagtgttggtgagtactgctttcaccactgtaaagcagcacctgttgttattgttcctggaaaagaggctggagatgcgtcaatcctctag

SEQ ID NO: 1854 - DNA, 594 bp, Glycine Max
atgagtgcgtcgaggttcattaagtgcgtcaccgtcggcgacggcgctgtcggcaaaacctgcttgttgatttcctacaccagcaacacttttcccacggactacgtgcccacggtttttgacaatttcagtgctaatgttgtggtggatggaagcaccgtaaacttggcattgtgggatactgctggtcaggaagattataataggcttagacccttgagctatcgaggagctgatgtttttatacttgccttttctctcataagcaaggctagctatgaaaatattgcaaagaagtggatccctgaactaaggcattatgcccctggtgttccaataattctcgttggaacaaagttagatcttcgggaagataagcaattttttatggaccaccctggtgcagtaccaattactacagcacagggagaagaattaagaaaactgattggtgctcctgcctacatcgagtgtagttcaaaaacacagcagaatgtgaaagccgtctttgacgctgccatcaaagtggttcttcaaccaccaaagcaaaagaaaaagaagagaaaggcacaaaaagcttgctcaatattgtga

SEQ ID NO: 1855 - DNA, 594 bp, Glycine Max; identical to SEQ ID NO: 1854

SEQ ID NO: 1856 - DNA, 432 bp, Glycine Max
atgagtgcgtcgaggttcattaagtgcgtcaccgtcggcgacggtgctgtcggcaaaacctgcttgttgatttcctacaccagcaacacttttcccacggactatgtgcccaccgtttttgacaatttcagtgctaatgtggtggtggatggaagcaccgtaaacctaggattgtgggatacagctggtcaggaggattacaatagattaagacccttgagctatcgaggagctgatgtcttcatacttgccttttctctcataagcaaggctagctatgaaaatattgcaaagaagtggatccctgaactaaggcattatgcccctggtgttccaataattctcgttggaacaaagttagatcttcgggatgataagcaattttttatggaccatcctggtgcagtgccaattactacagcacagaattga

SEQ ID NO: 1857 - DNA, 591 bp, Glycine Max
atgagtgcgtcgaggttcattaagtgcgtcaccgtcggcgacggtgctgtcggcaaaacctgcttgttgatttcctacaccagcaacacttttcccacggactatgtgcccaccgtttttgacaatttcagtgctaatgtggtggtggatggaagcaccgtaaacctaggattgtgggatacagctggtcaggaggattacaatagattaagacccttgagctatcgaggagctgatgtcttcatacttgccttttctctcataagcaaggctagctatgaaaatattgcaaagaagtggatccctgaactaaggcattatgcccctggtgttccaataattctcgttggaacaaagttagatcttcgggatgataagcaattttttatggaccatcctggtgcagtgccaattactacagcacagggagaagaattgagaaagctgattggtgctccggcctacattgagtgtagttccaaaacgcaacagaacgtgaaagctgtctttgacgcggcaatcaaagtggttatccaaccaccaaagctaaagaaaaagagaaaaacacagaaagcttgctccatattatga

SEQ ID NO: 1858 - DNA, 588 bp, Glycine Max
atgagtgcgtcgaggttcattaagtgcgtcaccgtcggcgacggtgctgtcggcaaaacctgcttgttgatttcctacaccagcaacacttttcccacggactatgtgcccaccgtttttgacaatttcagtgctaatgtggtggtggatggaagcaccgtaaacctaggattgtgggatacagctggtcaggaggattacaatagattaagacccttgagctatcgaggagctgatgtcttcatacttgccttttctctcataagcaaggctagctatgaaaatattgcaaagaagtggatccctgaactaaggcattatgcccctggtgttccaataattctcgttggaacaaagttagatcttcgggatgataagcaattttttatggaccatcctggtgcagtgccaattactacagcacagggagaagaattgagaaagctgattggtgctccggcctacattgagtgtagttccaaaacgcaacaggtgtactttcttatcttttgcttaaaatttatggatcattttttttcatcttttataacacagattgtcatgcgctcttgggatgacagaacgtga

SEQ ID NO: 1859 - DNA, 765 bp, Glycine Max
atgagttcagacagccgcagcaggagcagaagcaggagcccaatggaccgtaagatccgctctgatcgattttcctatcgtgatgcaccttacaggagagattcacgtcggggtttcagccgtgacaatctgtgcaagaactgcaagagacctggtcattatgcaagagaatgccctaatgtcgcaatttgccacaactgtggcctccctgggcatattgcttctgaatgtacgacaaagtcactgtgctggaactgtaaagaacctggccacatggccagcagttgtccaaatgagggtatttgccacacctgtggtaaagctggacaccgtgctagggaatgctcagcccctccaatgcctccaggggacttaaggttgtgcaacaactgttataagcaggggcacattgcagctgaatgtacgaatgagaaggcatgcaacaactgtaggaagacaggccacttggcacgtgattgtcctaatgatccaatttgtaatttgtgcaatgtttctgggcatgtggctagacagtgtccgaaagccaatgttcttggagatcgcagcggtggtggcggtggtgctcgtggtggtggcggtggtggctatagagatgttgtttgcaggaactgccagcaattaggtcacatgagtagggattgcatgggccccttgatgatttgccacaattgtggaggtcgtggtcacctggcatatgagtgcccttcgggtcggtttatggaccgctaccccaggaggtactga

SEQ ID NO: 1860 - DNA, 765 bp, Glycine Max; identical to SEQ ID NO: 1859

SEQ ID NO: 1861 - DNA, 687 bp, Glycine Max
atgagttccccttgcagttgcgcttgcgcttctactaattggagcgttgattatggttatggaggtggtggcgtgctttcaaattcaaaggtaagaagcaggaggtccaaagaaatatccatggcacattcagtttgtggttcgagaaggtccactgcacttgtgatttcatccttgcctttcggcttccttttcctatctccgccagctgaggccagacgcaacaagaaggccatccccgaagaccaatacattactagcccagctgatggattgaaatactatgatttggttgagggcaaaggtccagtcgctgaaaaaggaacaactgttcaggtacactttgattgcttatatcgcggaatcacagctgtctccagtcgagaatctaaactcctagctggaaatcgtatcattgctcagccatatgaattcaaagtgggagctccaccgggaaaggaaaggaagcgcgaatttgttgacaacccaaatggtttattctctgctcaagcagcaccaaaacctccccctgctgtgtatataatagttgaaggaatgcgagttggtggaaagcgaactgtgattgttcctcctgaaaatggctatggtcaaaagggaatgaatgagattccgcctggagctacatttgaactaaatgttgagcttctgcaagttgtagctacctga

SEQ ID NO: 1862 - DNA, 441 bp, Glycine Max
atgagttccccttgcagttgcgcttgcgcttctactaattggagcgttgattatggttatggaggtggtggcgtgctttcaaattcaaaggtaagaagcaggaggtccaaagaaatatccatggcacattcagtttgtggttcgagaaggtccactgcacttgtgatttcatccttgcctttcggcttccttttcctatctccgccagctgaggccagacgcaacaagaaggccatccccgaagaccaatacattactagccctgatggattgaaatactatgatttggttgagggcaaaggtccagtcgctgaaaaaggaacaactgttcaggtacactttgattgcttatatcgcggaatcacagctgtctccagtcgagaatctaaactcctagctggaaatcgtatcattgctcagatactattagaaggtacttga

SEQ ID NO: 1863 - DNA, 684 bp, Glycine Max
atgagttccccttgcagttgcgcttgcgcttctactaattggagcgttgattatggttatggaggtggtggcgtgctttcaaattcaaaggtaagaagcaggaggtccaaagaaatatccatggcacattcagtttgtggttcgagaaggtccactgcacttgtgatttcatccttgcctttcggcttccttttcctatctccgccagctgaggccagacgcaacaagaaggccatccccgaagaccaatacattactagccctgatggattgaaatactatgatttggttgagggcaaaggtccagtcgctgaaaaaggaacaactgttcaggtacactttgattgcttatatcgcggaatcacagctgtctccagtcgagaatctaaactcctagctggaaatcgtatcattgctcagccatatgaattcaaagtgggagctccaccgggaaaggaaaggaagcgcgaatttgttgacaacccaaatggtttattctctgctcaagcagcaccaaaacctccccctgctgtgtatataatagttgaaggaatgcgagttggtggaaagcgaactgtgattgttcctcctgaaaatggctatggtcaaaagggaatgaatgagattccgcctggagctacatttgaactaaatgttgagcttctgcaagttgtagctacctga

SEQ ID NO: 1864 - DNA, 624 bp, Glycine Max
atgagttccccttgcagttgcgcttgcgcttctactaattggagcgttgattatggttatggaggtggtggcgtgctttcaaattcaaaggtaagaagcaggaggtccaaagaaatatccatggcacattcagtttgtggttcgagaaggtccactgcacttgtgatttcatccttgcctttcggcttccttttcctatctccgccagctgaggccagacgcaacaagaaggccatccccgaagaccaatacattactagccctgatggattgaaatactatgatttggttgagggcaaaggtccagtcgctgaaaaaggaacaactgttcaggtacactttgattgcttatatcgcggaatcacagctgtctccagtcgagaatctaaactcctagctggaaatcgtatcattgctcagccatatgaattcaaagtgggagctccaccgggaaaggaaaggaagcgcgaatttgttgacaacccaaatggtttattctctgctcaagcagcaccaaaacctccccctgctgtgtatataatagttgaaggaatgcgagttggtggaaaggtgactcaaacttccttctatgttttgtcatcttatactgttattacttattag

SEQ ID NO: 1865 - DNA, 1080 bp, Glycine Max
atgagttgcttttcgtgctttgtttctcgccggaaagatgtgagaagggttgaaattgacaatggctctcgatctgctaccgctactgctacttcttcttctgagagtgaaaggaagagggaatcctcagaggggaaggggaagaagagtgtgagtagtagcagtaacaaaggaagtacggcagcggcaagtttcggttttcgcgaactggcagaggcaacgaggggtttcaaggaagtgaacttactcggggaaggtggttttggaagggtttacaagggtcgtcttgcaacgggagagtatgttgccgtgaaacaattgagtcatgatggtcggcaaggttttcaggagtttgtgacggaggttcttatgttgagcctgctgcacaattctaatcttgtcaagttaattggctactgcactgatggagatcaaaggcttttggtttatgagtacatgcccatgggttcacttgaagaccatctatttgatcctcacccagacaaagaaccactaagttggagtactcgaatgaagattgctgttggagctgctcgtggccttgaatatctccattgtaaagcagatccacctgttatctacagggacttgaaatctgcaaacatcttgttagataatgaattcaacccaaaactgtcagattttgggcttgctaaacttggacctgttggagacaatacccatgtttcaaccagagtgatgggaacatatggttactgtgcgccagagtatgccatgagcggcaaattaactcttaaatctgatatatatagctttggtgtggttttgttggagttgatcactggacgtagggcaatagatactaatagaagaccaggagagcaaaacttggtttcatggtctcgtcaatttttcagtgaccggaaaaagtttgtacaaatggttgaccctctgttacacgaaaacttccccgtgcgctgtttgcatcaggcaatggctataactgctatgtgtatccaggagcaaccgaaattccgtccacttattggtgatattgttgttgcactggaatacctagcttctcatagtaatccctga

SEQ ID NO: 1866 - DNA, 324 bp, Glycine Max
atgataacacgatcgaatctggttgaacagctgcgagagtatcagattcgatccaagcatgactgggcctctgtctcgttcttctcctccacttcttcaaacatcaccacttccagggtggatgtggtgctttttgtaatatgggaacttgttattttagctttcttggttttttctgtagtctctctgtacttcaagcacatccggcttgcttttattttagtctgcatcacaatcctattgcttttatgcatgaaaattacaaagcaagtaaggcttgcaaggaaaaagagacgaaggatgcttcttccattgtcaatgtaa

SEQ ID NO: 1867 - DNA, 2001 bp, Glycine Max
atgatactcgcaaacagcatgctctctggagttctgcccgggaggttgtttagtgattcgttgcagttcctagtgctgaggcaaaacaattttagtggttctttgcctgttgagttgtggtctctgccaagattgagcttccttgatgtctctgccaataacttcagtggtctgcttcccaattccagttctgctgctaataatgctactgttgcggtgctcaatatttcacataacaagttttatggaggcctcactcctgctctcagaaggtttgctttcgttgatctttccagcaattattttgagggcaaggttctggatttcatgcgtaatgtatctctagatattaactgcctccagaatgcgacaaatcagaggtcaacggtgaaatgtgcatcattttatgcagagagggggctcagttttgacaattttggacgcccaaatacgacaaaacctcccgccgcagccaaaagctctgggaagagcaataaaactaagattatattggcagcagtcttgggtggagtgggtttaattgcaattttggtgtttctactagttctgttgcttctgtgtgctcgtaagaggggtaattcaaatcagagaggaaatggtgtgggtcctgctcctgttggcagtagtcctccaaatcccggtgtaccaatcgactttccaaatgtcggagattcatttacctatcatcagttgctccaggcaacaggagatttcaatgatgcaaatcttatcaagcatggccacactggggatttcttcaatggtgttctggaaagtgggattcctattgttatcaaaaggatcgacacgcgctcagctaaaaaggaggcttacctgtcggaattggacttcttcaataaggtttctcatcaaagatttgttcctttgttaggtcattgctttgaaaatgagaatgagaagttcctggtttataaacgcacgccaaatggggacttgtctaattgcttgtactacaaaaacacatctgaagatggtacttcgcaatcattggattggataactaggttaaaaattgctactggagcagcagaggccctatcatatctacatcatgaatgtgttccaccgattgttcacagagatattcaagcaagcagtatacttctagacgacaaatatgaagttcggttagggagtttaagtgaagtttgtgctcaagaagctgatattcatcaaagtaaaatcacccggtttctgcggttgcctcatggtcaagatatatgtggagtgattgaacatgtactgattcctgttggcttgagaagttatactgttacattcacacaaaaagctcatagaactttggttggtttgtgcctgtctttcaaaagtgcaagttcatcaacatcaatttgtgcctatgacgtttattgttttggaaaagttttacttgagctggtgacgggtaagctgggaatgagtgcagctagtgaggccgaagtaaaggaatggtttgatcagattctaccttgcattagtatgtatgataaggagctagtaacaaaaattgttgatccgtcaatggttgttgatgaggatttcttagaggaaatatgggctatatccattgttgccaggtcttgcctaaatcctaaaccttcaaggagacccccaatgagatatgttctcaaggctctggaaaaccctttaaaggttgtgagggaagaaaattccagttctgcgcggcttagagcaacctcttctagaggctcttggaatgctacgttgtttggtagttggcgtcagagttcttccgatgtaacagttactccagcagcctctggtacaaaactcgaaagagctagcagtttaaagctgtcaggaactaccggttcgcagtcacagggtagtttccacaatggtggaggtgagatttcgtcatcgcggagacgacattcaaaggagatattcccagagccatctggggtacatgatgtagagaggttggagcttcaatag

SEQ ID NO: 1868 - DNA, 858 bp, Glycine Max
atgataggatcttttattacaagggcacttgtgatggtttttggctatgccttccctgcctatgaatgctataaagcagttgaaaagaataggccagaaattgaacaacttcgtttttggtgccagtactggattttggtagctgttttgtcagtatgtgagcggattgctgatgcttttatatcatgggtcccaatgtatagtgaagctaagttggcatttgtcatatacttgtggtacccgaaaacaaagggaacaacatatgtgtatgattccttctttagaccatatgttgcgaaacatgagacagaaattgaccgcaacttgttggaactaaggacaagggcaggagatactgcagttttgtattggcaaaaagctgctagttatggccagactagaatatttgaaattttgcagtatgttgctgcacagtcaacaccttcgccacgccctgctcagcaacaaccagctatgagggtgcgtcaagccgcaactagtaatagccaaccagcatctgcgacagaaccacaagctgagaatccatcttctcctacttctagttcatccagtcagcaacagaaggaagtagcagaggaggagttgggttcttcacaagtgcctaaagcaccttatactgtagcaggtttaagtagccagaagtctaatcctatacctgaaacggccaatcaatcggtacctgaagaggatgagccaatgcagattgaagcagcagcaccttcatcctcttctgcaaatgaaaatgagaaccctcccttggaagatacaataatggaagaaagcattagggtaacgcgtggtagactaagaaaaaatcgatcagctcgaatccgttag

SEQ ID NO: 1869 - DNA, 1332 bp, Glycine Max
atgatattgcagttcttcgtgctttcacagagaggcgataacatcgtctaccgcgactatcgtggtgaagctcaaaaaggaagcgctgagacatttttccgaaaagtaaagttctggaaagaagatgctgagggagatgctccacctgtttttaatatagacggtgtgaactacttccacgtaaaggttgctggattgctatttgttgctactactagagtcaatgtctccccttctcttgttttggaacttttacaaagaattgcacgtgtcatcaaagattaccttggtgttctcaatgaagattcctttagaaagaacttcgtgctcgtttatgaattactggatgaagtcattgattttggttatgtgcaaacaacatccactgaggatttgaagtcatatgttttcaatgagccaatagtgattgatgctgcacggatgcctccacttggccctgcttccatttttatgcaagggaccaaacgaatgccaggtacagctattacaaagtctgtggttgctaatgaacccggtggaaggaagagggatgagatctttgttgatgtaattgagaaaataagtgttacattcaactctagtggatttatacttactagtgagatagatggaaccattcaaatgaagagttatcttactggtaacccagagattcgacttgctctcaacgaggacctgagtataggaacaagtgattatagaggttcaggtgctgtcattttagatgattgtaacttccatgagtctgtacaccttgatagttttgatgttgatagaactttgtcattggtaccaccagaaggtgaatttccagtcatgaattatcgtatgactcaaccatttaagccaccctttcgtattaatgcattaattgaagaaacaggatccctaaaggctgaagtgaccattaaagtgcgagctgaattcaactcaagtatcaatgctaatactgttcttgtgcagatgcctctgccatcatttacatctcgtgttacttttgagttagaacctggagcagttggacacaccactgattttaaggaagcaaataaaagactggaatggggtctgaaaaaggttgttggtggatctgaacatactttacgagcaaagctgacattttcacaggagttacatggaaatatcatgaaagaagcagggcctgtcagcatgactttcaccgtacctatgtacaatgcttcaaggcttcaggtgaagtatttgcaaatagcaaagaaatcaaaagcacataatccttatcgctgggttagatatgtaacccaagcaaactcatacgtagcacggttataa

SEQ ID NO: 1870 - DNA, 1038 bp, Glycine Max
atgatcatgtattcgttgacactgaaacccttcttcactcctcaattagtttcttcgtcttcttcaacttccacttcgtcctcttcgatttctctcgtgtccttcccatctcgttcggtctcatcaattagctttcccagaaatttaaagcacaaaggaagatttggtctcagagttgaagcatacgattcctccaataatgacacttccaaccctgccagtgctggcggcgactccaaaccccctaatggcactttgtcaaagagcaggagagaaattttactggaatatgttaagaatgtgcagccagaatttatggaattgtttgtgaaaagagcgccacaacaggttgtggatgcaatgcgacaaacagtgacaaatatgattggaacactgccccctcaattttttgctgtaacaattaccactgtagctgaaaaccttgcacaactcatgtacagtatcatgatgactggatacatgttcaagaatgcacaatatcgtttggaattgcaagaaggtttggaacaagttgttgctcttccggatgtgcaagataaaaaggatgtgccagactatgcacctggcacacaaaagaatgtttcaggtgaagttattcggtggaacaatgtttctgggcctgagaaaatagatgctaaaaagtacattgaattacttgaagcggagattgaggagctgaatcgtcaagttgggagacaatctagcaatggacaaaatgaactgttggaatacctaaaatctctcgaacctcgaaatttgaaggagttgaccagtagtgctggcgaggatgtagtgtttgcgatgaatacatttataaagcgcctgctggctgtttcggatcctagccaaatgaagactagcgtgaccgagactagtgcagctgaacttgcgaagctgctttattggttgatggtggttgggtacagcatacgcaatattgaagttcgttatgacatggaaagagtacttggcacccctccaaagctagctgaattgccgccaggtgaaaatgtttaa

SEQ ID NO: 1871 - DNA, 852 bp, Glycine Max
atgatcatgtattcgttgacactgaaacccttcttcactcctcaattagtttcttcgtcttcttcaacttccacttcgtcctcttcgatttctctcgtgtccttcccatctcgttcggtctcatcaattagctttcccagaaatttaaagcacaaaggaagatttggtctcagagttgaagcatacgattcctccaataatgacacttccaaccctgccagtgctggcggcgactccaaaccccctaatggcactttgtcaaagagcaggagagaaattttactggaatatgttaagaatgtgcagccagaatttatggaattgtttgtgaaaagagcgccacaacaggttgtggatgcaatgcgacaaacagtgacaaatatgattggaacactgccccctcaattttttgctgtaacaattaccactgtagctgaaaaccttgcacaactcatgtacagtatcatgatgactggatacatgttcaagaatgcacaatatcgtttggaattgcaagaaggtttggaacaagttgttgctcttccggatgtgcaagataaaaaggatgtgccagactatgcacctggcacacaaaagaatgtttcaggtgaagttattcggtggaacaatgtttctgggcctgagaaaatagatgctaaaaagtacattgaattacttgaagcggagattgaggagctgaatcgtcaagttgggagacaatctagcaatggacaaaatgaactgttggaatacctaaaatctctcgaacctcgaaatttgaagtgctggcgaggatgtagtgtttgcgatgaatacatttataaagcgcctgctggctgtttcggatcctag

SEQ ID NO: 1872 - DNA, 1035 bp, Glycine Max
atgatcatgtattcgttgacactgaaacccttcttcactcctcaattagtttcttcgtcttcttcaacttccacttcgtcctcttcgatttctctcgtgtccttcccatctcgttcggtctcatcaattagctttcccagaaatttaaagcacaaaggaagatttggtctcagagttgaagcatacgattcctccaataatgacacttccaaccctgccagtgctggcggcgactccaaaccccctaatggcactttgtcaaagagcaggagagaaattttactggaatatgttaagaatgtgcagccagaatttatggaattgtttgtgaaaagagcgccacaacaggttgtggatgcaatgcgacaaacagtgacaaatatgattggaacactgccccctcaattttttgctgtaacaattaccactgtagctgaaaaccttgcacaactcatgtacagtatcatgatgactggatacatgttcaagaatgcacaatatcgtttggaattgcaagaaggtttggaacaagttgttgctcttccggatgtgcaagataaaaaggatgtgccagactatgcacctggcacacaaaagaatgtttcaggtgaagttattcggtggaacaatgtttctgggcctgagaaaatagatgctaaaaagtacattgaattacttgaagcggagattgaggagctgaatcgtcaagttgggagacaatctagcaatggacaaaatgaactgttggaatacctaaaatctctcgaacctcgaaatttgaagttgaccagtagtgctggcgaggatgtagtgtttgcgatgaatacatttataaagcgcctgctggctgtttcggatcctagccaaatgaagactagcgtgaccgagactagtgcagctgaacttgcgaagctgctttattggttgatggtggttgggtacagcatacgcaatattgaagttcgttatgacatggaaagagtacttggcacccctccaaagctagctgaattgccgccaggtgaaaatgtttaa

SEQ ID NO: 1873 - DNA, 285 bp, Glycine Max
atgatggattttttggtttttttaggttgggataattaccgtgtggttggacttgtaccaatctccaatgaggacagtgtaatcaccagctggatcagggaatgggacgggaattcttggtctgctgagaatcctaatgcctccaaaaccgccagcggctttgtggaatgcaagggatgggaaatagtaaaaactcccaatttgatctttgacttgaaggatgtaagtaaaattcttccctggtgggatggggcacgttgttccaaaaacaccatcttcgaatga

SEQ ID NO: 1874 - DNA, 1071 bp, Glycine Max
atgatggcggaatcgggcgaggaagagatagttggtaaacctgtccaagagctgctgttgaatcccgaaaatctaccaaaaaattacatctacgaggaaggtggtgctggatttcgtgatgctcttgtgccatcacaggatgatgatattccggtgatcgaccttcatcgcctttcatcttcatccatctcacaacaagagcttgctaaactccaccatgcactccattcatggggctgcttccaggcaataaaccatggaatgaaaagctcatttctggacaaggtgagagaagtttcaaagcaattctttcaacttccaaaagaagaaaagcaaaaatgtgcgagggaaagggaaccaaacaatattgaagggtatggcaatgatgtaatatattcaaaaaaccaaaggcttgactggactgacagagtttacctaaaggtgttgcctgaagatgagaggaagttcaatttttggccccaaacccctaatgatttcaggagtactgtcctacagtataccgaaagcctaaggctgctaagtgaagtaatccttaaagccatggcaaagtcactgaacttggaagaggattgcttcctaaacgaatgtggagagagatctaatatgattgtgagggtcaactactaccctccatgtccaatgcctgatcatgttcttggcgtgaagccacatgcagatggatccaccataacttttctgttgcaagacaaagaagtagaaggcctccaagtcctcaaagatgatcagtggtttaaagttccaataatccctgatgctctcctgattaatgtcggtgaccaaatagagataatgagcaatggaatcttccggagcccagtacatagggtagtgataaataaagcgaaggaaaggctcacagtagcaatgttctgcgtcccggattcagaaaaagagattaaaccagtggataagctagtcaacgagtcaaggccagtgttatacagaccggtgaaaaattatgttgaaatctatttccagtattaccagcaaggaaaaagaccaatcgaagcttcaaaaattaccttttga

SEQ ID NO: 1875 - DNA, 2442 bp, Glycine Max
atgatggctgcgagctgggatggaagtagtgaccctggcagtcagtcagatgatagctttcttgagaggttgcacattgagcctctttatgatgcctttgtatgtccgctgacgaagcaagttatgcgtgatcctgttactttagaaaatgggcagacttttgaacgtgaagcaattgaaaaatggttcaaggaatgtagagagagcgggcggagactgctatgccctttgactcttcaagaactaagaagtacagagctgaatccaagtatggctttgcgtaacaccattgaagaatggactgccaggaatgaagctgcacagctggatatggctcgccggtcattgaatatggggagtccagaaaatgagactcttcaggccttaaagtatgtccagcacatctgccgaagaagtcgatcaaacaaatacactgtccgcaatgcagggcttatcccaatgattgttgacatgctgaagagtagcagccgtaaggttcgttgtagagctctggaaacccttagagttgtggtagaggaagatgatgagaataaggaattgttggctgaaggggatactgttcgcactgtagtaaaattcctttcacatgagctttctaaagaaagagaggaggctgtctccttgctttacgagctctcaaaatctgcaaccctttgtgagaagattggttctatcaatggtgccattcttatactagtagggatgacaagcagcaaatcagaagatcttctcactgttgagaaggcagataaaacattggagaatctggagaagtgtgagagtaatgtgcggcagatggccgaaaatggtagattgcagcctcttctgacccagcttcttgaaggtccaccagaaaccaaactctccatggctacataccttggtgagctggttttaaacaatgatgttaaagtccttgttgctggaactgtgggttcatctctgatcaatataatgaaaagtggtaatatgcaatcaagagaagcagcactgagggcactaaatcagatatcatcatgtgacccaagtgcaaaaattttaatagaggctggaatactttctcctcttgtcaatgacctttttgcagtcggtcctaatcagcttccaacacgattaaaagagatctccgctacaattcttgctagtgttgtaaactcaggagaagacttttattccattccatttgggcctgaccaccaaactctggtctcagaggatatagttcgtaatctactccatcttataagtaacactggtccagcaatagagtgcaaacttctccaagttcttgttggacttactatttctccaactacagttctgagtgttgtggctgctatcaaaagctctggtgccaccatcagtctagttcagttcattgaggcaccacagaaagatctgcgtgtagcttccataaaacttcttcagaatttgtctcctcatatgggtcaggaactagctgatgcactacgcggctcagttggacagcttggtagtctaattaaagtcatatcagaaaatacaggaatcactgaagagcaggcagcggccgttggccttttagcggatcttcctgaacgggacttgggcctcacaagacagctactagatgaaggtgcctttgtgatggtcatatccagggtgattgccatcaggcagggagagatccgaggcactcgcttcatgacaccatttcttgaggggcttgtaaagattgttgcaagggttacatatgtcttggcagaagagcctgatgccattgctctctgccgtgatcacaatcttgccgctctctttattgatctgcttcagtccaatggacttgataacgtacagatggtttctgctacagctctggagaatttatcccaagaatcgaaaaacttaaccagactacctgaaatgccatcgctgggtttttgtgcttcagtgttttcatgcttcagcaagcagccagtcataactggattgtgtaggctccaccgagggatatgttctttaaaagaaacattctgtctctatgaagggcaggcagtgcttaagttagtaggtctactggaccacacaaatgtgattgtggtcgaggcagcacttgcagccttagctactttaatagatgatggagtagatattgagcaaggagtggcaattttgtgtgaagcagagggagtgaagcctatactggatgtgctacttgagaaaagaacagaaacattgaggaggagggcagtttgggcagtggagagactattgagaacagatgatatagcctatgaagtttctggggaccaaaatgtgagtactgcacttgtggatgctttccagcatggtgactatcgaactcggcagacagctgagcgtgccctcaagcatgttgataagattccaaacttctcaggaatctttccaaacatgggatga

SEQ ID NO: 1876 - DNA, 633 bp, Glycine Max
atgcaaagggcgacgcaacaaggcatatcaagttcaaggggttcaaagtgccatgactgtgggaaccaagccaagaaggaatgttcatactcaaggtgcagaacttgctgtaaaaacaaaggctttcactgccaaacccatatcaagagcacttggactcctgtggataatattaggagacgccatattcctcaaaatcacaacccatattcaggattagagttgaaatttccgggtgctacaaattcgatggctatatttcggtgcgtgaaggttcgttctatggatgatgcggtttatgaaatagcgtatcaaacatctgtgaacatcggagggcatgtatttaatggactactatatgatcaaggtcctgaccaaagctataataataattgtaagggtgaaagttccacgagccttgttgatcagcagcagaataatctgggttttgtgaatattaataatggttcaatccagagtagagatagtagtggtgcaagtgcaagtgcaactatggcttctgttggtccggaagagactcttttaactccatcaccatatccgttttcccttgcttctttcaggtccgggcaagaggcatttatggatggatatgaggaaagtactaattaa

SEQ ID NO: 1877 - DNA, 1053 bp, Glycine Max
atgcaagctgcatcttcaggcatcggatacggtctaaaatatcaggctagatgcatatccgatgtgaaggcagacacagatcacactagcttcctcgctggcactctcagcctcaaagaagaaaatgaggtacatctgattcggctttcgtcgagtggaaccgaactcttctgcgagggattgttctctcatcccaacgagatctgggaccttgtttcttgcccctttgatcaacggatcttttcaaccgtctactctaacggtgaaacgtatggggcagcaatatggcagatccccgagctatatggcgagttaaattcacctcagctagagagaattacctccctcgacactgattctggcaagattaaatgtattctatggtggccatctggaaggcatgataaattgatcagcatcaatgaggaaaacctgtacttgtggaatttagatgtttcaaagaaaactgctcaggtacaatcacaagattcagctggtatgctgcacaagttatctggaggggcatgggatccacatgatgtgagttctgttgctgcaacttgtgaatcgtatctccaattttgggatgtcagaacaatgaagaagactatgtcaatcgagtgttcccatgtatgcagtgttgattaccatccccaaaagcagcacatacttgttactgcagaacatgagtctgggatacacatttgggatctaagaaaacctaaagttcccatccaagagcttccaggacatactcattggacttggactgtcaagtgtaacccagagtatgatggaatgatcttgagtgctggtacggattcaactgtcaacttgtggcttgcctcaacaaatcatgatgagttaacaactgaaagacaagtcgattcatctgcccgatgggttgatccattgcttaatacgtacagtgattatgaagacagcatttatgggctcacatggagttctcgtgaaccatggatctttgcatcattatcctatgatggcagggttgttgtagaatcagttaagcctttcatctccaaaaaataa

SEQ ID NO: 1878 - DNA, 1029 bp, Glycine Max
atgcaagctgcatcttcaggcatcggatacggtctaaaatatcaggctagatgcatatccgatgtgaaggcagacacagatcacactagcttcctcgctggcactctcagcctcaaagaagaaaatgaggtacatctgattcggctttcgtcgagtggaaccgaactcttctgcgagggattgttctctcatcccaacgagatctgggaccttgtttcttgcccctttgatcaacggatcttttcaaccgtctactctaacggtgaaacgtatggggcagcaatatggcagatccccgagctatatggcgagttaaattcacctcagctagagagaattacctccctcgacactgattctggcaagattaaatgtattctatggtggccatctggaaggcatgataaattgatcagcatcaatgaggaaaacctgtacttgtggaatttagatgtttcaaagaaaactgctcaggtacaatcacaagattcagctggtatgctgcacaagttatctggaggggcatgggatccacatgatgtgagttctgttgctgcaacttgtgaatcgtatctccaattttgggatgtcagaacaatgaagaagactatgtcaatcgagtgttcccatgtatgcagtgttgattaccatccccaaaagcagcacatacttgttactgcagaacatgagtctgggatacacatttgggatctaagaaaacctaaagttcccatccaagagcttccaggacatactcattggacttggactgtcaagtgtaacccagagtatgatggaatgatcttgagtgctggtacggattcaactgtcaacttgtggcttgcctcaacaaatcatgatgagttaacaactgaaagacaagtcgattcatctgcccgatgggttgatccattgcttaatacgtacagtgattatgaagacagcatttatggtaaagagggctcacatggagttctcgtgaaccatggatctttgcatcattatcctatgatggcagggttgttgtag

SEQ ID NO: 1879 - DNA, 861 bp, Glycine Max
atgcaagctgcatcttcaggcatcggatacggtctaaaatatcaggctagatgcatatccgatgtgaaggcagacacagatcacactagcttcctcgctggcactctcagcctcaaagaagaaaatgaggtacatctgattcggctttcgtcgagtggaaccgaactcttctgcgagggattgttctctcatcccaacgagatctgggaccttgtttcttgcccctttgatcaacggatcttttcaaccgtctactctaacggtgaaacgtatggggcagcaatatggcagatccccgagctatatggcgagttaaattcacctcagctagagagaattacctccctcgacactgattctggcaagattaaatgtattctatggtggccatctggaaggcatgataaattgatcagcatcaatgaggaaaacctgtacttgtggaatttagatgtttcaaagaaaactgctcaggtacaatcacaagattcagctggtatgctgcacaagttatctggaggggcatgggatccacatgatgtgagttctgttgctgcaacttgtgaatcgtatctccaattttgggatgtcagaacaatgaagaagactatgtcaatcgagtgttcccatgtatgcagtgttgattaccatccccaaaagcagcacatacttgttactgcagaacatgagtctgggatacacatttgggatctaagaaaacctaaagttcccatccaagagcttccaggacatactcattggacttggactgtcaagtgtaacccagagtatgatggaatgatcttggttctctctctctctctctctctctctctctttcacacacacacagggatgtag

SEQ ID NO: 1880 - DNA, 168 bp, Glycine Max
atgcacaacttcaaaatgttaaaaaaagtaaaaacatcaaacatctgctacaccggtagaactaaagaaacgaggaaatgcccaaattctaagggaaacatagggtttactaagaatggagggatcgaaattatagggtttctaacaccagatgcaagcggaaattga

SEQ ID NO: 1881 - DNA, 1500 bp, Glycine Max
atgcacatgcagcttctccacaacgaccgcgtcatcatcttcgaccgcaccgacttcggactctccaacctaaccctccccgacggaagatgccgcaacaacccaaacgagttggtcgtcaaacgcgactgcaccgcgcactccatcgaatacgacgtcgcagccaacacattccgcgctctctttgtccaaaccaatgtctggtgctcctccggttcggtctctcccgacggaacattagtccaaaccggtggcttcaacgacggctaccgtgcggtcagaaccttcaccccgtgccgctcgtgcgactgggcagaagttcagcatggactcgcggcgcagagatggtacgccaccaatcacatcttgccagatggacgtcaaataattatcggaggaagaagacaattcaactacgagttttaccccaagacacaagccaagaatacttacagtttaccttttcttgctcaaaccaacgacgctaacgctgaaaacaatctctacccgtttgtttttctaaacgtcgatggcaacctttttatctttgccaacaaccgcgctatcttgttcgattacaataagaacagtgtcgtgagaacctaccctcaaatacccggtggagatccacggtgttatcctagcaccggttccgcagttttgcttcctcttcgagaacctaatgtggaggctgaggttctgatttgtggtggagccccgagaggggcttttcggaatactctctcgggtaagtttgttggagcgttgagaacttgcgctcggattaaaataaccgacccgaaagcgaattgggtgatggaaaccatgccgggtgcgagagttatgagtgacatggttttactccccaacggcgacgttttgattgttaatggagcagctgtggggactgcgggctgggaattgggccgtaacccggtgttaaacccgtttctttataaacccaacaagcgggtcgggatgagatttgaggtccagaacccgtctcatattccgaggatgtaccactccggtgccgttttgcttcgcgatgggcgagttcttctcgctgggagcaaccctcacacgtattacaatttcaccaaagtgttgtttccaacggaactgcggttagaagcgttttctccttggtatcttgagcccggattctctaacgtgcgtcccgcaatagtatctcctgcgtcccaaacaaaactcaagtacggtcagacgttgaggcttcggtttaaggtgagcgcgactttggttggggattcggtgtctgttaccatgctggcgccgccatttaacacgcactcgttctccatgaatcagaggctgttggtgctgaagccgcaccatttgagtggggttggagaatcaacgcacgaggttgaagttaccgcgccggcttccgctgttcttgcgccaccgggtttctatctgctgtttgtggtccatcaagaagttccaagccacggtatttgggtccagatggtgtga

SEQ ID NO: 1882 - DNA, 1578 bp, Glycine Max
atgcagcaaggagactacacctccgctccatctccatattatcaattccctcatctccaaaaccccaatcccaatcccgatccacacccaaacaacccctacgcttctgcacctcccttcacccccaattacgctccttccgattacaccccttacccttcttcctaccctcaaaatcccgatcctattccacccactgctccttccttccctccctcttcctccaaccctaatttaccccctcctttcaatcctcccttcgattctaaccctccctaccaacaaccgcaaccacaacaaccctatttcccaccctatgatcaccatcaaacgcctcccaattacgcccctcccaacaccaattccactccctcagtatacaactctgctccctacagctacactggagtctcctccgttcctccgattccgacgtacgaacctgcatacgacgctccgagcgttggtggtgcttcgagatatgacggtgtcgctgatgatggatacggagatggggtgtatgcttatgaagggggcaaggtggaaccctatggggcgcgtggcacggcgccaaaatcgtcgacttgggcggcgtttgatgattacgggaggtccatcagtttcccctcgcagaaggaatcttctgtggggggtaagattgtgaaagcggtgcccaaggctgatacacaagaagacgtcaaaggtggtggcgtgcaaaagtttcgtgtcaagctgttggcagaaagtgggggtcagagcaccatggatgttctctgtcagattggtttggatggaattcgcatgctggatccaaataccagccggacattgagaatttatcctcttgagaacataacaagatgtgatagaatcgattcatctacctttgcattttggtcaaagagccctgttgacattgagccaagacggatcagattgcaatctaatagttacactactaacacacttttggatatagtgactgctgcaaccatacagttcaaggaaatgggtggaagcaggtggcctgctgaagcagtgaaaccaaatgaacagcctacagaaagaaagaaaggttttggtgattggatgaatcttattaaacctgccaatgaagagaaggatcattgggtaccagatgaagccgtctcaaaatgtacagcatgtggtactgattttggggcttttgttcgcaggcatcactgtaggaactgtggtgatattttctgtgacaaatgtacatatggtagaattgctctgactgctgatgagaatgctcagcctgtacgagtttgtgaccggtgcatggcggaagtgtctcagcggctgactagtgcaaaagagtcatcaagtaaacctgcattgcagagtcatgaggatcttgcaaggaaacttcaggaggagctggagagaaatcgaaagacatcaggttccaagtctgatggatctgcaagacggatgaaggaagttgcatgtcccatttgcactgtccatctgcaggttcaggtgcctagctcgggttcagagacaattgagtgtggagtttgccagcacccatttcttgtgagcgctcattga

SEQ ID NO: 1883 - DNA, 162 bp, Glycine Max
atgcatgaagattttgataagccacaatggtcaccttcaaacggaatcatcatttcggtcgggtttaatcaatatcttcaatttctcatcattgcgcaagtttataaacaacgattacttagtgaggtgcatgctggcataatcccgagcacaaataactaa

SEQ ID NO: 1884 - DNA, 462 bp, Glycine Max
atgccaaatgagccaccttctgctctgatatcatcatcgcccaaaacatcggaccctgcatatatagtgaataagggattgagagaatgcagagaacctgctttgcctttgttaacaattcagtgcccaacggcttgcgaaccaccatggcagagaagagttgtccgtcgtcacacaacggttgccctcgcaccagaccaaggagacgccgacctgcagcttggccataccaacgcctgcgtcgcccggatcttccagctgacccaagagatcgaccacaagttcgacggcaagaccatccggtggctcttggagcacgccgagtcggctatcatcaaggccactggcacgttcaaaatatcaaccagctcatccaacgagaaagaagccgcctctaacaagaagtggaaacgcccctcaaacaagaagtggaaacgcccctcaagagttcgagagatcgcg

SEQ ID NO: 1885 - DNA, 423 bp, Glycine Max
atgccaagtaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattag

SEQ ID NO: 1886 - DNA, 1644 bp, Glycine Max
atgccgctcaagttggcgggaggagccactgtcggttcccttctcctatgtgttgctatttctctctttcacatcgctggggccgaagatccctacaggttcttcaactggaatgttacttatggtgacatttaccctcttggtgttcgccaaacgggaatattgatcaacgggcaattcccaggtccagatattcattctgttaccaacgacaacctcatcatcaatgtcttcaacagcttggatgagccctttcttctctcttggaatgggatccagcagagaaggaactcattcgaagatggtgtttttggaacaacgtgccccatcccaccagggaagaattttacttacatccttcaagtcaaagatcaaattgggagtttttactatttcccatcccttgcattccacaaagccgctggcggttttggaggcattaggattctcagcagaccaagaattcccgtcccattccctgatccagctggtgattacactgtcctcattggagattggtacaagtccaaccacacgactttgaaagcccgtcttgataggggcaagaagctgccttttcccgatggaatacttatcaatggtcgcggacctaatggagtgtctttaaacgttgaacaaggaaagacttataggcttagaatatcaaatgtggggctgcaacactcccttaactttagaatccaaaaccacaaaatgaagctggtagaagtggaaggaacgcacacccttcagacaacgtactcctctcttgatgttcatgtaggccaatcttattcagtgctggtaactgcggatcaacctgctcaggattattatattgtgttttcctcacgattctcctacaaggtcctcaccaccactggagtgcttcgctatagcaactccgcaggcccggtatcaggcccaccccctggtggacctacaatccaaattgactggtctttgaaccaggcccgctccattaggacaaaccttacagcaagtggaccgaggccaaacccgcaaggatcgtaccattacggtatgataaacacgacaaagacgatcatattggcgagttcggctggtcaagtaaatgggaagcaaagatacgcaattaacagcgtgtcttatgttgccccagacacccctcttaagctcgccgattacttcaaaatctccggtgttttccgccccggaagcatatctgacagacccactggtggcggcatttaccttgacacttctgtgttacaagctgactacagaacttttgttgagattgtcttccaaaacaacgagaaaatcgttcagagctaccatcttgatggctactctttctttgtcgttggtatggacgggggacagtggacacctgctagcaggaaccagtacaatctccgagatgcagttgcacgttgcaccacacaggtataccccttttcatggactgctatttatattgcccttgacaatgtgggaatgtggaacttgaggtctgagttttgggcacgacaataccttgggcaacagttatatttacgcgtttatacagcatcaacctcaatcagagacgagttccctgttccaaagaatgcaattctttgtggtagggctagtgggagacacacgcgacccctttga

SEQ ID NO: 1887 - DNA, 2604 bp, Glycine Max
atgcctcacaatccgcacaccgtggtctacctccacggcaccctcgatttggtaatcgaggaggctcgcttccttccgaacatggacatgctctccgagcgcgtgcggaggttcttctccgctctcaacacctgcagcgcctccatctccgggaaacggaagcagcaacaagcgcgccaccgccaccgcaaaatcatcaccagcgatccttacgtcaccgtgtgcctcgccggggccaccgtggcgcgcacccgcgtgatctcgaactcgcaggacccgacgtggaacgagcacttcaagatcccgctcgcgcacccggcctcgcaggtcgagttctacgtcaaggacaacgacatgttcggcgccgacctgattggagtcgccaccgtctccgccgagaggatcctctccggcgaagccatcagcgactggttcccgatcataggcacgttcgggaagccgccgaagcctgactgcgcggtgcggctggcgatgaaattcacgaggtgcgaggacagtcctatgtaccgggccggcaccgaatcggatccggaccggttcgttgttcgggaatcgtattttccggttcggcgcggaggttcggtgacgctgtatcaggacgcgcacgtgcctgattcgatgttgccggaggttgagttagaggacggggttgtgtttgagcacgggaagtgctgggaagatatatgccacgcgatattggaagcgcatcatttggtttacattgtgggttggtccatctaccacaaggtgaagttggtgagagagcctacaaaacccttacctagcggtggtaacttgagtctcggggagttgctcaagtacaagtcgcaagaaggtttgcgagttttactattggtttgggatgataagacttcgcacagcaagtttttcattaacacgagtggagtaatgcaaacacatgatgaagaaactcgaaagtttttcaagcattcttcagttagatgtttgctgtcaccaagatatgccagcagtaagcttagcattttcaggcagcaggcatgctttatgctatgtggacacccttgtttctattgcccaaatctgcatacctggcacgttgttggcactctctttacacatcatcagaaatgtgtgattgtggatactcaagcacacggcaataatcggaagataactgcatttataggtggtctagatctttgtgatggccggtatgatacacccgagcatagaattttacgtgatatcgacactgtttatcaggacgattatcataatcccacattttgtgcgggaaccaagggtccaaggcaaccatggcatgatttacattgcaaaattgaaggcccagctgcatatgatatactcactaattttgagcagcgctggagaaaagccaccagatggtctgagctgggtcgaaaactcaagagagtatctcactggaacgatgattctttgatcaagttagaacgcatctcttggattcttagtccttcggaatcaactccaattgatgatcctgaactatgggtttcaaaggaagacgatcctgaaaattggcatgttcaggtttttcgatccatagattctggttctttgaagggatttcctaaggatgtagtagttgccgagactcagaaccttgtttgtgcaaaaaatttggtcatagacaagagtattcaaacagcatatatacatgcgatcagatctgctcaacattttatttatatcgagaatcaatattttattggatcatcctttgcttggccagcttacaaagaagcaggtgctgataacctaattcctgtggagttggcactgaagatagtcagtaagataagatccaaggagagatttgcagtttatattgtcatcccaatgtggcctgaaggttccccttcttctacttcagtgcaagagatactcttttggcagggacaaacaatgaaaatgatgtatgaaatcattgctcgggagttaaaatctatgcagcttgatagtcatccacaagattacctcaatttttactgtcttgggaaccgagagcagttgacaactgaagtttcgagttcaagtagttcaccttcagataatggcgaaacggtttcagcctcacaaaagttccgacggtttatgatttatgtacatgccaaaggaatgattgtggatgatgaatatgtaattcttgggtctgccaatataaatcaacgatctttggctggatccagagatactgagatagcaatgggtgcatatcaaccccatcatacatggagtcaaaaaaagggacatccacatggtcaggtatatgggtatagaatgtctttgtgggcagaacacacggggaccatagaagcttgcttcaaggagcctgaatgtttggagtgtgtgaaaagtgtgaacaagattgctgaagacaactggaagaagtacacagctgatgattatagtccattgcaagggcacctaatgaagtatcctgtgtctgtaaatgccaatgggaaggtaaagtccttacctggatttgagtctttcccagatgtcggtggcaaggtgcttggctcccggtctacccttcctgatgctctaactacgtaa

SEQ ID NO: 1888 - DNA, 2094 bp, Glycine Max
atgcctgtcctggcttgttgcgtggatgctgcagcacctcccggctatgcatttgccggtgacatctcttttccggcgccgatcgcctttactggcgtacctccggccacggcagacgacaccaacaacagcaacaaccattggtcgccgtctctctccgccgccctttacaacgtcgacggctggggcggcccctacttcgccgtcaacaccgccgggaacatctccgttcgcccacatggttccgacacgctgtcgcaccaggagatcgatttgctgaagattgtgaagaaggcctccgatcccaaatctctcggtggtctcggccttcagctacccctcattgtccgcttcccggacgttctcaagaaccggttggactccctccaatcggctttcgattacgcaatccaatctggagggtacgagtctcattaccaaggagtttaccccgtgaaatgcaaccaggaccggttcgtggtggaggatattgttaaattcggttcgtccttccggttcggtctggaggccggctccaagccggagctccttctggccatgagctgtctttgcaaaggcaaccccgacgcgcttttgatttgcaacggcttcaaggatgcggagtacatttctcttgccctggttgccaacaagcttgcgctcaacaccgtgattgttctggagcaggaagaggaggttgatttgatcgttgaattgagcaagaagctctgcattaagcccgtgattgggcttcgtgcgaagcttagaaccaagcattctgggcatttcggtgggacttcaggagagaaggggaagtttgggctcaccaccgcacagattctgagggttgtgaagaagctggcccacgcaggcatgctggattgcttgcaactgctgcattttcatattggttctcagattccctcaaccgcgttgcttgctgatggcgtgggagaggctgcgcagatctactgcgagctggttcggctcggggcgaacatgcgagtcatcgatattggaggtggactgggcatagattacgacggttccaaatcttgtgactcagatatttctgttgagtacggtctcgaggagtatgctgcagcggttgttcacgcggttcagtgtgtgtgcgaccgaaggtccgtgaaacaccctgtcatctgcagcgagagtgggagagccatcgtgtctcatcattcggtcttgattttcgaggcggttggcaccagcagcacaaacggcggaggagctcccccggcattgtcagcgcattacctggcggaggagctgtcggaggactacggatatctctcggagctggcgttccgaggggactatgaaacgtgcctggtgtacacggaggagatgaaagagcggtgcgtggagcagttcaagcaggggacggtgtgtatggaacagctggcagcggtggaagggttgtgtgaattggtgaggaaggcggttggggcggcggaatcggttcggagatatcacgtgaacttgtctattttcacgtccgttccagacgcgtggggcattgaccaggtgtttcccattatccccattcaccggttggaagaaaagccttcggtgaggggtattctctcggacttgacttgtgacagcgacggtaagattgacaagttcatcaacggagagtccagcttggcgcttcatgaaatggaaggaggaagttactatctgggaatgtttttgggtggggcttacgaggaggcgctcggtggagtccacaatttgttcggcggccccagcgtgatcagggtgtcgcagagcgatggccctcacagcttcgcggtgacgcgtgccgtgccggggccatcctgtggagatgttcttcgagtgatgcagcaccagcccgagctcatgttcgagacactcaagcaccgcgcgcaggagtatgtcagccacgacaacgcagcagcggttctggccgctggccttgctcgcacctttgacagaatgccttatctgctgcctctgtcttcctttgtggctgatgatgttgctgctgctgctgctgttcctgctggtgaagatgatgaagagcagtggtcttatatatgtgcttga

SEQ ID NO: 1889 - DNA, 678 bp, Glycine Max
atgccttcggaagattcgaagccggtggtgaagaaagaggtggatttcagcaacaagagcttcgtttccaaaaaggtcttaacttcgaactctaaggtcacaaaagttaagaaagaagacaatgacgacgacgacttccccatcgggagaaggacctccaactccaaggaagtgaagaaaaagaagaaggtaataataaaggaggaagagaataagaataataagaagaagaaagaaaaaaaggtttatgatttacctggccagaaacgagatccacctgaggagaaagaccctcttaggattttctacgagactttattcaagcaagtccccagcagcgaaatgtcacaaatctggttgatggaatcggggttgcttcctaaagatgtggcaaagaaagtatatgagaagaagaagaaagttccacagaagctcacttctccagttaagtcagtagctgctgtgaagagcaacactaagtctgtcactgttaagaagaaaagcccagcatcccctgtgtcttctgttaaaaagaagacaacaacaacgaactccacatcaaagcagtccaagaagaggaaggttaaggatctaagctctgaggatgacgatgacaccaactcctccgatgatgaatttatattatcatcagtagcaaagaggagaaaaatggcttaa

SEQ ID NO: 1890 - DNA, 222 bp, Glycine Max
atgccttgcccatttgccctggatcttgatgaagcgaagctgaataggttctgctcggagattgaagtgattttggatccaagtgtttctaaggatgcagatgcagatgcaggggaatggggaaggattacttgggctacagaagagtcatgtctaccactttgccaattaggatattgggccctcacaatgctgcaattcatagaagaagacccaccttga

SEQ ID NO: 1891 - DNA, 1293 bp, Glycine Max
atgcgccgattgcaaacattgaaacaagtttcatgggcctccgatttagatctttgtcaggttaggctattcttatcagaggaatctccttcacaggttgggttaaattctcaagataacctccaagcaaaaacatcattgtcgttgcgtccaggtggagcaggttctgatgacattctgcctcctggatttgagggaactcatgcttcaagtcagtttgagattaagccatcccagataccagttattaagtggattactcctcaaaagattgttctaaatgtcacatggcgggtagtgtctggggaagaaagcaaagaagcagaggatcaatgtcagagggagatgagagtactggaagctatttatcctcgcatatcttccattcctctaaacccttctgtttcaatggatgttgaagagttccattgcattgatggtcaaactactttgataccaataacgccagttgaagatgaagatgcagcagcagaaacattatcgtattccttggaaccatttcatgtttcccaatctcttcaattagcttctggtgttctgaaggattcaaactctgctacaagtatgcagttagcttgtggtcttgcatctgatgtagctgttgctgcatctgttgctttaactaaccttgtgaagagcaatgaacatggaaattttgttgaccatgaattacttaataatattctcaacaatccagaagtgattgagaagttggttggagattatggagctattaataattcacaatatgtacataatgcggggtcatccttggcggctttttcaaatcctcctattcctattcaaggacaaaccactacaccttcatcggttgttttttcaactacttcttcctatactccccctattggaggtcaggcggaacctgttactacccaatggcctcctaggcctgcagtgagttcagctattgtttcttctcccattgaggtccctcctgcaagagatgtaaactactataagagcttaattcaacaacatggaggacataaagaaacacttccatactccagtaaacgtcagattcctcaggcagcaacaaactatgagacaacctcctacaatcatagaggtaaagtgtcaaaaccaaagataatgaagccttgtatctttttcaacagttctagaggatgtcggaatggagctaactgtgcctaccagcatgatgcatcatttcagccacggggtaatactgtgtcagggatacaaagttcaaagaggatgaaaatggatcatgagattagcaattaa

SEQ ID NO: 1892 - DNA, 660 bp, Glycine Max
atgcggaaacttgccatatcttttgaaccgaatctatgggtcaacgtgcactctggaatggaggctctttttatgccttatgatcataaaaatacaacaccagatggattgccattgcaacggatgaaatcattgcttgaagaagtaaaacatcttcattgccaagagcgctgcatgattgggtctggaggcggttctgtagggtattttgcacacgggacagcaactgatttcatgtatgacattgtgggggtacccatggctttcacctttgagatatatggtgatggaactgcctcatcgagagattgtttcaaaatgttcaatcccaccgaccttgctacctacaatagagttctgagtgactggtcggcaacattctttacgattttcaaattggtgccgcagaaacttggtgattcaaacgcgtctattttgaagccggataagttggtatcgatagatgagtatctagatgggtatttgatggaaagaagaaatagatatggaaagaagttggaggtgcttgagcttggaatgcaagaaataagaacatattttaggctctttttattatcttcagtgttattactgttcatgttctgttctagaatttcaaaaagcaagtgtagaccaattgtttctgctatacccctctaa

SEQ ID NO: 1893 - DNA, 1353 bp, Glycine Max
atgctatcgtttcactcatgtggatgttgccgcgtttccgcttcccgagcattccaatttcaatttcaaaccgcaccttctccttcactctttctctcagctacgagctataaatttcgttctgccaccgcgagcgccgcttctggttccgccggcgactcagactccgatggagagccaaaattgaacttctcgggtgtgcggttggaggaggcagtcgatagcagaatcggatctggaaaactcagactcgacaactggatctcttcccgcatcaatggcattagcagggcacgagttcaatcaagtatcaaatcaggactcgttcatgtcaatggccgtgtcgttgataaggtttctttcaatgtcaaatctggggatgagatcaagtgcacaatcgcagaattgcagaatttgagggccgtgccacaaaatatacctttggatatcgtttatgaagatgagcatgttctagtcataaataaacctgcacacatggttgtgcatccggcacctggcaatacatctggaacgcttgtcaatggcattcttcaccattgcaaccttccaaatgttgaattttctaaagacgaagctctttcagatacagaagattctgatgatgagttcaatagttatatctccctggcaagttcttgtgaggggttaaattctagactgtctgtggcatcaaattcaattcgcccagggattgtacacagattggacaaaggcacgagtgggttacttgttgttgcaaaggatgaacattcacacatgaaattgtcagagcaattcaagcaacgaaccattaagaggctttatgtcagtcttactgctggggtacccactccagttgctgggcgtgttgaggttccagttggccgtgatactaataaccggattcgtatgactgctgtaactggaccagttaattctaaaaaggcccgttatgctgctagtaggtacaaagtaattgagatacttgctggggggagttgttcattggttgagtggaagttggaaactggacgcactcatcagattcgcgcacatgctaagtatttgggagttcccctactgggtgatgagttgtatggagggacaaaaagcatggtcttgtcactgctaaggccccgaactcccatcagtttgcatagcaaaatcgtaaaaatggtttctaggctagataggccttgccttcatgcttggactctcgggtttcagcatccccatacaggggagcaggtgcatttttcatgcgaaccccctgcagacttcgctgagattttgagccagcttcgtagaattggtagtgagacggtttctttcacaaagcgttcaaattcatga

SEQ ID NO: 1894 - DNA, 396 bp, Glycine Max
atgctcgattcggtccttctggcgcttttcttgccgtgccttggcatgagcggggtttttatcgtctacatgtgccttctttggtacgccaccacccggcaccaccagcaaccccccatcgacgggcaaccggtgaagcccgtcgctgacaagggtctatccgctctggagttggagaagcttccaagagtcaccggcaaagaactcgtcttgggcaacgaatgcgccgtctgcctcgacgagatcgagagcgagcaaccggctagactggtccccggttgcaaccatggttttcatgtccattgcgctgacacctggctctccaagcaccctctttgccccgtttgcaggaccaagctggaccctcaaatcttcacttcccaaagcccttgctga

SEQ ID NO: 1895 - DNA, 645 bp, Glycine Max
atgctgaaatcgggcattggaattgaggagaggaagcaattgaagaagccagcacaagccagctcgagaaagggttgcatgagaggaaaaggaggtcctgagaatgctagttgcacctacaaaggtgtgagacagagaacatgggggaaatgggttgctgaaatccgtgaacccaatcgaggtgctcggctctggctcgggacttttgagacctctcatgaagctgctttggcttatgatgctgctgcacgtaagctttatggctctgatgccaaactcaatttaccagaactctctatcaaatctcaatctcagtgtccaccaccatcaccaccaccaccttcttctgttaccaacaacactcaaatggaaaacctgcagcagattcaaaacaattacatagacatggctaccaggttggagttggaccaatttacaccacctgtggagaatgaggtcgagtttcgtccatcgtgggcgacaatgaacgagggtttgccggttttcgatgattccatttgggctgaagctgctatgtctctagattttcctcacattgcagcagagactgcgatttacgcgtcggggaacaacttggctgatgttggtgtttgggactctctgcaaaccccatggtgcatgtaa

SEQ ID NO: 1896 - DNA, 1380 bp, Glycine Max
atgcttcctcgattcgtcgcgcgggaaggagatccggtaatactttattcatggtttctaaggtggctggtggcttatggtgagtatctgtatatatacgttcatcaaccgcgtccaaatcaaaaatcccctccacccattttctgtgcctcaggcatcaagggcaagcgagtgactgcgttgtcagcagaaaaaaatggcctcactgatttcattcaaagaatcattgctgacaaaccagacatcgacacaccattcagcgtcctcgatttgggggtcgtcatgggcctgatggaccaatgggcctgcaagctccccacggtccagcccttctacgccgtcaagtgcaacccaaacctctccctcatcggtgcgctcgctgcgctcggctccagcttcgactgcgccagcaaagccgagatcgaatccgttctctccctcggagtctcacccgacagaatcatctatgcaaacccatgcaaatccgagtcacacatcagatacgccgcctccgtaggcgtcaacgtcacaacctacgactccatagacgaggtcgagaaaatccgaaaatgccaccccacgtgcgagttgctcctccgcattaaacccccgcaagacagcggagcgcgaaccagcttgggcctcaaatacggcgcgcttcccgaggaagtcgatgagcttctccaagctgctcacgaggcggggctcaaggtgaccggcgtgtccttccacattggtagcggcggagccgacacgcgagcctaccacggagccatatccgccgctaaaaacgtcttcgaatcggcttctcggctcggcttgcccagaatgggcgtcctcgacatcggcggcggcttcacctctgggccgtcgttcgaagccgcggctttgaaaataaacgccgcgattgaaggcagcttcgggaaggaggaggggctggtggtgattggcgagccgggtcgttatttcgcggaaacggctttcacgttggcgacgagagttattggaaagcgcgtcaggggggacgtgagggagtattggattgacgatgggatttacggaactcttaataacatcgtgtttgattacgctaccgtcacgtgcatgccactcgcgtgcacctcgaaaccggagaatcctacatgctgcagggatttgaatttgaagacttaccctagcaccgtgtttggacccacatgcgattctattgatacggttctgagggattaccagctcccggaactgcaagtgaacgattggcttgtgttcccgaacatgggtgcctatacgacgtcgtccgggactaacttcaatgggtttagctcctcagccaagtccatattccttgcatgttcgagcccggaacacaccatgttctaa

SEQ ID NO: 1897 - DNA, 1305 bp, Glycine Max
atgctttcccacttggtaaaggagcatccttattacataatttgttgctatgttggtctcttgttgttgttcttattagtatgttgggcactttggtgcaaaaacaagtcctctatcggcattcctccgggaaatcgaggattgcccttcgtaggagagacacttcagttcatggctgccatcaacagcagcaaaggagtctatgagtttgtccatgctcgccgcctccggtatggaaaatgcttcaaggcgaagttgtttggggagacgcacgtttttatatcgagcagggagtcagcaaaagtgattgtaaacaaggagaacgagggagggaaattctcaaagagctacataaaatcaatcgcagagctgcttgggcgcgacagcttgctctgtgcagcacaacagcatcacaaactcatacgcgcccgtctcttcagtttgttctcaacagattctttgtcttccttcgttcaactctttgattcactcgttcttcaagctacacgtacctggacctgtggatctgttgtcgtcatacaagatgaaacactcaagctggcctgtaaggcgatgtgcaagatgctaataagcatcgagagtggccaagaattagtgacgatgcataatgaggttgctcgtttgtgtgaagcaatgctagcattacccgtgaggttaccctggaccagattctacaaaggccttcaggctcgaaaaagaataatgaacatattggagaagaatataagtgaaagaagaagtggaattgcaactcaccatgtagattttcttcaacaactttgggataataagttaaaccgaggatggagtaacgacacgattgcaaatgcaatgacatggatgatcaaatttgtggatgagaatcgacaagtttttaatactcttatgaaggagcaacttaagattgagaagaatggctcaagaaattcgtatcttacactagaggcccttaatgagatgccatatgcttctaaggttgtaaaagaagcgttgaggaaggcatctgtggtacagtggttgcccagagtagcactcgaggactgtgtgattgaaggatttaaaatcaagaaagggtggaacattaacatcgatgctagatcgatacaccatgatccaactgtgcacaaggatccggatgtgttcaatccttcaagatttccagcagagtcaaaaccatacagcttcttagcttttgggatgggaggaaggacgtgcctagggaagaacatggctaaagccatgatgttggtgtttctccaccgcttcatcaccaattacaagtga

SEQ ID NO: 1898 - DNA, 666 bp, Glycine Max
atggaaactcaacaccaacaacccaccatcaagtctaggttcagacgcatctgtgtctactgtggtagcagccctggcaaaaaccctagctatcagctcgctgctattcagctcggaaaacaactggtggagaggaacattgacttggtttatggagggggaagcatagggttgatgggtctaatctcacaagttgtgtatgatggtggacgccacgtgttaggggtgattccaaagactcttaatgcaaaagagataactggagagagtgttggagaagtgagagctgtatcgggcatgcaccaacgcaaagccgaaatggcccgacaagccgatgcatttattgcactgccaggtggatatggcacccttgaagaactactggaaattatcacctgggctcaactaggtatccatgataaaccggtggggttgttgaacgtggatgggtactacaactcgctgctggcattcatggacaaagctgtggacgaaggtttcgtaacaccagctgcccgtcacattattgtttctgcccacactgcccaagatctcatgtgcaaacttgaggaatatgtccccgagcactgtggtgttgcccccaaactaagttgggagatggagcaacagttagttaacactgcaaagtcagatatttcccgttga

SEQ ID NO: 1899 - DNA, 1020 bp, Glycine Max
atggaaagttgttcctctggtggaaagatttccgaaattattactcataaaaagtcatggaagaggtgtgcagctcatgttcacatcagtcatctcatccgtagtttagaagtgtcaaaacgacaggtgggcaaagaacatgagctttgtcctcaaacaagagtacaccaagggtcaaaatgtggggttctaacacaagcacacaacttgaattggatgagaagtggaaatagtcatgctactcgaacagtttattctgctactacgagtaattcacgtgaaaccaagaatggtattcttcagcatggcctttatcatgaaaaatctcaggctcccccaacacctggagtgtatgatcctcaaaagcaatgttccaacttcttgtccttgtcaactagaggtagtgagttaaaggtcaacgaaagttttaataaaggtgaaagtaagttggaaccatattcaaaacagcaactgccttattttcagtcactacatcagcagcagcagcagcatggcctcatgcccattcaaagttctacgtatgcctcaactttccttgatcagcttcctgttgcaggaccacaggttcgattgcagcagcctcattattatggtaccccgttacgtggaactcattatagttcgacagtttcctataaacaacagcagcaaagtttttgggcggtgcagctagcagctcaaggtgggtcttcttctatgaattgcagcattgtgagggcccaatatcctaattggcaaagtggtagacatgactcttctgtagcccaagtaatccttccccattcccctgcatctgcatctgcatccttagaaacacttggatccaaaatcacttcaatctccgagcagaacctattcagcttcgcttcatcaagatccagggcaaatgggcaaggcatttatcttgcttcgtctgtgtgtgatgaaagtaaaggtaggttccgtagtagtaatagtggtaccccatcactgcaattgttatgtgatgagcgtatttga

SEQ ID NO: 1900 - DNA, 864 bp, Glycine Max
atggaagaagtggtggaagtaaaggtgagtggtagaccgagagagactcagagctctccggggatttcaactcccaaaagcccatttgcaactcgttttatgagcacccctttagccagccccatgaagaaggccattgaaaacatgcaaggttacttgggagaagttggtcgcttcaccaagcttgacccacaagatgattggcttcccatcaccgagtcaaggaagggaaacgcatactacgctgcgtttcacgttctttcttcagggattggatttcaggctcttgttcttccattagccttcaccagtcttggctggacttggggaatcatatgtctctgtgtggcttttacatggcagctctacacgttgtggttactgattcagcttcacgaatcggactcaggggtgcgccatagcaggtacctcagacttgctatggcagcattcggagaaaagatgggaaaactactagcactcttcccaatcatgtatttatcgggtgggacgtgtgtgacactgatcatgatcggagctgacacaatgaagatattctttcagatggtgtttggaactgcaagcccactcacaaccattgaatggtatttggtgtttacatgcacagccattttgcttgcccagttaccaaacctgaattcaatcgcaggggtttccctcataggagccatcactgcagtgagttattgtgctcttatatgtatagtatctgtagtccaaggtagacttgatcatgtatcctatgaaccaccaaggggacaatcagaggctagcatgatttttagcgcgtggaatgcactaggcatcattgcttttgctttccgcggtcacaatcttgtgtag

SEQ ID NO: 1901 - DNA, 627 bp, Glycine Max
atggaagcagagacctcaaacggtggtggtattggaggcctttacgtcaaagttatgaccgacgaccaaatggaactgctcaggcaacagatttctgtctacgccaccatctgtgaacagctcgttgagatgcacaaggccgtcactacccaacaggacctcgcagggctgaggctgggtaatttgtactgtgatccgttgatggcatgctctggacacaagataactgcgaggcagcgctggactccaacgcctctgcagcttcaaatacttgagcgtatttttgatgagggaaatggcactccgagcaagcagaagatcaaagacataaccattgagctgggccagcatggccaaatatcagagacaaatgtttataactggttccagaatagaagagctcgttcaaagcggaagcaactcactcctgcacccaatgttgtggagccagaagttgagtctccaaaagagaaaaagactcgtgcagaaggctttcaggttcaaccctatgagaattcatcacctcataggatcaaggatatgtacatccagagtcctgacataggatttgaccaattactgggtaaaatagaagttgcaagctgctacagttcttattttctttga

SEQ ID NO: 1902 - DNA, 6072 bp, Glycine Max
atggaagcgttgatcgagttatgcgacctcattgcgcagaatccgtcgctattctccgacaagctctcgtggatatgcgacaaatgccccccgccggagtacctctcggcgggatctcctagggtttcgcgctctcagctcaatgccgtcctcgccgtcgcgcgcttcctctccaactgccccgattccgccgatctgcgcccaaagtccgtcgtcctcgagttcctccgctccgttccccattccttcacgcaatccttctggccccaccctttcagcctcgattccgtcgcctctttcttcctcgatttcatcggctacgtctccaaggccgcacaatcctcaccggatttcgccgaggagctcgccgccttcgccggcgaagtagtgatttccgcgatcggcgaacagcgctctggcattgctagggctttcttggccgctctctcgcagaactttcttccaatttcgtccttcgatgccaacagattggtgacttgtttaatcgatcaattcgctgcgcctacggtggggcctgttccaggcatgccgagggaacaacttgctgcggaaaattcctcggctcagagctcgcccatcagtgtgaaccaccaatccctaaccaattacaatgacagtcccgggaatgagaatgcttcgggttcctcgagcagtgtggcttctaaggccgcggatgatgtcagcacggcgtcgtcgagagggatggtgaatgggggaaaccatgtttggaggaccggtgctgatcaattggcgcagaatttgggtttaaatgatggtggtcttggcgcgttctcgtctggccaacaagttgttttgttcgaggaagagtctgtggagttcttggagaggcaggaaatagcttttaagttgattgctcacgtgttggagaaggcccacgttgaacctgcgcttttggagcaggttaggttaatcgggaagaagcagatacagtccatgtctgtgtttctgaagataaggaagagggattggcatgagcaggggtctcttttaaaagctaggattaataccaaactgtcagtttataaagcagcggtgaacctgaaaatcaagagcctctcagcactggattccgattcgaggtctgttaagaggttggtttatgaggcagttgcgatattgatagatgctgccgaggcgtgcttactctctggatggcgtaagttgagattgtgtgaagagctcttcagttcattgcttcttggggtagcacatattgctattgcccgaggaggacagccgctgcgtattttgctcattcgcctaaagccaattgttctcaacgtttgtgctcagcctgatacatggagtaatacccacggaggcatgtttgagagtgtcatgaaggtcagctgtcagataattgaatcctgctggaataaggagcgagcccctgttgacacatacataatgggattagccacaagcatacgtgaacgaaatgattatgaagaacagcttaatgttatacacctgtttgctgagctgagcgctgcagtcaacaagtctgagctggtagacgtgttattacctctttttattgaaagcctagaagagggtgatgcttcaactcctagtttgttgagactccgacttcttgatgccgtgtctcgaatggccagtttaggttttgagaaatcttaccgtgaaacagtggttttgatgactagaagttacctgaacaaactttccagtgtaggatcagctgaaagcaaaacagaggcaactgaagccacaactgagcgagttgaaactctacccgcaggatttcttcttattgctagtggtcttactagtgatagactgcgttcagattttcgtcatcgattgctctccctatgctcagacgttggtttagctgctgaggctaaaagtggaaggagtggagcagatttcctgggtcctttgctccctgcagttgctgcaatttgttccgattttgatcctactttaaatgtggagccatcacttttaaaactatttcgcaacctatggttctatgttgctctttttggcctagcgccaccggtacagaagactccagtaactacaaagtcagtttcaagtacactgaacagtgtgggaagcatgggtgcaatttcccttcaagctgtaaatggaccatatatgtggaatgtggactggtcttctgctgttcaacgaatttctcaggggactcctccactagttgttagctcagtgaaatggctcgaggatgagttagaactaaatgctttgcacaacccaggcagtcgtcaaggcagtggcaatgaaaaggctgcacttgcacaaagagctgctctttctgcagctttaggagggagagttgatgtcacagcaatgaccacaatctcaggagtgaaggctacttatcttcttgctgtagcttttcttgagatcatccgcttcagcagcaatggtggaatcttaactggtggcaccactatggatgctgcaagaagtgcctttacttgtgtctttgaatatctcaagactccaaatttaatgccagctgtcttccagtgtttagcagcaatcgtccacagggcttttgaaacagcagtgtcatggctggaagatcgagtttctgaaataggccatgaagctgagacccgagattcaatacttacaatgcatacctgttatctaataaaaagtctgtcccagagggaggatcatatacgagatattgcagagaacttgttgactcaactcagagataagtttccacaggttttatgggattctccttgcatagactctttgctattttcatttaatgacgactcttccactaccatcatcaacgatcctgcttggacagcaacagtccgtaccttgtatcagagaattgttcgagaatggataataaaatcagtttctagtgctccgtgcactagccagggccttcttcaggataaactctgtaaagcaaatacttggcaaagagcacagcccacaattgatgttgttttacttttatctgagataagaattggcaccgggaaaaatgacaattggccaatacaaacagcaaatattcctgcagtcacggctgcagcagctgcagcttcaggggcaaacttaaaagcatcagagtcttttaatttggatgttattagttctggtaagtgtaaccaagctgcagcgacagttaagtgcaaccatgctggagaaattgctgggatgagaaggttgtataacagcattggtggatttcagtccagtactgcaccttctggtcttggacttggagctgggcttcaaagaattatatctggagcttttcctcagcagccacaagctgaggatgactcgttcaatggaatgttgcttaataagtttgtgcgattacttcaacagtttgtcaacatagcagagaaaggtggggaagtggtcaggtctgaatttcgtgatacttgctctcaggccactgtgctgcttttatcaaatttgagttctggatccaaatcaaacgtggagggcttctcacaacttcttcgtcttctttgctggtgtcctgcttacatttccactcatgatgcaatggaaactggtgttttcatatggacatggttggtttctgctgcacctgaacttggagctctcgttcttgctgagcttgttgatgcatggttatggacaattgacaccaagcggggtctttttgcatctgaagcaaggtattctggacctgctgcaaaactcaggcctcacctatcccctggggagcctgaattgcagcctgagactgatcccgtggagcagataattgctcatcgactatggcttggatttctaattgatcgctttgaggcaattcgacaccaaagtgtggagcaacttctgctttttggtaggatgttgcaggggacaacaaagcttccctggaatttttcacaccatcctgcggccagtggcacttttttcactcttatgcttctagggctcaagtactgctcttgccagtttcagggcaatctgcaaaaatttcagatggggcttcagctgctggaagatcggatatatagggcatctttgggttggttttcttttgagccagaatggtatgacacaaactatacaaactttgctcagtgtgaggctcaatctgtttctctatttgttcaataccttacaaatatgaaaggagatactgtccaagttggttcaaaaggaaatggacaagaaaatgggaatcctttggctgatgtgagtgatcaccatcatcctgtttggggtcaaatggagaactatgctgcaggaagagaaaaacggaggcagctacttttaatgctttgccagcatgaggctgataggcttgatgtctgggcacagccgactaacacaaaggaaagtagttcccgacccaagattagtgcagataaatggatagaatatactaggactgccttctctgtggatcctaggcttgctttatccttggcctcaaggttcccgaccaatgcatttgtaaaaactgaagtaactcagcttgtacaggcaaatatagtggatgtgcgcaacataccagaagcattaccttactttatcaccccaaaggcagttgatgataattcagtgctcttgcaacaattgcctcattgggctccttgttctattacacaagctctagagtttctttctcctgcatacaagggtcatccacgggtcatggcatacattctaagggttctggaatcctatcctcctgaacgagtaacttttttcatgccacagctggtgcagtcgttgcgacatgatgaagggaaattggttgaagggtatttgcttagagctgctcaaagaagtgacatatttgcccatattcttatctggcatttgcagggtgagactgtacctgagacaggaaaagacccaaacagtgggaagaatggttcatttctagaactgctgccagcggtaaggcagcgtataattgatggttttaatccaaaggcacttgacatatttaaaagagagtttgatttctttgacaaagttacatccatctctggtgtactatttccactccctaaagaagaacgccgagctggtatccggagggagttggagaaaattgaaatggatggtgaggacctttatttaccgacagctcctaacaagcttgttaggggtattcgagtagatagtggtattcccttacaatcagctgcaaaagtcccaatcatgataacttttaatgtaattgatcgagatggggatgagaatgatgtaaagccacaagcttgcattttcaaggttggagatgactgtagacaagatgttcttgcccttcaagtaatagcactacttagagatttatttgaagccgttggcttaaatctttatctatttccttatggtgtactgcctactggtcctgagagaggtataatagaggttgtgccaaatacgcgcagtagaagtcagatgggggaaacaactgatggaggtttgtttgagatatttcagcaagattatgggcctgttgggtctgccagttttgaggctgcacgccagaactttatcattagcagtgctggttatgctgttgctagtcttttgcttcaaccaaaggataggcacaatgggaaccttctctttgataatgttgggaggcttgttcatattgacttcggtttcatcctagaaacttctccgggtgggaatatgcgttttgaaagtgctcattttaagctgagccatgagatgacacaattactagatccatctggtgttatgaagagtgatacatggaaccaatttttaagtttgtgcgtgaaggggtaccttgctgcccgtcgacgaatggatgggatcatcactactgtgtcattaatgctagacagtgggttaccttgcttcagcaggggtgacccgattggcaatcttcggaagagatttcatccggagatgagtgagcgtgaagcagccaatttcatgacccatgtttgtaaagatgcttataataagtggaccactgctggctatgacttgatacagtatctgcagcaaggcatcgagaagtga

SEQ ID NO: 1903 - DNA, 1116 bp, Glycine Max
atggaagctatcagaaagcaagcctccaaacttcgagaacaggtcgctcgtcaacaacaggctgtgcttaaacagtttggggctgggggatatggaggatcagataatatggttactgatgaggtagagcttcagcaacatcagaaacttgagaagctttacatatcaacacgtgctggaaagcattatcaaagggatattgtccgtggtgtggaaggttatattgtaactggatccaagcaagttgaaataggaacaaagttatcagaagataacaggaaatatggtgcagataatacgtgtaccagtggtagtacattatcaagagctgcgctaaattatgcacatgcccgtgcacaaatggagaaggagcgtgggagcttactaaaagctcttggcacacaggttgcagagcccttgagagcaatggtgatgggagctccattggaggatgcccggcatcttgctcaacgttatgacagaatgcggcaggaagccgaagcacaggctattgaagtttccaaacgccaggcaaaagtaagagaaacaccaggcaatgctgagaatgctatgaagctggaagcagctgaaacaaagctgcaagacctgaagacaaacatggccatattgggaaaagaagcagctgccgcaatggctgctgtagaagcacagcaacagaggttaaccctccagcgtcttatagctatggttgaagcagagcatgcctatcatcaaagagtactccaaatacttgatcagcttgagggagagatgatatcagaacgacaacgaattgaagcccctcctacacctagtgtggatagcagcatgacaccacccccatcatatgaagaagtaaatggtgtatgtgcttctcaagcacataatggctcaacagatagtatgggttacttcttaggagaggtgttatttccctaccatgctgagtctgaagttgaattgaatctatccgtcggagattatattgtcgttcgaaaggtgacaaacaatggatgggctgagggtgaatgcaaagggaaagcaggttggtttccatttggttacattgaaagaagggagcgagtcctcgcaagcaaggtggctgaagtgttttga

SEQ ID NO: 1904 - DNA, 645 bp, Glycine Max
atggaagctgttttgacgcctcacgcgacggcacaaaaacaaccgtttgctcctaacaagaacatcagaatgaaaaccccgaagaaaaacggacgaggtaatttcatttgtgctaataaccggtctgagaattttgacacgtatgcaggtctcttgaatcctccttcacgcgccatgtccttctcctactctcacccgctctcagcttcttcactcttcactcatcactgtgctcaacaaccacctctgcttcctctgccccacgttgtttcgccaacttatggtagcggacaaggccttgttgttgttgttaataaaaacaaaaacaggagcagagacatgtctctgacacctaagaaatcgaaaccaacgaagcgagaggaagcgaagaagagatcggtgacacaatctgataaccgctggggacctgatcccaaagaccttcccaaagtggtgctagggatgggaaacaaccaccacgacgtcgtttcgggggcggttttcaatctggctccgccacccagtagtttgccgctgccaaagttctctttgagatccaaactcggttgcaacgccgaaaccgccgctggtggcgttgatgacggagcaaccaacaatctccggcgacttctgcgcctccggtga

SEQ ID NO: 1905 - DNA, 1314 bp, Glycine Max
atggaaggtgttgatcaaagaaatagttctgcatttggtgttccagttccaagaccaccaaaccagaaatctcgtatgccaccatctcaccctagtatcaatgtttcaccttcagcaactccttattcccaataccctcagcgattgcgttctccgggttcctcccattcgaggtctttgtctcaacctcccattttctcgttggattcattgcccccattgagtccttcccctgctgctgttacctccatgtttgactcaatctcaacaactgatatgtctgtggaggaaagtaatgtttcctctcaggtgcccctcaatagagggcatgcccttcttcctcctaggaagggacacaggcgctctagtagtgattcccctttgggaatctctggttttatgcagtcttctccagttccctccggaggagagagctcggggttcgagaagccgattcagttggtcttgaaggcgtcctttagggacagcctggatgggggccatgctaatgagcctgttaatgggaggaaggaggaggctgcggatgatttgttcagggaatacatgaatttggacaactttgataatctgaactttcctggcatggaagataaggacttggatagcaggaccagtggttccaagacagttgagagcagcgataatgaagttgagagtcatgtcaatgggaaggcgagtggggctcagggggcaagttcaagctgctcggaggaaaggagggaaggagtcaagaggagttcaaatggggaggttgcaccgggttcccggcatcggaggagtttttcgttggatagttccatagggaactttaacattgaagatggattgcctaagcttcctccttcgaaaaatcaaatgggtcagcactcacctagcaattcgatggacggcaaaatgtcagaaacctccacggagtttggaaatggcgaatttagtgcagaggaggtaaagaaaataatggaaagtgataaactagctgaaattgcttcgactgatcccaaacgtgcaaaaaggattttggctaatcgtcaatcagctgctcgttcaaaggagaggaagatgcgatacattgctgaattggaacacaaagtgcaaactcttcagacagaaacaaccacattgtctactcagtttaccaaattacagagggataactctgaccttaaaagtgagaacaacgagtgcaaattaaggcttcaagccatggaacaacagtctctattgaaagatgatattagtgtcgaatggcttgtgctactaggattacacacttgcaattcaacagctgtataa

SEQ ID NO: 1906 - DNA, 1542 bp, Glycine Max
atggaaggtgttgatcaaagaaatagttctgcatttggtgttccagttccaagaccaccaaaccagaaatctcgtatgccaccatctcaccctagtatcaatgtttcaccttcagcaactccttattcccaataccctcagcgattgcgttctccgggttcctcccattcgaggtctttgtctcaacctcccattttctcgttggattcattgcccccattgagtccttcccctgctgctgttacctccatgtttgactcaatctcaacaactgatatgtctgtggaggaaagtaatgtttcctctcaggtgcccctcaatagagggcatgcccttcttcctcctaggaagggacacaggcgctctagtagtgattcccctttgggaatctctggttttatgcagtcttctccagttccctccggaggagagagctcggggttcgagaagccgattcagttggtcttgaaggcgtcctttagggacagcctggatgggggccatgctaatgagcctgttaatgggaggaaggaggaggctgcggatgatttgttcagggaatacatgaatttggacaactttgataatctgaactttcctggcatggaagataaggacttggatagcaggaccagtggttccaagacagttgagagcagcgataatgaagttgagagtcatgtcaatgggaaggcgagtggggctcagggggcaagttcaagctgctcggaggaaaggagggaaggagtcaagaggagttcaaatggggaggttgcaccgggttcccggcatcggaggagtttttcgttggatagttccatagggaactttaacattgaagatggattgcctaagcttcctccttcgaaaaatcaaatgggtcagcactcacctagcaattcgatggacggcaaaatgtcagaaacctccacggagtttggaaatggcgaatttagtgcagaggaggtaaagaaaataatggaaagtgataaactagctgaaattgcttcgactgatcccaaacgtgcaaaaaggattttggctaatcgtcaatcagctgctcgttcaaaggagaggaagatgcgatacattgctgaattggaacacaaagtgcaaactcttcagacagaaacaaccacattgtctactcagtttaccaaattacagagggataactctgaccttaaaagtgagaacaacgagtgcaaattaaggcttcaagccatggaacaacagtctctattgaaagatgctctgaacgagactttggatgctgaagtccggcgtttgaggcgtgctgttgcagaacttggcggtgaatccctcacaagttgcatggctcgacagcttgctattaaccaacaaatgttcgagttacagcatcagcagcccagccaacagagacattttctactgcaaaatcaccatactcaggaagagatagagtctcgatcacagcagattcaaggcaatgaattgcatccccaggcacagattcagtcacagcagattcaacgcaatgaattgcatccccagccttaa

SEQ ID NO: 1907 - DNA, 1122 bp, Glycine Max
atggaattggtgagcaaccgttgcgtggatctgcatggtaggattgctgacaagcgaacaacaggaggatggaaagcgtcgcactttatcataggggatgattttgctgacacgtactttcggcttcaatggacacgctacgccctcataaatgcactgttccgccatgcaaaggggcaagccaaggccaaaccgcattcctatacggtgcacttacccacattgctttgggcaccggaggaatcaagccctgtgtgtcctccttcggtgctgaccaatttgacgagggagatgagaaagatagtgcagatgaagttctctttcttaaactggttcttcttcgccatcaacatgggtgccatccttggaatcacaccattggtttacatacaagacgccgctgggtttggttggggttttggaatacacgcagccgccgccatttgttccatcgttatcctacttgctggtctccgatattaccgtttcaaaatgccaatgggaagccctttcactaggtttcttcaggttatggtagcctccacgatgaatcatctaaatagggttcatttagaaaatgaccaaactcgtctctacgaggtcgaaaccactcgcaagcttcctcacaccccacaatacaggttttttgacacagcagcagttatgacaaacgcagaagacgagcaatcgatggcgcatatgtacggtgacgcaagtagaagagttcaaatccttcattcgagtccttcctgtgtgggcttccaccattgctctctccgtgtcctacgctcagctctcaaccttcttcctaagccaagccaacatcatggacagaacactcggtacccacttcaaaatccccgcaggttctgtccccgtgttcagcgccatcacactcatcctcgtacccatctacgagaaattcattgtcccctccctccgcaacatcatcggccaccaccgaggcgtcacgtcgttgcagcgaatgggcgtaggtttattcgtcttgatcttcgccatggcctcggcagcgttggtggaaaggaaaagacgggaccacaagtcattaaagatgagtgtgttctggttgctccctcagtttttcctaatgggtgctgctga

SEQ ID NO: 1908 - DNA, 1293 bp, Glycine Max
atggacaaattgtatgggttgagtcatctcttcatgacagtgtttcttcataacttctccatgttcatggtggtaccagccatcaccgatgtcacaatggctgctctttgtcccggacaagatgaatgctcacttgccatctacatcactggttttcaacaagcgatgatagggctgggcacgcttgtgatgatgccactattgggaaatctttcggataagtatgggaggaaggccatcctcacactccctatgatcctcacaatcattcccgtaggcatattagcttacagcaggacgaaaaaattcttctacgtctactatgtgtttaagatactcatttcaatggtttgcgaaggaagcgttccttgcctcgccctagcttacgtggcagataacgttccagaaagtggacgaagcactgtatttggaattctttcaggaattgggtctgccgcatttgtgtgtgccaccttatctgctcgatttttatcatcagccctaacttttcaagtttctacacttatcgcggtgattggagcactatacatgcaatttttccttcgagattcagtcattgatgacaagcacctttataccccaatcatatcacaaggaaatcccataatatctaaggtcaatggaaacttggaaagtaagaagcatcttttgaaagcattgcgctccataaaggacctaacttctttcctcaatagcagcttgaccattaatcaagcagcaattgttgctttcttcaatagccttgcagatgttggccttcatggatcattgttgtattttttaaaggctcaatttcactttgataagaatcagtttgctgacttgatggtcatttctgggattgcagggactgtgtcacagcttcttcttatgcctattttggctcctattttgggcgagacaagactactctcagttggcctattcttccattgtgtacatgtaagcaccatggcatggtcctccttggttccttatgcttccgccatgttctcaattttatatgttttctcacacccttgtatacgaagtattgtatctaaagaagctggtccccatgagcagggaaaggctcaaggttgcatttcaggcatatgttcaattgcacatattgtttctcccttggttttctctccattaacagctctattcctttctgaaaaggcaccttttgattttcctggattcagtataatgtgcattggatttgcttcgatgatatcttttgttcaaagtttgatgcttagagtggctcctcccattttgaattag

SEQ ID NO: 1909 - DNA, 771 bp, Glycine Max
atggaccccctctctctcttctgcaccggagccctcctcgccggcggcctctactggttcgtgtgcgttctgggccccgccgagcagaagggcaaacgcgccaccgatctttccggcggctccatctccgccgagaaagtccaagacaactacaaacagtactggtccttcttccgccgcccaaaggagatcgagaccgccgacaaagtccccgacttcgtcgacaccttctacaatctagtcacagacatctacgagtgggggtggggccagtccttccacttctccccctccatccccggcaagtcccaccgcgacgccacgcgcctccacgaggagatggccgtcgatctcatcgaggccaagcccggcaacagaatcctggatgtgggctgtggcgtgggcggtcccatgcgggccatcgcggcccactcgcgggccaacgtagtcggcatcaccatcaacgagtaccaggtcaaccgcgcaaggatgcacaacaagaaggcagggttggagtccctctgcgaggtcgtgtgcgggaattttctcaagatgcccttccccgacaacagcttcgacggcgcgtactccatcgaggccacgtgtcacgcgccgaagctggaggaagtgtacgccgaaatcttccgtgttctgaaaccgggggcgctctatgtttcctacgagtgggatcgcctactggcggaaccatattgtggtcactgttctcgccgctttgggaatcgcgcccaaggggaccgtcgatgttcatga

SEQ ID NO: 1910 - DNA, 645 bp, Glycine Max
atggacctggatcctcgccaatacgaaaaccttgctgtaaatgataatgacatccacaacattgttctgtcatatcttatacataattgctacaaagaatcggtagaatcattcattgcttgcacgggagcaaagcagccgacagattatttggaggacatggataaaaggaaaagaatttttcactttgcactagagggaaatgcactcaaggctattgagcttactgaacagctggcaaaggatattctagagaacaataaggatttgcagtttgatctactaagccttcattttgttgagcttgtctgctcaaggaaatgcacagaagctttggagtttgctcagaccaaattgggccctttcggaaaggagcccaaatatatggaaaagcttgaagactttatggcccttcttgcttataaggagccagagaaatccccaatgtttcatctccttagcttagagtatcggcaacaggttgcagatagtttgaatcgagccattcttgcacacttgaatcttcccagttacacagcaatggagaggctaatacagcaggctacagttgtaagacaatgcttaagtcaagaagctggcaaggatgggccaccattttccttaaaggattttctcaaaagttga

SEQ ID NO: 1911 - DNA, 789 bp, Glycine Max
atggacgaggagaatggttacagtgggagtagcagctcaaacttggagactacaaaagcagagagatctgtgtggctgatgaagtgccctttggtggtggctaagtcatggcaggctcatcctccttctcaacctctcgccaaggttgtgctctcccttgatcctctccaccctgaagaagacgatccctctgcagtccagtttacaatggagatggctggctccgaagctgtgaatatgccaaaaacttattcattgaatatgtttaaagactttgttcctatgtgtgtcttctccgagactagccaaggtggcaaggttgcaatggaagggaaagtagaacataagtttgatatgaagccccatggtgaaaacattgaagagtatggtaaattgtgtcgtgagaggacaaacaaatctatgattaaaaatcgacaaatacaggttattgataatgaccggggagttctaatgaggccaatgcctggaatgattggtctagtttcatccaattctaaggacaagaagaagacacagccggttaagcaatctgatacaaagagaacaagaagagatcggggagagctggaggatataatgttcaagctatttgaaagacagcctaattgggccttgaaacagcttgtccaagagactgatcaacctgcacaattcttgaaagagattctgaacgaactttgtgtttacaataaaagaggtgccaatcaaggaacctacgagctgaagcctgagtacaagaaatctgttgaagatacgagtgctgaataa

SEQ ID NO: 1912 - DNA, 735 bp, Glycine Max
atggacgaggagaatggttacagtgggagtagcagctcaaacttggagactacaaaagcagagagatctgtgtggctgatgaagtgccctttggtggtggctaagtcatggcaggctcatcctccttctcaacctctcgccaaggttgtgctctcccttgatcctctccaccctgaagaagacgatccctctgcagtccagtttacaatggagatggctggctccgaagctgtgaatatgccaaaaacttattcattgaatatgtttaaagactttgttcctatgtgtgtcttctccgagactagccaaggtggcaaggttgcaatggaagggaaagtagaacataagtttgatatgaagccccatggtgaaaacattgaagagtatggtaaattgtgtcgtgagaggacaaacaaatctatgattaaaaatcgacaaatacaggttattgataatgaccggggagttctaatgaggccaatgcctggaatgattggtctagtttcatccaattctaaggacaagaagaagacacagccggttaagcaatctgatacaaagagaacaagaagagatcggggagagctggaggatataatgttcaagctatttgaaagacagcctaattgggccttgaaacagcttgtccaagagactgatcaacctgcagtatgcttttctgctctgccttttttttttggtgttctttttcacctgagtctagagaaatgctag

SEQ ID NO: 1913 - DNA, 1932 bp, Glycine Max
atggacgaggaggagccgcgtgacgaaggacaacaaggaggttctgtcgagcaaagcccagagcaactggtggcccgtgccatagcccccgtcaagaaggatttcctccgtcctcctcccgttcgctcttcctctccaaacgacggcgtttccattcccaatgataacaacaagacctctgttctcgccaaggagaagaagtccaagcgccaactcaaacgcgaacgtcgtctggaacaaaagtcagcacgaaacctgtgtcccgaaattgccaaaacaggggatgttagttcatgtccttataaagacaagtgtcgtttcagccatgatttggaagccttcaaggcacagaaacctgctgatctagaggggcaatgtcctttctttaaatctggaggcgcttgcccatatggtttagggtgtagattttcgagtacgcatgaagatggtgtgccttctgccaatctgaatggtcttaagaataattccgaggtgaatgggttgagcaaacatgttcaaaagcttttgtggaaaaataagatgagcttctccaaggcagatgcccaactcaaaagtctaggcctcgtggtatttttcattaacatgatgctcctatttttgtcccctagttcttcttcagtgcgaactctgatagtgtccacagtaaaatatgagggaacctctaagtcaaaaaggaatgacttggaaaataaagatgaaggtgacactggttcaaataaaagaaaaattgcagaaaattgtggtcctatggatgcagaaaatgaaggtcatcgcttcatcttcgactctaaaactgatctaagcctgaagctgcactcacgtgaaaagaagctgattgattttagggagaagttgtatctcgcacccttgaccactgttggcaatctccctttccgaagagtttgcaaagtattaggagctgatgtaacttgtggtgaaatggcaatgtgcacaaatcttttgcagggtcaagcctctgaatgggcattgctaagacgtcattcatctgaagatttatttggtgtacaaatctgtggggcatatcctgatactgtggcacgaacagttgaactaatagagcaagagtgtacaatagattttattgatataaatatgggttgtcctattgacattgttgtgaataagggtgctggatcagctcttctaacaaaaccaatgcggatgaaaagtattgtagaagttgcttcaggcacagcggaaaaaccaataactatcaaggtacggactgcttattttgaagggaagaatcgcattgattctctgatagcagacattggctcttggggtgccagtgctgtgacaatacatggtaggtcacgtcaacaacgctatagcaagcttgctgactgggactacgtataccagtgtgccaggaaagcccctactacattgccagtagtggggaatggagatgttttttcatttgtagactggaacaaccacagaactgaatgccctgaacttgctacggacatggttgctcgtggtgcactgattaaaccttggatatttactgagatcaaggaacagagacattgggacatcagttctggcgagcgtctaaatattctcaaagattttgtgaattttggtcttgaacactggggttctgacacaaaaggggttgagacaacaaggcggttcttgttggaatggcttagctacactttcaggtatatacctgttggtcttttggatgtggttccacaacgattaaactggcgtccaccatcttactatgggcgtgatgagcttgagacactaatggcctcagactctgctgccgattggatacgaatatcagagatgctacttggcaaggttccagatggctttacatttgctcctaagcataaatcaaatgcttacgatagagctgaaaatggttga

SEQ ID NO: 1914 - DNA, 3918 bp, Glycine Max
atggacgtccaagacaaggaagctccactccaacaacactctgattcgcaatgccacaccgacctgccaaatctcccctacgccgccgccggacaccttgaagaggccgtggcggtacgacgaaattggggacggaaacacaaacgaagacgctttgatggaagaagagcaacatcaacaaggagaggaggaggaggaggaagagcagcaacaaggagagggggaggaagaagaagaacaacaagtagacgaggaggaagaaggagaacagcaacaagagacgaggaggaagaaggaggacagcaacaaggagacgaggaagaagaagaagagcgacaaggagaagaagaagatggtgatggtggaatggcaatggcagaagacacagaggagaagagtgctgctgtgagtggtgggaagaggaggcgtggggctgggaagaatgctaaggctacagggagagttgcatccaggaaaaagatggaggaggacgtttgtttcatttgcttcgatgggggtgaccttgtgctttgtgaccgcaggggatgccccaaggcttaccatccttcctgcgttaatcgtgacgaggccttctttcgagctaaggggaagtggaattgtggttggcatctttgcagcaactgtgagaggaatgcatcctatatgtgctatacatgtacattttctttgtgcaagggatgcatcaaagatgctgttatcttacgtgttaggggaaacaagggcttttgtgagacttgcatgagaaccataattaacccaaaaattgatcttctgagggcaaacctgcctagtcaacatcacaataaccgtcatcttcagcactgcccttattctcataaagtaaccctttccctgattcactcatgcatccctaagaatatgaaccacaacatccccaggagaccagggtttgttagtggatctgatatgcttctttctaaagaggaatcactggatgaaacttttgatgccactaacgatagaggatcagattcagatagctcctatgagaatgcagatttgagtcgttctaaaagaaaaaaggccaagaaacgggggaagtcccgttccaaagaaggagatgacagctcagagtgggcttcaaaagagcttttggagtttgttatgcacatgagaaatggagacaaatctgttttatctcagttcgatgtgcatactcttttgctagagtatatcaaaagaaataagcttcgagatcctcgccgaaaaagtcagattatttgtgatgcaagacttcaaaatctgtttggaaaaccaaaagtgggacattttgaaacgttaaagcttcttgaatcccatttccttctaaaagatgattctcaggctgaagatctgcagggaagtgttgttgacactgaaatgagtcattgggaaggtgatggcaatcccaattcatatacgaaagctggcaaagataagagacgaaagaaccgtaaaaagggtgatgagagaggacttcaaactaatgttgatgattatgcagccattgataaccataatattaatttaatttatctaagacgtaacttggtggaagatctacttgaagatactgagaagttccatgataaagttgttggttcttttgtgagaataagaatttctggtagtggtcagaaacaggatttgtataggttggttcaggttgtaggtacatgcaaagcagcagagccatataaagttggtaaaaggatgacagatatcttgctagaaatcttaaatttaaacaagacagagattgtttcaattgatattatctcaaatcaggagttcacagaggatgaatgcaagcgtctccgccaaagcataaagtgtggcctcataaatcggctaactgtgggtgacattcaggacaaagcattggtgcttcaggaagctagagtaaaagattggctagaaacagagacagtgcggctgagtcatcttcgtgatagagctaagaaattgcagcttttgaaaacacctgaagaacgtcaacgcaggttggaggaaatcccagaaatacacgtagatccaaacatggatccaaaaaactacatgagacctagagggtctactgcatttggaaggagggggagagatattgtttctcctagaagtggttctatttcaaatgattcttggagtggaacaaggaattattctaatgtgaatcaggaactaagcagaaatttgtctaataagggattttcaatcaaaggtgataatgcttccaatgctaatgaggcactaaatgatgctcaattgcaccggggaagagatcgggaatcacaactatctaatagctgggagaggcaaaagcaatcttcaaccttggaaagtgaagcttctgcagcaccatcttcagccggaataactcctccagctgtgaaaattaatgaaactgaaaagatgtggcattaccaggatccatctggaaaagttcagggaccattttccatcgtgcaactacgcaaatggagtaacacaggatactttcctgctgatttgaggatttggagaaccactgagaagcaagatgattctatactcttaacagatgccttgacagggaatttttctaaggaaccatcaatggtggataaagctcaatcggtgcatgatttacattacccatcatcatactctaggaagtctccacaacaaggtatagaaggtcaagttggagaaagactgtcattagatcaaaatggtggatcttggaattcacatattgaggtccccaagaaccctgcaaatggctggggttctgatgctggtgttaggaatgatgcaacaaatcttccttcacctactccccagactactcctggtggtactatggggctggcttttgaaaataaatggtcaccaacacctgtccagttgcctgggtctctcttaggaaattcattcccaggcagtcacggagagcatgctgtacaaaatgctgaaaaaggctcaagttcacaacctggcattagttcagcttctacagataataccaagttgcatcctcaagcaacagcggtggtacctgttgtggcttcaggggttgacatcaaaatggcaggtgcaaatatgcaaaaccaggttgtgagtagccagaactctcatgctgaagctcaagggtggggttctgctggggttccaaagccagaaccactggcctggggaggtgcatcttctcaaaggatagaaccaaataatcctgctaccatgccttcccagccagcttcccatggcccctggggtgatgcttcatctgtgccaaccactgtctcgtttaacactggaaatccaactgcgagtttacccacacctggatttctgggcatgactgcacctgagccttggagaccaccggcttcaagtagtcagtcaaacatcgcagctccagctccacccaatatgccttggggcatgggcatgtctggaaatcagaatatgaactggggtggggttgtacctgccaacatgaatgtaaactggatgcctacgcaggtgccagcacctggaaattcaaatccaggatgggctgctcctagtcaggggctacctccagtgaatgcaggtggctgggttggacctggtcaaggacgttcccatgtaaatgcaaatgcaggttgggttgggcctggtcaggggctagcacctggaaatgccaatcctggttggactgcaccggttgggaatccaggcatgtggggaagtgagcaaagtcataatggagacaggttccccaaccatggggatcgtggtgcacagggtagagattctggttacggtggtaaatcttggaataggcagtcatcatttggcagaggagtagtctgcaagtattatgagagtggacgttgcaggaaggggacttcttgtgactttctacacacttag

SEQ ID NO: 1915 - DNA, 651 bp, Glycine Max
atggactgctccatcaacttccacaagctccaaacaaagaaaaccacgaaacctcggaaacatcatccacagctccgaaagatcgcaaacatgttgcgttacgcggagttgtgcgttgttctggtcttggtttcgaggctctccatcaacctaccctacacaaccgagtgtttccgcaacttcatgggtagccctcgcttcgtttttctcctgggaaacgtcatcatcataacgctcttcgcacaatctggccacttttcatcttcagccaaacgtgccccagaacctgcagatctctatctcgagttcctccaaaacaccaccatccatcagaaacttcaagtccacgtcagcaaaccaaagccaagtgcgagagtattggagagtgttataataaagggcaccaaaactgcagagactggtttggaggtgaagaaggattatagaaggtctaaatcggatattgttgtgaagcgcgtggagagtgagaaggtgcctccacgcgtgttgcagaggtgtgagactgagaaagttcttgttaataataactcgtaccctgaagatggcatgagcaacgacgactttcgtcgcaaggttgaggctttcattgctcgccaacagaggctacgaactacagaactctgtaattaa

SEQ ID NO: 1916 - DNA, 753 bp, Glycine Max
atggacttcccattagcattcgcaagcaacttccctcttctctcttctccttcttctgctccagctccctctgctacctaggctgaggagttgtgtaccattcccttcttgttgggtccactcgtccaaggtcaccaaaaggatacacctcactcgcactctctgaaacccggtctttacctcgttggaacaccaatcggaaatctcgaagatatcactctgagggctattcgcgtgctgaactcggctgacgtcatactctcagaggacacgaggcactcggggaagttgcttcatcactatcacatcaaaacaccccttatgagttatcacaagttcaatgaatcgcaaagggaacaggttgtgctgaggaggttgaagcagggtgagattgtggctctcataagtgatgctggaatgccaggcatcagtgatcccggtatggagttggccaaactgtgtgtgagtgagaatatcctggttgttccaatccctggtccctgtgctttggtatcagctctttctgcctcgggtttaactactgatgaatttacatttgttggttttcttcctaaacattcggaattgagaagaaaaaggctcatggtttcagctgatcaaactacaactcaaatattttatgttgctcctcacaagctttctcagttccttgatgagagttcttcaatttttggtgatgcaaggcaatgtgttattgctcgggaaatgactaagttacatgaagaggggtga

SEQ ID NO: 1917 - DNA, 1233 bp, Glycine Max
atggagccagtgttggacaaactcaacgcgtttgcgaaatccggccaggattttttcgacggacttttccgtcgccgcaatccggttgaaatccttaaacggttgcagagagaagcgttctctgatctcatgaaactgagagagcgtcaagataaggttgagcgggtgctttctttctaccagtcctcgaaagtgggtccctttcaagagaccaccactcacgtgagaggacaagtggatttcttaggtgctttgttggtgctgggtaacttagatgctgtagataagttgggaatcagaacaggggttgattcgaggttcatttttgaaacaaccatgggggacaaggctaccggtgctgctgagtttgtggccagtcatggagggaggagggaacattgtgaagaaaagcctctttctcttgccaagcttagttttacagcaaatgtcaatgattggttctctttcgtggctatgccaataggtgcccggtgcagagatgttgctattgcttctaattcctttcatcaggttggaaaagggcttacagatttttcctattttgggccacctcttctcaacctgcacaatggtactgcttttggcataactgtgagaaagtcaaatgttactgcttcattggctcaaattgtaactggtctgggtatgccacctagttctagtataacagataatagatctagcacttttgggcagcttgtgtatcaattttctagaggatcaaaactgtctattctgggtcttcaccatatgcctttatcatcaaagaaacttggaagatttggagctcttacaattccactactcgtgtccaagcaagatgaagatgaagtttctgaggcagtacctgaagtattgccattaataggaacaaagacacgtgtgccagctggttctattgctttaatggcagagtctgaacttgatgattttacaaagattggaggttgggtcgagatggacaaattaaatcccaaatatttacaattgggtgtaaccatatctgatgtgtctgaagattcatttggttggggaacgagtctcagtgggaggatgattggaaattcggcaaatgaggctcattttcaggctgaatcgtatctaaaatttaacatgggtaataatttttgtttgaagccaggtcttgtattgggaatagatgggaaatcgaaaacagctgccttagtgcttcgatctaactggtcactgtga

SEQ ID NO: 1918 - DNA, 229 bp, Glycine Max
atggaggataccaatgagttgttgcacctcttggtggatgctatgaataggggattgcgtgatgccaatgggtcacttagcaaacaaaatgtagaacgaataatacttcctcaactcaatgcaaaaactaaattcatgtacgttcttagcgggtgggagggttcagcacatgattccaaggtgttaagtgatgctttggcaaggaagaatggacttaaagtgccccaag

SEQ ID NO: 1919 - DNA, 1356 bp, Glycine Max
atggaggatgatgagaaacccacgggtaactcccatggcattgctgatatggatgttgctgatgctgctttgcaaggccaacgtgttgcttcttcccctgctccgctacaacaggatcaagtaatggtcgaacagggtcatgatatcaaaaacggcgattctggtcctgctcatttgccagaagccagtgtaattaacaataatcagtttgaagttgaagatgctcagaccgtttcgcatcaggaactgaccactccaaagcctaaagaaaaaaacgtcagagaaatgaagaatgtgctaaatgatactgagattttttattatctcgacattaacccacagatgactgattatgatgagtatggcacgcctctggatcgagaaacattcatgaaagagcttgagactttctacagagagcgctccttggaatttaagcctcctaagttttatggagagccactcaattgccttaagttgtggagagctgttatcagactaggcggctatgatgtggtaactggatccaagttgtggcggcaagtaggagagtctttccaccccccaaagacctgcactacagtctcatggacatttagaattttttatgagaaggcacttttagagtatgaaaggcataagagagagattggggagctacagctccctgttggaccattccatcaatcttcaaatgtggaaaaagagcctgctgtttaccagactccaggctcaggtagagcaagaagggattccgcagcacgtgcaatgcaaggttggcatgctcagcgccttcttggatatggtgaggttgctgagccagttattaaggacaagaacttcagttccacacaaaagcgtgaaaagaacctaaaaagtattggtatgatcaataaacagaggacactgtctggtctggagcatgctgagaaatctgcaaatattgaaggagatcaacagttaatcaggattctgttcattattactgattctccgatcaatccaaccacatacaatgcctatttcaatctgaaaaagatacgtgtgcactcggtagtggacgttggacccccagctgactgggtgaagatcaatgtgcgggaaactaaggatggttttgaggtgtatgcccttgttcctgggctccttcgtgaggaggtgcgagtccaatcagatccggttggacgtcttgttataactggtgtgccagaacaccttgacaatccatggggaattacccccttcaaaaaggttgtgaacttacctacaagaattgattcgcttcagacatctgctgttgttagtttgcatggtcgactatttgtacgcgttccttttgagcagggagctgtgtga

SEQ ID NO: 1920 - DNA, 591 bp, Glycine Max
atggaggcaagtggaggtggcggtggcggtgcttcaccgtctgcaccagtgaagcaatatctgcacgatttctcgaagctgtttcagtactatctggataaatccactccacattccacgtacagatggattgggacttttgtgatagcatccatctacgttttacgcgttgtttatgtgcaggggttttacattgtctcttatggcctcggaatctaccttctgaatctcttgattggttttctctcccctttggtcgatccagagctcgatccctccgattcccctttgcttcccaccaaaggctccgatgagttcaaacccttcattcgccgcctccccgagttcaagttctggtattctttcacgaaggctctctgcatagcatttgtgatgacttttttttccctgtttgatgttcctgtcttttggcctatattactctgttactggtttgttctctttgtccttacaatgagacgccaagttgcacacatgatgaaatacaaatatatccccttcaacttggggaagcagaagtatagcggtaagaaatcttctgcaagtagcagtggctctcgtgcagactga

SEQ ID NO: 1921 - DNA, 585 bp, Glycine Max
atggagggaagtggaggtggcggtgcttcaccgtctgcaccgttgaagcaatacttacaggaattctcgaagctgtttcagtactatctggataaatccactccccatcccccctacaggtggattgggactttcgtcattgcatccatctacgttttgcgtgttgtttatgtgcaggggttttacattgtctcttatggcctcggaatctacctcctcaatctcttgattggctttctctcccctttggttgatccagaactcgatccctccaacgcccctatgcttcctaccaaaggctccgatgagttcaaacccttcattcgccgcctccctgagttcaagttctggtattctttcaccaaggctctctgcatagcgtttgtgatgacctttttttccatgtttgatgttcctgtcttttggcctatactactctgttactgggttgttctctttgtccttacaatgaggcgccaagttgcacacatgatgaaatacaaatatatccccttcaacttggggaagcagaagtatagcggtaagaagtcttctgcaagtagcagtggctctcgtgcagactga

SEQ ID NO: 1922 - DNA, 585 bp, Glycine Max; identical to SEQ ID NO: 1921

SEQ ID NO: 1923 - DNA, 1374 bp, Glycine Max
atggaggtaattttaagggagaaggacgcaggtgagtgggtttaccgaggcgaaggagctgccaatcttgttctcgcatacaccggatcatctcctacgtttattgggaaagtgatgcgcattcgtaagtgtccaaggaatggcgcagagggtatgtgtatgaggagcccctctgctttgactgcgcacgagcgcctcctctggaaagacgttgatgaactcatttcatctttggacaatgaaattgcatgccaactattttcccaccacgttatgaagccattgcttggtcccaaatatattgatgctgggatgcttgttggggtgtcaagggaatttctcgaattggttgaaaagaatgtaattcgtcaacgtcctgcttggagagttgataatgctcaggtcgacatgcatcgtgattctgtgcttctcatgtctgatcactcactcttcactcatggtaatctagtatctatcccctgcatatctgttgagataaagcccaaatgtggatttattcctctttcaagattcatatctgaaggaactgctatcaaaaggaggataactcgctttcaaatgcaccaagctctgaaattgcatcaaggagagatatcactgctaagtgaatacaatcctcttgatctgttctctggatcaaaggaaagaatttataaagctatcaaggatctcttcactacacctcaaaacaattttcgtgtatttatgaatggctctctcatatttggtggtctgggaggtggtgcagaagatacaaactttggtattgctaaagcatttgaagatgcacttaagtctgtcattcaagctgataatggtctgtgtacagagaacttgcttactattgttgctgaggctgtgcaaaaatcgggagtccttgatcgactcctggatgttcagaagcttgataatgttgacatagaaggagccatccatgcttattatgacattactcatcaacagtgcatgatatgtagagaattgagtgaagagcaactgaaaagatatacctctttgcattctgctacattggatgaaagcttgagaattgtaaaggactacttaatagcagcaactgcaaaagactgcagttttatgatatgttttagaccaaggaaagcgggggattctggatctggatctatatacagtaacatatatcttgagtcaactaagcaaacctttgacttcaaggtgtatttcattgacttggatttgaagcgaatgagtaaaatggaagaatattatgaattagataagaagatagtgagctgctacaaagaaatgatcaaaatggaccagggaagaaacccacaaacttgcaatcctcttaaactgcatactgagatttag

SEQ ID NO: 1924 - DNA, 918 bp, Glycine Max
atggaggtagcagtggccaaagcgttgaaaccgagtttaaggagagagttcatcgttcagcaaatgctctgcgaggatattttcagcctgaacgccaacaccgtcgccgccggcgaagatttctccgtcgacgacctatttgacttctctaacggctctcttcacaacgaacaacaacaagaatacgacgaagggaaacaaagtttatcggcttcagaggaccgcggagaagacgattgcaactccaattccaccggcgtttcctatgattcacttttctccaccgaattagccgttccggccggtgatttggaggacctagaatgggtttcacactttgtggacgattcactcccggagctgtcacttctatacccggttcgttcggaggaagcaaaccggtttgttgaaccggaaccctcagcgaagaaaacgccttgttttccgtgggaaatgaaaataacgaccaaggcgagaaccgtacggaataggaagcccagcaacagtcgcatgtggtcgttgggtagcccgttgctctcgctgccgtcttcgccgtcttcgccgtcgtcgtgttcttcttcggtgagggagccgccggctaagaagcagaagaagcaagcccaggcccagcccgttggggcccagattcagcggcggtgcagtcactgccatgtgcagaagacgccgcagtggaggaccggcccactgggcgcgaagaccctctgcaacgcgtgcggggttcggtacaagtcgggtcggttattttcggagtatagaccggcgtgtagccccaccttctgcagcgatattcactccaatagtcaccgtaaagtgttagagattcggaagaggaaagaggtggctcaaccggataccggcttggcccaggcccagactcaaatggttcccacctgctga

SEQ ID NO: 1925 - DNA, 1074 bp, Glycine Max
atggagttgtggaacgtggtgtttgtgtgttgtgttttatgttacagtttttgtcacactgcggaggctatcgttaagctacgaggcaatgaaacaataccagcattgattttgttcggggattcgatagttgacacaggaagtaacaataacctaataacggggcttaagtgcaattttcctccttatgggagggatttcgagggtgggataccaacaggaagattcagcaatggcaaggtcccagctgacttcgtagcggaagaattgggaatcaaggaatatatagcaccatacacgagtcctgctttgcagcctggtgatctcctcaggggagtcaacttcgcttctggtggcacgggatatgatcctttgaccgcacaactagtgtcagtcataccgttatctgagcaactagagcaattcaaagaatacataggaaagcttaaaggaaattttggagaagcaaaaaccaacttcatcttgtccaaaagtttagtacttgtggtatcaagcagcaacgacattgccaatacttattttgcaactggagtaaggaaactgaattatgatgttcccaattacactgatatgttggtgcaacaagcctcttctttcgttaaggaattatatggattgggggcaaggagaataggagtgtttggtgcacctccactaggatgtttgccattcgtgcgagcattgtttggaggtctacgaagactgtgctccgaagaaataaacatggcatcaaaattgtttaactctaaactatcttcagagctgcacaagctaaaccaaagtttgcctcaagccaaggtggtgtatatccatatttacgactctttgctcaatatcatccaaaacccaaccaaatatggatttgaagttgctgacaaaggatgctgcggcacagggactgtagaggcggcttttctgtgtaatatgttagatccaacaacctgctcagatgattctaaatatgtgttttgggacagctaccatcccacacagaagacataccagattcttgttggtgaaatcctcaacaaatatacaagcaacttctcttga

SEQ ID NO: 1926 - DNA, 486 bp, Glycine Max
atggataaaaggaaaagaatttttcactttgcactagagggaaatgcactcaaggctattgagcttactgaacagctggcaaaggatattctagagaacaataaggatttgcagtttgatctactaagccttcattttgttgagcttgtctgctcaaggaaatgcacagaagctttggagtttgctcagaccaaattgggccctttcggaaaggagcccaaatatatggaaaagcttgaagactttatggcccttcttgcttataaggagccagagaaatccccaatgtttcatctccttagcttagagtatcggcaacaggttgcagatagtttgaatcgagccattcttgcacacttgaatcttcccagttacacagcaatggagaggctaatacagcaggctacagttgtaagacaatgcttaagtcaagaagctggcaaggatgggccaccattttccttaaaggattttctcaaaagttga

SEQ ID NO: 1927 - DNA, 2202 bp, Glycine Max
atggataccattgccaattcagtttcgaagctactcacattgtttctcacggtcttgtttgtgggttctgagctgacacactgtaatgtcacctacgacagaaagtctcttctcatcaatggccagaggagaatcctcatctctggctccattcactatcccagaagcacccctgagatgtgggaggatctaatttggaaggccaaacacggaggacttgatgtcatagacacttatgtcttctgggatgtccatgaaccttctcctggcaattacgattttgaaggaaggtatgatctagtacggttcattaagacggtgcagaaggtggggctttatgccaatcttcggattggaccttatgtatgcgctgagtggaactttggaggaattcctgtatggttgaagtatgttcctggcgtaagcttcagaacggataatgagcctttcaaggcggcaatgcaaggtttcacgcagaaaattgtccagatgatgaagagtgagaagttgtttcaatctcagggtggtccaatcattctctctcagaaatactcaaaaaccaagattgagaatgagtacgggccagagagtaggggagctgctggccgtgcatatgtaaactgggctgcaagtatggctgttggattgggtacaggagtgccatgggtgatgtgcaaggaaaatgatgccccagatcctgtgataaattcatgtaatggtttttactgtgatgatttctctccaaataaaccatacaagcctagcatgtggaccgagacttggagtggctggtttacagaatttggcggcccaattcaccagcgaccagttgaggatctatcctttgcagttgctcgtttcatacaaaagggtggctcatatgtgaattattacatgtaccatggaggaactaactttggacgatcagctggaggcccattcataactacaagctatgactatgatgctccaattgatgaatatggtttgatcaggcaaccaaaatatagtcatttgaaggagcttcataaagctatcaagcgatgtgaacatgctttggtgtctttggatcccacagctcatgtattctcttcaggaactggaacatgtgcagcttttctagcaaactataatgcacagtcagctgctacagtgacattcaataacaggcactatgatttacctccttggtccataagcatccttcctgattgcaaaattgatgtatttaatactgcaaaagtgagagttcaaccttcacaggtgaaaatgcttcctgtcaaaccaaagttgttctcctgggagagctatgatgaagatctatcttctctggccgaaagttcaaggattacagctcctggactcttagaacagctgaacgttactagagataccagtgactatctatggtacataaccagcgttgacataagttcatcagaatcctttcttcgaggcggacaaaaacccagcattaatgtgcagtctgcaggacatgctgttcatgtgtttgttaatgggcaattttcagggtcggctttcgggacaagggagcagagaagttgcacatataatggacctgttgacctacgcgctggagcaaataaaattgctcttctcagcgtgactgttggattacagaatgttggtcggcattatgaaacatgggaggcagggatcactggtccagttttgctccatggtcttgaccaaggacagaaagatttgacgtggaacaagtggtcatataaggttggcctaagaggagaggctatgaatttggtatctcccaatggagtctcgtctgttgactgggtccaagagtcacaagctactcaaagccggtcacaattaaaatggtacaaggcatattttgatgcacccgggggaaaggaaccactggctttggaccttgaaagcatgggtaagggtcaagtatggataaacgggcagagcatagggagatattggatggcttatgcaaagggtgactgtaattcttgcacttattctgggacctttcggcctgtaaagtgccaacttggctgtggacaacccactcaacgatggtatcacgttccaaggtcctggctgaagccaacaaagaacttgatagtagtgtttgaagaattaggtggaaatccttggaaaatatctttggtaaagagagtggcacatactccggcagttcatgggcagtga

SEQ ID NO: 1928 - DNA, 1314 bp, Glycine Max
atggatccctacaagcaccggccatccagcgccttcaattctcccttctggactacaaattctggtgctcctatttggaacaacaactcctctttaaccgttggagctagaggtccaattctgctggaggattatcatcttgtggagaagcttgcaaattttgatagggaacgtatcccagaacgtgttgtccatgccaggggcgctagtgcaaagggtttctttgaggtcacccatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagagggtaactttgaccttgttggaaacaaccttcccgtcttctttgtacgtgatggcatgaagtttccagatatggttcatgctcttaaacccaatcccaagaaccacatccaggagaattggaggatccttgacttcttctctcactttccagaaagccttcacatgttcacctttttatttgatgatttgggtgttccacaagattacaggcatatggatggttttggagttaacacatacacactgatcaacaaggctgggaaagcagtgtatgtgaaatttcactggaagaccactagtggtataaagtgtctattggaggaagaggccattaaggtgggaggagccaaccacagccatgccactcaagaccttcatgattcaattgctgctggtaactatcctgagtggaaactgttcgttcagacaatagatcctgagcatgaagacaaatttgactttgaccctcttgatgttactaagacttggcctgaggacattatacccttgcagcctgttggtcgcttggtcctgaataaaaacatagataatttctttgctgagaatgaacaacttgcattttgccctgccattgtggttcctggtgtatactactcagatgataagatgcttcagaccaggatattctcttatgctgattcacaaaggcacagacttggaccaaactatctgcaacttcctgctaatgctcccaagtgtgctcaccacaataatcatcatgaaggtttcatgaatttcattcacagggatgaggaggtcaattacttcccttcaaggtatgatcctgttcgtcatgcagaaaggttccccatacctcctgctatctgcagtggaaggcgtgaaaaggttaaaggagaacaacttcaagcagcccggagagagataccggtcttgggcacctga

SEQ ID NO: 1929 - DNA, 1479 bp, Glycine Max
atggatccctacaagcaccggccatccagcgccttcaattctcccttctggactacaaattctggtgctcctatttggaacaacaactcctctttaaccgttggagctagaggtccaattctgctggaggattatcatcttgtggagaagcttgcaaattttgatagggaacgtatcccagaacgtgttgtccatgccaggggcgctagtgcaaagggtttctttgaggtcacccatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagagggtaactttgaccttgttggaaacaaccttcccgtcttctttgtacgtgatggcatgaagtttccagatatggttcatgctcttaaacccaatcccaagaaccacatccaggagaattggaggatccttgacttcttctctcactttccagaaagccttcacatgttcacctttttatttgatgatttgggtgttccacaagattacaggcatatggatggttttggagttaacacatacacactgatcaacaaggctgggaaagcagtgtatgtgaaatttcactggaagaccactagtggtataaagtgtctattggaggaagaggccattaaggtgggaggagccaaccacagccatgccactcaagaccttcatgattcaattgctgctggtaactatcctgagtggaaactgttcgttcagacaatagatcctgagcatgaagacaaatttgactttgaccctcttgatgttactaagacttggcctgaggacattatacccttgcagcctgttggtcgcttggtcctgaataaaaacatagataatttctttgctgagaatgaacaacttgcattttgccctgccattgtggttcctggtgtatactactcagatgataagatgcttcagaccaggatattctcttatgctgattcacaaaggcacagacttggaccaaactatctgcaacttcctgctaatgctcccaagtgtgctcaccacaataatcatcatgaaggtttcatgaatttcattcacagggatgaggaggtcaattacttcccttcaaggtatgatcctgttcgtcatgcagaaaggttccccatacctcctgctatctgcagtggaaggcgtgaaaagtgtggaattgagaaggagaacaacttcaagcagcccggagagagataccggtcttgggcacctgacaggcaagatagatttgctcgccgatgggttgatgctttatctgacccacgggtcacccatgagatccgcagtgtctggatatcatactggtctcaggctgaccgttctctaggccaaaagatagcttctcatctcagcacgaggccaaatatttaa

SEQ ID NO: 1930 - DNA, 1338 bp, Glycine Max
atggatccctacaagcaccggccatccagcgccttcaattctcccttctggactacaaattctggtgctcctatttggaacaacaactcctctttaaccgttggagctagaggtccaattctgctggaggattatcatcttgtggagaagcttgcaaattttgatagggaacgtatcccagaacgtgttgtccatgccaggggcgctagtgcaaagggtttctttgaggtcacccatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagagggtaactttgaccttgttggaaacaaccttcccgtcttctttgtacgtgatggcatgaagtttccagatatggttcatgctcttaaacccaatcccaagaaccacatccaggagaattggaggatccttgacttcttctctcactttccagaaagccttcacatgttcacctttttatttgatgatttgggtgttccacaagattacaggcatatggatggttttggagttaacacatacacactgatcaacaaggctgggaaagcagtgtatgtgaaatttcactggaagaccactagtggtataaagtgtctattggaggaagaggccattaaggtgggaggagccaaccacagccatgccactcaagaccttcatgattcaattgctgctggtaactatcctgagtggaaactgttcgttcagacaatagatcctgagcatgaagacaaatttgactttgaccctcttgatgttactaagacttggcctgaggacattatacccttgcagcctgttggtcgcttggtcctgaataaaaacatagataatttctttgctgagaatgaacaacttgcattttgccctgccattgtggttcctggtgtatactactcagatgataagatgcttcagaccaggatattctcttatgctgattcacaaaggcacagacttggaccaaactatctgcaacttcctgctaatgctcccaagtgtgctcaccacaataatcatcatgaaggtttcatgaatttcattcacagggatgaggaggtcaattacttcccttcaaggtatgatcctgttcgtcatgcagaaaggttccccatacctcctgctatctgcagtggaaggcgtgaaaagtgtggaattgagaaggagaacaacttcaagcagcccggagagagataccggtcttgggcacctgacaggttcctgttataa

SEQ ID NO: 1931 - DNA, 3093 bp, Glycine Max
atggatcgacgctggccttggaagaaaaaatcatctgaaaagtccgtgattgagaaagcaactactgcattggattcctccgatgcttctaacaaccaggataacaagaagaaaccaaactatgttcaaatttctgtggaatcctattcacatctgtctggtttggaagatcaagtgaagacatatgaggaaaaagttcagacactggaagatgagataaaggaaatgaatgaaaagctgtccgcagcaaactctgagatcaataccaaggaaagcatggtaaagcaacatgctaaagtggctgaagaagctgtatcaggctgggaaaaggctgaagctgaagctttggcattgaagaaccatctagaatctgtcacccttttaaaactcactgctgaggatcgcgcaacgcatttagatggtgctcttaaagagtgtatgcgacaaataagaaaccttaaggaagaacatgagcagaaaatacaggaagttgctctctcaaaaaccaagcaattagacaagattaagggggagctggaggcaaagatagtgaacttcgaacaggaacttcttagatctgctgctgaaaatggggccctgtcaaggtcattgcaggaatgctcaaacatgctaatcaaattaagtgaagaaaaggctcatgccgaggctgaaattgagcttcttaagggaaacatagaagcatgtgaaaaggaaattaattcacttaaatatgaacttcatgttgtttccaaagagcttgaaattcgcaatgaagaaaaaaacatgagtatgaggtctgcagaagctgctaacaagcagcatatggagggtgtgaaaaaaattgccaagttagaggccgagtgccaaagattacgtggtcttgtgaggaaaaagttacctggtcctgctgcacttgcacagatgaagctagaagttgaaagccttggccgagattttggagaaagtcgattaaggaagtctcctgtgaagcctgctacccctaatttgtctccattacctgatttctccttggagaatgtacagaaattccagaaggacaatgaatttcttacagagcgtttattggcaatggaagaagaaacaaagatgctgaaagaagctttggctaagcgtaacagtgagttgcaggcctcaaggagtatgtgtgctaaaacactgagcaaacttcaaagtttggaagcacaatctcagacaagtaaccagctgaaattatctccaaaatccatcgtccagttaactcatgaaagcatttataatcaaaatgcaagcagtgcaccaagcttggtctccatgtctgaagatggaaatgacgatgcagcaagttgtgctgaatcttggtcgacagcaatagtctctgggctatcccaatttcctagagaaaagtgcaatgaggaatcaaacaaatctgaagtcactaacaagttggaactaatggatgactttctggaggtggagaagttggctcgtttgtcaaatgattccaatgtagatgccactgtttcaaacaataagacaacagacattgtgaccgaacttagatcaagaatattactggtttttgagtccttagctaaggatgctgacatagggaagattgtggaggatattaaacatgtgcttgaagattcgcatgacactaccatccaccactctgtggatgcccatccttctgacgctacatgtgataggaaggataatcctgaagatgctggcttaaaccttgaaaaggaagtcatttcatcccagcaacccaaaggatatgtgcagataacttcagatttggaagctgcaatttctcagattcatgactttgtattgttccttggcaaggaagcaatgacattccatgacgatgtatcttctgatggaaatgaaatgaggcaaaagattgaggagttctccatcacctttaataaagtattatgcaacaatgcaagtttgctacagtttgttcttgacctgtcctatgttctagataaagcaagtgagttcagatttaatgtccttggctacaggggcacagaagctgaaagtagcagtccagattgcatagataagattgctttgcctgaaaataagttagtacatgacaattcatctggagaaagatatcaaaatggttgttcccatattatcaatccatgttctaatcccgaggttcccgatgatggaaatttggtctcaggctataaagcagatgctgcatcacagaaactgtcaatagaggagtttgaagaattgaaactagagaaagagaaagtagtgattgatttgtcaaattgtacagaaaatcttgaaatgacaaagtctcaattgctagacacggagcaacttctggctgaagttaaatcacaattggcttctgctctaaaatcaaaaagcttggctgagacacagctaaagtgtgtggcagaatcatacaactcacttgaaacacgtgcccaggtcttggaaactgagctgaaccatctgcaaatcaagatagaatctctggagaatgaacttcaagatgaaaagagggctcatgaagttgctatggccaggagcaaggagctagaagagcagttacaaaggattgagtgctcggcagctgatgatgaccacaagacttcgcatgagagagatttgacagctgctgctgaaaagctagccgagtgtcaagaaaccatacttcttctgggcaagcagttaaattctctacgtccacaaactgagccaaatgactcattgtacagtaagataaatccaaaagatgaaggattcacagaagatgaacatactactaatcaaaattttcaagaattaggtcagttggagatggacagttctacttctgcttttgtgcaaagattgagttcggagtcccccttgcatttttccaacagtttatttagcccttcggacagcgagtccaccattccagccagatccccagttcagcattctaaatcaaaaccaaaacaccgacctaccaagtcagcctcttgttcagtttcttctgccactacacctgagaaacatgcacggggatttagtagattcttttcacctaaaggaaaatccggtcattga

SEQ ID NO: 1932 - DNA, 1531 bp, Glycine Max
atggatgacaggcgagagaggaaattgagttttgagaataattccgaggatgatagatgggcaaaaattggtagtctgaaaaagaaagcattatacgcgtccgccaaatttagacactctttcaagaagaaaagaagcagaaaaattgatagcaggagcaattccctctccattgaggatgttcgggatgttaaagacattcaagcagtggatgcatttcgacaggcacttgtgttagataacttgcttactccaatacatgatgactatcatatgctattgagattcttgaaagcaaggaagtttgatattgagaaagcaaagcacatctgggccaatatgatccaatggaggaaagaatatggtacagatacaattatggaggattttgaattcaaggagttgaatgaagtcctaaagtactacccgcatggtaatcatggtgtagatagggaaggaaggcctgtttatattgagaggctagggaaagttgatcccaacaagcttatgcaagtaactaccttggaaaggtatttgagataccatgtgcagggttttgagaaaacatttgctgttaagtttccggcttgctctatagctgcgaagagacacatagattcaagtacaaccattttggatgttcaaggtgtgggcttcaaaaacctaacaaagtctgcacgggaactcatcacccggctgcagaagattgatggtgattactaccctgaaacactctgccaaatgtttatcattaatgctggtcctggttttaagatactctggaacacggtgaaaacatttcttgatcccaaaactacttcaaagattcatgttcttggaaacaagttccagagtaaactgcttgagattatagatgagagtgagctgccagaatttcttggtggcagttgcacttgtgtagatcaaggtggttgtatgaggtctgataaagggccatggcaagacccaaacattttaaagatggttcttagtggtgaagtgggatgttctaaacaaatagtaacagtttctaacgacgaggggagggtgattgaatgtgacaagatatcttttccaatgattagaggtagcgatacatctacaggagaatcaggatctgaagttgaagatatagcttctcccaaagcatgtgggaattgtataagccctatgttaactcctgtccttgaagaagcaagaatggttggtaagactagtcatgctggcaatttagttgagcatgttcccacggttgacaaagccattgatgttggaccaaaggaaaaacaagcaacacctcgaatattcacaaagacaaacattccctcgtctaccttaaaacgcattggtgagcttgaagagaaagttgacatgctgcaatcaaagcctagtgtgatgccacatgagaaagaggagctgctcgatgctgctgtttatcgtgtggatgcattggaagcagagttgatagctacaaagaaggctttatacgaatctttgataagacaagaagaacttatggcatacatagaca

SEQ ID NO: 1933 - DNA, 984 bp, Glycine Max
atggatgagtcaaatgcaacctgcgggaagcgtttggcatctattgggttagagaacacagaagctaatcggcaggcataccgtaccctacttgtgacagtacctggtcttggtgaatacatctctggtgccattctctttgaggaaactctctaccaatccactgtcgatggaaggaagatcgtcgacgtacttgttgaccaaaacattgttcccggtatcaaggtcgacaagggtttggtgcccctagctggttcgaacgatgagtcatggtgccaaggtcttgatggtcttgcgtctcgctcagctgcatactaccagcaaggtgcccgtttcgccaaatggcgtactgttgtgagcatccccaacggtccctctgctctggcagtgaaggaagctgcctggggtctagctcgctatgctgcaatttcacaggagaacgggttggtcccaattgtggagccagagatcttgcttgatggtgagcatgggattgacaggacattcgaagtagcccaaaaggtgtggtcagaggtattcttctacctggctgagaacaatgtcctgttggaaggtattctcctcaagcctagcatggttactccaggagccgagtccaaggacaaggccactcctctgcaagttgctgattacaccctcaagctccttcacaggagaatcccacctgctgtccctggaatcatgtttctgtctggcggacaatctgaggttgaagcaaccttgaacttgaatgctatgaaccagtctccaaacccatggcacgtgtccttctcctacgccagagctctccaaaacacctgcttgaagacatggggtggactccctgagaacgtgaaggctgctcaagatgcactccttttccgtgccaagtccaactcactcgctcagcttggaaagtacactgccgagggtgaatctgaggaagccactcggggaatgttcgtcaaaggttactcctactaa

SEQ ID NO: 1934 - DNA, 1017 bp, Glycine Max
atggatgatgccgggcatcgtgaaaatggaaggcacaaagcagcagatcaatataaatctgctcagggacagtggttgatgcaacatcagccttccatgaagcagattatggcaattatggctgaaagagatgcagccattcaagaaagaaatctggccatttccgagaaaaaagcagcatatgctgagcgcgatatggcattcatgcagcgagatgctgcaattgctgaacgtaataatgcaattttggaacgagataatgcaattgcaactcttcagtatcgcgaaacctctttaagtagtggcagtatgccatcatgccctccaggatgccaaatttcacgtggtgtgaagcatatacatcatccccagcaacaggtacaccatatacctaacatgggtgatgcctcttacagcacacgggaaatgcacacaaccgatgccctccctgcagcccccatcccttctgaggccgggaaaccgaggcgggccaagcgaccaaaggaaccaaagtcagcttcacctaataagaagacttccaaaccagcaaaaaaagtcaagaaggagagcgaagacttgaacaaggttatgtttggcaagtcacatgagtggaagagtggtcaggaaatggtcaatggaggtgatgatcttaacaagcagttaactgtgtcaaaggctgattggaaaggacaggacttggggttaaaccaagtggcgtatgacgagtcaaccatgccagctcctgtgtgctcttgtactggtgtcctgaggcagtgttacaaatggggtaatgggggttggcagtctgcctgttgcacaactactctgtcaatgtatccacttcctgcagtgcccaacaagagacatgcccgggtaggtggtcggaagatgagtgggagtgctttcaacaagctgcttagtcgccttgcagcagaaggtcatgatctgtcaaaccctgttgacctcaaggaccattgggcaaaacatggaacgaaccgttacatcacaataaagtag

SEQ ID NO: 1935 - DNA, 816 bp, Glycine Max
atggatgttctctgtcagattggtttggatggaattcgcatgctggatccaaataccagccggacattgagaatttatcctcttgagaacataacaagatgtgatagaatcgattcatctacctttgcattttggtcaaagagccctgttgacattgagccaagacggatcagattgcaatctaatagttacactactaacacacttttggatatagtgactgctgcaaccatacagttcaaggaaatgggtggaagcaggtggcctgctgaagcagtgaaaccaaatgaacagcctacagaaagaaagaaaggttttggtgattggatgaatcttattaaacctgccaatgaagagaaggatcattgggtaccagatgaagccgtctcaaaatgtacagcatgtggtactgattttggggcttttgttcgcaggcatcactgtaggaactgtggtgatattttctgtgacaaatgtacatatggtagaattgctctgactgctgatgagaatgctcagcctgtacgagtttgtgaccggtgcatggcggaagtgtctcagcggctgactagtgcaaaagagtcatcaagtaaacctgcattgcagagtcatgaggatcttgcaaggaaacttcaggaggagctggagagaaatcgaaagacatcaggttccaagtctgatggatctgcaagacggatgaaggaagttgcatgtcccatttgcactgtccatctgcaggttcaggtgcctagctcgggttcagagacaattgagtgtggagtttgccagcacccatttcttgtgagcgctcattga

SEQ ID NO: 1936 - DNA, 1101 bp, Glycine Max
atggattttcctcctccgtttactatgttagaggccaaagacagtgcatttgtggtggatgatcagaaatcaggggatttgaatgatataaaaccgatgactaagggtaagcctccacgccatgcttcgactttgaggcacagcattagcaacaccagattgctggccatatcagatttgcacacatgtataattcttctggtccttttgtcatatttggatgtgggggttactgggagcaagtcatcttctgaagaaaacacggagtttctaccaatacttcggtcaggaagctgtgctgaaagaggacctaaacaatatatggaagacgaacacatatgtatagataatcttattcagcatataggtcctgcttcaactattcctttacctggagctttttatggggtgtttgatggccatgggggtacagatgcagctttgttcataagaaataacatcctcagattcatagttgaggactcccattttccaacttgcgtgggggaggcaattacaagtgcgtttgtaaaagctgattatgcatttgcagattctagttcgcttgatatctcatctggcaccactgctttaactgctcttgtattcggaagctgtactggggaggcgtgtagagcaattgagatgtcaaaagaccagaaaccaaattgcatttcagaaaggctaaggattgagaaacttggcggggtggtatatgatggatacttgaatggccagttatctgtttcccgtgccttaggagactggcacatgaagggtcacaagggttctgcctaccccttgagtgctgagccagagctgcaggaaatcaacctgactgaggatgatgagttcttgattatgggctgcgacggcctatgggatgtaatgagtaaccaatgtgctgtaaccatggcaaggaaagaattgatgatacataatgatcctcaaaagggtttcaaagagagttggttcagagaaggcttcttaaagcgtaacttcgtatcctccctcctaggaaaagagacacctccttctcgagtcaggaggagtatatcggcagaaggcctcaatttacttaagggtgtattggactgttag

SEQ ID NO: 1937 - DNA, 567 bp, Glycine Max
atggcaacagtgcaattcattttcgctaatggtggttcgggagaagctagctacgcaaacaattcctcctttcaagctccaaaggggttggctaaggaaacaggattggttaacaagggaaacatttacttcacaaacacaagcccatccgaagtgtaccaagcataccttgaccagtttagtcaagatttcaatctgtttctaaaatcacgtgcggaggaattaagtttggttgaagaggcaaagttggagtatgttaatatgccaagatatggtcctactgcaaaggaagtgaaacaattgatcgatgcagaagggtctttcactcttgagaagttggagacattcaagtcgcgttgggatgagggcttgaaggagaatggtaatggtgatttcgtattagacacaaatgtcagagccaatttcatagccaaatatgtgagagctactaccgaacctttcctgacggcacggtttggagaaggaataattgatgaattattcattagatttagaaagaaggttgcggaactattggaagaagtgatattagagcatgcttacctg

SEQ ID NO: 1938 - DNA, 924 bp, Glycine Max
atggcaacccaagcttcacgatccgagattgaggttgtggtagacacgaccacctccaacgataacaacaatgaggaaccaacctcgttgtccttaacgtcgtccctgaattctatactaacaaaattccatgcaggttacttcagaataagcctctccctcggtggccaagctttgttgtggaagacactgatcgaatcatcatcatcaccaacacacgacacaagcgccgctctacgacgcgttctttgcacgcttccttccgcagcagctattcttgcactgtggtcgttggctctctttgctctcgtgttgctctctcttctttacctcctacggtgcttgttttactttaagatggtaaaggcggagttcttgcatcccgtaggggttaactacctcttcgctccgtggatttcgtggcttctattgcttcaatcggcgccattcgtggcgccaacaacagcaacctacttggttctgtggtgggtgttcgcggtgccggtggtggtgctggacgtgaagatctacgggcagtggttcacgaaggggaagaggtttttgtcgacggtggcgaatccgaccagccagatgtcggtgatagggaacttggtcggggcacaagctgcggcgaacatgggttggaaagagagtgcagtatgcttgttttcgctggggatggtgcattacttggtgctgtttgttacgctctatcagcgcttgtccggtggagatcgccttccggtgttgttgaggccagttttcttcttgttctttgcagcacctagtgtggcaagcttggcttgggaatccattgttggcacctttgatactgcttccaagatgctcttctttctctccctattcctcttcacgtcactggtaatttatttcatcataaaaacatacaaaactataatttaa

SEQ ID NO: 1939 - DNA, 822 bp, Glycine Max
atggcaactcggcgatgcattcaactcttcatttatttcttagctacatgctcttcgcttgccgattcagtttcaagtccggtgcccgtcaacaaatttctgatgcagtcctattacgacagatacacgattttacacgattcggattttgataattttatgtctcaagcaatcccttctggttcttcgtgtggatttgtgttgagattgtcagatttaaagcgcactcttattggtgaaggttcacatcgtagtgtctctacattaatcaaatttcagacccaacagttaaagtgtgaactgttaagctactcatgtgaattcataattattgaaagattgccttctggagtttttgctgatccatttgagttacaacatcttgttcaccgtggcattttcagtgatgtagctgtctttggtgacacaaatctggagctgccttcattcttgtccaatcgttctgctgttgaaattcacttgcttgttgacccaaatatattgcaagagccaactgatataaaaatggagcttccattgcatgctcgatatcaaccccttaatgaaagtgggtactcgacggttgaatttggtgcaccggatatgttagtgcgctgcggcacaaaaggaaaggtggaaaaccactattgcttcttcaaattggaaaaggatgacgccaatctgtatggtcctcatactgtttggagaataccttctggaataaaggcacatgctgatcttgtttctgcagctacatttattgcagctttgttatcaactcttgcaattgttgttgcatcattatattattccaatagctga

SEQ ID NO: 1940 - DNA, 1419 bp, Glycine Max
atggcaacttactatacgagttcaaaagcactgtctggcaattctcagcagcaaaacaattgctttgtgattccatcaccatcagtaggggcttcacattccactcctgaacaacaagaaatctttgccaatattagtgggttccaaactgggtttcatgatttcagtgcatggagggaagatgagggtatgagacattctgaaaatcttccacctggcttacctgaagctaatcaagatttggccaaagcggatttttcatttcatggaatgtctggtgttggaaaaacagttcctagctccaaatacctcaagacagtgcaactactacttgatgaagttgttgacatccgaaaagctattaaaagacctgctatgaaaacttcaactggtaagacctcttgtgagctttcacatgctgaaaaacaagatctgcaccacaagttaacaaagcttttgtcaatgttggacgaggttgacaataggtataaacaatattatcagcagatgcagactgtagtgtcatcatttgatgtgatagcaggatgtggagcagctaaaccatacacagcccttgctctgcaaaccatttcatgccattttcggtgtttgcgtgatgcaatcactggtcaaatcagtgcaacacaaaagaaccttggagagcaagatgcttctggaagtaacaatggagttggaatggcaagactaaagtatgtggaccaacaaatccgacaacagagggttattcagcagtttggcatgatgcaacatgcatggagaccacaaagggggcttccagaaagctctgtttcaattcttcgcgcttggctttttgagcatttccttcatccctatccaaaggattctgataagatcatgctagcaagacagacaggcttgaccagaagtcaggtgtcaaattggtttataaatgctcgagtgcgtctatggaaacctatgattgaagagatgtacaagcaagataattgtattgctggcatggactcaaattcttcatctgaaaatgtgtccaaggacctcagacatgatcaggctcttgatacagaaatgatggcatccattggattagctagtctcataaatggagttgttcagtctgatggagctactaataagaggtttgtgtcagttggtccaacatgccaaatgccagagtctgagaggttcaagtcaggaagtggagtgtctctaacattgggtttgcagcattgtgaaggaggtaattttttgcctggtaagacccatctcagtttggtttccatgagggaggacgacatctccaaagcgaccgcagcttcaacagttggagtagagacaacagaacttgagtgcattggtgctggaaaccaacaacaaaggttaaattcacctcatatgctacatgattttgaagtatga

SEQ ID NO: 1941 - DNA, 1722 bp, Glycine Max
atggcacatcagcgccggcgccaccactattaccaacgcttccgtcacatgattccagtgttttccgccgtcgccgccgcgctattctttctcttcgctctcctttcgtttttagctccttctcccgtcgaaaccgatcgtatccaccggagacgccaacacacttcggttaacgttcaaaaggatgatgcgattgacaatcctgcgttccgcgttccgggtgatggaggaaagttgggacgcgatatctggagttctctaaattcggaacacttctttggatgtagcaattccagcaacaagtttcaaaaagctcaagtgattacacaaccgaatcggtatttgatgattgcaacaagtggaggcttgaatcaacaaagaactgggattacggatgctgttgttgctgcacgaattttgaatgctactcttgtggttccaaaattggatcaacgatctttctggaaagattctagtaacttctcagagatctttgatgttgattggtttatatcatttctgtcaaaagatgtcaaaattatcaagcaacttcccactaagggtaggaaagcattatctgcatacaatatgcgggttccaaggaagtgtaatgaaagatgttacataaatcgcatattacctgtactccttaaaaagcatgctgttcagctcagcaagtttgactacaggcttgctaacaggttggatacagaatatcagaagctgagatgtagagttaattaccatgctttaagatttaccaacccaatacttgcaatgggtgaaaaattggtccatcggatgaggatgagaagcaagcattatattgcactgcacctgagatttgaacctgatatgcttgcattttctggatgtgattatggtggaggggagaaggagcagaaggaactgggtgcaataagaaggaggtggaagacattacatagaagcaatcctgatagggcaaggaggcaggggagatgcccattaacccccgaagaagttggtctcatgctaagagcattgggatatggttctgacattcatatttacgttgcatcaggggaggtatatggaggggaaagaacattggcacctctcaaagcattatttcctaatttccattcaaaagagaccattgctaccaaggaagaattagaaccgttttcttcattttcttctcgcatggctgcactcgacttcattgtttgtgatgaaagtgatgtttttgtaaccaataataatggaaatatggcaaaaatattggctggacgaaggagatactttggccataaaccaaccattcgtccaaatgctaaaaaactttatcgattgttcttgaatagaagtaattcgacttgggaagcttttgcttctagtgtccgaactttccagaaaggcttcatgggagagccaaaggaggttagaccaggtagaggcgggtttcatgagaatccatcatcatgcatatgtgaagattctgcagcagccaaagtggacaaaaattcacaatctagaaaatatgggaaggataatacaacgaagaaaaatgtagcaaatgatgaactggatgttgacaatgtgtctgagtggccagacatggatgatgatgacgatgatcagaatgatctagcagagaagggtacattcaatgaaacaatttcggattatgatgctctgaacttcgaggatcccgagttggaggaaattatatcagattag

SEQ ID NO: 1942 - DNA, 933 bp, Glycine Max
atggcaccggtagaaacaagcataaaaagctctctgcacagtcgcagcaacagcttgcccaatgcaccacaccccattttatcacaagttgaggtgcatttgcacagattgaagaaggatcctgaagccaccacttcattgtcatcatcatcatcttcaataagtcacagactcaatgacttgcaggatctgcaagaaagtgctgataagttgctccaattgacaatctcccaacaagggttggcacaagaatgcagaagcaaacagattgatgaactattagataggtctctgaggctcttggatatttgtagtacaattaaagattgcctgctgcaatcaaaggatagcatgcacgaacttgggtcagttattcgcaggaagagagatgctgaaactggattcacaactgagggtggcaaatacctggcatgtaggaagaagatgaaaagggcaattgcgaaggccttgagagacttgaaggcaatacaaaataagttcacagtttcttcctcaaacaaagacgaggagacttcttccatgcttagcttcttaaaagaagcagaaatggtcactatgagctcattcgagtctttgttgatttttattattggccccaaaggtcagttaaagcagagcaggtggtcggtaatatccaagctggtgcagccaaagcgaatatcatgtgattctgaagtgtcagacactaataaattcaaaatggttgacaaagtgctgaagcttctcatcggttcaaagccttcatctactgagaatttccaaagccatgttcaaaatttagagttgtgcatccaagatattgaagttggagtcgaacgcctctcaagacaactaattagaaccagagtgactcaacattttgagccactaaaaatagtaatttatattccctctgttttgaatctggaatga

SEQ ID NO: 1943 - DNA, 1476 bp, Glycine Max
atggcacctcccaatttcagagcctattctattattcttattcttcttttcgtcaattcaggaagcgcccacaattaccaggaggcattgtccaaggcaatcctattcttcgagggccaacgttcgggtttcttgccgcaagaccagagacagaactggcgcgccaattcgggcctcggcgacggctggacctacaacgtcgacctcaccggcggctactacgacgccggcgacaacatcaaattcgggtttccgatggcattcaccaccacaatgctgtcctggagcgtcatcgaattcggagacatgatgcctcccaacgagcaccggaacgccttggtcgcaatccgttgggcaaccgattatttgctcaaaactgtttctcagccaaaccgcattttcgttcaggtgggtgatccaatctctgaccacaattgttgggaaaggcctgaggacatggacacaagcaggacagtgtatgctgttgatgcaccaaacccagcttcagatgtagctggtgaaactgctgcggcactagctgctgcatcaatggcttttcgttcatcggatcctggttattcagacactttgcttcgaaatgctgctaaggcctttcaatttgcagatacctataggggtgcctacagtgacaatgctgatgttaggagtggtgtttgcccatattattgtgacttcgatggttatcaggacgaattgttatggggagccgcatggctaaggagggccactcaggatgaaaatttcctcaactacattcaaagcaatggtaaaacccttggtgctgaagacaatataaatgagtttggttgggacaacaaacatgctggccttaatgttcttgtctccaaggaagttctagatggaaacgtaatgtctcttgaatcctacaagacttcagcagagagctttctgtgcacactcatacccgaaacatcaagttcacatatagagtacactcccggtggactcatatacaggcctgggggcagcaacttgcaacatgcaacttcaattgctttccttgaattggtttacgccaattacctatctcgcacttcgcaaaccataaattgtgggaacatctatgttaacgcacaaacacttcgccagcatgctaagaagcaagttgattacattttgggagataacccaatgcgtatgtcctacatggttggctacagcaacaagtatccgcaacatattcaccatcgtggctcctctttaccctctattaaggaccatcctcagttcattgcctgcaaagaaggctcaatctacttcaactcaagcaatcctaatcctaatgttctcgtgggagccattgtgggaggacccggagaagatgatgtgtatgaggatgatagggctgattttaggaagtccgaaccaaccacatacattaatgcaccatttgttgggattttagcatactttgttgccaatcccaacccttga

SEQ ID NO: 1944 - DNA, 738 bp, Glycine Max
atggcacttcttcttctaccttcttcctctctgttaccgaagcttccaattccaacggccatcgccatgcacatgcagctcctcaacaacgaccgcaccgacttcgtcttctccaacctaaccctccccaacggcacgtgccgccacgacccctccgacaaggttctcaacataacggactgcaccgcacactccctcgaatacgacattgcatgcaacaccttccgccccctcttcgtccaaaccggcggctacaacgatggcgaaggcaaaataagatccttcggtccatgcgaaacgcgtgactggcaagaaacaaataatgccctcgtgacctatgataagtgcgcggagaacaatctttatccgtttgtgtttttattttcgccaagaaccgggccattctatcgtacccggagaccctatgtgttatccgcggtcttgcttccgttgaggaatttggaagcggcgagtgttgaggctgcggtggggcccgcaggggccaggattaagattacggatccgaacgccacgtggacggtggagaccatcccgatggggagggtgatgctccccaacggcgacgttttgatcataaacggagctcagttaggtggaggtttgttttgcaaagcgcgtcgatcgagtattcctaggatgtacactcaacggcgattttggttcgttatggaagggttctcgtgggtggtagcaaccctcaccagaaatacaatttaa

SEQ ID NO: 1945 - DNA, 1056 bp, Glycine Max
atggcagaatcaagtgaggtagagatagtgggtaaacctgtccaagatttggttttgaattctgaaaatctgccaaaaacttatatctacgaggaaggtggtgccggatttcgagatgctcttgtgccatcacaggatgagaatattccagtgatcgaccttcatcgcctctcatctccatctactgcactacaagagcttgctaaactccatcatgctctccattcatggggctgctttcaggcaataaaccatgggctgaaaagctcatttttggacaaggtgagagaagtttcaaagcaattctttcatcttccaaaggaagaaaagcaaaaatgggcaagggaaccaaacaatattgaaggatatggcaatgatataatatattcagaaaatcaaaggcttgactggactgacagagtttacctaaaggtgcttcctgaagatgagaggaagttcaaattttggccccaaaacccctatgatttcaggagtattgtcctacagtataccgaaagcatgcgactgctaagtgaagtaattattaaggccatggcaaagtcactgaacttggaagaggattgcttcctaaatgaatgtggagaaagagctgatatgtttctgagattcaactactaccctccatgtccaatgcctgatcatgttctcggtttgaagccacatgcagatggatccaccataacttttctgttgcaagacaaagaagtagaaggcctccaagtcctcaaagatgatcagtggtttaaagttccaatcatccctgatgctctcgtcattaatgttggtgatcaaatagagataatgagcaatggaatttttcggagcccaatacacagggcagtgataaattcagaaaaggaaaggctcacagtggcaatgttctgcctcacggattcagagaaagagattaaaccggtggagaagctagtgaacgagtcaaggccaacgttatacagaccggtgaaaaattattctgagatctatttccagtattaccaacaaggaaaaagacctattgaagcttcaaagatttaa

SEQ ID NO: 1946 - DNA, 564 bp, Glycine Max
atggcagacgagacccagaacaagtatgagagctctgaggttgaggtccaggatcgtggtgtttttgactttctcggtaagaaaaaggatgaagaagacaagcctcatcctcaggaggaggtcatcgccaccgagtttcaaaaagtcactgtctcagaccaaggagagaacaagcacagcctcttagaaaagcttcaccgatctgacagcagctctagctcttcaagtgaggaggaaggagaagatggagagaaaaggaagaagaagaagaaggaaaagaaagggctgaaagagaagatcgaggagaaaatagagggtgatcatcatcatcacaaggatgaggacacaagtgtccctgttgagaaagttgaggttgttgaaacagcacatgctgaggaaaagaaggggttcctcgacaagattaaggagaagctaccagggcacaagaagacagaggaggccacagctactactcctcctccaccaccacctgttgcatcattggagcatggtgaaggtgctcatcatgaaggagaggccaaggagaagaaaggtaataattga

SEQ ID NO: 1947 - DNA, 645 bp, Glycine Max
atggcagacgagacccagaacaagtatgagagctctgaggttgaggtccaggatcgtggtgtttttgactttctcggtaagaaaaaggatgaagaagacaagcctcatcctcaggaggaggtcatcgccaccgagtttcaaaaagtcactgtctcagaccaaggagagaacaagcacagcctcttagaaaagcttcaccgatctgacagcagctctagctcttcaagtgaggaggaaggagaagatggagagaaaaggaagaagaagaagaaggaaaagaaagggctgaaagagaagatcgaggagaaaatagagggtgatcatcatcatcacaaggatgaggacacaagtgtccctgttgagaaagttgaggttgttgaaacagcacatgctgaggaaaagaaggggttcctcgacaagattaaggagaagctaccagggcacaagaagacagaggaggccacagctactactcctcctccaccaccacctgttgcatcattggagcatggtgaaggtgctcatcatgaaggagaggccaaggagaagaaaggtatattagaaaagataaaagagaagcttcctggttatcactccaagacagaggaggaaaaggaaaaggaaaaggagagtggtgctcattga

SEQ ID NO: 1948 - DNA, 891 bp, Glycine Max
atggcagcctcttcattgaaccacaaattccataaccatgctcgttctaatagcttgccctctaagccacaccctctcatcctacaatgcaatgaacgcttatctagactaggggcctatgataccatctcttcttcattgctaaggcaaaatcttactaaccttctagatttgcatgggtgcattgaaaagttggttcaactacccttaactcaacaagcacttgttcaggaatgccaagagaaatgggtggatgatctcttggatggatctctaaggctccttgatgcatgtacggcaaccaaagatgccttacttcacaccaaggagtgcacccgtgagcttcaatcaactataagaagaagaagaggaggtgaagtggaactcacactagaggttaagaaattcttgacctcaaggaaggtggtgcgaaaggccatattcaaagccctggagaatctgaagggtaatgcaaataaaggaaaccttgccatcactaattacaaagactaccaaaccatggcattggtaaacttgttaaaagaagctgaagtgatcactttttccacgtttgagtcattgctgaatttcttttctgggtcaacacaagcaaaacgaattagcagctgggctttggtttcaaagctgatgcacaacaaaagggtaggctacgcacaaggagcagatgagaatgagtttgcaaaagtggatgctgcatttcagttatttgcctttaacatgtcaaccaagtcaaatgatgatatcagtgatttgctaaagaagctagagaacttggggacttgcataccagatcttgaagaaggacttgagtccctgtttaggcgtttgattaaaatcagagttgcacttctcaatatccttaatcactag

SEQ ID NO: 1949 - DNA, 933 bp, Glycine Max
atggcaggggacagcaagagcaagattctgttcatcggagggactggttacatcggaaaattcatcgtggaagccagcgccaaagctggccacccaactttccttttggtgagggagtccactctctccaaccccgcaaaatcacccctcatcgacaatttcaaaggcctcggtgtcaatcttgttttaggagatctatacgatcaccaaagtttggtgagtgctataaagcaggtcgatgtggtaatttctactgtaggacacctgcagctagctgatcaagataagatcatttctgcaattaaagaagcaggaaatgttaagaagttctatccatctgagtttggaaatgatgtggaccggactcatgcagttgaaccagccaagtctgcatttgcaacaaaggccaaagttcgccgagctattgaggctgaaggaattcccttcacttatgtgtcaagcaacttctttgctggttacttcctgcccaacttgtcacagcctggagccacagctgcccccagagacagagttattatcctaggagatggaaaccccaaagctgtttttaacaaggaagaggatattggaacttatacaatcaattctgtggatgatccaagaaccttgaacaaaattctctacattagaccaccagctaataccttgtcgtttaatgagcttgttactctctgggagggaaagattggtaaaactcttgaaagaatctatgttccagaagaacaactcctgaagcaaattgaagagtccgcaccacccgtgaatgtgatcctgtcaattaaccactcttcttatgtaaagggggatcatactaactttgaaattgagtcttcttttggagtggaagcttcagctctatatcctgatgtgaaatacatcactgtggatgagtaccttaatcagtttgtctaa

SEQ ID NO: 1950 - DNA, 771 bp, Glycine Max
atggcaggggacagcaagagcaagattctgttcatcggagggactggttacatcggaaaattcatcgtggaagccagcgccaaagctggccacccaactttccttttggtgagggagtccactctctccaaccccgcaaaatcacccctcatcgacaatttcaaaggcctcggtgtcaatcttgttttaggagatctatacgatcaccaaagtttggtgagtgctataaagcaggtcgatgtggtaatttctactgtaggacacctgcagctagctgatcaagataagatcatttctgcaattaaagaagcaggaaatgttaagaagttctatccatctgagtttggaaatgatgtggaccggactcatgcagttgaaccagccaagtctgcatttgcaacaaaggccaaagttcgccgagctattgaggctgaaggaattcccttcacttatgtgtcaagcaacttctttgctggttacttcctgcccaacttgtcacagcctggagccacagctgcccccagagacagagttattatcctaggagatggaaaccccaaagctgtttttaacaaggaagaggatattggaacttatacaatcaattctgtggatgatccaagaaccttgaacaaaattctctacattagaccaccagctaataccttgtcgtttaatgagcttgttactctctgggagggaaagattggtaaaactcttgaaagaatctatgttccagaagaacaactcctgaagcaaattgaaggttag

SEQ ID NO: 1951 - DNA, 861 bp, Glycine Max
atggcataccaagcgatgcagggtccgagttcgggatcgagttcgagttcggggtttcagttattgaattctccgttcggagacaccacctacaccaaagtcttcgtcggaggattggcctgggagactcagagcgaaaccatgcgccgctacttcgaccagttcggcgagattctcgaggccgtcgtcatcaccgataagaacaccggaagatccaagggctacggtttcgtgactttccgggatcccgaggccgcaaggagagcgtgtgctgatccatctcctgttattgatggcagaagggccaattgtaatttggcttcacttggtcgaccacggccccctctgccttatggacggatcagacctgcctccccttatgttggaagtttgcaaccagctcgtggtgcttatgttgggggttttggctaccagcaaccagtttcctacagctatcaacaaggattggtttaccctccttatgggtatacgtcatacggacctgagtacatctacccacagagtctgtacaacccatatatggggcaacagtaccttcagatatatggagtgcctggggcagtgaatacaacaactatttatccttatggacaagtgggtcaggctattaccagcggtcatggttattcggctatgcagggttatacagtaccaggtcatcagattgtgccctatggtggatccaatgttaatgccataacaacttcacctatgcctgccattcaagcttcatatcctagtggaattgctgcaccagttcctggccaaccacaatttattgttcctgctccttctcctcagtttatgcaaggtagtggtcctgaccaaacagctgggtga

SEQ ID NO: 1952 - DNA, 891 bp, Glycine Max
atggcatcctctcctttgaacccaaaatacagttcccacggtcgctcaaatagcttgccctctagaccacaccctctcattctcaaatgcaatgaacacttggaaagcttaagggcttccaaagcaacctcctcttcctcaacacttcttagacataaggtagaaggcttgcaagatctgattgagtgtgttggaaaattgattcagcttcccctcactcaagatgtccttctccacgagcgtcaagagaattgggtaaatgagcttttggatggatccttaaggctcttagacgtgtgtactgcagccaaagatgctttactacacacaaaagaatgcacacgtgaacttcaatcaaccataagaaggaagaaaggtggtgaagtggagctgacagcagaagtcaagaaattcttgacatctaggaaggtagtgaaaaaggccatctccaaagccttggcaaatttgaacagcacttcaaagagttccaacatctcatctaatacaaacaaagatcaccgaacagtggctttgattagcttattacaagacatggaagtggctacactatcaacatttcagacactgctgcaatttatctcagggtcaacacaatcaaagtcaaacagctggctttcgatttccaagctaattcagcccaagagagtcggttgctcgctagtggcagatgaaagtgaatttgcccaagtggatgcagcattgcagtcctttgtatttaccaagacttgcaaatttgaagacataaacaatctgcaaaaccagttggagaaaatggagtcgtgcattcaagactttgaagaaggacttgagtttctatttaggcgtctgattaaaatcagagtttcccttcttaatgtcttcaaccactag

SEQ ID NO: 1953 - DNA, 885 bp, Glycine Max
atggcatcctctcctttgaacccaaaatctggttcccacggtcgctcaaatagcttgccctctagaccacaccctctcattctcaaatgcaatgaacacttggaaagcttaagggcttccaaagaaacctcctcttcctcaacacttcttagacataaggtagaaggcttgcaagatctgattgagtgtgttgaaaaattgactcagcttcccccttactcaagatgtccttctccacgagtgtcaagagaattgggtaaaagacatggatccttaaggctcttagacgtgtgtactgcggccaaagatgctttactacgcacaaaagaatgcacacgtgaacttcaatcaaccataagaaggaagagaggtggtgaagtggagctgacagcagaagtcaagaaattcttgacatctaggaaggtagtgaaaaaggccatctccaaagccttggcaaatttgaacagcacttcaaagagttccaacatctcatctaatacaaacaaagatcaccgaacagtggctttgattagcttattacaagacatggaagtggctacactatcaacatttcagacactgctgcaatttatctcagggtcaacacaatcaaagtcaaacagctggctttcgatttccaagctaattcagcccaagagagtcggttgctcgctagtggcagatgaaagtgaatttgcccaagtggatgcagcattgcagtcctttgtatttaccaagacttgcaaatttgaagacataaacaatctgcaaaaccagttggagaaaatggagtcgtgcattaaagactttgaagaaggacttgagtttctatttaggtgtctgattaaaatcagggtttcccttcttgatatccttaaccactag

SEQ ID NO: 1954 - DNA, 651 bp, Glycine Max
atggccaaaccgaaggctccaagacgaaccctagagtcatactcagtcaaacacataagcaaaaccattagagctggcgattgcgtgctcatgcggccctccgatctgtcgaaaccgtcgtacgtggcgaggatcgagcggatcgaagccgacgcgcgcggctccaacgtgaagattcacgtccggtggtactaccggccggaggagtcaatcggcggccgccgccagtttcatggctccaaggaggttttcctctccgatcacttcgatgttcagagcgccgacacaatcgaagccaagtgtacggtccacagcttcaagagctacacgaagctcgatgctgtcggaaacgacgatttcttctgtcgttttgagtacaattcctccaccggcgccttcaatcctgatagagttgctgtgtattgtaaatgtgagatgccttacaaccctgatgacctaatggtccaatgtgagggctgcactgactggttccatcctgcatgtatagacatgactgtggaagaagccaaaagacttgaccacttcttttgtgaaaattgctctgctgaaggtcaaaaaaagttgcaaaactctcattctgcttctagacactcagatacaaaggtggatactaaacgccgtcgtaggtaa

SEQ ID NO: 1955 - DNA, 1356 bp, Glycine Max
atggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgattctatgctgggaacctttaaggcagatgtgaaaatactagacaatgaaaccatcactgttgatggtaagtccatcaaggttgtttcaagcagggaccctcttaagcttccatgggctgagcttggaattgacattgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaagatcctggatgcagagtttggaattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacagccaaagagtggtcgatttggcacatctagtagcaagcaagtggccaggggcacctaaagcggggagtggagacccattggaggatttctgcgagacaaaccctgctgatgaggaatgcaaagtttatgaatag

SEQ ID NO: 1956 - DNA, 1239 bp, Glycine Max
atggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgattctatgctgggaacctttaaggcagatgtgaaaatactagacaatgaaaccatcactgttgatggtaagtccatcaaggttgtttcaagcagggaccctcttaagcttccatgggctgagcttggaattgacattgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaagatcctggatgcagagtttggaattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacaggttagttggaacatga

SEQ ID NO: 1957 - DNA, 1455 bp, Glycine Max
atggccaccgccgccaccgaacctctcccttccaccaccgaaacgcctccggcaccgcctccaccgaagcaacccccgcctcccgcgccgcaacctccggcggcggcggcggcggcggcagtgaagccggaggctccattgcccgattcgaaaacttcggcggaggcgaacgtaatcgtggtgccgagctactctcggtggttctcgtgggattcgattgacgaatgcgaggcgcgtcacctccctgagttcttcgaatcggcgtccaagagccctagggtttacaagtactacaggaactccatcgtgaagtacttcaggtacaatcccacccgcaaaatcaccttcaccgatgtccgcaaaaccctcgtcggagacgtcggttccatccgcagagtcttcgatttcctcgaaacttggggtctcatcaattaccacccctcttcgtcgctcaccaaacccttgaagtgggacgacaaagagaccaaatccgattctgcatccaactccaccgaatcttcttccgctcccgtcaaagaaaacactaagagactctgcagtggctgcaaagtcgtttgtaccattgcttgttttgcctgtgacaagtatgatttgacactttgtgcgaggtgttatgttcgtggcaattatcgagttggtgtgaactcttcggattttaggcgagtggagataagtgaggagacaaagacggattggagtgaaaaggagatcacgaatcttctggaagctatttcgcattacggtgatgattggaagagggtttctcagcatgttcctggcagaactgagaaggagtgtgttgctcattttctgaagcttccttttgcgaatcaattccagcattatcaacaacaccctgctgtcaatggcacagatgacggttgtaatctgttaaagatggtaactaatgctgatgctgaatctgaattggatactgttgcctctgctgaacccagtaagagaatgcgtctcacgcctcttgcagatgcaagcaatcccattatggctcaggctgctttcctgtctgctttggctgggtcagaggttgcacaagctgctgctcaagctgcattgacaactctgtctgaggtttacaaagcaactaaaataaattatcgggcgtttccaaggaatacattgctgcaagatgctggtatcacgtctaacggtggtaatacttcagattcatttcaaggatctcgattgcatgcaaacatacagcttgagaaggaagagttagatgtggaaaaagcaatttctgagattatagaagttcagatgaaaaatatccaagataagcttgttcattttgaagatttggacctgctgatggaaaaagaaggccagcagatggagcaaatgaaaaatatgtttttccttgatcagcttactcttttatttcataaatcatctgcaccaaaaactggagaatga

SEQ ID NO: 1958 - DNA, 1419 bp, Glycine Max
atggccaccgccgccaccgaacctctcccttccaccaccgaaacgcctccggcaccgcctccaccgaagcaacccccgcctcccgcgccgcaacctccggcggcggcggcggcggcggcagtgaagccggaggctccattgcccgattcgaaaacttcggcggaggcgaacgtaatcgtggtgccgagctactctcggtggttctcgtgggattcgattgacgaatgcgaggcgcgtcacctccctgagttcttcgaatcggcgtccaagagccctagggtttacaagtactacaggaactccatcgtgaagtacttcaggtacaatcccacccgcaaaatcaccttcaccgatgtccgcaaaaccctcgtcggagacgtcggttccatccgcagagtcttcgatttcctcgaaacttggggtctcatcaattaccacccctcttcgtcgctcaccaaacccttgaagtgggacgacaaagagaccaaatccgattctgcatccaactccaccgaatcttcttccgctcccgtcaaagaaaacactaagagactctgcagtggctgcaaagtcgtttgtaccattgcttgttttgcctgtgacaagtatgatttgacactttgtgcgaggtgttatgttcgtggcaattatcgagttggtgtgaactcttcggattttaggcgagtggagataagtgaggagacaaagacggattggagtgaaaaggagatcacgaatcttctggaagctatttcgcattacggtgatgattggaagagggtttctcagcatgttcctggcagaactgagaaggagtgtgttgctcattttctgaagcttccttttgcgaatcaattccagcattatcaacaacaccctgctgtcaatggcacagatgacggttgtaatctgttaaagatggtaactaatgctgatgctgaatctgaattggatactgttgcctctgctgaacccagtaagagaatgcgtctcacgcctcttgcagatgcaagcaatcccattatggctcaggctgctttcctgtctgctttggctgggtcagaggttgcacaagctgctgctcaagctgcattgacaactctgtctgaggtttacaaagcaactaaaataaattatcgggcgtttccaaggaatacattgctgcaagattcatttcaaggatctcgattgcatgcaaacatacagcttgagaaggaagagttagatgtggaaaaagcaatttctgagattatagaagttcagatgaaaaatatccaagataagcttgttcattttgaagatttggacctgctgatggaaaaagaaggccagcagatggagcaaatgaaaaatatgtttttccttgatcagcttactcttttatttcataaatcatctgcaccaaaaactggagaatga

SEQ ID NO: 1959 - DNA, 498 bp, Glycine Max
atggccaccgtcacttctgcagccgttgctattccctcattcactggcctcaaggcaagcgcaggcaaagtgagtgccgcagttaaagtctcagctccccaagccacaaggttgggcatcaaggcttcgctgaaagacgttggagtcgctgttgtggccactgccgcgagtgcagtgctggctagcaacgccatggccattgaagtgttgctgggtggtgatgacgggtctctggctttcgttcccaacaatttctccgtggcctctggggagaagatcgtgttcaagaacaacgcaggtttcccccacaacgttgtgttcgacgaggacgagattcctagcggcgtggatgcagggaaaatctccatgagcgatgaagaccttctcaatgcgcctggtgagacttacagcgttactttggatgctaagggaacctacagtttcttctgttcgcctcaccaaggagctggtatggtgggaaaagtcactgttaattaa

SEQ ID NO: 1960 - DNA, 354 bp, Glycine Max
atggccgaagagggacaagtgattggtgtccacagcgtggaggagtgggaggaacatctcaagaagggacaagagtccaagaaattgattgtggtggattttactgcttcttggtgcggcccatgccgtttcattgccccaattcttgcggatatggctaaaaagttgccgaatgtcaccttcctcaaggtggatgtggatgaattggcgactgtttccagggagtgggaagttgaggctatgccaaccttcctattcttgaaagaaggcaagctggtgaagaagcttgtgggtgccaggaaagaggagctgcaagacataatagtcaaacttgctgcaattgatgctgcctga

SEQ ID NO: 1961 - DNA, 450 bp, Glycine Max
atggcctcatcaagtggaaactcctctattagcacaaaatctcagagctcagggtctgagggtgatttgcaggtcgtgataacagacgagaggaagaacaagaggaagcaatcgaatcgtgaatcggcgagaagatctcggatgcgaaagcgtaaccacttggaccaactcactaagcagctctcacagctcgcaaagaacaacggcgaaatcctcgccaccatagacatcaccacgcagcactatctgaacgttgaggcagagaattccattctaagggcccaaatgggtgagcttagccaacggctccaatcgctcaacgacatcgtccacgacatcatcatcaacacaaccaccacctacgaaagggactgttatctaacaagcgcacaaaatttcaccaccaccacctacacgctctgtcttaaccaacccgtttttcagtggtga

SEQ ID NO: 1962 - DNA, 555 bp, Glycine Max
atggcctcatggccacccaaacctacagagattttttgtgtgcatgcgagggagaaagcgatggcctcatcgccatgtgattgctggccccatctctctcctccttcttccattgagcatgtctggaacgacatcaaactcgactctctctccaattcccctgttgacatagacttcaacaacaaccactctgtctctgattcttcttttcttaacctcacttccacttcctcttctgtctttcacaaacatgaccatgaccactctcttctttctgtctccaacacttccttcgaagcctccggctctaagaaaaccaccctgctagatcaacgccatgcgcgtataataaaaaatcgagaatccgcggttcggtccagagctagaaaacaggcttatagaaaaggcttggaagttgaaattgcccgtttaacggaagagaattccagactaaaaagacaattgaaagagttgcagtgctgcttgtcctcctctgataaccctcccactcccagaatggccgctctgtgtagaacctcatcatctccattttga

SEQ ID NO: 1963 - DNA, 216 bp, Glycine Max
atggcctccagcactttgagcaaacaaaagccttatgattcgtgttggaccccaaaacagaacaaggtgtttgaaaaggcacttgcaaagtatgacaaggatacccctgaccgctggcacaatgtagccaaagcaattggtggtaaatcagaagatgatgttaagagacactatcagatactcttggaggatctcaggcacattgagtctggccat

SEQ ID NO: 1964 - DNA, 1023 bp, Glycine Max
atggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgacgagctcgtcaaaaccgccaaaacagtggcctcaccggggcgtggtattttggcgatggatgagtcaaatgcaacctgcgggaagcgtttggcatctattgggttagagaacacagaagctaatcggcaggcataccgtaccctacttgtgacagtacctggtcttggtgaatacatctctggtgccattctctttgaggaaactctctaccaatccactgtcgatggaaggaagatcgtcgacgtacttgttgaccaaaacattgttcccggtatcaaggtcgacaagggtttggtgcccctagctggttcgaacgatgagtcatggtgccaaggtcttgatggtcttgcgtctcgctcagctgcatactaccagcaaggtgcccgtttcgccaaatggcgtactgttgtgagcatccccaacggtccctctgctctggcagtgaaggaagctgcctggggtctagctcgctatgctgcaatttcacaggagaacgggttggtcccaattgtggagccagagatcttgcttgatggtgagcatgggattgacaggacattcgaagtagcccaaaaggtgtggtcagaggtattcttctacctggctgagaacaatgtcctgttggaaggtattctcctcaagcctagcatggttactccaggagccgagtccaaggacaaggccactcctctgcaagttgctgattacaccctcaagctccttcacaggagaatcccacctgctgtccctggaatcatggtacgtaagacattccttgttactgcaaacaaacaattaaccatggtaatgaccaaagttgttgtgttgtgcagtttctgtctggcggacaatctgaggttgaagcaaccttga

SEQ ID NO: 1965 - DNA, 1188 bp, Glycine Max
atggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgacgagctcgtcaaaaccgccaaaacagtggcctcaccggggcgtggtattttggcgatggatgagtcaaatgcaacctgcgggaagcgtttggcatctattgggttagagaacacagaagctaatcggcaggcataccgtaccctacttgtgacagtacctggtcttggtgaatacatctctggtgccattctctttgaggaaactctctaccaatccactgtcgatggaaggaagatcgtcgacgtacttgttgaccaaaacattgttcccggtatcaaggtcgacaagggtttggtgcccctagctggttcgaacgatgagtcatggtgccaaggtcttgatggtcttgcgtctcgctcagctgcatactaccagcaaggtgcccgtttcgccaaatggcgtactgttgtgagcatccccaacggtccctctgctctggcagtgaaggaagctgcctggggtctagctcgctatgctgcaatttcacaggagaacgggttggtcccaattgtggagccagagatcttgcttgatggtgagcatgggattgacaggacattcgaagtagcccaaaaggtgtggtcagaggtattcttctacctggctgagaacaatgtcctgttggaaggtattctcctcaagcctagcatggttactccaggagccgagtccaaggacaaggccactcctctgcaagttgctgattacaccctcaagctccttcacaggagaatcccacctgctgtccctggaatcatgtttctgtctggcggacaatctgaggttgaagcaaccttgaacttgaatgctatgaaccagtctccaaacccatggcacgtgtccttctcctacgccagagctctccaaaacacctgcttgaagacatggggtggactccctgagaacgtgaaggctgctcaagatgcactccttttccgtgccaagtccaactcactcgctcagcttggaaagtacactgccgagggtgaatctgaggaagccactcggggaatgttcgtcaaaggttactcctactaa

SEQ ID NO: 1966 - DNA, 1086 bp, Glycine Max
atggcctctgtttggacactgcactttcgctcgctttctcttcgtccatgcctctacattagtcgcagtaacagtagcactgccactagaaattgcattagcatcagaaatggaatctccaattggcgctctggcacccaacaactcaaacacgattccatcaattccattaccaaatttcaccatcaactcgttaattccgtcgccattcctccctttctgttgaatcgaaacggtggaggcaattttcctatttgggtatgtgttgcggttgtggttttggttgtagcggtgagagtgagggtagtttccagaaaaaaggagcgtcctggttccgtggctgatctagtaagacgtggccaacttagatctgatagaagaggcatttcgaggcctctcaagtatgaagaccccttcaataatcccttcgtcaaggttggtaaaagtgactcaactgttgagatgtgcggaaaggtttaccgtttagcccctgttactcttactcaagagcaacaggctactcaccagaagaggagattgcgggcctaccagtggaagcgacccaccatcttccttagagaaggggacttggttcctccggatgttgatcctgacactgtcaggtggattccagctaatcatccctttgctaccactgccactgatttggatgaggacttggcacaaaacaatgtgtatcaaaagcatggagttccttttcggattcaagccgaacacgaggccctgcagaaaaagctcgaagccctacaaaatgaccagaaactgaataaactagtgatagatcctatcaatgctaaagaatttgagaggccattcaactcccacgccagattaaatgatcaagcagataagagctctgtaaacaatcaggagcagaaacacaataaactagtgatagatcctattgatgctaaagaaattgagagaccattcaactccgacaccagattaaatgatcaagccgaaaagagctctgtaaacaatcaggcgagtgcttctgactccccaagagtagatagtggcccaaatcactttgatagtacatcatcagaagattcaagttaa

SEQ ID NO: 1967 - DNA, 2085 bp, Glycine Max
atggccttgggcaccagcgccttgatcggaaggaatgttcttgtctcacccccaacccccaaaacaaccaaatcatctactccgctacaattccttttcaagagaagcatcttaaatgctcacaattcacaagctgctctagctgcccttatcttttcctccgcgagcctctctgtgaccccacaagcccttgccgctgataacgtcacccctccccctgtaattgaagcccaacagagccaattaaacccctccaactcatcctcccctttctcacagaacctcctcctcacagctccaaagccacaagcctcctccgacctccccgaaggcaccaactggcgctacagcgagttcttgaacgccgtcaagaagggtaaagtcgagcgagtcaggttcagcaaagacggttccgccctccagctaaccgccattgacggccgtcgcgcctccgttattgtccccaatgacccggacctcatcgacatcctcgccatgaacggcgtcgacatttccgtcgccgagggcgaatcccccaacagcttgttcaacatcataggcaacttgctcttccccttactcgcattcgcgggcctgttcttcctcttccgcagagcccaaggcgggcccggcgggcctggcgggctgggagggcccatggacttcgggcggaacaagtccaagttccaggaagtccccgagaccggcgtgagcttcgctgacgtggcaggcgcggaccaagcgaagcttgaattacaagaggttgttgatttcttgaagaatcccgataagtacaccgcgctgggcgcgaagattccgaaagggtgtcttttggtgggcccaccgggaaccggaaagacccttctggcgagggctgtggcgggggaagctggggtgccgtttttctcgtgcgcggcttcggagttcgttgaactttttgtgggagttggtgcgtcgagggtgagagatttgtttgagaaggcgaaggggaaggcgccgtgcattgttttcattgatgagattgacgccgttgggaggcagagaggggcggggctcggaggtgggaatgacgagagggaacagactattaaccagcttctgacggagatggatggcttttctggcaattctggtgttattgttttggctgccactaacagaccggatgttcttgattcggcgttgttgaggcctggccggttcgacaggcaagttactgtggatagacctgatgttgccggcagagttaaaattcttcaggtgcattctagaggaaaagcacttgcaaaggatgttgactttgaaaaaattgcaaggagaacccctggattcactggggctgatctgcagaatctgatgaatgaagcggctattcttgcagccaggcgtgacctcaaggaaataagtaaagatgagatatctgatgcgcttgaaaggatcatagctggacctgagaagaaaaatgctgttgtctcagatgagaagaagaaattagtagcctatcatgaggctggccatgctctagtgggtgctttaatgccagaatatgaccctgtagccaagatatcaattattcctcgtggccaagctggtggtctcacattttttgctcccagcgaagagaggctcgagtctggattgtacagtagaagttaccttgaaaatcagatggctgttgccctgggtggaagggttgccgaagaggttatttttggccaggaaaatgtcaccaccggagcatcaaacgacttcatgcaagtttcacgagtggcaaggcagatggttgagagatttggattcagcaaaaaaattggacaagttgccattggtggacctggtggaaatccattcttgggtcaacagatgtcatcgcaaaaggattactccatggcaactgcggatgtagtggatgcggaagtgagggaactggtagagagagcatattctagggcaacacatattatctcaactcacattgatatccttcacaagcttgctcaacttctcatagaaaaagaaactgtggatggtgaagagttcatgagtctattcattgatggaaaagccgaattatatgttgcataa

SEQ ID NO: 1968 - DNA, 870 bp, Glycine Max
atggcgaaaggaaagcattcgcatacccgcgcacaagggaagaagtggtcaacgttctcgctggttctgtgggcgcttttcttcctcacactcatcctcgtcgtgctccttgctctcggcattgtttatcttccaaccaccgacgacgattttccaaccacggagctcagcgccttcaggcgcaagacctctcaaagtggcgagagtttggtggaaaactcggagcagtggaccgagattctctcctgggagccaagagcgttcatctatcacaattttctgtctaaagaagaatgtgagtacttgattgaacttgccaaacctcatatggtaaaatcaagtgttgttgatagcaagactgggaagagtacagaaagcagggttcgaaccagttcaggaatgttcttgaagagaggaagggacaaaatcatccagaatatagagaaaagaattgctgactttaccttcatacctgtagagaatggagaaggacttcaaatccttcactatgaagcaggacaaaaatatgagcctcactatgattacttccttgatgagttcaacactaagaatggaggccaacgtattgctacagttcttatgtacctttcagatgttgaagaaggcggtgagactgtatttcctgctgccaatgcaaattttagttctgtgccttggtggaatgatttatcccaatgtgcaagaaagggtctctcagtgaaaccaaaaatgggtgatgctctgctattttggagcatgaggcctgatgccactctagatccatctagtttacatggcggttgcccagtaattaaaggaaataaatggtcttcaacaaagtggctgcatcttcatgagtacaaggtttga

SEQ ID NO: 1969 - DNA, 1365 bp, Glycine Max
atggcgaagcattcggtggcaatggcgaagaagcggtggctgataatgttggcggcattcctgtccgtctcaacagtgacggtgctcttaatgagatccaacaactccgattcctgcaacaccaaccattttactattgcacaagataataaccagattcgttcccctgtccaactcactaatgccgcttccagcccccttaatttcatgaagtccaagctagttctcatggtttcgcacgagctttctctttcaggagggcctttgcttctgatggagttggcgtttctgttgagaggcgttggttccgatgtcgtttggatcactaatcagaaaccttcggaacatgatcaggttatttacagtttggaaagcaagatgttagacagaggagtgcaggtcctgtctgccaaaggtgaaaaggctatagatacagctctcaaagcagatatggtcattctaaatactgctgtagctgggaagtggctggatgccgttctcaaggaaaaagttgcccatgttcttccaaaggttttatggtggattcatgaaatgcgagggcattatttcaaagtggaatatgttaagcacctcccttttgttgcaggtgccatgattgattcacatacaactgcagagattaaaatgcctgaaacttttgttgtacatcttggaaatagcaaggagcttatggaagttgcagaagatagtgtggcaaagagagttcttcgtgagcatgttcgggaatctcttggagtgagaaatgatgatctactttttgccatcataaatagtgtttctcgtggtaaagggcaggatctatttcttcactccttttatgaaagtttgcaactcattcaggagaagaaactccagttgccatctttgcatgctgtggtagtagggagtgatatgaatgctcagacgaagtttgaaatggaacttcgcaaatttgttgttgaaaaaaagattcagaatcatgttcactttgttaacaaaaccctggctgtggctccttacctggctgctgttgatgttcttgttcagaattctcaggcacggggagaatgttttggaaggataaccattgaagcaatggcatttcggctgcctgtactgggaactgctgctggaggcacgatggagattgtggtgaatgggacaaccggtttgctgcatcctgttgggaaagaaggcgtgacacctctcgcggagaacattgtgaaattggctagtcatgttgagaagaggctaacaatgggaaagaaagggtatgaaagagtgaaggagaggtttctggagcaccatatgtcgcagagaattgcattggttctgaaggaagttttacagaaggctaggcaatag

SEQ ID NO: 1970 - DNA, 1116 bp, Glycine Max
atggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaa

SEQ ID NO: 1971 - DNA, 303 bp, Glycine Max
atggcgagtagctggagaagaacgtttggcaacatgaggtccttcgtaagcaattcgatgggtggtctcaggggcggaagcaaccttgcttcttgggtcgtcgccggaaccctagcttacttcctctggatcaaaccctcccaagacctcaagcgtgaacagcaggagaaggccgctcttgccgccgccgagtctgatccttatcgttacgttgagactcgtaaacccattcccgatcctcaggttacgggtttgatatatggaaacaagaacaaggacaaaccaaccaaaccagaggattga

SEQ ID NO: 1972 - DNA, 303 bp, Glycine Max; identical to SEQ ID NO: 1971

SEQ ID NO: 1973 - DNA, 303 bp, Glycine Max; identical to SEQ ID NO: 1971

SEQ ID NO: 1974 - DNA, 303 bp, Glycine Max; identical to SEQ ID NO: 1971

SEQ ID NO: 1975 - DNA, 927 bp, Glycine Max
atggcgagtgcatcagagttcgacccagcgcttgcgctttctcacaaattccctgatactacgtactcttataccgaaagggatgcagcactttatgccctaggcgttggggtgtgtttgtcagacgctgttgacggtgttgagcttaaatatgtctaccatgaaaatggtcaggggtctatcaaggtcttgcctacgtttgctactctacttgtacttagatctggggcgagtggttataatctcccaggtttggaatatgatccacgccttctacttcatggacaacagtacatagaattatacaaaccacttccttcaagctgtcatatacacaatatagtaagccttgccggattacatgataaaggtaaagcagcaattttggagattgaaacaaaaagctacgagaaagaatctggtgatttattgtgcatgaacaggacaactgtctttctccgtggtgctggtggcttctcaaaatcatctaagccattttcttatacaaattaccctatgaatcagaatccagctgtgaaaattcctgaaagtaaacctttttcagtgtttgaggatcgtacccaaccatctcaggcattgctctataggctatctggtgattacaatcctctgcattcagatcccatggttgcaaaggttgctggattctcgcagccaatattgcatggtctgtgcacattaggatttgcagttagggcaatcatcaaatgcatatgcagaggagatccagacttgataaaaagcgtagcgggcagatttcttctacatgtctaccccggtgaaactctagttactgagatgtggcttgaaggctcaagggtaatatatcggactaaggtgaaagagcgaaagcggacagttctttctggctacgttggtctgcgtggtttgacttcgtcactgtga

SEQ ID NO: 1976 - DNA, 1164 bp, Glycine Max
atggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcatag

SEQ ID NO: 1977 - DNA, 1164 bp, Glycine Max; identical to SEQ ID NO: 1976

SEQ ID NO: 1978 - DNA, 3186 bp, Glycine Max
atggcgggacccaacatggatcagttcgaagcgtttttcaggagagcagatttggacggagatggcagaatcagtggagccgaagccgtctcattctttcagggatccaatttgcccaaacaagtcctcgctcaggtgtgggcgtatgctgatcaggccaaaacgggtttccttgggcgcgcggagttttttaatgctctaaggttagtcactgtggctcagagtaagcgagatttaacgcctgatattgtgaaggcagctttgtatggtcctgctgctgctaaaatccctgccccacagattaatcttgctgctgtgcctcaaccacgcccgaattcgatgcccggtgctgggtctgtcgggcagatgggtgttaccgcacccaatttggctcaaagttttccctatagaggacaagggttggcaggtcctggtgcaaacccgcaatattatccttcgcagcagcatcctggcatgagacctcctcaatccatgcctgctggtggcggtctgcgtccacaacagggtgttgcaggtccagatatttctagaggagttaacatagctggtcacaatttctcaaatcctggcgtcgtctcgaatgattggaataatgtaaggcctggtatggttgctaccagacctgctggactgaccccatcagctgcattaccgtcatcaacatctccaatctcaccaatgccgcagtcatctccaatctcaccaatgccccagtctacaactgttaacactaaagcattaggtgtatctggaaatgggttctcctccaattcagttttgggcaatgattttttctctgctgcctcattgacaccgaaacaagaacctgctggactgagttactctgtcagcaatgtctcatcagccattgttcctgtttccactgctccccaacctgcaattaagcaaaattctcttgactcattgcagagtgcatattcttcaatgctgcctgcaaatagtcagtttcagcgggcacaatctgcaccaaacataagccaacaaatttcaccaccagcttcttcttctccaaatacaccatctgggcttggaaatgcaaattctgacaattcacatctttcttggccaaaaatgaaacctactgatgtgcagaagtatacaaaggtgtttatggaagttgacaccgacagggatgggaaaatcactggggagcaggcacgcagtctatttttaagctggagattacccatagatgtcttaaagaaggtgtgggacttgtctgatcaggataatgatagcatgctttctttgaaggagttttgctttgctctttatttgatggaacgttacagggaaggtcgtcctcttccagagtctcttccaagcaatgttttgtttgacgagacactgatgtcaatgataggccaaccaaaaattgcttatggaaatgcaggctggggtattggccaaggttttcagcagcaacaagggattccaggtgctcggccagtggcaccaacagctggtttgaggccaccagttcagggaagttctgcccaggctgatggcactcaacagcccaatcagcaaaagtcaggaacacctgtgttggacgattcctttttgaatcgtgcagaaaatggtgagcagaatatattgaattcaaagcctcaagaggcaacaactgcggagaaaaagtttgaagaaactcagaatgtgattttggattcaaaagagaagcttgagttataccgcaacaaaatgcaggaactggttctatataaaagcagatgcgataatcgactaaatgagattacggaaagggcatctgcggataagcgtgaggcagaatcattgggcaagaaatatgaagagaaatacaaacaagtagcagaaatagtatcaaaattgaccgttgaagaagctaaatttcgtgatatacaggataggaaggtggagttgcagcaagcaattgtcaaaatggtacaaggaggcagtgcagatggtatccttcaggtccgtgctgaacgcatacagtcagatctcgaggagttatttaaggctctagccgaacggtgcaagaaacatgggctagatgtgaagtcaattacaatggttcagcttcctgctggttggcaacctggaattccagagggagcagctctttgggatgaagattgggataaatttgaggatgaaggatttgctaatgatctcacttatacatcttcaaaaccgaagtcggcatttattgatggagaacaaaatttatctgatgataattctgttcatggttcacctgtgaatgcaaatgggaagcaagaaaattctgctaatggtgattatacagttgaggatgaatcctatgcacacagtgaagatgacctggcaagaatcccccatagtctagctgggaggagtacggtggagagtccttctcaagacttttcaaattctcattttggaaaaagttttgaagcagatgcagaaacacacagaagttttgatgaatcaacctggggtgcatttgacaacaacgatgatgtggactcagtgtggggttttaacaccaagaccaaggactctgacttcgagcagagagatttctttaaatctgatgattttggtataaacccagttagaacaggatctacacatacagatggcacgttccagacgaaaagcccatttgcttttgatgattcagtgcctgcaactccagtttccaaatttgcttttgatgattcagtgcctgcaactccagtttccaagttcgaaaactctccaaggtacagtgaggcaggggatcacttctttgacatgtcaaggtttgattccttcaggcacgaaagtggatattctccacaaccagagaggctcacgagatttgattcaataagtagcagcaaggattttggctacaataatcataaattcacaaggtttgactccataagtagcagcaaggattttggctccaatcctgagacgctcacaaggtttgattccatgagtagcagcaacgattttggctttggtcgtcagggacatgcaaggtttgactcaattagtagcaccaaggacttcggtcacagtggtccattctcttttgatgactctgatccattcggctcctctggcccttttaaggtctcttctgaaaatcattctccgaagaaagctagaagaaaagctggacggtaa

SEQ ID NO: 1979 - DNA, 3189 bp, Glycine Max
atggcgggacccaacatggatcagttcgaagcgtttttcaggagagcagatttggacggagatggcagaatcagtggagccgaagccgtctcattctttcagggatccaatttgcccaaacaagtcctcgctcaggtgtgggcgtatgctgatcaggccaaaacgggtttccttgggcgcgcggagttttttaatgctctaaggttagtcactgtggctcagagtaagcgagatttaacgcctgatattgtgaaggcagctttgtatggtcctgctgctgctaaaatccctgccccacagattaatcttgctgctgtgcctcaaccacgcccgaattcgatgcccggtgctgggtctgtcgggcagatgggtgttaccgcacccaatttggctcaaagttttccctatagaggacaagggttggcaggtcctggtgcaaacccgcaatattatccttcgcagcagcatcctggcatgagacctcctcaatccatgcctgctggtggcggtctgcgtccacaacagggtgttgcaggtccagatatttctagaggagttaacatagctggtcacaatttctcaaatcctggcgtcgtctcgaatgattggaataatgtaaggcctggtatggttgctaccagacctgctggactgaccccatcagctgcattaccgtcatcaacatctccaatctcaccaatgccgcagtcatctccaatctcaccaatgccccagtctacaactgttaacactaaagcattaggtgtatctggaaatgggttctcctccaattcagttttgggcaatgattttttctctgctgcctcattgacaccgaaacaagaacctgctggactgagttactctgtcagcaatgtctcatcagccattgttcctgtttccactgctccccaacctgcaattaagcaaaattctcttgactcattgcagagtgcatattcttcaatgctgcctgcaaatagtcagtttcagcgggcacaatctgcaccaaacataagccaacaaatttcaccaccagcttcttcttctccaaatacaccatctgggcttggaaatgcaaattctgacaattcacatctttcttggccaaaaatgaaacctactgatgtgcagaagtatacaaaggtgtttatggaagttgacaccgacagggatgggaaaatcactggggagcaggcacgcagtctatttttaagctggagattacccatagatgtcttaaagaaggtgtgggacttgtctgatcaggataatgatagcatgctttctttgaaggagttttgctttgctctttatttgatggaacgttacagggaaggtcgtcctcttccagagtctcttccaagcaatgttttgtttgacgagacactgatgtcaatgataggccaaccaaaaattgcttatggaaatgcaggctggggtattggccaaggttttcagcagcaacaagggattccaggtgctcggccagtggcaccaacagctggtttgaggccaccagttcagggaagttctgcccaggctgatggcactcaacagcccaatcagcaaaagtcaggaacacctgtgttggacgattcctttttgaatcgtgcagaaaatggtgagcagaatatattgaattcaaagcctcaagaggcaacaactgcggagaaaaagtttgaagaaactcagaatgtgattttggattcaaaagagaagcttgagttataccgcaacaaaatgcaggaactggttctatataaaagcagatgcgataatcgactaaatgagattacggaaagggcatctgcggataagcgtgaggcagaatcattgggcaagaaatatgaagagaaatacaaacaagtagcagaaatagtatcaaaattgaccgttgaagaagctaaatttcgtgatatacaggataggaaggtggagttgcagcaagcaattgtcaaaatggtacaaggaggcagtgcagatggtatccttcaggtccgtgctgaacgcatacagtcagatctcgaggagttatttaaggctctagccgaacggtgcaagaaacatgggctagatgtgaagtcaattacaatggttcagcttcctgctggttggcaacctggaattccagagggagcagctctttgggatgaagattgggataaatttgaggatgaaggatttgctaatgatctcacttatacatcttcaaaaccgaagtcggcatttattgatggagaacaaaatttatctgatgataattctgttcatggttcacctgtgaatgcaaatgggaagcaagaaaattctgctaatggtgattatacagttgaggatgaatcctatgcacacagtgaagatgacctggcaagaatcccccatagtctagctgggaggagtacggtggagagtccttctcaagacttttcaaattctcattttggaaaaagttttgaagcagatgcagaaacacacagaagttttgatgaatcaacctggggtgcatttgacaacaacgatgatgtggactcagtgtggggttttaacaccaagaccaaggactctgacttcgagcagagagatttctttaaatctgatgattttggtataaacccagttagaacaggatctacacatacagatggcacgttccagacgaaaagcccatttgcttttgatgattcagtgcctgcaactccagtttccaaatttgcttttgatgattcagtgcctgcaactccagtttccaagttcgaaaactctccaaggtacagtgaggcaggggatcacttctttgacatgtcaaggtttgattccttcaggcacgaaagtggatattctccacaaccagagaggctcacgagatttgattcaataagtagcagcaaggattttggctacaataatcataaattcacaaggtttgactccataagtagcagcaaggattttggctccaatcctgagacgctcacaaggtttgattccatgagtagcagcaacgattttggctttggtcgtcagggacatgcaaggtttgactcaattagtagcaccaaggacttcggtcacagtggtccattctcttttgatgactctgatccattcggctcctctggcccttttaaggtctcttctgaaaatcattctccgaagaaaggttcagataactggagtgcattctag

SEQ ID NO: 1980 - DNA, 1407 bp, Glycine Max
atggcgggaggaggagaaggaggtgacaccaggcagctagatctcacacctacatgggccgtcgctgcggtttgtgcaattatcgttatcatttctatactcttggaaaaaattatacacaaattcgcaaagatgtttgaagagagaaagcagcatgcattgctagaagctcttgaaaagattaaagccgagcttatggttttgggatttatttctttgctcttaacatttggccaaaattacatttctaaaatgtgtattccctccaagtatgcgaaaacaatgctcccctgtgtcccccctgaagaacgtcatggagctggacatcacacagaggaggcgggtggtggtgaggccaaagatggtggccatcgccgcaggcttttatcgtatgaacgtcagaccttagtagtttgtgaaaagctcatgctattgaatgttggttgttgccataacaatgacgcttggaagagcaaaggttggttgattcgtggatggaaggcatgggaagcagaccatatcgtggatcaagatgccttgaatgatcctagaagattcagacttactcatgagacatcatttgtgagggatcacaacagtatctggactaaaacaccagtttcgttctatcttgtatgcttttttcgacaatttttcagatctgttcgtagggccgactacttgaccatgagacatggatttgtgactgttcatttagcaccgggaagtaagtttgattttcaaaaatatatcaagaggtcattagaagatgactttaaggtagttgtaggaatcagtccattactttggggatcagtggtgttattcttgcttgtgaatgtccatggatggcatgctgctttctgggtgtcttttcttccactactggtgattctggccgttggaacaaagcttcaaggaattataactcgaatggcacttgacatatcagaaaggcatgctgtagtgcaagggatccctcttgtgcaagtctctgacaagtatttttggtttgcatggcctcagttagttctttatctcatccattatgtcctctttcagtatgagtttggttgggcatcttgcttctacgaggatgatagtctcatgattgtcagagtagctctcgggttaggagctcaagtggtttgcagttatgtgacacttccactctatgcgcttgttactcagatgggatccacgatgaagaagtcaatatttgatgagcaaacatccaaggcactgaaacagtggcataagaatgctctaaagaagaaaccatccaagggacgcaccgaaactcaaacgttagccggagatacagaaatggctgagcagagcgccaccatagtcaccgccgtggatcacgaaccctacgataaccgcgacctactaagtgggccgtga

SEQ ID NO: 1981 - DNA, 735 bp, Glycine Max
atggcgtccatttcgcggttctgttgtgtgcatatgcgagcgtctctatgcaacttcacagcccagaaaggtccatcacctcccacaaccttggacttggagcatcataaaacaacaccatgtttgctttcttccatcgaagaaggacgtgcggttaataggagacaacttattcttcacacgccagtagcagtagctgcatttgcagtcccaaatgcattggcactcaatgatgtgtctgaggatgttcgtgtctacactgacgatgagaacaagttcaagattgagattccccaagagtggcaagtgggaacaggagacggagaatctagtgggtttaaatccataactgctttctacccaacagtggcatccaattccaatgtgagcgttgtgatcacagggctgggaccggatttcactaggatggaatcctttggcaaagttgacgagtttgcccagactctagttagtgggcttgacagaagctggcgaaaacccccgggtgtggctgctaaactcatagattgtaaatcatctgatgggatttattacatcgagtattcgctgcaaaatcccggtgagagtcgcaggtatttatattcagctatcgggatggcatcaaatggttggtataacagactgtatacggtgacaggacagtatgtggaagaggaaacagacaagtatgcttcaaaagttcagaaggtagttgcatcatttaggttcatatga

SEQ ID NO: 1982 - DNA, 768 bp, Glycine Max
atggcgtccatttcgcggttctgttgtgtgcatatgcgagcgtctctatgcaacttcacagcccagaaaggtccatcacctcccacaaccttggacttggagcatcataaaacaacaccatgtttgctttcttccatcgaagaaggacgtgcggttaataggagacaacttattcttcacacgccagtagcagtagctgcatttgcagtcccaaatgcattggcactcaatgatgtgtctgaggatgttcgtgtctacactgacgatgagaacaagttcaagattgagattccccaagagtggcaagtgggaacaggagacggagaatctagtgggtttaaatccataactgctttctacccaacagtggcatccaattccaatgtgagcgttgtgatcacagggctgggaccggatttcactaggatggaatcctttggcaaagttgacgagtttgcccagactctagttagtgggcttgacagaagctggcgaaaacccccgggtgtggctgctaaactcatagattgtaaatcatctgatgggatttattacatcgagtattcgctgcaaaatcccggtgagagtcgcaggtatttatattcagctatcgggatggcatcaaatggttggtataacagactgtatacggtgacaggacagtatgtggaagaggaaacagacaagtatgcttcaaaagttcagaaggtgattttttttttttttgttatcatactccgttatttgacagaagtacgtaggtcatga

SEQ ID NO: 1983 - DNA, 747 bp, Glycine Max
atggctaaagtcatgtttggtttggtctgcagcttcctcgtattatgctgtttcacaatcaacactagcgccttctcaccttctggatggaccaatgcccatgccactttttatggaggaggagcttgtgggtatgggaatctgtattcgacagggtacggaactgatacagcggcattaagtactgccatatttaacgatggagcttcatgtggggagtgttacaaaatcatatgcgattatcaaacagatcccagatggtgcttgaaaggagcatcagtaaccataactgccacaaacttctgccctcccaattttgctcttcccaacaacaacggaggatggtgcaacccacctctcaaacatttcgacatggctcaacccgcatgggaaaagattggtatctatcgaggagggatcgtgccagtgttgttccaaagggttccatgcgtgaagaagggagggattaggttcagtgtgaatgggagagactactttgagcttgtattgatcagcaacgtgggaggggctggatctattcaatctgtgtctatcaaaggctcaaaaactggatggatgactatgtcaagaaactggggagctaattggcaatccaatgcgtatttgaatggtcaatctttgtccttcagggtcacaaccaccgatggtgtaactaggtttttccaagacgttgttccatcaaattgggcttttggccagactttccctactagtgtccagttttaa

SEQ ID NO: 1984 - DNA, 771 bp, Glycine Max
atggctaaagtcatgtttggtttggtctgcagcttcctcgtattatgctgtttcacaatcaacactagcgccttctcaccttctggatggaccaatgcccatgccactttttatggaggtagcgatgcctcggggaccatgggaggagcttgtgggtatgggaatctgtattcgacagggtacggaactgatacagcggcattaagtactgccatatttaacgatggagcttcatgtggggagtgttacaaaatcatatgcgattatcaaacagatcccagatggtgcttgaaaggagcatcagtaaccataactgccacaaacttctgccctcccaattttgctcttcccaacaacaacggaggatggtgcaacccacctctcaaacatttcgacatggctcaacccgcatgggaaaagattggtatctatcgaggagggatcgtgccagtgttgttccaaagggttccatgcgtgaagaagggagggattaggttcagtgtgaatgggagagactactttgagcttgtattgatcagcaacgtgggaggggctggatctattcaatctgtgtctatcaaaggctcaaaaactggatggatgactatgtcaagaaactggggagctaattggcaatccaatgcgtatttgaatggtcaatctttgtccttcagggtcacaaccaccgatggtgtaactaggtttttccaagacgttgttccatcaaattgggcttttggccagactttccctactagtgtccagttttaa

SEQ ID NO: 1985 - DNA, 1380 bp, Glycine Max
atggctaatacaccttcgaattcttcaattctcctctccctttttctattggccatcgccctctccctcgctgagtcccaatctttcatcggagtaaactacggccaggtcgccgacaaccttccggcgccggaggacacggccagcctcctcaaatccaccaccatcggaaaagtccgtctctacggcgccgatcccgccatcatcaaggccctcgccaactccggcatcggaatcgtcatcggcgcctccaacggcgacattgcgagtctcgccggcgatcccaacgcggccacccagtgggttaacgcgaacgtcttgccctactacccggcgagcaacatcactctgatcaccgtcggaaacgagattttgaccttagccgaccagggtcttaagtcgcagctcgtcccggcgatgcgaaatgtccaaaatgccctcggcgcggcctcgctcggcggcaagatcaaggtctccacagtgcactcgatggccgtgttgactcagtcggacccgccctcgtccgggttgttcaacccggcgctgcaagacacgctcaaacagctgctggcgctactcaaggacaacaaatcgccgttcacgatcaacccgtacccgtttttcgcttaccagagcgacccgagacctgaaacgctggcgttttgcctcttccagcccaactcgggccgggtcgactcgggcaacgggaagctttacaccaacatgttcgatgctcaggttgatgctgtacattctgctttgagtgccatgggattccaggacgtggagattgtggttgctgagactggatggccctcacgtggtgacagcaacgaattgggacccagtgttgaaaatgcaaaggcctataacgggaacctgatttctcatcttagatcattggttgggacacctttgatgcctgggaagtctgtggacacttacatttttgcactctatgatgaggatctcaaacaaggcccaggatctgagcgtgcatttggtatgttcaaaactgatcgcaccgtgtcgtacgacgttggattaaccaagtctagccagcagactccatcaactagtccaacaactccagcacctaaaactgctggatggtgtatacccaaagctggagtttctgatgctcagttgcaggccaatattgactacgcctgtagccaaggtatagattgcgggccaattcaaccaggaggcgcttgttttgagcctaacacagtagcatcccatgctgcatattccatgaatctatactaccaaacttctggcaaaaatcaatggaactgtgatttctctcaatcagcaacactcacatcccaaaatccaagttacaatgcttgcatttacactggtgggagcacctga

SEQ ID NO: 1986 - DNA, 1101 bp, Glycine Max
atggctaatctctcaatcttgttcttcggtctcctcctattctccgctgccgtagccaccgtcgaacgaatcgacgatgaagacaaccttctgatccgtcaagtggtgccggacgcggaggaccaccacctgctcaacgcggagcaccacttctccgccttcaagacaaagttcgccaagacctacgccacgcaggaggagcacgaccaccgcttccgtatcttcaagaacaacttgctccgcgccaagtcgcaccagaaattggacccctccgccgtccacggcgtcaccaggttctccgatctcactccgtctgagtttcgcggccagttcctcggcctgaagccgctccgccttccctccgacgctcagaaggctccgatccttccgaccagcgaccttcctaccgatttcgattggcgcgaccatggagctgttaccggcgtcaagaatcagggctcgtgcggatcgtgttggtcatttagcgccgttggagctttggaaggtgcccattttctttctaccggtgggctcgtgagcctcagtgagcagcaacttgtggattgcgatcatgagtgtgatccggaagagcgtggagcatgtgattcgggttgtaacggtgggttgatgaccactgcatttgagtacacactcaaggctggtggactaatgcgagaagaggattatccctacactggaagagaccgtggcccctgcaaatttgacaagagcaaaatcgctgcttccgtggctaatttcagtgtggtttcccttgatgaagaacaaattgctgcaaatctggtcaagaatggtcctcttgcagttggtatcaatgcagtttttatgcagacatatattggtggcgtctcatgcccatacatctgcggcaagcatttggatcatggggttcttttggtgggctatggatctggtgcttatgctccaattcgttttaaggaaaagccttactggatcataaagaattcatggggggagagctggggagaagaaggatattacaagatctgcagaggtcgcaatgtatgtggggtggactcgatggtctcaactgtagctgctatacatgtttctaaccattaa

SEQ ID NO: 1987 - DNA, 3393 bp, Glycine Max
atggctacaacggttatattcttcagcttcaccctcgtcgccttcttcgccaccctaaccttggcacacaacaacacctcgtttgagattcaagccttgacctctttcaagcgcagcctccacgaccctctgggttccttggacggttgggacccttccactccttcagcaccctgcgactggcgcggcattgtctgccacaacaaccgagtccaccagctccgcttaccgcgtctccaactctcgggtcaactctctccttctctctccaatcttcttctactccgcaaactcagtctccactccaacgacctcaactcctccatccccctttctctcacgcgttgcgtcttcctacgcgccgtttacctccacaacaacaaactctccggccaccttcctcctccgcttctaaacctcaccaacctccaaatcctcaacctcgcccgcaacctcctcaccggaaaagtcccctgctacctctccgcctccctccggttcctcgacctctccgacaacgccttctccggtgacattccggccaacttcagctccaaatcatctcagctccagctcatcaacctctcctacaacagcttctccggaggaatacctgcctccatcggaacgctgcaatttcttcagtacctatggttagactcaaaccacattcacggaatcctaccttccgccctcgcgaactgttcctctctggtgcacctgaccgcagaggataacgctctcactggacttcttcctcctaccctcggatccatgcccaagcttcaagtcctttcgctttcgcggaaccagctttcgggttcggtccccgcgtctgtgttctgcaacgcgcacctgcgaagcgtgaagctcgggtttaattccctcacgggtttttccacgccgcaaagtggtgaatgcgacagcgttttggaggttttggatgttaaagagaacggcattgctcacgcgccgtttcccacgtggttgacccacgctgcgaccacgtcgttgaagcttctcgatgtttctggaaacttctttgccggctctctgccggtggacattgggaacctttccgcgttacaagagttgagaatgaagaataatttgttatccggtgaagttccggttagcattgtgagttgtaggttgttgacggttcttgatcttgagggtaaccggttctctgggttaattcctgagtttcttggggaactgccgaacctgaaggaattgtctcttggcggtaacatttttaccggttcggttccttctagttatggaacgctttctgcgcttgagacgctgaatttgagtgataataagttaaccggtgtggtgcctaaggagatcatgcaattggggaacgtgagcgctttgaatttgagcaataacaatttttcgggtcaagtttggtctaatattggggacttgacgggtttgcaggttcttaatttgagtcagtgtggcttttcaggaagggttcctagttcgttggggagtttgatgagactaacggttttggatttgagcaagcagaacctctcgggtgagttgccccttgaggttttcgggttaccgagtctgcaagttgtggcgcttcaagaaaaccgtttgagtggtgaagttcctgagggtttcagcagcatagttagtttgcagtatcttaacctcacctcaaatgaatttgttggtagcattccaataacttatggattccttggttctttgagggttctctctttgtctcacaatggtgtttctggtgaaatacctcccgagattggtggttgttcgcaacttgaagtttttcagctgcggtcaaattttctagagggtaacattccgggtgatatctctcggctctctcgtttaaaggagcttaatttgggacacaacaagttgaaaggtgatatcccagatgaaatatcggagtgttctgctttgagttcactcttgttggatagtaatcacttcacgggtcatataccaggctccttatcaaaattgtcaaatttgacagtgttgaacctttcttcaaatcaattgataggggaaattccggttgaactatcaagcatttctggtttggagtatttcaatgtgtctaataataacctcgagggtgagattcctcacatgctaggtgctacattcaatgacccttctgtgtttgcaatgaaccaagggctatgcgggaagcccttgcacagagaatgtgcaaatgaaatgaggagaaagaggagaaggctaataatcttcataggggtggccgtggctggtttatgccttttggcattgtgttgctgtggctatgtttacagcctcttgaggtggcgcaagaagcttcgagaaggggtaaccggtgagaagaaaaggagccccacaacaagtagtggaggagagagaggtagcagagggagtggggaaaacgggggaccaaaactagtgatgttcaacaacaagatcacgttggcggagacattggaagcaacgagaaacttcgacgaagagaacgtgttgagcaggggaagatatggccttgtgttcaaagcctcctaccaagacggaatggttctctccattcgtcgttttgttgatgggttcatagatgaaagcaccttccgcaaagaagcagaatcactgggcaaagtgaagcatagaaacttaacagttctacgtggttactatgcaggcccacccgaaatgagacttcttgtgtatgactacatgcccaacgggaacttaggaacactacttcaagaggcttctcagcaagatggccatgtgctgaattggccaatgcgtcacctcattgcgctaggcatagctcgcggtctagctttcttgcattcggtgccaatagttcatggagacgtgaagccgcaaaatgttctctttgatgcagattttgaagcccatttgtctgaatttgggttggagcggttgacaatagcagcaccagctgaagcatcatcgtcctccaccccagttgggtccttagggtatgtttcaccggaagcggcatcgagtgggatggccaccaaggagggtgacgtgtatagctttgggattgtgttgttggagatactaacggggaagaaaccggtgatgttcacggaggatgaggacatagtgaagtgggtgaagaagcagttacaaaggggccaaatttcggaattgttggagccagggttgcttgagcttgacccagagtcttcggaatgggaagagtttttgttgggtgtgaaagttggtctcctatgcacagcaacggatcctcttgatcgaccatccatgtctgacgttgctttcatgctccaaggttgccgggttggaccagaaattccatcatcagctgatcccacaacactaccttcccctgcatga

SEQ ID NO: 1988 - DNA, 684 bp, Glycine Max
atggctagaggaaagatccagatcaagaggatagagaacaacaccaaccgccaggtcacttactctaaacgacggaatggccttttcaagaaggccaacgagcttaccgttctctgcgatgccaaggtttctattattatgttctccagcactggaaaactccaccagtacatcagcccctccacctcaacaaagcagttcttcgatcaataccagatgactctgggagttgatctctggaactctcattacgagaatatgcaagagaacttgaagaaactgaaagaggtgaataggaatcttcgtaaggagattaggcagagaatgggagattgtctgaacgagctgggcatggaagatctcaagctccttgaggaagaaatggacaaggccgccaaggttgttcgtgagcgtaagtataaggtgataacaaatcagattgacacccagaggaaaaagtttaataacgagaaagaagtgcacaacaggctcctgcatgacttggatgcaaaagcagaagatccacgttttgcattgatagataatggaggggagtatgagtctgtgatcggattctcaaatttaggtccacgcatgttcgcattgagcatacaaccaagccatcctagtgcccatagcggaggagcaggctctgatcttaccacttaccctttacttttctag

SEQ ID NO: 1989 - DNA, 1929 bp, Glycine Max
atggctaggcgtcatggatgggagctcccctttcacacttttcaggtcgtggctataacagtatttttcttgctatctatagcatattatgctttctttgctccttttcttggaaaggacatctatgaatatttggctattggtgtttactctgtattggctctctccgtgttctttctttatgttcgatgcactgccattgatcctgctgataagggagtcatggttgattgtgacaagacatcaaagaatagatcaaaacttgatgaagagttggcagaacccagcaagatgggactaaagggtgatggaatgtctgatcggcacaattcaaattggtgctctaaagttggatgtttcttctgtggtttccttgttagagaagattgctgtagtaatgaagaaattagtctacagcaacagtctggggaagaggaggctttgttctgcactttgtgcaatgctgaggtgcagaagtttagtaagcattgtcgaagttgtgacaaatgtgttgatggatttgatcaccattgtcggtggttgaacaattgtgttggaaagaagaattacatcacgtttgtgtgtcttatggcagtgagcctagtttggcttatagttgaatgtggagttgggattgcagtacttgtcagatgtttcgttgataagaaaggtacagagaatcagatagctgaaaaacttggagctggtttctctcgagtcccatttgctattattgtggccatatgcacagcagtttcattccttgcaactgtacctttgggagaattattctttttccatatgatcctgatacgaaagggtatcacaacttacgagtatgttgttgccatgagaactctaagtgaaccacctgggccttcagttgatgggggtgaacagcagagtctaccatcgtctcctactagttcagctgtcactgcaatgagtggaagaagctccgttggaatgagtatacagtacaaaggtgcctggtgtacaccgccaaggatctttatggaccacccggatgaaattataccacatttggagccgggacgcctaccatccactgttgatccagatgccgtacaaccacctgacaaagggagaaaaatgaaccagcgccctgtgcgtataagtgcatggaaacttgcaaaattggattctaatgaggcaactaaggcagctgctaaggccagagcatcatcgtctgtgcttcgtccaattagttctcgacctcatgcgtatgatgttgatcatgtatccagtagcaatgtgagtggaagaagcagcccaatcagcaatcaaggatttcatataaaaaatgatacagtggggacatcaaggttatctccttccaagagctcgtaccctcctagtcaagcaagcaaggatgacatagatgcatcatgccaacacagtatgagtaactttagcagtccacgagtctccaaccttactccttcaccaatgcagaggccaggtttgaacagagaccatttcaaccccatgtatcaacaaccatcgggaaaccagtctccttcgtcagctaaaggaagtgaagggaacataaatccagttcacgacaatgtgccacgtgtaccaatgagaagcaacaccttagctgtttcagataatagaagatcgtcagtgttttgggatcaagcagctggacgctttgtctcgtcctcatcaagaggtcccggaacagaattattgtacacgggccgttctatattttttggcagccccgttgtgaatgaacagccaagtacaggaacaagaagtagcagttcagtagtagctggtattccggatagagattcttctacattaagggattttcagcaaggtagatcacataggggtggccagcttcctgtgtttgttcctggttgtggttatgcccagcaaaacaagtttccttag

SEQ ID NO: 1990 - DNA, 2661 bp, Glycine Max
atggctcagccgcttgtgaagaaagacgatgaccgcgacgacgaagctgactattccccctttcttggaattgaaaaggggtctgttcttcaggaggccagggtttttaatgaccctcaactagatgctaggagatgttcacaggttattacaaaactcctatacctactgaatcagggagagacgtttacaaaggttgaagccacagaagttttctttgctgtgactaagcttttccagtctaaagatacgggattaaggagaatggtctacctgatgataaaggagatctctccctctgcagatgaggttatcatcgtcacaagctctctcatgaaggatatgaacagcaagattgatatgtaccgagcaaatgccattcgagtgctgtgtcgtatcactgacggaaccctcctttcacaaattgagaggtatttaaaacaagccattgtagataaaaatccagttgttgcaagtgctgctctagttagtggcattcatctactccagacaaatcctgaaattgtaaaaagatggagcaatgaggttcaggaagctgttcaatcaagagcagcccttgtacaatttcatgcactgggtttgctgcatcagatacgacagaatgaccggctagcagttagcaagctggttaccagcttgaccaggggaactgttcgctcacctttagcgcagtgccttttgatccgttacacaagtcaggttattcatgaatcaggccatacacagtcaggggaacgccccttctatgattatcttgagagttgccttcgccacaagtcagacatggtgatttttgaagctgccagggcaataacagagctcaatggtgtaacaagccgagaattaactccagcgattactgttcttcagctattcttaagttcgactaagccagtcttgagatttgctgctgtccgcaccttgaacaaggtggcaatgacgcatccaatggcagtcaccaactgcaacattgatatggaaagtttaatctctgaccagaacagaagcattgctaccctcgctattactacacttttgaaaacaggaaatgaatctagtgtggatcgtcttatgaagcagatcacaaatttcatgtctgatattgctgatgagttcaaaattgttgttgttgaagcaataagatcattgtgcctgaagtttcctttaaaatatcgatctctgatgaatttcctgagtaatattcttagggaggaaggtggttttgattacaagaaggcaattgtagattcaattgtgattctcattagagatatccctaatgcaaaggaagctgggttgcttcatctttgtgagttcatagaagattgtgagttcacttatttgtccacacagatacttcacttcctgggaattgaaggaccaaaaacatcagacccgagcaaatatatccgttacatttataatagagtacatcttgagaatgcaattgttagggccagtgctgtgagcacactggcaaaatttggtgctgctgttgatgcgctaaagccccgcatatttgttctgctaaggcgatgcctttttgacagtgatgatgaggttcgtgatagggcaacactttacctgaacacacttggaggtgatggttcagttgttgagactgataaagatgtaaaggacttcctgtttgggccatttgatgtcccacttgtcaatctggagactagtttgaaaaattatgagccttcagaagaagcttttgacattaactctgtgcctaaggaggtcaagttccagcctcttgcagaaaagaaagcccctggtaaaaagccaactggtttgggtgctcccccaagtggtcccccatcaactgcagatgcatatgagaggatgctttcaaccattccagagtgtgcaaactttgggaagcttttcaagtcctcagcacctgtggagctcactgaagctgagacagaatatgcagttaatgtcattaaacacatttttgataggcatgttgtgttccagtacaactgcacaaacacgataccagagcaattgttggaagatgttattgtgactgtggatgcttcagatgcagatgaattctcagaggtgttctccaagcctctcaggtctcttccttatgattcacctggacagacttttgtggcatttgagaagccagagggagtgccaacagttggaaaattttctaacgttctgaaatttattattaaagaggttgacccaaccacgggtgaggctgaagatgacggtgttgaagatgaataccagctggaggatctggagattgttgcagcagattatgtgttgaaagtgggggtgtctaattttaggaatgcatgggaaagcttgggccctgattttgagcgtgtggatgagtatggtcttggtcctagagagagtttggctgaagctgtaaatactgttatcaacctacttggcttggagccttgtgagggcacagaggaggttccacccaattcaagatcacacacatgcttattgtcgggtgtattcacagggaatataaaggtgcttgtacggttgtcttttggacttgatggtccaaaggatattgcaatgaaattgtctgtcagatctgaggacgaaactgtcagcgataccattcatgagattgtggcaagcggctag

SEQ ID NO: 1991 - DNA, 327 bp, Glycine Max
atggctccaaagaaggacaaggctcccccaccttcatccaagcctgccaagtctggcggtggcaagcagaagaagaagaagtggagcaagggtaagcaaaaggaaaaggtgaataacatggtgctcttcgatcagggtacctatgacaagctcctctctgaggcacccaaatacaagctcattactccttccattctctctgaccgtttgaggattaatggatcacttgcaaggaaggctattagggaattgatggctagaggttcaatcaggatggtgtctgcccatgcaagtcagcagatttacactagagctacaaacacctag

SEQ ID NO: 1992 - DNA, 1047 bp, Glycine Max
atggctccaaataaattaaatagcaccaatttcgcccacgaaaccctctctcttgtctcgtcgcttcaaactcctctgcggtttccccttcttgttcttcttcacagtgggttgaatttgtgcgtagaaatggaggtagcagtggccaaagcgttgaaaccgagtttaaggagagagttcatcgttcagcaaatgctctgcgaggatattttcagcctgaacgccaacaccgtcgccgccggcgaagatttctccgtcgacgacctatttgacttctctaacggctctcttcacaacgaacaacaacaagaatacgacgaagggaaacaaagtttatcggcttcagaggaccgcggagaagacgattgcaactccaattccaccggcgtttcctatgattcacttttctccaccgaattagccgttccggccggtgatttggaggacctagaatgggtttcacactttgtggacgattcactcccggagctgtcacttctatacccggttcgttcggaggaagcaaaccggtttgttgaaccggaaccctcagcgaagaaaacgccttgttttccgtgggaaatgaaaataacgaccaaggcgagaaccgtacggaataggaagcccagcaacagtcgcatgtggtcgttgggtagcccgttgctctcgctgccgtcttcgccgtcttcgccgtcgtcgtgttcttcttcggtgagggagccgccggctaagaagcagaagaagcaagcccaggcccagcccgttggggcccagattcagcggcggtgcagtcactgccatgtgcagaagacgccgcagtggaggaccggcccactgggcgcgaagaccctctgcaacgcgtgcggggttcggtacaagtcgggtcggttattttcggagtatagaccggcgtgtagccccaccttctgcagcgatattcactccaatagtcaccgtaaagtgttagagattcggaagaggaaagaggtggctcaaccggataccggcttggcccaggcccagactcaaatggttcccacctgctga

SEQ ID NO: 1993 - DNA, 117 bp, Glycine Max
atggctccaattatttctaacatgattgcacattccacctcaacagcctgcgtgatctttgacagtctcagcacactaatattcttgtcctacaatcctgcatttgctacaatctaa

SEQ ID NO: 1994 - DNA, 303 bp, Glycine Max
atggctctctcaaagcttctagttgcatcccttctggtatcctttgtcctcttccatctcgttgatgctgatgatcaatcggcatacgcacagactcagggttctcttgttcagcagatagattgtaatgctgcatgtgctgcgaggtgccgtttagcatctcgtcagcgcatgtgccacagagcgtgtggaacttgctgcagacgctgcaactgcgtgccaccgggaacttccggtaaccaagaagtgtgtccctgttatgccagtctcagaacccacgggggcagacgcaagtgcccttaa

SEQ ID NO: 1995 - DNA, 2523 bp, Glycine Max
atggctctgtcaaatgcccaggaagagagaatcttcgtttccataagagtaaggcctttgaacgagatagaaaaggccaggcatgatgtttccgattgggaatgcatttctggcaacaccatcagatacaagaacaacggccatgcggaaccgcgaccactctcaatggatacctatgcctttgatagggtatttggggagaagtgcaatacaaagcaggtttatgaacaagggattaaggaagttgctctttcagtagttaggggtatcaactctagcatttttgcatacgggcaaacaagcagtggaaagacacacaccatgtctggcattactgaatatgctttaagggacatatatgaatacatagagaagcataaggacagagaatttgttgtaaaattctctgccatggagatctataatgaagctgtcagagaccttctcaatgcaggtgctacttcactaagaattctagatgatccagagaaagggactgttgttgagaaactcacagaagaaacactgacagagaagagacagttgcagcaactcctttcaatatgtgcagctgaaaggacaacagaagagacggccatgaatgaaactagctccagatctcaccaaattcttagattgacagttgaaagtaatcctcgtgattatgcagacaccgcaagatccggagctctatttgccagtgtgaattttgttgatctagcaggaagtgagcgtgcttctcaagcaatgtcagcaggcacaagattgagagaaggtagccacataaatcgcagtttactgagccttggaactgtaattcggaaactaagcaagggaagaaatgaacacataccttacagggactcaaagcttactcgcattctgcagaactctttaggtggtaatgccagaacagcgatcatttgtaccattagtcctgcaaggagccagagtgagcaatcaagaaatactctgctttttgctagttgcgcaaaacaggtgactactaatgctcaggtcaatctagtgatgtcagacaaggttttggtaaagcaactacaaaatgaattggctagattggagaatgagttgaggagtttcaccccaaataccatgttacttaaggagagagaacttcggattcaacagcattcgaatcagatgtactctctgctaacgcagaccatggatagcccatcaaatttgatggaaaaagagataaaagaattgactcggcaacgtgatctctttcaatctcgtgctgaaaatatggtccagtctgttgggaaagataggcttttaagaggagcagacaaagattccgcctcagaatctacaggtgttgctaacgatcttcttcgcaggacagacagcgcatctgagagtctggacagaacaacatccagtttactgcacactgcgaattctgaagaggactttctcttggatggcaattctcccacgtttgctggtcctgacccatgtcatggttgggaggagatgaccacaagcagagaatctgaagataactacaaggaagttccatgtattgaaataaaagaagtggagacagaacacaaaacagatgttaataatacgccccccattcctgtttctgaagaaaatggaggaaatacacccatgatacaagttgtgaatgtaaatgccaaatcatcctcaggaaatgagcctatagagttgactcctgttgccatagataatactcaaggtgctctgcagggaaaaactgaggagagccttcaaaataccaaagaccttgctgtggacatcactaagaaatccaatgggtcctctgaatccgaatcacgtatttcgaatgccatgtctcctcctcaaatagataaggaaacttcaacccatcctcagatcagtagtaacttggagcagaatgagtcacctcggtttaataagctggaccaggaatccgcctcacctcctcggtgtgatgtgcaagagcttaaaactacgttacctcctcaacttgataagccggattctactagtttggtttgctttgaggacaagctacctgaatcgaagttacaagccgcaaaaagaaactcttccagaaaatattctccaattcactatagggatgcttcagttgaagatgtagaatccctttgggattctgatgcggaggatactgccagcgtccttaattttgttggaagaatgaataaaaaggctaagcaaaaggcattcaacaaggacatggatgatattatggtacgtgcaaggacatctggaatcaataaacgtgtgaacaaagtaataggtgtcaattttgagaggcagcagagagatacaatccaactttgggatgcatgtaatataccgttggtgcacaaatcctattttttccttctcatcaaaggtgaacttgcagattctgtgtactttgatgtagagctcagacgtttgtccttccttaaggacacgttttttagcacaacaaacattgcaggacatggttcggatgtcacacctaattcaaggcac

SEQ ID NO: 1996 - DNA, 1095 bp, Glycine Max
atggctctgtttatgaagttctttaattcttcttcgacaagcttaatgctccgtttcatattatcgttagttctatcattcagagcgaaggctgtggtgaaactaccgccaaatattaccattcctgcagtgatagctttcggagattccatcgttgacccgggcaacaacaacaaggttaaaacactggtcaagtgcgatttccctccttacggtaaagattttgagggagggatcccaaccggtcgattttgcaacgggaaaattccatcagatttgctagttgaagaactgggtattaaggagcttttacctgcttatttggatccaaatcttaaaccaagtgacctagttaccggagtctgctttgcttctggtgcttccggatacgatcctttaacgccaaaaatagcgtcggtgatatcaatgtccgaacaactagacatgttcaaagaatacataggaaagcttaaacatattgttggagaggacagaacaaaattcatcctagccaacagttttttccttgtggtagctggaagtgacgacattgccaacacctattttatcgctcgcgttcgacaattacaatatgatattccagcttacactgatcttatgctccactccgcttctaatttcgtaaaggaattatatggacttggagcacgcagaatcggagtactgagtgcaccaccgattggatgcgttccatcacagaggactctagctggaggtttccaaagagagtgtgcagaagaatacaattacgccgccaagttatttaactcaaaattatcaagggaactggacgctcttaagcataacttgcccaatagtaggatcgtttacattgacgtttacaaccccctaatggatatcattgtgaactaccaacgtcatggctataaagttgtggatagaggttgctgtggcacagggaaattggaggtggcagtgttatgcaaccctttgggtgccacttgtcccgatgcttcacaatatgttttttgggatagttatcatcctaccgaaggagtatacagacagctcatagtccaagtccttcaaaaatatttgactcgattctactga

SEQ ID NO: 1997 - DNA, 285 bp, Glycine Max
atggctgaagcacaactacgagaccagcatggcaaccctgtcccactcaccgatcaatacggtaatccggttatcttaactgacgagcgcggtaatcccgtccaactcactggtgtcgctaccaccgctaccggcacagcaggttctgggtttgggtcctatggtaccggtgcttacggtggtggtgcaagtgcaaccaccgttgcagatcttttggcaacccaaccaaggagtggcagggaggctagagagcttcgtcgttcctccagttcaagctctagctcg

SEQ ID NO: 1998 - DNA, 1197 bp, Glycine Max
atggctgaagcagaggatgccgtaagacgccgtaatgcggtcgccgagtatcggaagaaacttctccagcacaaggaattggaatccagagtccgatccgtcagggagaatttgcgagcttcaaagaaagagttcaataaaacagaagatgatttgaaatctcttcaaagtgttgggcagattattggcgaagttctcaggcctcttgacaatgaacgcctgattgttaaagcaagcagtggtcccaggtatgtggttggttgccgcagtaaagtggataaggaaaaattgacttcagggacaagggtggttcttgatatgacaacactcaccataatgcgagctcttcctcgagaagttgatccagtagtttacaatatgttgcatgaagatcctggtaatatcagctactcagctgttggtggcttatctgatcagatcagggaattgagggagtcaattgaactgcctctaatgaatcctgagctcttccttcgagttggaattaaacctccaaagggtgttctcctttacgggcctcctggtactggtaaaacattgttagctagggcaattgcaagtaatatagatgcaaatttcctaaaggttgtttcaagtgccataattgataagtacattggagaaagtgccaggttaatcagagagatgtttggttatgcacgtgatcaccagccttgcatcatttttatggatgagatcgatgccattggaggtcgccgtttcagtgagggaacaagtgcagatcgtgagattcagagaacgctaatggagctgcttaatcaacttgatggatttgatcaacttggaaaggttaaaatgataatggcaacaaaccgacctgatgtacttgaccctgctctcctgcgtcctgggagattggatagaaaaatagaaatccctctgcctaatgaacaatcaaggatggaaattcttaagattcatgctgctggtatcgctaagcatggtgaaatagactatgaagctgttgtgaagcttgcagagggatttaatggggctgatcttcgaaatgtctgcacagaagctggaatggcagcaattcgtgcagagcgtgattatgtgatccatgaagattttatgaaggctgttaggaaactgaacgaggcaaagaaacttgaatccagtgcgcactacagtgctgattttggtaaagactag

SEQ ID NO: 1999 - DNA, 1494 bp, Glycine Max
atggctgagggaaaaacagcaactcaaaaatctcttcaggattttgatcctcaaaagacacccagaaggaacaagtatgctttcgcctgtgccattttggcttccatgacttccatattacttggctatgatgttggggtgatgagtggagcgattatatacataaagagagacttgaaattgacggacgtgcaaatcgagatcctggtaggcatcatcaacctttactctctgataggttcatgcctcgccggcagaacctccgactggatcggccggcgttacacgatcgtccttgccggaagcatcttcttcgccggagccatcctgatgggaatatccccgaactatccctttcttatgttcgcgcgcttcatcgccggcgtcggcatcggttatgccctcatgatcgcccccgtctacaccaccgaagtctcccctccttcctgtcgtggcttcctcacctccttcccagaggtattcataaatggagggatattgctaggatacatatcaaactacggattttcaaagctgtcacttgagctgggatggaggatgatgctgggagttggggcggttccttcagtgatcctagcgctgggagtgttagccatgccagagtcgccacgctggctggtgatgcgaggtaggctcggcgaagccaccaaagtcctcaacaaaacctccgactccaaagaagaggctcagcagaggctagccgacatcaaagctgctgctggcatccccgagagttgcaccgacgacgtcgttcaagtaaccaaccgaaaccacggcggcggtgtatggaaagagttcttcctttaccctacaccggcggtgcgccacatcctcatagccgctctcgggattcatttctttcagcaggcttccggaatagacgccgtggttttgtacagccccgagattttcaagaaggctgggctggaatccgatggggaacagcttctggcaaccgtggccgttggattcgccaaaaccgtattcatcttagtggctacgtttttgttggatcgggtggggcgtcggccgctgttgttgacaagtgttggcggaatggtgttttctcttctgacgctggggttgagtctcaccgtcattgaccactcacgcgccgtcctcaagtgggccattgggttgagcataggcatggttttgtcctacgtgtccactttctccgtcggagcgggtcccatcacgtgggtttatagctccgagatcttccccttaaggcttcgcgcgcagggtgcggctatgggagttgtcgtgaatagggtcactagtggggtcatctcaatgactttcctgtccctctctaataagatcactattggtggggcattcttcctctttgggggaatcgcaatgtgtggatggatcttcttctataccatgctccccgaaacacagggcaagacccttgaggaaatggaaggctcctttggtaaattcgcctcatggtccaaggattag

SEQ ID NO: 2000 - DNA, 1167 bp, Glycine Max
atggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcgggattacagcgaaccaaggtttttacttgcttggcttggacaacacatccccaacctttgcatcagcgattcagaactctgtcccagccattacatttctcatggcagtcatactcaggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggatcataggagcagtgttgatcgttgtgggactgtactttgtcttgtggggtaaaagcgaagagagaaagtttgcaaaggaacatgctgcaattacgtctactccagagcacagtggtatcaggtcctcaagccatgccaaaacattactcactcagccacttctcccttcatctacggagaatgtctga

SEQ ID NO: 2001 - DNA, 1026 bp, Glycine Max
atggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcgggattacagcgaaccaaggtttttacttgcttggcttggacaacacatccccaacctttgcatcagcgattcagaactctgtcccagccattacatttctcatggcagtcatactcaggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggttcgtcctaccttccttatccttttcattctcttttttttttttttaa

SEQ ID NO: 2002 - DNA, 1308 bp, Glycine Max
atggctgcatccgccacctccaccggcggtgcgctgccggagctaactaaccgaactcccttactcggcctcaaactctacgtcctactcctcattgtagctctaatcgtgatcgcaacggtggtcctgatcctcgtgttcgttcgccggagccggagctcgaagaagcggaaaatgcgagtgaagcacagctccggcgcgatcccactggtctcgaaggagatcgtggaggtgaatactctggagctgaaaatcgatccgaagaagaaggaggtggagatggaagagagtgcgtcggtggagtcgccgaacatagggtggggacgttggtatagcctcaaggagcttgagaatgccactgaaggctttgcggaacagaatgtgatcggagaaggaggctatgggattgtctacaaaggaattctcatggatggctctgtcgtggctgtcaaaaatcttctcaacaacaagggtcaggcagagaaagagtttaaggtggaggttgaagccattggaaaagtgaaacataagaatttggtggggttagttggatattgcgcagaaggtgctcaaaggatgcttgtttatgaatatgttgacaatggaacattggaacagtggctgcatggtgatgtaggacctgctagccccttgacatgggatataagaatgaagattgctgttgggactgcaaaagggctagcctacttgcacgaaggattagaacccaaagttgtccaccgagatgtaaaatccagtaacattcttttggacaaaaagtggaatgctaaagtatcagactttggactggccaagctcttagggtctgagaaaagctatgtgacaacgcgcgtaatggggacattcggatatgtttcacctgagtatgcaagcactggtatgcttaatgagggaagcgatgtgtatagttttgggattctactgatggagttaattacaggaaggagtcccattgattattctagaccacctggagagatgaacttggttgattggtttaagggaatggttgcaagtcgacatggcgatgagctagttgatccattaattgatattcagccctctccaagatctttgaagcgagctttactggtttgtctgcgctgtatagacttggatgtcagtaagcgaccaaagatgggtcaaattgttcatatgcttgaggctgatgatttccccttccgttctgaacttcgaacaaatagagagaaagatcctgctgcttccagtaagattccatatccaaccaggcatgtggagcccgcagataaatcaagctggagatga

SEQ ID NO: 2003 - DNA, 495 bp, Glycine Max
atggctgccttcagcggtgatgaaacggctccgtttttcggcttccttggagccgcagctgccctcgtcttctcctgtatgggagctgcctatggcacagcaaagagtggtgtgggcgtggcttccatgggtgtgatgagacctgagctggtgatgaagtctattgtccctgttgtcatggctggagttttgggtatttatggccttattattgctgttattatcagtaccggtattaatccaaaggccaaatcttattacctctttgatggttatgcacatctctcctctggtcttgcctgtggcttggctggcctttctgctggcatggctattggtattgtcggtgatgctggtgttagagccaatgcacagcagccaaaactttttgttggaatgattctcatcctcatttttgctgaagctcttgccctttatggtctaatcgttggtattatcctgtcttctcgtgctggccagtctagagctgactaa

SEQ ID NO: 2004 - DNA, 1710 bp, Glycine Max
atggctgctgcgtctaatctctccactctctcctcctcttccctctccaaaccctcgtcctctttccctttccgcaacacaccaacaaacaacaacgcttcttttctccacaacaaatcccttccaaaccaaaactctctctctcacaaactctcttcccctctgcctctcgcatgcaacccaaaaaaccaaaacacttgtgtcttcttcgacgacgaagaccaaaagccccgtgaagagtgcggcgtggtgggcatctacggcgacccggaagcctcccgtctctgctccctggccctccacgccctccagcaccgcggccaagaaggtgccggcatcgtagccgtccacgacaaccacctccaatccgtcaccggcgtcggcctcgtctccgacgtcttcgacgagtccaagctctcccgcctccccggcacctcggccattggccacgtccgctactccaccgccggccaatccatgctcaaaaacgtccaacccttcctggccgactaccgcttcggctccgtcgccgtcgctcacaacggcaacttcgtcaactaccgctccctccgagccagactcgaacacaacaacggctccatcttcaacaccacctccgacaccgaggttgtcctccacctcatcgccacttcaaaacacaggccattcctcctcagaatcgtggacgcctgcgagcatctccaaggcgcctactccctcgtattcgtcacggaggacaagctcgtcgccgtcagagaccccttcgggttccgacccttggtgatgggtaggagaaccaacggcgctgtagttttggcctccgagacatgcgcgcttgatttaatcgaagccacgtacgagagagaggtgtacccgggtgaagttatcgtggtggaccacactggaatccaatccctctgcctcgtgtctcatcctgagccaaaacaatgcatcttcgagcacatatacttcgcgcttcctaactctgttgttttcgggaggtccgtgtacgagtctagaaaaaaattcggagaaatactagcctctgagagtcccgttgagtgtgacgttgtgatcgcggttcctgattctggcgttgtggctgcgcttggttatgctgcaaaagctggggtaccctttcagcaggggttgattaggtcccactatgtagggaggactttcatcgagccttcgcagaaaattagggattttggagtgaagcttaaactgtctccggttcatgctgtgcttgaagggaagagggttgtggttgtggatgattccatcgtgagaggcaccacgtcgtccaagattgtgaggctcttgaaggaggccggtgccaaggaagttcacatgaggattgcatgtcctcctattgttgcttcgtgttattatggagttgacacacccagttcagaggagttgatatccaaccggatgagtgtggaggagataaggaagtttattgggtcggattcgctggcttttcttcccttggataagttgaagacattgttaggggatgatgctcttaactactgctatgcttgcttctctgggaagtaccctgttgagcctgaggaacttcaaatgaagaggcttggtgttgctcacttcaattgggacgacgacttcaatgggaatttcgaatctattgatgtggggggttgggttacaaatcaagatgggtttaagattggtagtgtctaa

SEQ ID NO: 2005 - DNA, 1635 bp, Glycine Max
atggctggtggtgctgctactgcagaaagaagcttaaaggagacacccacatgggcagtagctgctgtttgttcagtgttcatcatcatctctgtattaattgaacacggaatccattcacttggaaagtggtttcaaaaacgacataagaaggccatgaatgaagccttggagaaaatcaaatcggaattaatgttattaggattcatatccctattaataacttttggtacaaaatacattgcaaagatatgcatccctgtgtcagctggtgacataatgcttccatgcaagaaggtggaagtgtcagattcagatgatgactcaaatgacagaaggaagctactttcttttgacgacaacgtggtggaatggcgtcgagttttagcagctgcatctgggggtgactattgctcacaaaaaggtaaagtgcctttgatctctcagtctggggtgcaccagttgcatatatttatatttgtcctcgctgtttttcacattttctacagcgtcatgaccatggttctagccagagcaaaaatgaagaaatggaaggcttgggaagcagaaacatcttccctggagtatcaatttacaaatgatcctgcaaggttcaggttagcgcatcaaacatcattcgttaggcgtcactctggttggtctaggatgccaggaattcgatggatagtggcattcttcaggcaatttttcgggtctgtcactaaggtggattacatgaccatgcggcacggatttattaacgcacattttgctcccgatagcaaatttgactttcaaaaatacattaaaagatccatggaggacgactttaaagtggtcgtgggtataagcattccgttatgggtttttgcaatcgtctttatgcttgtgaacgtttacaaatggtacacgctcacttggctatcattagcaccactagtggtaatacttctattagtgggcaccaagcttgaacttataatcatggaaatggcccaacaaatccaagaccgagccacaattgttagaggagtccctattgtagagccaaacaacaagtatttttggtttaaccggccccagtggattatcttcttaattcattttaccttgttcgagaatgcattccaaatagcctttttcttgtggacatggtatgagtttaagatcacatcttgcttccatgaaaacttgcccctaatactgacaagggttgtccttgggatagccttacaagtcgtatgcagttacatcacattccctctctattccctagtaacacagatgggatctcacatgaagaaaacaatctttgaggagcaaactgcaaaggcacttaagaaatggcaaaaggctgcaaaggacaagagaaagttaaggaaagcaggaatagatattccttcagggactatgagtggggaaacaacaccaagccaaggcacatcacccttgcatttgcttcacaagtacaagccaagccacacagacacagatagtgttctttattctccacgatcataccaatctgacactgacttgtccgagacagagggatcttcacaccaattgaatgaaataacacaaacgcgtcaagcttcaagaaatggagaaactcataatatcgatttttccttt

SEQ ID NO: 2006 - DNA, 846 bp, Glycine Max
atggctggtttcttctctctaggtgggacacaaaacaaggaagaagaggaagtagaaaaaggagacaagaataacctattgctgttgaggaacgaggagatctacaacaacaagggtgggttcgagatatggccacagtcgtcgtcgtcgtatcacttgagcaactactttgcgtttggagtgggtcctagtcgcaggaacaggtcggaggatgtttcattgtgcgtgtcggaggatgagtctacgagatttggattaagtgtgatgaggactggaggaagcagcagcagcagcatgagcatgaactgtcaggactgtgggaaccaagccaagaaagactgcgcgcatcttagatgcaggacttgctgtaagagccgagggtttcagtgccagacccacgtcaagagcacttgggttcccgcagccaagcgccgcgaacgacaccagcaactcgctgagttgcagctacaacaacaattccgtggagaaactaattggttagagctgggacaattcccagctgaagtgagcacttcggcgttgtttcggtgtgtgagagtgagcgcagtggacgcttcagatgaacagtatgcgtatcaaacctctgtcaacatcggaggacatgttttcaagggatttctctacgatcaaggtcctgaaagttcttacactggtgcagcagctgagggttcctccggtggtgaacctcaacaacttggttttataaccgccgccgcaaccacagccacaacaagtgggaacagcccatttgacccttcactttacccagctccgttgaatgctttcatggctggtacgcaattcttccaacctccaaggtcctaa

SEQ ID NO: 2007 - DNA, 1815 bp, Glycine Max
atggcttcaaattccgataaggattccccaacaccaccttcacctgattcatcttcatcccaatccccgccatcatctcctccaccatcccaagatagttcatcgcccccaccatcatctcaggataattcgtcgccgccaccatcgtcccccccgccatcatccccaccaccatcatcttcgcctcctccgtccccgccaccgccgtcatcaaatgatcagaaatccccgcctccgccatctgactcatcctcctcccccccatctccaccaccgccgccacctcctgataaggattcaggcagccaccggtcgccaccgcctccgccacattcaagacatgagttttctcctcctccgcctccgaaccaccggttgtctccacccaagtcgtcatcatcagttataataggaattgcagctggagctggcattttgctccttctccttctcgtagtcgtttatgatggatattataaaagaccaaggggaggtcaaaatcagtatgggtacaataacaacggcgagcacgttctgaatattcctccacctccaggagcaggttggggagcagcaccccaacctccccagatgattagtagtgacatgagcaactccagtttctcgggttcccacggtcccgttttgccacctccacaccctacagtggcccttggattcaaccaaagctccttcacttatgacgagctctcagctgccaccggagggtttagccaacgcaacttgctcggtcaaggtgggttcggatatgtgcacaaaggtgttctacccaatggtaaggaaattgcagtgaagagcctcaagtccaccgggggacaaggtgacagagaattccaagctgaggttgatattattagccgtgtccatcatcgccatcttgtgtcacttgttggctattgcatgtcagaaagcaaaaaacttctggtttatgagtttgtgcctaaagggacccttgaattccatcttcatggaaagggccgacctgtcatggattggaataccaggctcaaaattgcgattggatcggccaaaggacttgcttatttacatgaggattgtcaccctcgtatcattcaccgagacataaagggtgcgaacattctacttgagaacaacttcgaagccaaagtggcagattttgggttggcaaagattagtcaagacactaacactcatgtttctactcgtgtaatgggaacattcggttatatggctccagagtatgcatcaagtggtaagctaactgacaaatctgatgtgttctcgttcggtattatgcttttggagctcataactggtaggcgccctgtgaacaacactggggaatatgaagatactttggtcgactgggcaagaccactttgtacaaaggcaatggaaaatggaacttttgaaggactagtggatccacgtttagaggataattacgacaagcagcaaatggcttctatggtggcttgtgctgcttttagcgttaggcactcagcaaagaggcgcccaagaatgagtcagattgtacgagtactggagggtgatgtgtcactagatgcccttaatcatgagggagtgaaacctggacaaagttcaatgttcagcagcgcgagcagggagtatggtgcggaggcatacggtgctgacatgatgagattcaggaaactagcattagatagtggcgtgggaagcactcaagcagtgaacaatcatctgctgaatatgccaggaggaccacaggaggaggccggatgcacactccttgagaaaattgaaattgcatgcatgcatgtgtatgtgtga

SEQ ID NO: 2008 - DNA, 348 bp, Glycine Max
atggcttcgacggcagcgtacctggctcggcgcgcggcgcagaaggagagggttcggatcctctaccgccgtgccctcaaagacactctcaactgggccgtacatcgccacctcttctacgacgacgcttcaaacctccgcgaaaggttcgaggagaacagacacgtggaagaccctgataccattgacaggctcatagcggatgctgaagcttcctacaacaagtggcgccatcctgatccttatattgttccttgggctcctggtggttccaagtttactcgcaacccaactccacctcaagggattgagatagtttataattatggccgagaagataatgactga

SEQ ID NO: 2009 - DNA, 348 bp, Glycine Max; identical to SEQ ID NO: 2008

SEQ ID NO: 2010 - DNA, 264 bp, Glycine Max
atggcttcgacggcagcgtacctggctcggcgcgcggcgcagaaggagagggttcggatcctctaccgccgtgccctcaaagacactctcaactgggccgtacatcgccacctcttctacgacgacgcttcaaacctccgcgaaaggttcgaggagaacagacacgtggttcgtttccctcttttcacttcccttcccttccaaatcatcgcatctctaacatggtttcgatccacacatcccttgtcatattttgtaccctaa

SEQ ID NO: 2011 - DNA, 2202 bp, Glycine Max
atggcttcgctttgtgccctaaactatcctcctgctcgcagagacgattcagtcgtcgaagattaccatggtgtcaaaattgccgatccttatcgatggctcgaagatcctgatgcggaagaagtgaaagagttcgtagcgaaacaggttcagctgacggattcggttcttcaaaaatgcgaaacgagagggaagcttagggaaacgataacgaagctatttgaccatcctcgttacgacgctccgtttaggcgagccaataagtacttttacttccataacactggccttcagccgcaaaacattctatatgtgcaggagagtttggagggagaggcagaggctttgctcgatcccaataccttcagtgaagacggaaccgtttccctgagcacactttcggtgagcgaagatgccaagtacttggcttatgcgcttagttcaagtggtagcgattggactactataaaagtaatgcggattgaggaccggaatgttgagcctgataccttatcgtgggtcaagttttcctcaattagttggacgcacgatggcaaaggtttcttttatagccgctatccagcacccaaagatggagaagtagtagatgctggtactgaaacaaatgctaaccttcatcatcagctctattatcattttctgggtacagatcaatcggaagatattttgtgctggagagatcctgaaaatcctaaatatacgtttggaggaagtgtaactgatgatggcaagtacatccttctccatattgcagaagggtgtgatccagttaacaaactttactactgcgacttgtccaaacttcctaatgcgctggaaggctttcggaatggaaattctctcctcccatttgccaaacttattgataactttgatgcacagtatgaagccattgccaatgatgacaccgtgtttacatttttaactaataaagatgctccaaaatataaaatagtccgagtagatttgaaagaaccaactgcttgggctgatgttctccaagagtctgaaaaagatgtactggagtcagcatgtgctgtaaatggcaaccaactgatagtaagttacttgagtgatgtgaagtatcttctacaagtaagagacttaaaaacaggatccttgctgcatcaattaccaattgagattggcagtgtttctgaaatttctgcacgacgtgaagatagtgtggttttcattggctttacaagcttcttaactcccggtatcatctaccagtgcaacctaggaacagagattcctgatatgaagatatttcgtgaaattgttgtccctgggtttgatcggtctgaatttcatgttaaacaggatttcgtgactagtaaagatggtaccaagatcccaatgttcattgttgccaaaaaggatattactttggatggttcacacccatgtttgttatatggatatggtggttttaacatcaatattacgccatatttcagtgtcagtcgcattgtactcacaagacatttaggtgttgttttcagcatagcaaatattcgtggtggtggagaatatggggaggaatggcataaagcaggctcccttgcaagaaagcagaattgctttgatgacttcatttctgctgctgaataccttgtatctactggttacactcaacccaaaaagttatgcatcgaaggtggaagcaatggtggacttcttgttggtgcttgtataaatcagagacctgatttatttggctgtgctctggctcatgttggtgttatggacatgctacggttccacaaatttaccataggtcatgcttggacctctgattatggttgttcagacaaggaggaagagtttcattggctaatcaaatactcaccattacataatgtccggagaccgtgggaacagcatcatgatcagtcatttcagtatccatcaaccatgctgttgacagctgatcatgatgatcgtgttgtgccactgcacacattgaagctattagcgaccatgcaatatgtcctctgtacgagcttggaaaaaagtccccagacaaacgctataattggtcgcattgactgcaagtctggtcatggagctggtcgtccaacacagaaaatgagaacaatggattatttctttaagacgatacccttgaaccattttatttctctgtttttcacttctaccaagaaaatacattga

SEQ ID NO: 2012 - DNA, 2184 bp, Glycine Max
atggcttcgctttgtgccctaaactatcctcctgctcgcagagacgattcagtcgtcgaagattaccatggtgtcaaaattgccgatccttatcgatggctcgaagatcctgatgcggaagaagtgaaagagttcgtagcgaaacaggttcagctgacggattcggttcttcaaaaatgcgaaacgagagggaagcttagggaaacgataacgaagctatttgaccatcctcgttacgacgctccgtttaggcgagccaataagtacttttacttccataacactggccttcagccgcaaaacattctatatgtgcaggagagtttggagggagaggcagaggctttgctcgatcccaataccttcagtgaagacggaaccgtttccctgagcacactttcggtgagcgaagatgccaagtacttggcttatgcgcttagttcaagtggtagcgattggactactataaaagtaatgcggattgaggaccggaatgttgagcctgataccttatcgtgggtcaagttttcctcaattagttggacgcacgatggcaaaggtttcttttatagccgctatccagcacccaaagatggagaagtagtagatgctggtactgaaacaaatgctaaccttcatcatcagctctattatcattttctgggtacagatcaatcggaagatattttgtgctggagagatcctgaaaatcctaaatatacgtttggaggaagtgtaactgatgatggcaagtacatccttctccatattgcagaagggtgtgatccagttaacaaactttactactgcgacttgtccaaacttcctaatgcgctggaaggctttcggaatggaaattctctcctcccatttgccaaacttattgataactttgatgcacagtatgaagccattgccaatgatgacaccgtgtttacatttttaactaataaagatgctccaaaatataaaatagtccgagtagatttgaaagaaccaactgcttgggctgatgttctccaagagtctgaaaaagatgtactggagtcagcatgtgctgtaaatggcaaccaactgatagtaagttacttgagtgatgtgaagtatcttctacaagtaagagacttaaaaacaggatccttgctgcatcaattaccaattgagattggcagtgtttctgaaatttctgcacgacgtgaagatagtgtggttttcattggctttacaagcttcttaactcccggtatcatctaccagtgcaacctaggaacagagattcctgatatgaagatatttcgtgaaattgttgtccctgggtttgatcggtctgaatttcatgttaaacaggatttcgtgactagtaaagatggtaccaagatcccaatgttcattgttgccaaaaaggatattactttggatggttcacacccatgtttgttatatggatatggtggttttaacatcaatattacgccatatttcagtgtcagtcgcattgtactcacaagacatttaggtgttgttttcagcatagcaaatattcgtggtggtggagaatatggggaggaatggcataaagcaggctcccttgcaagaaagcagaattgctttgatgacttcatttctgctgctgaataccttgtatctactggttacactcaacccaaaaagttatgcatcgaaggtggaagcaatggtggacttcttgttggtgcttgtataaatcagagacctgatttatttggctgtgctctggctcatgttggtgttatggacatgctacggttccacaaatttaccataggtcatgcttggacctctgattatggttgttcagacaaggaggaagagtttcattggctaatcaaatactcaccattacataatgtccggagaccgtgggaacagcatcatgatcagtcatttcagtatccatcaaccatgctgttgacagctgatcatgatgatcgtgttgtgccactgcacacattgaagctattagcgaccatgcaatatgtcctctgtacgagcttggaaaaaagtccccagacaaacgctataattggtcgcattgactgcaagtctggtcatggagctggtcgtccaacacagaaaatgatcgatgaagctgctgaccggtacggttttatggctaaagtgttggaagtgcattggattgaatag

SEQ ID NO: 2013 - DNA, 492 bp, Glycine Max
atggcttctcttcccaccactttcgctataaccaaatctgcatcctccataaacaaggtggaccactctctggtcaagatcaaaccatacaacttctctctcaatctaaatcgtcaagggaccatgcaaacatctttaaccagaaggcctctaacaattcaagctacgtatagtgatggtggaaggcccagcagtgctagtgtatttgttggtgggtttctcttgggaggattaatagttggtactcttggttgcgtgtatgcacctcagatcagcaaggccctagctggagctgacaggaaggagttaatgagaaaattgccaaagtttatatatgatgaagaaaaggctttagagaaaacccggaaagtactggctgagaagattgaacaactgaatgctgccatagatgatgtttctgctcagctaaggtcagaggaggcctcaaatggagtagctgtgaactctgatgaaattgaagctgccacatga

SEQ ID NO: 2014 - DNA, 1560 bp, Glycine Max
atggcttctgcttgtgtgaccttgaaatccaatacccatttagcaaactctgagaagggctttctaggagaaagaataaaaggtggcttcaacaacagtgccttggtaatgaatcagttggctatacgttctagaagccacaagagggtgaaacatggtgttggtgttgtatctgctgttctcacttcaaacaatgccaaagaatcactgaccttgcaagtgccttcctttttaagaagaagggctgatccaaaaaatgttatttccatcatattgggaggaggacctgggacacaactctttcctctcaccaaacgtgctgccacacctgcggttcctgtgggtggatgctacaggcttatagacatccctatgagcaactgcctcaacagtggcatcaacaaaatatttgtgctgacacagttcaactctgcatccctcaaccgtcacattgcccgcacctattttggaaatggcatcaactttggggatgggattgtggaggttctggcggctactcaaacaccaggagaggctggaaagaattggttccaaggaactgcagatgctgtgaggcaattcacttgggtatttgaggatgccaagaatacaaatgttgagaatgtattgatcttggctggagatcatctatatcgtatggattacatggaccttgtgcagagtcacgttgatagaaatgctgatattacagtttcatgtgctgctgtgggtgacagccgtgcatcagattatggattggttaaagtagatgacagaggccgcatcattcaattttctgaaaaaccaaatggtgatgatctgaaagcaatgcaagcagatacctctcttcttgggttgtctccccaagatgcattgaagtcaccatatattgcatctatgggggtttatgtattcaagacagatgttttactcaatcttctgaaatggagatatcctacctccaatgacttcggatctgaaatcatccctgcagctgtgagggatcacgatgtccaatcgtatttttttgaagactattgggaagacattggaacgataaaatcgttttacgatgctaacttggcccttactgaagagagtcacaagtttgaattttatgaccccaagattcccatttacacatctccaggattcttaccaccaacaaagattgacaaatgccagattgtggatgctattatttcccatggatgtttcctgcgagaatgcacagtccaacactccattgtgggtgaacgttcacgtttggattatggtgttgagctcctggacactgtaatgatgggagcagactattaccaaactgaatctgaaattgcttctctgctggcagaggggaaggtcccaattggtattggaaggaataccaaaattagaaactgtattattgacaagaatgctaagatcgggaaagatgtcatcatcgcaaacaaagatggcgttcaagaagcagatagaccagaagatggattctacattcgatcaggaatcaccatcataatggagaaggcaaccatagaagatggcactatcgtataa

SEQ ID NO: 2015 - DNA, 3159 bp, Glycine Max
atggcttcttcctcgcgcgcaaggagtagctcaccgttttcttaccgaaaaccttcgactccttactcttccacttcttcgtcctcttccttcaccaacggaaggttaatgcctcgctccagctcttcctccacgtcctcgtttttcaactccggaggccgatccatgactccgagtcgcggtcgcagcgagtcggcgtatcacggctcgcgcggttacgccgcccgttctccggtggcgttcggagctgaggagctgattgcggagccggtggtggattcttcgaggaccggcgatagcatttcggtcacgattcggtttaggccgttgagtgaaagggagtatcagagaggggacgagatcgcatggtatgccgatggcgaaaagattgtcagaaatgagtataatccagctactgcttatgcatttgatagagtttttggaccacataccaattcagacgaagtgtatgaagtggcagcaaaacctgtagtgaaggctgccatggagggggtcaatggaactgtgtttgcctatggtgtgacaagtagtggtaagacacatactatgcatggagaccaaaattctcctggtctcataccactggctataaaggatgttttcagtatgatccaagataccccaggaagagaattcttactccgagtgtcatatttagaaatatacaatgaggtgataaatgatttacttgatccaactggccaaaatttgcgagttagagaagatgcacagggaacttatgtggagggtataaaggaagaagttgttttatctcccggacatgcactttcttttattgctgctggagaagagcatcgtcatgttggatctaacaattttaatctctttagcagccggagtcacacaatatttacactgatgatagagagcagtgctcatggtgatgattatgatggagtcatcttctctcagctaaatttgattgatttggctggatctgagagctcaaaaactgaaacaactggattaagaagaaaggaaggatcttacatcaacaaaagtcttctgacacttggaactgttattggaaaattgagtgaggggaaggcatctcatgttccatatcgagattcaaagctaacccgcctcctgcaatcttctcttggtggacatggccatgtttcacttatatgcacagtaactccagcatccagtaatatggaggaaactcataataccttgaagtttgccagcagggcaaaacgagtagaaatatatgcgtcacgtaataagattattgatgagaaatctctaattaagaaataccagaaagaaatttcattcctcaaactagaacttgatcaactaaggaaggggatgctagttggtgtcaatcatgaggaaattttgaccttaaagcaaaagttagaagaaggtcaagtgaaaatgcaatcaagattggaagaagaggaggaagccaaggctgctcttatgagtaggatccagaggctaaccaaactcattctggtttcctcaaagaatgcaattcctggatatctaactgatgtttccaaccatcagcgaagtcactctgttggcgaggatgattgtgtatactttgaactcctcactctacagattgaaaatgagaatctgtttcatgatgttagacataaaagatcatctagtagatggaatgaagagttctccccagctagcagtactggtgggatgacaacatctgatcagaaggatcttcttattgaacaagtcaaaatgctagccggcgatattgctttcagtaccagcactctgaagcgcttgatggagcaatcggtacatgaccctgaatgctccaaaattcagattgagaatttggaacgtgagatccaagaaaaaaggaagcaaatgagggtgctagaacaaagattaattgagactgaagaatctcctgtggctaattcatcactagttgaaatgcagcagacagtcacaaagttaatgactcaatgtaatgaaaaggcctttgagttggagctaaaatctgccgacaaccgtgtccttcaggaacagttaaatgataagagttctgaaaacagagagttgcaagaaaaggtgaggcagctagagcagcaactggcagcagttaacagtggtacatcgtcagtgtcttctgaacagtgtgcatcaggagaacacattgatgacatgaaaaagaaaatacaatcccaggaaattgaaaatgaaaagctaaagctagggcaagttcacttgtcagaagagaatagtgggttgcgtgtgcagaatcagaaactctctgaagaagcttcttatgccaaagaactggcctctgcagctgctgtggagctgaaaaatttggctggggaagtgacaaaactttcattgcagaatgcaaagttagaaaaagaattgatggccgcgcgagacctggtcaactctcgtagtgctgtcatgcaaacggttaatggtgtcaaccgcaagtacaacgatccaagagctggaaggaaggggaggatttctagccgtgctagtgaaatttcaggagctggtgtagatgattttgagtcatggagtcttgttgctgatgatttgaagatggaactacaggcaaggaaacaacgagaggcagctctggaagctgcattagccgagaaggaatttgtggaagaacagtaccggaaaaaagctgaagaggccaagaaaagagaagaagccttagagaacgatttagcaaatatgtgggtccttgttgctaagttaaaaaaagaagggggtgctgtcccagaatcaaacatcgataaaaaaaatgatggtgcagagcacataaataatcccaaaattaatgacgttgaaagtaatattgttcccaaggaacagcttttggatgcaccaaaaccagatgatgaaatgcccaaagatgagcccttggttgttcgcctcaaggcgcgcatgcaagaaatgaaggaaaaagaactcaagtaccttgggaacggcgatgcaaattcccatgtttgtaaagtatgttttgaatctccaactgcagcaattctgcttccatgccgacatttttgtttgtgtaaatcttgttcacttgcttgttctgagtgtccaatatgccgcacaaatattacagataggatttttgcttttacataa

SEQ ID NO: 2016 - DNA, 330 bp, Glycine Max
atggcttcttcttcagcttctcctcgaccgagcgccgccgcggaacattcgaggaagatattagggtttatggcgcacgcgaagcaacggaaggacagcttcatccaattcttcgccatgacgggtatccttctattgagcatgcgatctttgagtcagaagtacaaaatccatggcctccaagaagacatccacgccctcagggtcgaccacggttctctcaccgaccgcatcaacaacatcaagaacgacctccttcgagaagcttctcaagattccaccggcctcttcgcttctcgccttcgccacctctttgcagaacaacactga

SEQ ID NO: 2017 - DNA, 468 bp, Glycine Max
atggcttgttcaagtggaacatcttcaggggcgacgtcgtcgatgcttcaaaataactcaggttcggaggaggagctgcaggcactgatggagcagaggaagaggaagagaatgatatcgaaccgcgaatcggctaggcgatctcgaatgaggaagcagaagcacttggatgatctagcatcgcaggtgactcagctcaggaacgagaaccaccagattctcacatcggtgaacctcactacccagaagtacttggcggttgaggctgagaactctgttttgagagcacaagtgaacgaactcagccactggttggagtctctgaacgagatcatccacttcttgaatgccactgatggtggtccaccaccaccaccaagctccttctttgagcccgatgctaccttcttcaacaaggcttatctgagccagccgattatggcttcagcagacatgttgcagtactga

SEQ ID NO: 2018 - DNA, 858 bp, Glycine Max
atggctttcacacagcttatcccttcaccttcttcttcctccttaaaccctatcacactctccctaaaccctaaatccccaacctctccgccgcagcagcatttcaatctcgatattctccggcaccggcgccggaggcctaattccactcttcggtgctccgcctcctcgttctcggagaagcaccacacgaactcctcgaactccgacgacgtggtggagctccccctgttccctctccctctggtcctcttccctggcgccatcctccccttgcagatcttcgagttccgctaccgcatcatgatgcacacgctcctccacaccgacctacgcttcggcatcatctacaccgacgccgtctctggaaccgccgaggtcggctgcgtcggcgaagtcatcaagcacgagcgcctcgtcgacgaccggttcttcctcatctgcaaggggcaagagcggttccgcgtgaatggtgttgtccgcaccaaaccctacctcgtcgcgcaggtgacgtggctcgaggaccgcccttctccctccaccgacctcgatctcgacggtctcgccaccgaagtggagacctatatgaaagacgttatccggttatcgaaccggttgggagggaaaccggagaaggaggttggggatttgagacgaaacctctttcccacgccgttttcgtttttcgttgggagcacctttgagggcgcgcctagggagcaacaagcgctgcttgaattggaggacactgcggccagattgaagagggagaaggaaacgttgaagaacacgcttaattacctcactgctgcttctgctgttaaagacgtttttccctcttcttccaattcttcttga

SEQ ID NO: 2019 - DNA, 1050 bp, Glycine Max
atggctttctcctcctccaaggcacttttccttgcctgctctttttgcctatttgcatctttggctgttgctggcgatttctccattgtgggctattcatcagaggacttaaagtccatggataagctcattgaactctttgagtcatggatgtcaagacatggcaagatttaccaaagcattgaggagaagctgcacaggttcgatattttcaaggacaacctaaagcacattgatgagagaaacaaggtggtcagcaactactggcttggcttgaatgagtttgctgatttgagccaccaagagttcaagaacaaatatctcgggcttaaggtagactactctagaaggagagagtcccctgaagaattcacttacaaagattttgaattgcctaagtcagtggattggagaaagaaaggtgccgtaacccaagtcaagaaccaaggttcatgtggtagctgctgggcattttccactgttgcagcagttgagggaataaaccagattgtgaccggaaatttaacatcactgtctgagcaagagttgattgactgtgacagaacatacaacaatggttgcaatgggggtctcatggactatgccttctcctttattgtagaaaacggtgggctccacaaagaggaagattatccttacattatggaggaaggtacttgcgagatgactaaggaagaaactgaagttgttactattagcggataccatgatgtgccacaaaacaatgaacagagcctattgaaggcacttgtaaaccaacccctcagtgtggccatagaggcttcaggcagagatttccaattttacagtgggggtgttttcgatgggcattgtggaagtgacctagatcacggtgtggctgctgttggatatggaacttcgaagggagtgaattatatcatagtgaaaaattcatggggatctaagtggggagagaaaggatacataagaatgaggaggaacattggaaaacccgagggaatctgcggtatctataagatggcttcttatcccactaagaagaaataa

SEQ ID NO: 2020 - DNA, 846 bp, Glycine Max
atggctttctcctcctccaaggcacttttccttgcctgctctttttgcctatttgcatctttggctgttgctggcgatttctccattgtgggctattcatcagaggacttaaagtccatggataagctcattgaactctttgagtcatggatgtcaagacatggcaagatttaccaaagcattgaggagaagctgcacaggttcgatattttcaaggacaacctaaagcacattgatgagagaaacaaggtggtcagcaactactggcttggcttgaatgagtttgctgatttgagccaccaagagttcaagaacaaatatctcgggcttaaggtagactactctagaaggagagagtcccctgaagaattcacttacaaagattttgaattgcctaagtcagtggattggagaaagaaaggtgccgtaacccaagtcaagaaccaaggttcatgtggtagctgctgggcattttccactgttgcagcagttgagggaataaaccagattgtgaccggaaatttaacatcactgtctgagcaagagttgattgactgtgacagaacatacaacaatggttgcaatgggggtctcatggactatgccttctcctttattgtagaaaacggtgggctccacaaagaggaagattatccttacattatggaggaaggtacttgcgagatgactaaggaagaaactgaagttgttactattagcggataccatgatgtgccacaaaacaatgaacagagcctattgaaggcacttgtaaaccaacccctcagtgtggccatagaggcttcaggcagagatttccaattttacagtggggtatatatttaa

SEQ ID NO: 2021 - DNA, 1050 bp, Glycine Max
atggctttctccttctccaaagcacttgtccttgcctgctccttctgcttatttgcgtctttggcttttggacgcgatttctccattgtgggctattcatcggaggacttaaagtccatggataagctcattgaactctttgaatcatggatgtcaaaacatggcaagatttaccaaagcattgaggagaagcttcttaggttcgagattttcaaggataacctaaagcacattgatgagagaaacaaggtggtcagcaactactggcttggcttgaatgagtttgctgatttgagccaccaagagttcaagaacaagtatctggggcttaaggtggactactctcgaaggagagagtctcctgaagaattcacttacaaagatgttgaattgcctaagtcagtggattggagaaagaaaggtgctgtggccccagtcaagaaccaaggttcatgtggtagctgctgggcattttccactgttgcagcagttgagggtataaaccagatagtcacgggaaatttgacatcactgtctgagcaagagttgattgactgtgacagaacatacaacaatggttgcaatgggggtctcatggactatgcattctcctttattgtagaaaacggtggactccacaaagaggaagattatccttacattatggaggaaggtacttgcgagatgactaaggaagaaaccgaagttgtcaccattagcgggtaccatgatgtgccacaaaacaatgaacagagcctattgaaggcacttgcaaaccaacccctcagtgtggccatagaggcttcaggcagagatttccaattttacagtgggggtgttttcgacgggcattgcggaagtgacttagatcatggtgtggcagctgttggatacggaactgcgaaaggtgtggattatatcatagtgaaaaattcatggggatctaagtggggagagaaaggatacataagaatgaggaggaacattggaaaacccgagggaatctgcggtatctacaagatggcttcttatcccactaagaagaaataa

SEQ ID NO: 2022 - DNA, 303 bp, Glycine Max
atggctttgagaaaatcaagtaaacttcctcagacagcactaatcaagcaaatcctcaagaggtgttcgagtttagggaggaaagatgatcaaggccttctggacgtgccaaagggtcactttgttgtatatgttggagaaaacagaagcagatatattgttcctatttccttcctaagtcgccctgagttccaaacacttctccaccaggctgaagaagagtttggctttgatcacgaaaagggtctcactattccatgcgaagaggacgtttttgagtctctcacctccatgctcagatga

SEQ ID NO: 2023 - DNA, 624 bp, Glycine Max
atgggactaagagctttattactggtaattttctttcattgttatattattgttgactcaagagttcccaaatttcactttgactccgcttgttttgtatccaattcagggaaacctgtatttggtactctcgttgctcttctacaaaatggcacaccaatccttggcataattgatcaacctgtgttaagagaaaggtggatcgggatagcaggaaagagaacctcactgaacggacaagaaatatctacacgcacttgtgcggacctttctcaagcatacctgtacaccacaagcccacatctgttcagtggagatgcagaagaggcattcattcgtgttagaagcaaggttaaaattccattgtatggctgcgactgctatgcatatgcacttttgtcttctggttttgtggatcttgttgttgagtctggtctgaagccatacgattttcttgcattgattcctgttattgaaggcgctggaggtgtcataactgattggaaaggagataaactgttttgggaagcttctccactttcaatcgccacaagttttaatgttgtggctgctggtgacaaacagattcatcaacaagctctagattcattgcagtggaagtga

SEQ ID NO: 2024 - DNA, 1590 bp, Glycine Max
atgggagaaaaatcgaggtccaaaggagggtgctgcggttggtttatcgcgtttatcattctggctctcgtcgtcggtgccattgtttttaccgttaagaagaaatttagtcactccggttccgataagcctgctccggttcccggtccccctggcgccgttgaccaaaaatattccactgcactcaaaactgcgatgcaattcttcgatattcagaaatctgggaagttagttgacaacaaaatatcttggagagggaattcggctcttaaggatgggagccaagcgaagttggatctaacaaaagggatgtacgatgctggggataacatgaagtttggttttcccatggcttttacggcgacggtgctgtcgtggtccattctggaatatggagatcagatggatcacgttggccagttagacgctgcgcaagattcgctcaagtggatcactgattatctcatcaatgctcacccttctgagaatgttctctatattcaggtgggtgatcctgttgcagatcacaagtgttgggaaaaaccagaagccattactgaggaacgaccactcatacaagtgaatgcatcttgtcctggatcagacgttgcagctgaaactgcagcagccatggcctcagcatctttggtctttaaaaagactgatcctacatattcaagcactctactcaagcatgcaaaacagttgtttacttttgctgacaagaatagaggttcctatagtgagaatatacccgaagtccagacatattataactcaactggatatggtgatgagcttttatgggcagctagttggctctatcatgctacgggtgatgattcttaccttcagtttgtgactggccaagatggagaagactatgctcaatggggaagcccaacctggttcagttgggataacaagcttgctggaactcaggttttgttatctagattaagcttttttaaggcaaaggacatttcgaattcatatagctctgggctccatagttacaggaaaactgctgaggctgtaatgtgtggtcttcttccggattctccaacagccacaaaaagcagaacagatgatggtcttatatgggtgagccaatggaactctttgcaacatcctgttgcatccgcattcttagctgctgtttacagtgactatatgctaacatcgcagacaccaaaactaaaatgtggttcagattcctttaccccatcagatcttcgagactttgccaaatctcaggctgattacgtattgggcaagaatcctatgcatatgagttttctggtgggctatggagataaataccctcaatttgtgcatcataggggtgcttcaattcctgctgatgcaaaaactggctgcaaggatggcttccagtggcttgagtcatctgatcctaatcccaatgtagctactggagcacttgttggtggacccttcttaaatgagactttcattgattccaggaacaattccatgcaaacagaaccaagcacgtacaacagtgctgtcatagtcggtctcttatcaagtttagttaccacgtcttctgccgttcaatcctttacctaa

SEQ ID NO: 2025 - DNA, 2586 bp, Glycine Max
atgggagatagtggtgtgacatcatctgctgctaccatgatggaagctccaccacctgatggaacaacaacaacagcaacttcaatggattttgattacatgggtgagtttttcttagatgggtgctggttggaagcctctgccgatgtatctgacttcttgctgcaaagtccttccttttccaatcccctctttgacccttcattatcctggcctgccttggagaccaaccacaataaatcccaggatgctgcttttgggactcaacaagaaagtcataacaacatcgttagtgtttctgagactcattcagttgaagattacaacaggaacaaagatatgcttatacagatttgggtgccaattcataaagagggtaggccgattcttgcggctgatgaccttctgttctcacttgaatccaagtctctgaatcttgcaaagtaccgcgaaatctctgtgacatatgagttctctgcagaggagagtgactccaaggagttggcgcggggattgcctggtcgagtgtttaggtacaaggttcctgagtggactcctgatgttagattctttaggagtgatgagtatccaagagttgaccatgctcaagagtatgatgtgcgtggaacggtggcggttccaatctttgaacaaggaagcaagacgtgcttgggggttattgaggttgtgatgactactcagcagatcaactatggtcctgaacttgagaattggaggaatgttgttaacttgcaggctgttgatcttagaagctcaaaacaattaagtattcagaatgtgaaggcatgcaataggacctatgaagctgcactacctgagatttatgaggtgttgagatctgcttgtgaaatgcacagattacctttagctcaaacttgggtcccatgtgtacaacaaggcaaagaggggtgccggcactctgaagataattatctactctgcatatctcctgtggagcatgcttgctatgttggtgatccctctattaggtcttttcatgaggcttgcactgagcatcacttgttaaaaggtgaaggtgttgctgggggagcttttatgacaaaccagccgtgcttctcagatgacataacttccttaagcaagaaagactatccactgtctcattatgcaagattgtttggattgcacgctgctgttgccatacgccttcgaagcatctataatagcacagatgactttgttctagagttcttcttgcctgtagattgcaatgacagtgaagagcagagaaagatgcttactgcactgtccatcattatacaaagggtttgtcgcagcctgcgcgttataagagacaaggaattagaggaagctaacttgtcagttgatgaagtgatagcccttgcagatagtggatttgctaggaatgcaattttttcggaaccccaatacaaagggatggtcgcctcattggatgctgaagaaaaatcaagtgaaacaatgggtagaaaattctctgacctaaggcagcaacaagaaagtcctattttaaaaggaaaccttgactgtgttaaggagtgttctacgtctgttgagggtaacttatcaagtttgggaacaaataaaactggagagagaagacgtgccaaagcagagaaaactatcactttgcaagttcttagacaatattttgctggaagcctaaaagatgctgccaagaatattggtgtttgtactacaactttgaaaaggatctgccggcaacatgggataaagcgttggccttctcgaaagatcaaaaaggttggtcactctctacaaaaacttcaacttgtcatcaactcagttcaaggtgcctctggtgcatttcaaatcggttccttctattcaaacttcccggatctagcttctccaaatttatcaggaactggcttcttctcaactttgaatcaaagtgattatccaaactcaacaagcacacagccagatcatggctcattgagcccagaaggtgcatcaaaatcgccatcttcatcgtgcagtcagagttccatttcaagccattcctgctccagcatgtcagagctacaacagcatcgcacagctaacggtgctggtaacaaagtttccaccacggttagtgaagattctgctggtgttgtgttgaagaggatcagtagcgaggcagagcttaaaagccttagtcaagatagagcaaagctcttgccaagatcacaaagccaggaaacacttggtgaacaccctaaaactcagtatcaacagcctttattgaaaaccagtagcagcaaggtggattctcacagagtaaaagtcgcatatggagatgagaaaacccggtttcggatgccgaagagttggggctatgaagatcttctgcaggaaattgcaaggagatttaatgtgagtgacatgagcaaatttgatgtcaaatacttggatgatgactgtgagtgggtactactcacttgtgatgctgatttagaggagtgcattgatgtttgtcaatcttccgagagtggtaccatcaaacttagtctacaaccttctagtcatagtatgagaagttctttagaatttagataa

SEQ ID NO: 2026 - DNA, 1377 bp, Glycine Max
atgggagatcatacagaatcttgcaatagcggaattttcaattctggatggaacctaagtccaaaacagaggcagaaggttggagtttataacgaggttctatgtagacttagggaattgaatgtcccagaggctatggttcctggttttgaggatgagctttgggcacacttctatcgccttccttctaggtatgcattggacatgaatgtggagagggcacaagatgttcttatgcataaaaggttactggacatcgcacgagccccaactacagcattcgggcctgcagttgaagtccgtcttgtacaggttggttctgcttcagctggtcattctagtaaatcccttcattcaaactcacaaagtaaagtttgtcctgaagattctggtattccaggcaacatgagcttccatcctccaccggctttgggttcgtcaactaatatggaacttgctcttggcgagagccagttacaagttcgagacagggataactatttgaatttttatgcacattatgcccggcccatacatgaaatcacaatttcaacaaatgacaagccaaaacttctctctcagttgacatccttactatctgagactgggttggacattcaagaagcacatgctttttcgacaatagatggctattcattggatgtttttgttgttggtggttgggcggttgaggaaacagagaagttaaaatatgaactagctaagaaagttcagaggctccagcaacctcaattgaaaaaaaatgggagtcttcctactgcaaagcaagagcaaaccaggatgaactttatctggagaattggtgctgggtgtttaagatatgaaaataaaattgcatctggacctttcagtgatttgtataaaggtacgttctgcaatcaagatgtagccatcaaagtccttaaacatgagagtttgaatgacaatatgctaagagagtttgctcaggaagtgtatatcctaagtaaaattcagcacaagaatgttgtcaaatttgttggcgcttgtacaaaacccccaaacctttaccttgtcacagaatacatgtctggtggaagtatgtttgactttttgcataaacagaagactgtccttgctcttccatctttactcaaagtagccattgatgtttccgaaggaatgaaatatttgcatcagaatgatatcatacatcgggaccttaaagcagctaatcttttgatagatgagaatggggtagttaaggtttccgattttggtgtagctagagtgcatgatcagtctggtatcatgactgcagaaactggaacttaccggtggatggctccggaggcatggatgaggctgtttaaggacacaataggcagcagtttgtga

SEQ ID NO: 2027 - DNA, 1350 bp, Glycine Max
atgggagatcatacagaatcttgcaatagcggaattttcaattctggatggaacctaagtccaaaacagaggcagaaggttggagtttataacgaggttctatgtagacttagggaattgaatgtcccagaggctatggttcctggttttgaggatgagctttgggcacacttctatcgccttccttctaggtatgcattggacatgaatgtggagagggcacaagatgttcttatgcataaaaggttactggacatcgcacgagccccaactacagcattcgggcctgcagttgaagtccgtcttgtacaggttggttctgcttcagctggtcattctagtaaatcccttcattcaaactcacaaagtaaagtttgtcctgaagattctggtattccaggcaacatgagcttccatcctccaccggctttgggttcgtcaactaatatggaacttgctcttggcgagagccagttacaagttcgagacagggataactatttgaatttttatgcacattatgcccggcccatacatgaaatcacaatttcaacaaatgacaagccaaaacttctctctcagttgacatccttactatctgagactgggttggacattcaagaagcacatgctttttcgacaatagatggctattcattggatgtttttgttgttggtggttgggcggttgaggaaacagagaagttaaaatatgaactagctaagaaagttcagaggctccagcaacctcaattgaaaaaaaatgggagtcttcctactgcaaagcaagagcaaaccaggatgaactttatctggagaattggtgctgggtgtttaagatatgaaaataaaattgcatctggacctttcagtgatttgtataaaggtacgttctgcaatcaagatgtagccatcaaagtccttaaacatgagagtttgaatgacaatatgctaagagagtttgctcaggaagtgtatatcctaagtaaaattcagcacaagaatgttgtcaaatttgttggcgcttgtacaaaacccccaaacctttaccttgtcacagaatacatgtctggtggaagtatgtttgactttttgcataaacagaagactgtccttgctcttccatctttactcaaagtagccattgatgtttccgaaggaatgaaatatttgcatcagaatgatatcatacatcgggaccttaaagcagctaatcttttgatagatgagaatggggtagttaaggtttccgattttggtgtagctagagtgcatgatcagtctggtatcatgactgcagaaactggaacttaccggtggatggctccggaggtctgtgaatatttatga

SEQ ID NO: 2028 - DNA, 2247 bp, Glycine Max
atgggagctctcacttcattcgcctcttggattcccgaggacgatcttcttctcaagaacgccgttgaggctggtgcttcattagaatcgcttgcgaaaggtgcagtgcagttttctcgaaaatatagtcttaaagagatacaggatcggtggtattctctcctctatgatcctgtcatttctgctgaagccgcggccggtatgacaaactttgagctttcggcttcgcctctcccatcaaagttctataggtttggacacttgaaagaacggaaagttgtttctgctacaagaaagtccgagagtgttcgcaatttgtattatgccaggtgcaaaagaatccgcaatagcatgttaacttccatggacttaagttttctagttgattcggaaaatggtggaacttctaatcatttttcaagtcttgatcctgctcagtatgcttttcctgaaaatttgatggatgataatgttgcttctgatagagttgctgctgttgaagagaatttccctgtcgagctaaagagtgtacttaaggaagaacctcagatttttgaagacaatgtgcctttggatggagttgttgaggatttggatgttcctaatgaattggctatagatgggtggattggagacgatggtttagagagaatgcctttgtccacattggatcatatcaacaatgaccctggaaatatgtgtcctgagtttgatgaaaacaatgtatttgattcagagttagagttctggaggacagatgagagcattcaagaacacaatttgccatgtgatggttttaatgatcctattgcttgtggggatgcttatttggaagaactgtccaattctctcctccacttcagtagcgaggaagaacagattctgatggatgttgatggagatgaagggattgacaagtcttactttgatggtctgacttcactactacaaaattctacaaatgatattaattcagatcagatctctaaaaaggatgaaacagagtcgttaatggcctcacaggcacatgttataaatcagtcagtttcatgtcacaaagaattggatgacaactcggggtcaagctctcgtggtttacaagtagttcacaaattagagttccaaatgtcatcttctgtctcgactacagacccccaatttcctgaactaattaatgaaagtatgccctgttcaataaacaccgagcaccaagaaattccagaaaatgatgacgtttttctaccatttgatgtgcctcctgtcatatttcccccttcatctaaattaattttcaaagtatccaataaaccaatttcttcatctgttattaagcatagagctagtgaaagaggacctgttggtggttctaaggtaaaatgtggaaatgatgctgcaaacacaacagatgctcttttgcatgcaaataaaaaggaagaagctaccagcatttgcttggcaaaggatccaagcaatcatgtggcaaattccttcatgaagaaatcagctgctgattctaaagacttcagaaatcatccccaacctaatggttctagcatgaaaaatgaacaagatttacccttgccacttcaagatcaccagttgcaacgtgctgaactgggatcctcagatgttcttgagtcagagctggtggcaaatcctccagcattagatgaggaagagcaatatatagagagtgacgatgagcttccttcttattctgacgtagaggcaatggtacttgatatggacctggatcctcatgatcaccaggattcttattataatgaggaagtatcaagatatcaacatgtggaaagtaagagagctatcatgaggctggaacaaggttcccattcttgtattcaaagagccattgattcacatggagcatttgccattttgtacagtcgccactcaaagcattatattaagaaacccgaggttttacttggacgagcaactgaaagtgttcctgtggacattgacttgggcaaaggagggcatggcaatgcaatatctcgacgtcaggcaattataaagatggctaaagatggcacattctacatcaaaaactttggcaagagttcaatccttgtaaatagcaaagaagtgcacactggtcagtctcaaagactgcattccaattgtctggttgaggtgaggggcatgcctttgatatttgagataaatcaaagtcgtgtgaagcagtacctggattacatttctgaccattctcagaccttttag

SEQ ID NO: 2029 - DNA, 417 bp, Glycine Max
atgggagctgcctatggcacagcaaagagtggtgtgggcgtggcttccatgggtgtgatgagacctgagctggtgatgaagtctattgtccctgttgtcatggctggagttttgggtatttatggccttattattgctgttattatcagtaccggtattaatccaaaggccaaatcttattacctctttgatggttatgcacatctctcctctggtcttgcctgtggcttggctggcctttctgctggcatggctattggtattgtcggtgatgctggtgttagagccaatgcacagcagccaaaactttttgttggaatgattctcatcctcatttttgctgaagctcttgccctttatggtctaatcgttggtattatcctgtcttctcgtgctggccagtctagagctgactaa

SEQ ID NO: 2030 - DNA, 2694 bp, Glycine Max
atgggagctgttgctggagaagagttagttaaatgggagaagatgggaggagtgggaggccatgaggagaagattctggtgttagtgaggctgaggcctttgagtgagaaggaaattgatgtgaatgaaacaggagattgggaatgcatcaatgacactaccatcttataccggaacacccttcgggaaggttccacattcccaagtgcctacacctttgatagagtatttcggggtgactgttccacaaagcaggtatatgaagaaggggccaaagatattgctctttcagttgttggcggaataaactcaagtatttttgcctatgggcaaacgagtagtggaaagacatacacgatgattggaataactgaatatgctgtagcagatatttttgactatataaataagcatgaagaaagagcttttgtgttgaagttctcagcaattgaaatttacaacgaaattattagagacctcctgagcactgagaacacatcactaaggctgcgtgatgatcctgagagaggaccaattgtagagaaacttacagaggagactctccggaactgggtgcatttgaaagagctcctatcattctgtgaagcacagagacaggtaggagagacatacctcaacgacaagagttctcgatctcaccaaattatcagactgacaattgaaagttctgccagagaattcatgggtaaaagcagctcaaccaccttagctgctagtgtgaattttgttgatttggcagggagtgagcgtgcatctcaggcattatcagctggggccagattgaaagaaggctgtcatataaatcggagtttactcactcttggaacagttattcgtaaacttagtaagggaagacaaggacacatcaattatagagattctaagttgacacgcatactgcagccttccttaggtggcaattctagaacagccattatttgcactttgagccctgcacggagccatgttgagcaaactagaaacacccttctttttgcttgttgtgcaaaacaagtgaccactaaagcacaggttaatgtagtgatgtctgataaggtattggtcaagcagctgcaaaaagaggtagccagattagagactgagttgagaactccttgtcctccttccaccaattgtgattgtgcagcaatgttgagaaagaaaaatctccagatacaaaagatggagagggagattcgggagcttattgagcaacgtgatcttgctcaatctcaggttgaggatttgctgcgcatggttggaaatgatcagaaatctagaaaagaaaggatgaacacctgggaagatgatgattcaacatcagagtcatcaagcatttacccttctgatttacgcattagagaattcaacaatcctcactacaacaatgaaaacagtgaaagtagtcctgataaacaccctgatgaatgctgcaaagaaattctaagtgttgaattggaggaatcaagtagagatgaccttgaatatgctaatccatcagtaagtgacaatggggtgttggcattaacattgtatggagaggaaaatgtaataagtcaggagataccgacccctgtgaatgaggatagggaggacagacagaaccaattaacatatggtgtgttggagcagagaatcgatgattcacaattgagtaatgattctcctttgactatgtcagaaacagtgtcaaattgtaggaatcttaaattaataaggagctggagttgtagggaatattacatgactggttctccggagaaaacgggagaaatgcagaggactccggccagtagttttaaaaaatgcttccctggaagaccagatggattgcagagaaagttccttccattaacttatggctcttccacaaaattgtcaatgaatggctctccatcttctattggaagcccctctatggatgagttaagaaccaacagcatgagatcatatgctaatgaagatgttactagcctccaaactttcgttgctgggatgaaggaaatggtaaaacttgagtatgagaagcagcttgtagatgatgatcagcaagcagagacaacaacttttagatttgaaaagaatatgaaagatgtaggtgtgggttcaatgttagaggcacctgaatctcctgtagaatggcctctgcaattcaagcagcagcaaacagaaatagtggaactgtggcaagcctgcaatgtatcattgtttcacaggacttacttctttcttttgttcagaggtgatccaactgactccatttatatggaggtggagcttagaagattatctttcctcaaagaaacatttgccagtggaaatcagtccacgaacgacgctcacaccgtcacattagcttcaagtgcgaagggtgttcggtgggagagagaggtgctggtcaagctgatgcggagaaggctatccgaggaagagaggaagaatctcttcagcaagtggggcattgcattggattcaaagcgccggaggaagcagttggcgaatcgcatatggagcagcaccgttatgaaccacatcgtggagagtgctgcagttgttgcaaagttattgaggtttacagggcagggtaaggccctgaaggagatgtttggccttagcttctcaccacataggatgtcatattcgtggagaaacaccagggcgtctcttttttag

SEQ ID NO: 2031 - DNA, 2700 bp, Glycine Max
atgggagctgttgctggagaagagttagttaaatgggagaagatgggaggagtgggaggccatgaggagaagattctggtgttagtgaggctgaggcctttgagtgagaaggaaattgatgtgaatgaaacaggagattgggaatgcatcaatgacactaccatcttataccggaacacccttcgggaaggttccacattcccaagtgcctacacctttgatagagtatttcggggtgactgttccacaaagcaggtatatgaagaaggggccaaagatattgctctttcagttgttggcggaataaactcaagtatttttgcctatgggcaaacgagtagtggaaagacatacacgatgattggaataactgaatatgctgtagcagatatttttgactatataaataagcatgaagaaagagcttttgtgttgaagttctcagcaattgaaatttacaacgaaattattagagacctcctgagcactgagaacacatcactaaggctgcgtgatgatcctgagagaggaccaattgtagagaaacttacagaggagactctccggaactgggtgcatttgaaagagctcctatcattctgtgaagcacagagacaggtaggagagacatacctcaacgacaagagttctcgatctcaccaaattatcagactgacaattgaaagttctgccagagaattcatgggtaaaagcagctcaaccaccttagctgctagtgtgaattttgttgatttggcagggagtgagcgtgcatctcaggcattatcagctggggccagattgaaagaaggctgtcatataaatcggagtttactcactcttggaacagttattcgtaaacttagtaagggaagacaaggacacatcaattatagagattctaagttgacacgcatactgcagccttccttaggtggcaattctagaacagccattatttgcactttgagccctgcacggagccatgttgagcaaactagaaacacccttctttttgcttgttgtgcaaaacaagtgaccactaaagcacaggttaatgtagtgatgtctgataaggtattggtcaagcagctgcaaaaagaggtagccagattagagactgagttgagaactccttgtcctccttccaccaattgtgattgtgcagcaatgttgagaaagaaaaatctccagatacaaaagatggagagggagattcgggagcttattgagcaacgtgatcttgctcaatctcaggttgaggatttgctgcgcatggttggaaatgatcagaaatctagaaaagaaaggatgaacacctgggaagatgatgattcaacatcagagtcatcaagcatttacccttctgatttacgcattagagaattcaacaatcctcactacaacaatgaaaacagtgaaagtagtcctgataaacaccctgatgaatgctgcaaagaaattctaagtgttgaattggaggaatcaagtagagatgaccttgaatatgctaatccatcagtaagtgacaatggggtgttggcattaacattgtatggagaggaaaatgtaataagtcaggagataccgacccctgtgaatgaggatagggaggacagacagaaccaattaacatatggtgtgttggagcagagaatcgatgattcacaattgagtaatgattctcctttgactatgtcagaaacagtgtcaaattgtaggaatcttaaattaataaggagctggagttgtagggaatattacatgactggttctccggagaaaacgggagaaatgcagaggactccggccagtagttttaaaaaatgcttccctggaagaccagatggattgcagagaaagttccttccattaacttatggctcttccacaaaattgtcaatgaatggctctccatcttctattggaagcccctctatggatgagttaagaaccaacagcatgagatcatatgctaatgaagatgttactagcctccaaactttcgttgctgggatgaaggaaatggtaaaacttgagtatgagaagcagcttgtagatgatgatcaggatcagcaagcagagacaacaacttttagatttgaaaagaatatgaaagatgtaggtgtgggttcaatgttagaggcacctgaatctcctgtagaatggcctctgcaattcaagcagcagcaaacagaaatagtggaactgtggcaagcctgcaatgtatcattgtttcacaggacttacttctttcttttgttcagaggtgatccaactgactccatttatatggaggtggagcttagaagattatctttcctcaaagaaacatttgccagtggaaatcagtccacgaacgacgctcacaccgtcacattagcttcaagtgcgaagggtgttcggtgggagagagaggtgctggtcaagctgatgcggagaaggctatccgaggaagagaggaagaatctcttcagcaagtggggcattgcattggattcaaagcgccggaggaagcagttggcgaatcgcatatggagcagcaccgttatgaaccacatcgtggagagtgctgcagttgttgcaaagttattgaggtttacagggcagggtaaggccctgaaggagatgtttggccttagcttctcaccacataggatgtcatattcgtggagaaacaccagggcgtctcttttttag

SEQ ID NO: 2032 - DNA, 2379 bp, Glycine Max
atgggagggtcgcgagttcaagtcaacaaacctcacaagtcccgtttttcatccaaatcttctcgcaaccttcataaaacctctgtcaaggacagactcgcaatcgcaaaatcagagcgcaatgtcggcaaaggagctcgtgcagctcgaattcagagaaataaaatgatacgtgatcagaaaagagctgctgttttgaaagaaaaaagagaactcagtgggtcgagaagtcctccccgagtgatagttctcttcgccctctgtgcttctgtggatttagaatcacttgctgatgatctcttgtcgttattatctaaagatacttgtgtggtgctgtcaggaaccgttgcttcttctgaatataggacaagaataacggtactaaaagcaccccatggcgatctactatcatgcatggaaatggccaaggttgctgatctaatggtttttgtggcctcggcaaggtcttcatgtgaagaaactgattcctactacattgactcatttggaaatcaatgcctttctgtatttagatctcttggtttaccaagcactgctgtgtttattcgtgatctatctactgatcttaaacaaagaaatgaactaaagaagatgtgcacatctagtcttgcctcggaatttcctgaggattgtaaattttatccagctgatacaaaggatgagctacacaagttcttgtggctctttaaagagcaaaggcttaaagttcctcattggagaactcaacgatcatacctcttgtctcaaaaggttgatgcagaatatgatggcaactctgaaaaatgcaccctgtttctcactggttaccttcgttctcgtaacctctcagtcaatcaactggttcatgtttcaggtgcaggagatttccaattgtctaaaattgaagttcttaaagatccttgtcctttgaattcaaggaaaaatcaggacctaatggatgctgatgaaatgcatgatgcagaggtcattggttctctagctcctgatcctcaaaaccaggaagccttagtggttgagaatatacctgatcctcttgctggagagcagacatggccaacagaggctgaaattgctaaggctgatgaagataaaaagaaaaagaagataaaaaagaggagtcttcctcatggcacttcagaatatcaggctgcttggattgtggacgattctgatgaggaggagtcggattgtgacaatgaaaacgatgatggtatggtgttggatgaaggggaggatggatttcctggtcaagaaaacaggtattcagactttgatggtgatggggcttctcttagattgggagattctgatgaagaaactgacattgattcagtgatgatggaagtagataatttgacgagagaaaagatagaagatgaactcaaggaacttaaagaagcacatgctgcagatgaggagtttcctgatgaagtggatacaccattggatgttcctgctaggaagcggtttgcaaaatacaggggactcaagtcctttaggacttcttcatgggatcctaaagaatctctaccccaagattatgccagaatttttgaatttgataattttaaaagaacacaaaaacacgttcttgctaaagctttagaactggatcaagaaaaccgggaggactgtattccagttggctcgtatgctaggttgcatatcatgggagtgcccagtgctgttgcttcaaagttatctttgcttgcaaagacaatcccggttacagcatgtgggctgttgaaacatgagtccaaagtatctgtccttcatttcagtgtgaagaagcatgaaacatatgatgcacccatcaaatccaaggaagagttaattttccatgttgggtttcggcaatttgttggcaggccaattttctctagcgagttcataaatacagacaagaacaagatggagaggtttctccatgctgggcgtttttcagttgcttcaatctatgctccaatttcttttcctcctcttcctacgataatcctaaaaagagctggagaggatgctgcacctgcagtggctgctgttggctcactgaaaactgttgatgcagataggataatccttaagcgtgttattttgacaggttatccccagagagtatcaaaacgtaaagcttctgtgagacacatgttttataatccggaggatgttaaatggtttaagcctgtcgagctttataccaaacgtggtcttcgtggtcgaataaaagaacctgttggtacacatggtacaatgaagtgccttcttaacggggttcttgaacagcgtgatactgtatgtatgaatttattcaaacgtgcatacccgaagtggccaacccatcattttcctctatctgaataa

SEQ ID NO: 2033 - DNA, 1314 bp, Glycine Max
atgggatcagcttgttgtgttgctgcaaaggatcatactattcccagcactagcagaactggaggtgaaagtttaaatagaaatgctgtatgttcgccatcatggagttttcgttgggatagttggggccgtgttgctggtgaaattgaggatccttcctttcacacatctcgcagagtcagcagaaatgtcagcatggagttaaaagggtcattaagttctgaaagaggcaatttatctgattggggaagcaccctggataattctgtaacacctttgtctctgaagtcccctgttcgggagcatttggttacaagtcagatgactccatcttcagatctatccatgtcaagtaattgctctgcagtggtgaagaatctgattgaatcaccagagattgcagaatcttcaataccaaatcgttcagtaccttcagttttctcaatccctacgacagatccaatgactaatcataattatcacaatcttcctaactcaacaccatccagatgggctcattgttctcccggacacccactgttaacacaaatttctgatagtcgaattctgggtcttaaatcacctgacaactcaatttctgaaggcaggccatcatttgtactctccaactgtagcaatgatatggcaacaggatcccaatgcgggtcatctgatggctggtctatgcgcaccttttctgaaatggtggccccatctcaaaaggaaaggtggtcttttgatagcgagtattcaggttcaggacgtcacaagataagtggaactagtagcaggttctcgtattccccctccatggatttacaatcttgtggggcttgctcgaagctcttgaccgagagatctgcatggggcagccagaaatttattgccagcagtgacctctcagttgttgctgtactggtctgtggtcatgtttatcatgcggaatgcttggagactataacaccagaggcagatagttatgatccagcttgtccaatttgtatggttggagagaagcacatgtcaaagttatccaaaaaaggttttaggactgaatcagagacaaaggccaagaattacaaaatatccagaaaccgagtagttgatagctacgttgatggtgggatagatgtttttgatcgcctcaaagatatagtttcaaagatggagcccagtagctccagtacaacgagttcatttggaaaacccttcttgaggcgccatttttcgttgggatctaagtggagccggtccctattggagaatgattctgccaggaagaagggcttttgggcaagatatcgcaaagactga

SEQ ID NO: 2034 - DNA, 1800 bp, Glycine Max
atgggatcggtttgttcggctggtatggtggagaaaaatggtgaacttggagggaagagtttggggctttctgggaagcttaagaaggaaaatagctttgtgaatcggagagaagctttttcagattcaagaagcacgatactgggttttcccatgaacttggtttatcgtctccttcacctggggggaaacagtgacatttcatattatgtgagtcagaggggttctattctgggaaaagcaggcgagagagcagtggaagttctggacacaattggaagtggcatgcctaagttaaacactaatagcgggtttgtctctggcacaacttctagagggaataagatatcaatactggcatttgaagtagctaatacaataaccaaaggaacaattttgtttcaatcactttctgaagaaaacattcagttccttaaaaatgaggtgttacaatcggagggggttcagctattagtatcaactgatgtgaagaagttaatagctcttgctgaggctgacaaaagggaagaactcaatgtcttctcaagggaagtgactagatttggaaatatgtgtaaagatccacagtggcacaacctagacagatatttctcaagattagatttggatgtcctggatgacaaacaatatcaggtagaggcagaaaagacaatgcaggagtttaccagcctagttcggaatacttctgaattataccatgagttaaatgcttatgaacgttttgaacaagattatctgcaaaagattaaggaaatggagtccttaaaccttcctctaaaaggggagagtatcacaatgtttcaaagtgagctaaagcaccaaagaaagcttgtgaggagcttgaaaaagaagtctctttggtccagaactttggaagagatagttgaaaagctcgttgatattgttacctatatacatcaagcaatttatctgttccttggaaatcatggtacagctgcaactaagcacagtgacggtcctgaaagactaggggaagctggtcttgcactgcactatgctaacatcatcagtcagataaatatgattgcatctcgcccaactgctcttcctccaaacacccgagacacattgtatcatggtttgcccaacaatattaaggctgctcttccatcccagttgcaaaccgttgctgacatgaaagagctctccatcactcagatcaaagctgaaatggaaaagattcttcagtggcttgcaccacttgccacaaatacagtcaaagcacatcaaggtttcggatgggtaggtgaatgggcaaacacaagtaatgactctggcgataacacctccaaagaaaataacctgattcgcctgcagacactttattacgctgataagaggaagatagatgtttacatcattgaattgttggcatggcttcaccatttgattagctctgtaaaatctagacagaataccttgagaccaatgcctacacggtctcctccaaagggacacgaacttcagtctaagatgcgacagttattaattctatctgtggatagtagcaacaagccgttgggaactcaaatttctcatgaggataggagattattggaggatgttattgcaaggaaaaagaaccctggacttagcaaaagcgaggatcttggtttggctaagaaaagacaagtcaaacatttgcaagtgaccaaaagtgctgggagttcacctgccaaggaattcttcggtacaagactcgtctttaaccaccaaaactataacgttttggatattatggatgggttgggttactga

SEQ ID NO: 2035 - DNA, 1722 bp, Glycine Max
atgggcgaggtatctgaaagtaccatgacgaagaggaagaagaagggacgcccctctcttttggatcttcaaaagcgatctctcaaaaaagaacagcaaaatcaccaccagcagcgacacaattcaaccaacgttgttccccacgacgacgacgaggacgagcgcaaggagaagaagcacaagctcttggttggtctcaattcccatctccaccacccaacattattgcccaattcccaacccttcaattccgatcccaagaggcgcaagattattgaccctctccaaacggatgtgaaggttccgaaagcgactgacagtaaacaacatggttcgcagggagagtccggtcccactacgcctttgccagacaaaaagctcttgctgtttatccttgacaggcttcaaaaaaaggacacacatggggtgttctctgagccagtggatccagaagagcttcctgattatcttgacatcattaaacacccgatggattttggaactgtcaggaagaaattggatggggggctatatactgacttggaacattttgagaaagacgtgttcttgatatgctctaatgcaatgcaatataattcctcagataccatttaccatcgacaggcccgagccatgcaagagattgcaaggaaagactttgagaatcttagacaagatagtgatgatgatagtgaaccacagcccaaaattgtgcagagaggaaggccaccaggcaagcactcaagaaagtcactgggactgggtatgcctcctcctgagcgtgttggtcctgaatcttcttctgatgcaactctggcttctggcggggatattgctagtggttccaacggttataatctaagaaaagtacccagcaaatttcagcccacagattcatctgcgagggcctacaacagcacttttaacagtggagggtatgttggctggtctgaatgggagaatgaatttccagcttctgttgtaaaagctgtgctaagatatggaaagaagcagtttgtggttgatgaaaccaggcgtgatacttacaaaaatccagtgactttaggaaatgaacgaccggtgttgtccacagttgaagatgaattcaagcaacttcttgcagtaggtgtacacatgaagcatagctatgcaagaagtctagcccattttgctgcagaccttggtcctgttgtttggaagattgctgcaagtaaaatcagcagtgttttgccagcaggacatgattttggtcctggatgggtaagtgaagatgatggttcgtcacagaggcgacacttcccagtttgtgatgagggtagaacttcagaccctcctgtaccagaggattatagaagtagattttcttctccatctggatcgctcccccttgcaaatagaccattctatcaaagtggagacatggctatagataattaccaaaatgagttgaatccagtaatcaacattcctggtgggtctgaatccataactcctatgaggattcagcaggaatccatggtgcactctgatgattttggttcatgtgatcggttaggttctaatttcccatctcaaatgaagatgggattggaagttcccactaaacagaattcttttgctcttgctaatgacttaaatggaaggattggaactacaaactcacccagttccaacgtggaggctggttcccagttgcagcctaatttggcattacagctctga

SEQ ID NO: 2036 - DNA, 1929 bp, Glycine Max
atgggctgcaacacctcgagacttgaccggctaccggcggtggcactgtgccgtgaccgttgcaagttcttggacgacgcgcttcgccaaagctacgccctcgccgacgcacacgtggcacacatggaggccctcaaaacacttggccacgctctcctctgtttcttcgacggtttcgaggattccgacgaaactaatgtcccaaataaggaaaccaaagttcctgtcgccacgaaatctccaccccctcactccccttcttcctttagttcggactcagacgacgcacacgtgcttttgcattccgaatcagaaaccgaagacgcagaaaaagaagagttccaattccgccgtctccgccgcctccttccggctccgcctgggatttccttaacttcttcgagccgtacgagaagtaccacgtgccttattttcctggcggcggaggaaaatggagaagcgaagaaaaagaagggtgattcgaaggagaagaaggtggtttctgagaaagcggaagttgtattagtttcagagcaatgtagtgactctgcgaaaggtttctctgaggcagtgaaagagattcagattctgtttgagaaagcgtcggagtcggggaaccccgttttggagatgctggacgctgggaaactccgttaccatcgaaaatttgacctcaacccggtttcgtgcaagatgatgcatgtgtttactccctcaagtcctcttggggttagatgcatgaaatcctcggatctcacttacgccaatctctgctctactctgaaaaaactatgtatgtgggagaagaagctgtatcatgaagtcaaggctgaggagaaattgcgtatgcttcatcagaagaagtgtaagcagttgagacgtatgaaacaaaaggatgccgatgcacagaaaattgattctgttcaaactttcattgggattttatctacaaaaatgaaaatttctatccaagtagttgacaagatatctattacaattagtaagttgagagaagaggagctgtggccgctgatctacaggtttattctcacgtttctcggaatgtggaaagatatgcaagaatgttacaaatgccaatatcagcaaattgttgaagccaaaactttagatgccttatcgttaaacacaaagcctggcaatgctcatattgatgcaacaataaaactcaaatctgaggtacagaaatggaatttgagcttcttagattggattcacgcccagaggtcccatgtgaaagccttgaatggttggctggtaagatgtctattatacgaacccgaagaagtacccgatgattcaactcccttctcacctagcaagattggggcaccacctgtgtttgtgatctgtcacaaatggtcaagggcagtggataatctctcagagaagaatgtaattgaagccgtaaatgggttcatgctacgagtgaacgagctcttggaaaagcatattttagaccttcaacaaaaactaacattggacaaagaatttgagagaaaggtgaaaatgttggagagggaggagcaaaagatgcacaaagtgatgcgggctcatgagaggaagatggttacagttggcagagaagaatctgatgcacttttacgtggagatgctgtgcatcacgctgatatcgttgattctactaacctacaatcaagtttgaagcagatctttggtgccatggaaaagttcacagactccactgttcgcttatatgaagaactttgtcaacaaattaagcaagaggatcatcatctcaaagtttcttccgggaaacatttgttaaattttcggggacttgtttttcacattccttttttttttttaacttggacaccccccgacatttttatattttttttccaaaaagattcattctcagaatctaattttaaaacatatttttag

SEQ ID NO: 2037 - DNA, 2511 bp, Glycine Max
atggggaaatctacctcctgcttcaaactaatcacttgcggtggtgatgcggctgagaaggacgattaccaccaagtatctgagatcaaggaatctaatgataaacgtggatggagtttccgcaagaagtctgcaaggcatcgtgtgcttagcaatactgtgatagcagaggccccatcttctgcaaataaggaaagttcagaatgtaataattttaattttcaaccacttcctgaacctaatgttgttgagaagatttacacaacaaattgctctgatgagaagccccagttatcttcctttgaaagctcacaagtagaagaaacaaatgtcattgaaactgaggagaagttggatgtgaatccaccagagtctgatgtcatcatcatccaggctgctattagagggttattggctcagagagaactactacagcttaagaaagtagtgaaattgcaagctgctgttcgtgggcacttggtccggagacatgctgtaggaaccctgcgttgtgttcaagccatcatcaaaatgcagatccttgtgcgagctcgtcgtgctcggcagtcatgtctggaaaaccatttaaatcaaaaggatggcaaaagggattcctcagaagctttgggaaatgaaaatctcatgaccaaatcaaatgtgaattacacttccattgagaagctgcttagcaataataggtttgctagtcagctgttggaatcaacaccaaagaacaaacctatccatttcaagtgtgatccttctaaatccgattctgcttggaaatggttggaaaggtggatgtcagtatcatcaaaagatattgcagagtgcaaagaaattagttctctgatagagcaatcaagggaaagcaaagatagcactcccatgtttcaattcgaaatgggtattccatctgaaccttttccccaagcagttgactcgaagctcactgttgaagattcacttctgccatctgaggatgaagaaaactactccacatcatctattgtaaaagatgacttggggcctgaaattgccccaccatcagagcttaattctgttcataaggggcctgaaattgccccaccatcagagcataattctcttcagaaggggactgacattgccccaccatcagagcataattctcttcagaaggggactgacattgccccaccatcagagcataattctcttcagaaggggactgacattgccccaccatcagagcataattctcttcagaaggggactgacattgccccaccattagagcataactctcttcataagggacctgaaactgccccaccatcagagcttaactcttttaatcagaagcctgaaattgatggtgagcagggcaaacaatccatgaaaagatttgcctcagaccaactagaggctgaaggaaagaaacctgtaaatggttcaagaaaggtcagtaatcctgcatttattgctgcacagtcaaaattcgaagagctgagctcaatagaaaattcagctgttgaatcacaaggagacacctcttctgttggcaatgatactgcatatagatcaaaagagtttgcatttgaaaatcctgctgcttatctttctaggtttgctggttctgaatgtggcactgaactctctatttcttccactcttgattcacctgacatatcagagcctggcgctatggaaaatgaacgagatgccaaagatttaatggaagggattggtaatcttgagaacactataaaccatgatgatgaggccaatgacaatgtttcacgtgtcatcccagcttctaacctagctacttctgttttggataagtcagagattgttgatgacattagtgccaatttgggtcactcagtggtagctgtggactctgaagagcctgctattaagactgagaaaaatgcacctgacctgcagagagagctgccagagtctgttctgcaagatttaagatcatctccagaagcttcacctagaagccatttaactgtccctgaatcacaaggaacgccttcaagtgaagtgtctgtgaaacctaaagatagcactatcaacaagactagatctggcaataaacgtcggagcctatcattgagtaacaaatcacctacaaatccaaatcatgattcaggctcgaaagacagtagggagcaactgcctaaagatcagcagaatggaaagaggcgcaattcctttggctcagtaaagcctgataacattgatcaagaatctagagataatagtactaacaacaattctctaccccatttcatgcaagctacagaatctgctagggccaaggttaatgcaaataactctccaagatcaagtccagatgtacatgaaggagatatcgaagttaagaagagacattccttacctggtgccactggtaggcaagtttctccacgcatccaacgatcaacatctaaggcacagcagagtgcaaaaggaaacaatgtacatcctcctcaagagagaaaatggctgaggtga

SEQ ID NO: 2038 - DNA, 1032 bp, Glycine Max
atgggtcaaagatatgaaaacaatgttttcaagtctcacataagtaatattgaagctgctcccggtatgacccaaacagttcatcttcctcccccacttcaaaccgaccctaccataagaggaaagcaaaatggtaaaccaaaaggttcaagaaatgcaaaatctgcggctcacagaccttatgccgattccactaattcgactgcggttaacaactgtcgttatgacagttccttaggactgttaaccaagaaatttgtgagcttaatccaggatgctaaggatggaaccctggatctaaatagaaccgctgaaatcttggaggttcagaaaaggagaatttatgacattacaaatgttcttgaaggggtaggactgatagagaaaacatcaaagaatcatataaagtggaagggatgtgatgggcttggacctcgagaactggaagaccaagttaatagtttaaaggctgaagttgatagtctatatgccgaggaatgcaaacttgatgattgtataaggaaaaagcaggagcttctaagaaacctggaggaaagtgaaagctctcaaaagtacctctttataaccaaggaagatattcttggccttccatgcttccagaatcaagaaattattgcaatcaaggctccaaaagctagttccatcgaggttcctgatcctgatgaggaattaggttttcggcaaaggcagtacaaaatgattgttcgaagtgccattggaccaatatatttgtacctcttgagcaaggacgaccacaagtttgaggatgatagtgccaaaccgatgaaattaacaaatccatcatggaatagtgatctctacagaaagaggggtgtgggattattagaaagccaaaatgatgaaaataatccttctgagcgtttcagtttgcagggttcacaagcatttggaattcaagaaattactcccactgattttgaaatggaagatgactattggtttcaatcagatcctggagtgagccaaacagaattgtgggggaaggagtag

SEQ ID NO: 2039 - DNA, 1032 bp, Glycine Max; identical to SEQ ID NO: 2038

SEQ ID NO: 2040 - DNA, 1950 bp, Glycine Max
atgggtgagttgaacaagaaacagcagtggctgttgggctgtttggtgttgagtgcagtgaatgagttgaagaagaagataaagaaaacaatgaaaagaggcatcatgagttcgaatctgtttctgtttccaattctcttttcatttgcctttctgtcctcgcccgtcctctctgcttcggatctgatcctcgccaaggttgaccgtcgcattgatctgacttcacagattgtgcgcatcactacttcactaaaggtacagaatacgggatctgatgttgtatctgagattttgctgtcctttcctgagaaccagacaagtaacttggcatacttgaaggcagcacttggtgaagggaagggaaaagcaaaaccatcttctggtgttggtttacccgtcgaagttgtccacctgaaagatgtgccgcctgccttgacaatttattccgtatctttacctaaggggcttgggaagggagatattctgacgctggatgtcttggctgtttttacccactcattgcaaccatttccagagaaaatcaaccaggctgacatccagcttctactatttcaagaaagtgcacgctatctctccccatatgcagtcaaggtccaatcactcactgttaaattgcctgatgcaagaatagagtcctatacaaaactaggaaatgcaaaacttcagggatctgaattaaaatatggtccatatgagaatcttcctccattttcatacttgccaatagttgttcactttgagaataaccaacccttcgctgttgctaaagagttggtgcgagagatcgaaatttcccattggggcaatatacagatcacagagcattacagtattatccatgctggtgctcagagcaaaggagaattttctaggcttgactatcagaccaggcaatttttaagaggtgcatcagcctttaggcgtcttgttgccaagctaccaccaagagctcattctgtgtactacagggatgaaattggcaacatttccacttctagtttatggggtgactcaaaaaagacagaactggagattgaacctaggtaccctatgtttggtggctggaaaactgcctttaccattggatatggcttgccacttcgagacttcttatttggatcggatggaaagcgcttccttaatatctcttttggtgcccctattagtgagttggtcattgacacactctttgtgaaggttgttttgccagagggttctaaagatatttcagtatctgttccatttcctgtgaaacaatcgcaggagacaaagctttcccacttggatattgttggtagacctgttgttgtgctggagaagaacaatgttgtacctgagcataatgagcattttcaggtctactataagttcaacagtctttctatgctcagggagcctttgatgttgatttctggctttttatttctgtttgttgcgtgcattgtctacacgcatgcagatatatcaatctccaaatcttctgcatcttatttggcaaagctccagtgggacgaggtgcaagcaactattcagcaggtccatggtatcattggccgctgcttaactgcacatgacaagctagaagcgtcattacacgatctttccaggacaggagacactcaagcctgtaaagcaactcgaaaatcagttgatagctcgttgaaagagctctctaaagagttgaagcaaccattggcaattttgcaatcttctccgcaagctgctcaaatattacccaaggtggaggaacttgttactaaggagagagagttgcaggataaacttctagtaaaacactctacaattgtagacgcctatgagaagaaagcaggaagggaaattgagaatcggattgcttcacaacagcagaaaattactgctttgagacgggagattgatgatcttatggacttgattgatgagatatga

SEQ ID NO: 2041 - DNA, 1308 bp, Glycine Max
atgggtgctgcttgttgtgttgctgccagagacaaaactatacaaagtggatcaaccagtgacaatttgcatcggaatgctcgatgttctccaacatggagctttcggtgggatcatcgggggcgtgtagctggtgaagatacttctataaattggttttcagatggtattagcaggaatgatggatcagagaataaaaatgaatcagcatatgtgtcagaggatggaagtccactgcagaattatcaacagaaaagatgccaaaaaccaccaatttcagaagtaactgctgcacacaggagaaattcaacttcagaccaatctttttcaaggactgtttctacggatgtgaacatcgaacaggtgaatgggttggcagaatcatcaatagtatcttgcccatctcccacaaaaccatcactgccttcaacttcattatcagcatctcctttatcatctcaatgtcacatacctccatcaagttcgacccctttgaggtggccctgccattccccaggacaccagctatcacagcaagcttatgatagccgtatcccagcagttaagtcacccagcagcttctctttgtctgacgaaaggcctgtgttttcttcatggagcaatgaagtgggtatgcactcccatggtggatcttcagatggttggtctatacctggcttttctgagctgatgggaacaccccagagagaaagatggtcatttgatagtgagtcctatggttttaaccgagaaagattagctagacccagtagttggttttcagcttcacaagttgatttgcaatcatgtggtatttgctcaaagcttttagcagagaagtcttcttggagcatgcaaaagataattgcaagtaatgacctttctgtagttgctgtccttgtctgtggacacgtctgtcatgctgaatgtttggagattatgacacctgatatcaataagtatgatccagcttgcccagtttgcacttttggtgagaaacaaactataaagttgtctgaaaaagctctgaaagctgaaatggatttgaaggctagaaacaataaatcaaagaatcgggttgtggacagtgatattgacgatgattctgttgtgtttgatcactttaaagggagagggcttaaaggtaaaggtcctaggatagattccagttccagtgggagaagctcctttgggaaaccttttctgaggcgacatttttcctttggatcaaagggttccagatccgtgttagataatcaccctacaagaaagaagggtttcttttgggcaaaatctagcaaggaataa

SEQ ID NO: 2042 - DNA, 1308 bp, Glycine Max; identical to SEQ ID NO: 2041

SEQ ID NO: 2043 - DNA, 780 bp, Glycine Max
atgggtggtcaatcccatgatggttcctcagaatggaaagaaacgtggtgggagaagagtgactggactggatataaggagctaggtgtggagaaatctggtagaaattctgagggggatacttggtgggaaacatggcaggaaaatcttcatcaagatgaatggagtaacatagcaagaatagaaagaagtgcacaaaaacaagcaaaatcaggaactgaaaatgctggatggtatgaaaaatggtgggaaaagtatgatgctaaaggctggactgagaaaggggcacataagtacggtagactgaatgaacaatcatggtgggaaaagtggggagagcattatgatggaagaggatctgttctcaaatggacagataagtgggcagaaactgagcttggaacaaaatggggagacaagtgggaggagagattctttaaaggcataggttcaagacatggagaaacatggcacgtatctccaagcagtgaacgttggtcaagaacttggggagaagaacactttggaaatgggaaagtccataagtatggaaatagcacaactggtgagagctgggatatagttgtagacgaggaaacttattatgaggccgaacctcattatggatgggcggatgttgtgggtgattcaacccaattactttcaattgagcctcgggagaggcctcctggtgtcttccctaatttagactttggttcacctccatcgcctgaagctcatgatgactcacctgatgaagattttccctcttcacaatga

SEQ ID NO: 2044 - DNA, 1119 bp, Glycine Max
atgggtgtagagtggggcgaactacctccagaactcctggaatcaatctcgaaaaccttaaccatctacgtcgattacctcagattccgttccgtttgccgcagctggcgatcctccgttcccaaaatccctctccaccttcctccccaactcccatggctcatgctatctcgccgcgccttcttcgacctctccctcaacaaaacccatctcctcaaccctcaaccctctcaccgcacccgaatctgcggctcctcccacggctggctcgtcatgctcgacgaaaccccccaaattcgcctcctgaaccccctcacgcgcgccacgcgccccctccctccgcttcacgccttccccaacgtcgtcgccttcgatcacgccaacgtcggacgcgagtacctcatccaaaacccttacggcggcctctacgccttcaacttgcgacagatgtgcaattctttcctcggaaagaataacttggcgttctgcagaaacggttacgattcttggattttcctgaacggagaggaagaagagatgaattgctgggaagatgttgtgaattacaacggcttgtttttcgcggtgagtaagggagggactattgcggtgtgtgatgctggagagggttgttttccgcctcgggtgtcgataattcagacgacgacgccgtttggattcgctggggatatccactatgcggtgttttcggcgggagacatgttgctgctgatacgtgttctggatcaggacttttccgatcacgcgggggaggagtcggatttggtgtataggacggtgggttttgaggttttcaagatgaattgggggttgctgacgtggcagagagttgagactttgggcgagcgagtgctgtttgtaggtgggaattcttcgctttcgttctgtgcgtctgattttgttgggtgttctgcggattgcatctatttcaccgacgattattcggagtccaatgacgacgatgcgtgtgggaagcatgatttgggcgtatttaggttacgggataagagcattgaaccgttgccatgttttaatcaaaattcctgttctcggcttcggtggccgctaccaatttgggtttcgccaaatccctgttga

SEQ ID NO: 2045 - DNA, 1263 bp, Glycine Max
atgggttccgtgtctctgaaaataggcgacggaaccgccagattcagaagagcaacagtgtgttcctccgcagttaacattctcatgatattctccgtcatcaccaccaacctcttcgccctctacgccttctcttcttccccaaaagaccctcactcccaccttcaccttcttgacaaaaacttctccctcatctctgagcaggtcaccctcattctccgagagatcgatatgtctcagaagaaacttgcccaaatagaaaaagaccttctcggctacgaaagcctcgacctttctcgacccaacattgcaaacgagctcaaactcttcctccaccaccaccagctccctctaggcaaagactccaaatccggaatcaccgaaatggtctcatccgtcggccattcctgcgaaaaatcctcggacttgttgtctcagtacatgagttacaaggcttttggaccctgccccaatgattggagcgtggcacagaaactcattttaaaagggtgtgagcctttaccaagaagaaggtgctttgctaaaacaatttctaaggtgggtcttcttcacccttttcccacctcgctttggaaagctccagtcaacaacactgttaactggagtggtttaggttgcaagaattttgagtgtttgaagggtaagaagttgagtagagattgcattggttgctttgatttggttaatgggtatgagaatcaaaggtttgtgaagtctaggagtaagaatgattttctaattgatgatgttttggcattgggaagtggtggaattcggattggacttgatgttggaggcgggtctgggtcctttgctgctgttatggccgagaggaatgttactgtggttactagcactttgaatgttgatgctcccttcagtgaattcattgctgcaagaggacttttccctcttttcttgagcttggatcataggttcccgttttatgacaatgcgtttgatttggttcgggcttcgagtggattggatggtggagggagggaagagaagttggagtttttgatgtttgatatcgatcgtgttttgcgggctggtggtttgttttggctggataacttctattgtgttgatgaagagaagaagagggcgttgactaggttgattgaacgatttgggtacaaaaagttgaagtgggttgtgggagagaaggctgatattcttggatcaggtaagtctcaggttgttttatcagctgtgcttgagaagcctgtaagggtctag

SEQ ID NO: 2046 - DNA, 1692 bp, Glycine Max
atgggttcgatcagaagggccgaagcctggtttgtcaagatcgcttgcactgttttcgttcgctccaactcgctggatccgttcgtgggttatttcagtaagcacctaaccccttcgctcgtttacgaggtcgtcaataggctacacattcccaatttgggcttcaagttcgttgaattctgtagacacaagttgcacatgagtcactcttatttgacttatagtttgctcttgaggtcactctgccgatccaatcttcaccatacggcgaaagtggtgtacgattggatgaggtgtgatggccagattcctgataatcggctgttaggatttttggtttggtcgtatgccattgttggtaggttggatgtttcgagggagttgctcgccgatgttcagtgcaacaatgttggagtcaatgctgttgtgtataatgacttgttcaatgttttgattaggcagaataaggtagttgatgctgttgttttgtttagggagcttatcaggttgcggtataagccggtgacctacacagtcaatattttaatgcgggggttgtgcagggccggggaaattgacgaggcttttaggcttctcaatgatttaaggagttttggttgtttgccagatgtaattacgtataatactctcattcatggtttgtgtcggattaatgaggtggatagagctagaagtttgctgaaggaagtttgtctgaatggggagtttgcacctgatgttgttagttacacgactattatatcaggttattgcaagtttagtaagatggaggaggggaatttgctgtttggtgaaatgattagatctggaactgcacctaatacgttcacgtttaatgctcttattggtggctttggtaagttgggtgacatggcttctgcactagccttgtacgagaaaatgctcgttcaaggttgtgtgcctgatgttgctactttcacttctctgattaatgggtattttcgacttgggcaggtgcaccaagcaatggatatgtggcataaaatgaatgacaaaaatattggtgcaactttatatacattctctgttcttgtcagtggtctttgcaataataacagactacacaaagctcgtgacattttgagactgttgaatgagagtgacattgttccacaaccatttatctataatcctgtcattgatggctattgcaaatctggcaatgttgacgaggctaataaaattgtagcagaaatggaggtcaataggtgcaagcctgataagttgacgtttaccattcttattattgggcattgtatgaaagggagaatgcctgaagcaattggtatctttcataagatgttggctgttggttgtgccccagatgaaatcactgtaaataatttaagatcctgtcttttgaaggctggaatgcctggtgaagctgcccgcgttaagaaagttcttgctcagaacctgacattgggtattacatcatcaaagaaatcttatcatgaaaccacaaatgaaatggttaaattctgtaagacttgttggtatccttttacatttgacaaggtatttaatcgtggggcttctcaacaagatgcttttactgagatatcacagttggtacaaagtgcgcttgatgggtacaaggaaactaaattagatcgtgttgtgcgaagaagaggacgcgtactaagataa

SEQ ID NO: 2047 - DNA, 945 bp, Glycine Max
atggtaggcgttttccggcgctccctttctttcccaaacaaaaatcccaaccgtccatcacaacagaaaccgcacatatcacaccacatcaggtccatcagtcttccgtgcagatctcaccctctgatctcagagatcaaagacgagatcaacgacctcaccagctgggcctccacctcaaagtccaatccacaaacacacacaaccatttcccacggtttaacccttctcaaagacacacacgaaacccttcaacacatcctccaactccctcagactctagaaaccctccgaagccaccctctctgggtcgagaagcttctagaagacttcctccgcttcgtcgacgccttcggaatgttccaaacttccatcatgtctctcaaggaagaacactcttccgctcagatggccatacgaaaacgcgacgagtccagggttgtcgcctacgtaaaggctaagaagaaaatttccaaggaaatggaaaagctcgtgtctgtcctccgatgtgttcacgtcacacaacatcagcaacattccacgctgcaggttccatcttccgttgtggacgctcaactgagacacgtcatcgcggatgttatgagcgtgactgtgtccgtttccgttgcgctgttcaacgggattggagtgtcgtttgcgtcacgaaggttgtcgtggacgcagatggtgaggttgtcgagaaacggtgggagggagaataataataaggagcatgaaggcattgaagagcttcgaaatggggtgggaatggaaaggcttcagaatctgaagaagaagggtgatgaagaggtgaggttggttctgaagaagatgcgggatttggaggaatgtgtatgtggcatcgaaactgttaccgagaaagttttcagagctttgataaactctcgggtggcgctgcttaacattcttacccttacacagtag

SEQ ID NO: 2048 - DNA, 279 bp, Glycine Max
atggtgaaagtgtcatcaatggagaaagagggtgaaaagcaaaaactgggggaaggaccccaaatctcaagaatggagccggtaacacatggtgcctatggtggtggaatgtacggtaccgagaaagggcaaccggagaaacaaacaaagccaccggcaagtgagagccagagtgctgatggccccgttgataaggacgctatcaagcccaaacacaatcctcccccttcaactggggacagagatttagatatcactggccagtcttatatccagtaa

SEQ ID NO: 2049 - DNA, 432 bp, Glycine Max
atggtgtggcctttgaaggagagaaggggtccggcatggaagcaagggtggacaagaagcactttgtactccctatctgcacctccgttgcaactcttggccatagttgccatcgtcatgtttttgttatttgttccgtcctatataaacttcaagtcaaccgtgcagacagccaccatcggcttccacgtgttcctcttgttcttgccccttctgttgatttttgttgcctacaccatctctaaatacggtccacgcctcgtggttccggcgccgccaccattctttggtggcattcgagtacgcacagaagctgggagtggggggtttccttggggcgtagcggcgttggtggtgttgctcttggttttggcctcttacctctccgatttcaggtccatgtggtcgccactcatttggagaccctactag

SEQ ID NO: 2050 - DNA, 432 bp, Glycine Max; identical to SEQ ID NO: 2049

SEQ ID NO: 2051 - DNA, 1563 bp, Glycine Max
atggttaccaccaccgttgattcttcctctaaccattactcacccactgctgctactgctgccgctgacacctctaataatttcccgcgaaaaaacctgccatccccgtgggcccaggtagttcgcggtgctgacgctgaacctaaccatcaatcgccgccatcttcttcctcttcctcgttctcgtccctcgattccattaattctaacggtcccgccgttcaaacaagcgataccaccgtgaaacctgcgtggaagaaaccggagtccaatggcgtctcggaagttgggcctgtaatgggcgctcattcttggcccgatttatctgagtccaccaagcccaccgctaaattgacatctgactcctctgttaagactgctgctgatgaagaatcactcaccaccactcctcaggatcctgttaattcagactcccctcagaaacaagccattggtaatgcaaaccctagtcctactcctgcaatgaactatggtatggctaatcgacaaagatcaatgaagcagcgtggagggtcaaatggctataatgttgggtctggtcctgttcagaacaacttctccggtgctacccagaatcttcctccaccgccaccaccgcccccctttcctgtgcttccgatgcctccaagaacatttgcccatgggataccaggggttccagttcctactccaagggatccttacaggaacaataactgggatgcaagacctccgcatgggggttttatgccaccaatgagtgagcatcggagtccctctcgcaggggcaatgctgggcaccatccacgtggagacggtccctatcataacagttatggcagcaggcgtgatcaggatcgtggaggttatgcaaatactagagatgctcatgtaaatcaacagaggatgcctccaaggggattaatgaggcccccgccacctaatcctgctccatttatggggcctcagcctatgcgaccttttgcaaaccctgctgggtttcctgaattctattatttcccaacgctacaatttgaaccctttgggggcatgccatttttcacacatgcacctcctcctgcaatgttcttcccagttgcagaaactcctctcaccaatacaatagccaaccaaattgattattactttagtgatgctaatttagtgaaggatgagtatttaaggtccaacatggatgaacagggatgggttcctattactctgattgcaagcttcccaagggttagaagtttgacaagcaacattaagttgatattggattcattgagaacttccactgtcgtggaagtgcagggggacaagttaaggaggtgcaatgagtggatgaagtggcttccctccgcccagcttcgggccaactctggttcaatatcccctagcggatcaagttctaataacctagcagctgattttgaaaagatcacagtggatgaagctatttcacataaagttaacactgagcctaccacaaatgaagatgctgcaggagagtcctcaactcagtcccaagtcccaaatgatgctactgtgagcagcaattaa

SEQ ID NO: 2052 - DNA, 657 bp, Glycine Max
atggttcttggcttgctgctccctgcaaggagctggtgggctgaaaatgtcgagctcactggcggagaagtccaccttctctcggacttgtactcttctgaggcaatacctcaaggagaagggcagctttggagaccttaccctcgggattgcattgccatgcaccaacggtactatataccaatttcatttttttcccctatcaaccctaaactaaataaattctttcgattaaatctttcttctcttaggtttgaacctttgtctgacgtgttcaatacaatatgtaaattctcgcttagaccggggcgtatcttccttaatataaactttttaagtcaccaaaaagaaagagtcatggctgcttacagtttcataataatgattaagattgcaggagatgataactcctctgcatatgctcaaactcataaccagcaaggaaataatcatccttcaagtattcctaatatcattcctcaagcgccatccacaccaattgttaatgacatgccaatcgccaggaaagcttcccttcatcggttccttgagaagaggaaagatagaattgctgccaaatcgccatatcaaacaaacagtcctatctctgctcctaataagcaggccgaatccctagatgctaaaccacacatctga

SEQ ID NO: 2053 - DNA, 609 bp, Glycine Max
atgtactccgcatcaaccattaaatccgtgtacaagcctccgttgcccagatctccaattcgccttcgaccctctcatgctgctcattcatcaaactctattgctcttcaaacgccaccaggttccttgaccaaatctcagaaaccggttctctccccgaacattcgacccgaataccgtaccatttcgtgcgagttatgggctctgaccaagatggttcgtgacgaattcagcaaagtgaattcggagaaagctgccacgaattcaagtgttctgttcgagagagggagattctatgacgagtattccgctagaaggaacgaaaggctcatgagaaagaaaggagtaactgctgttgatgaaggtaaggctaagcccgttcgctctcttggggttaccatggaatctggaaaaaagactagtgtcagaaaaatgggaactttgaggaaatctatctctgcggcttactcttctggggtgagtggaacaccaaggtacatgctcagaagcatgactaaggaaaataagaaacctcctcttgctgcaaaatttgacaaatctgttgttgctggagagaagaagatgggaacaagaggaagaaggatctaa

SEQ ID NO: 2054 - DNA, 1800 bp, Glycine Max
atgtatcccaaccaagccttttctttagggtcctatgcggagatgatgtctgggacttctctttttcctcatgactacagtgaaactgtaggaggaggacaaaacgaggttaagtttatcacagcaatgggtgagacagtgactatgcactctattaatggccattccaatgctgcaagtggtgatccagcatgcaactcttttgctggggattcccatgttgtttcaaggacacaaatgggaatggtagatagtgagcaaaacatcaattgccagggcctatctctcagtctcgggacactcatgccttctaatgcatccgtctctccatttcaataccaatatcacgacacgggtctcttaccactaatgaatgattttccaaatataaagggaaccatgtctctcaaagatgatgaggccaataacctacatggagagtttagaagtgttgaatgcatggcatctgtgtcctctggaggctttcatgacatgataaaaaaggagggtttttacaaccccaaccacccctcaatgtgtcttaaagaagtcccctctgatctaccaggttactcaaacagcattttgaactcccaataccttaaggcggcacaggagttacttgatgaaatagttaatggctctaaagatgctgatggaaaatctaccagtcaatctatgcaaatgtcttctgcccctaatggttccagtgccaatgcttctagtgacctatcgtctgcagaacgccagaccttgttggacaagaaaacaaagcttttgtccatgttggatgaggtagataaaagatacagacagtactgccatcagatgcagattgtggtgtcatcttttgacatggttgccgggtgtggagcagcagaaccatatactacacttgctttaagaacaatttctcgccactttcggtgtttgcgtgatgccatcagtggccaaattcaagtgacacaaagaagccttggggagcaagagggaataccccgtctccgctatgtggatcagcaacttagacaacaaaaggcccttcagcaacttggtgtaatgcgacaagcttggaggcctcagagggggcttcctgaaagctctgtttcaatactccgtgcttggctctttgaacattttcttcatccttaccccaaggattctgagaaaattatgctggctaggcaaacaggcttgaccagaaaccaggcattcaatgttgatatcaggtggcaaattggttcatcaatgcaagggtgcgtctctggaagccaatggttgaggaaatgtacaaagaggaatgatgttcaagagtctgataacattaacaataataataataaatgggaagagtcacaggacaatttagtaactgttgacagtgtgcaagtccaacctcaagcagaaatggatagagtggtcaatgtagaaaatgtgggtgaccaaaaccaacaaaggcttggcttgaacaacaacaacaacagcagcagcaacttttattctatctcaaccaacgagaatggtggggatggaggcctaatgggtacttctactcatgccacatatgatttatcagagttgggtaactttactgtgggtagccacgtttcccttgcattggagttgaggaactgtgaaaatgatgggtttgccatgtctgatgatgccatacagaaacgacgtaagcaaacattgtcctcttccccggagactgatttgctagattatcatttcacggattcaggaaagcaacagcacaggtttggcaatccccatttgctgcatgagtttgtcgtatga

SEQ ID NO: 2055 - DNA, 606 bp, Glycine Max
atgtcaacaataaacgaggaccatatcgtcgacgaatcgaactgttcagaaaccaaactagtcgaagaggaagaggaagacttacagaagcttctagtccctgacttgcagaatcttcctctcactcctgcttccgccgttgaaaccaactttgccatttacttcgccctagatttcatgaagccagctcacgatcagtacgtttaccgccacgccaatggcttgtgtgtgattgggttggctccttcccacattgctttcaatgatgaaggtggaatcacagccgttgatttcaatgttggaaagtctgatcgcagcgggataaaagtcactggaaagcggaagaagaacgcacaacactttgagtccaatacggctctgtgtaaaatttctaccaaaaatgatacttatattgtgagatgttgcgtcaaaggctcccttttagaaatcaatcaacaactaatcaagcagccagaactgcttaatgtttcggctggcagagaaggatacattgctattatcatgccaaaacctgctgattggctcaaggtcaaggcttcccttgttagccttcaggagtacaagaaatcgagggaagtcaattga

SEQ ID NO: 2056 - DNA, 812 bp, Glycine Max
atgtcaatttcaaataaacggctttcagtttcggcgatgacggtgctgctgttgttaatgaacggttatttggcgaggagagttgttccagagcgcggcaatgatgcatcaatgcattcaagcttaagcctttgtatattggaaggagaacttcttcaaacgagccttgtagttcctggagaatgcctccaatgcagccattttctttggagacttctcagaggttgcatttcaacaaggagaaaattgatttccaaaggtgttggttgcatcccctcttgtccacatggtttgaacttcaccgaggatgattggcacactttcgttgattgtgaaaaagcaaagcaattttgctctctcactcatctaccaaatgacctcaagtgcaaattttcaatgattctatggtccatttggaaaaacagaaatgagaaggtttggaacaatcttgatatttctccagcaacatcaatatctctatccgaccagttttattcagaatggtctcatgctagaagaaagagcaataacattccctccctccccgctcaacaagttcacggaacatgggagccccctccactgggatatatcacctgcaatgtagctatctttcaagacataaatgcttttggtgcagacttgtgtattcgcggtcatgatatgatggaaactttattcgaccaaaaacatgcatctttaatggcaaaccaactctttatcaagcaaaaggatgggcactattcaaagcaattcaatggatatcccaacttgatttctacaacgccatttttgagtcggattgcaaattt

SEQ ID NO: 2057 - DNA, 387 bp, Glycine Max
atgtcagcggcacttggaaaatgcagcagaatccgccacatagtcaggctccgccaaatgctgcggcggtggcgtagcaaggcccgtacgtcggcccacagaataccgtctgatgttccagcgggacacgtggcggtgtgcgtgggcaacaactcgaaaagatttgtggtgcgcacgacgtacctgaaccatcccgtgttcaagaggctactggttgaggcggaggaagagtacggcttctccaaccacggtcctctcgccattccctgcgacgaagcgatcttcgaacagctcctccgcttcgtttcacactccgatgactgccacgtgcctctcagaaacaacctcgacttctaccttgaatctcgaccactactcctccactga

SEQ ID NO: 2058 - DNA, 969 bp, Glycine Max
atgtcatcggcggcgagaactcccggtggcgaggagggaaagcactaccctgctccactcgcccctcacgagggcgtcgtgaaggactccactctcttctgggacactctaaggcgctttcactttgttatgggtaccaaatttatgattcctgtgattggagggaaggagctggatttgcacgttctttacgtggaagttacgagaagaagtggctacgagaaggtagttgcagagaagaagtggagggaagttggtagtgttttcaagttcgcagctaccaccaccagcgcttcttttgtactcaggaaacactactttagtcttctttatcattatgaacaagttcacttctttaaagctcggggtcctatctacactccatcagcagatgcattttccggcaacagcccttcgtggagacctgaattagctattgtggaatattcgcctaagcctatggataatagtcctgaatctcgtgctgaagatacttcatgcctttcaggaaatggaaccatcgagggaaaatttgactgtggttatttagtgtccgtgaagcttggttcggaggttcttagaggggtgctttaccatcctgagcaattggttcctccaccatcgattccaaaacatgagagtgccattgtaccaatcaaccgcaaacctcaccgttctggtcgtaggaagaaaaacaaaagaaggtgggaccccaattatccaaagccgaataggagtggctataacttcttctttgctgaaaagcattacactctcaaaactctctacccaaacagagaaagggagtttaccaaaatgattggccagtcatggaacagtcttagcccagaagaaagaatggtttatcagaacattggcttaagagacaaagaaaggtacaagagagaattgacggagtacaaagagaagatgaagcttaggcagacctcagaagttggacgtccatag

SEQ ID NO: 2059 - DNA, 1164 bp, Glycine Max
atgtccaactctattacctatcatcaaaaccaatttgagaaccaagagcttgatgcttatggctcttctatgaggctcaacaatgcatttcctgaggccttgggagcatttcctactagcattggagtagttgctgagggctctgagataagccacactaggcatttgatggatcttcttggagcagcaaatgagagcaatcaccaccaaactgctcaagggctttctctttctttaggctctcacatgcttacccttaaacccgggtctcatcaaccccaattacttcatgtctggacaagaggcacctcttatgctgctgtcattgggaactccaggtacctcaaaccggttcagtcccttcttgaagatcttgttgatgttggtggaaatgtggttgatagaatcaatgagaagtatgctgagaagttgtttcgtgggagtagaggcagtgctaggacactttcctcagagttgaaggcagagttggggaataatggtcatttattggctgacaaacatgaacatcaaatcaaaattgcacggttgattactttattggatgaggttgagggaaggtgtgagaaatactaccatcaaatggaagaagtggtgtcatcttttgagatgatagcaggtttgggagctgcgaagtgttacactgctttggcacttcaagccatgtcaaggcatttctgcagcttgagagatgccatattgtcacaaataaatgctgagaaaagaaaactctttcaggatttacctaagatcagtagtgggttgtctcaactaagcttgtttgatagagacagtagacagagtagaatgtctctccaacaacttggggtgatccgaagccaacgccaagtttggagacccatcagagggttgcctgaaacctctgtggctattcttcgttcttggctcttcgagcactttctccacccttatcctaatgattctgaaaagttaatgctggcatctcagacaggtttaactaaaaaccaagtctcaaattggttcataaatgcacgagtacggctatggaaaccaatgatagaagaaatgtacaaagaggagtttggagagttttctgaagactccaacccggctggtaacaactacttgacgagggaagataccacggattgtgtagaggattga

SEQ ID NO: 2060 - DNA, 1875 bp, Glycine Max
atgtccggtcccctcgatcgttttgccagaccttgctttgaggggttttcgggcagtgacgagaagaaggagaggagatctgacttcgagaactccgaggatgaaaggaggaccagaattggatctctcaaaaagaaggcacttaatgcatcctccaaattcaaacacactcttagaaagaagagtagcaggaggaaaagcgatggccgtgttagctccgtttcaattgaggacgttcgcgatttcgaggagctccaggctgtcgacgcctttcgccaatccttgatcatggacgaattgctccccgaagcctttgatgattaccatatgatgttaagatttttgaaagcgaggaagtttgatattgaaaaggcaaagcatatgtggactgacatgctacaatggaggaaggagtttggtgctgatactattgtgcaggattttgagttcaaggagttagatgaagtcgtgaagtattatccacatggccatcatggcgtcgacaaggagggaaggcctgtttatattgaaagacttggaaaggtcgatcctaacaaacttatgcaagttacaactttggatagatatgtgaagtaccatgtgcaggagtttgagaaagcttttgcaatcaagtttcctgcttgctctattgctgccaagaggcacattgattccagcaccacaatcttagatgttcacggagtgggccttaagaactttacaaagtctgcccgggaacttattacccgattgcagaagattgatggtgataattaccctgagactctttgccaaatgtttattataaatgctgggcctggatttaggctgttgtggaacactgtcaagtcttttctcgatcccaaaacaacttctaagattcatgttcttggaaacaagtatcaaagcaaattgcttgaagttatagatgccagtgagttgccagaatttctgggaggtacctgcacttgtgaagatcagggaggttgccttagatctgataaaggcccctggaaaaaccctgatatattcaagatggttctcactggtggagcatggcggtcaaaacaagttgtaaaagttcttaacaatgaaagaaaggttattgtgtatgccaagccaggatacccgatggtaaaaggcagtgatacatccactgctgaatcagggtcagaagccgaagatatatcctctccaaaagcgatgaagagttattcacaccttacgttgacccctgttcatgaggaagctaagatagtaggaaaaacaagctatgccagcaacttgtctgggtatgatgaatatgttccaatggtagacatacctgttgatgctggttggaagaagcaagcatctctacagaggtcttacacctctaaaggagcacctcctcctgacactcagaaaactcctgaagggattcaagctcggatgtgggtagcactgtctatcttcttcttgactgtattaactctcttacgccaagttgcataccctgtgaccaagaaatttccagcattatcttccaatgatgataagagtacttcaaaaccacctcctgatacaacaaacatggaagttcttcctccttcatcaactccatcatgtacagaggaaaatctccttccctccatgctgaaaaggttaggtgagcttgaagagaaggttgacacactccaatctaagccatctgagatgccttatgagaaagaggaattgttgaatgctgctgtatgccgggtggatgctttggaagctgagttaattgctactaaaaaggctctatatgatgcattaatgaggcaagaagagctgcttgcttacattgacagacaagaagaagccaagttgcggaaaaagaagttttgctggtga

SEQ ID NO: 2061 - DNA, 1134 bp, Glycine Max
atgtccgttacggagctgaaggagcgtcacttggcggcgacggaaaccgtcaacagtctcagggagcgcttgaaggagaggcgtctttcattgctcgatacagatattgctggctacgccaggtctcaaggtagatcccctgtcacctttggtcccaccgatctcgtttgttgtagaactctccagggtcatgcgggaaaggtgtactcattggattggacttcagaaaagaatcgaattgttagtgcatcccaagatgggagattgatagtgtggaatgctctaacaagccagaaaacacatgccataaagcttccctgtgcgtgggtcatgacctgtgctttctccccaaccggtcaatctgttgcatgtgggggccttgacagtgtttgctccctttttaatcttaattcccccactgacagggatgggaatctagccgtttcacggatgcttagtggacataaaggttatgtttcctcttgtcagtatgttccagatgaagatactcacttgattactggttctggtgatcagacatgtgttttatgggatattactactggccttagaacatctgtttttggtggtgaatttcagtctggacatactgcagatgtacttagcatttccattaatggatccaactctagaatgtttgtatctggttcttgtgattcaactgcccgattgtgggacactcgtgtggcaagccgagcagtgcagacatttcatgggcaccagggggatgttaatactgtcaaattctttcctgatggaaatagatttggaactggctcagatgatggaacttgccgattgtttgacattaggaccggccaccaactacaagtatatcatcggcaacatggggacaatgaagctgcacatgtgacctccattgcattctccatgtctggaagacttctttttgctggatatacaaatggtgattgctatgtttgggacactttgttggcaaaggtggtcttgaatttaggatctcttcaaaacactcatgagggcaggatcagctgtttaggtttgtcagctgatggaagtgccttgtgtacaggaagttgggatacaaacttaaagatatgggcatttggagggtataggagggtgaattga

SEQ ID NO: 2062 - DNA, 1032 bp, Glycine Max
atgtcgggatctgacatggcaagcagggagcaattcacggttgggatgcacaaaccccaaccccaaccccaacaacaacaacctcagcttcatcaaaacaacatgcgtatggactatgctgctgctgacggcaccgctgttttcgcccctcctaccgttaccgttaacattaacggcggagaatcctctccggcggtgcctccgggcctgggcctggcccagccccagccccagccccagcccatgatggttaactcctccgaaccaatcaagagaaagaggggaaggcccaggaaatatgggcctcacggtggcatggccttggctttgaacaccaccactcctcctggcggcgccgccgtgccggttggccagtccgctggtatcgtgaagcgcaggggcagacctcgtggttctgtcaacaagaataagaagaataacagctctaagtattctgggccaggatcttggtttactccgcatgtcattaccgtgaaagctggagaggatttgtcagcaagaattatgacaatttcccagagtagttcaagaaatatttgcatcttaacagcaaatggagccatatctaatgtgacacttcgacaacctgcctcatctggaggaactgtgacttatgaggggcgatttgagatcctatcacttggaggttctttttttcttgctggaactgaaagggctggggggctgagtgtgtccttgtcagggccagatggccgtgtcttgggcggtggagttgcaggtcttttggtagctgcttcccctgttcagattgttttggcaagctttgtttctgatgtacgcaagcacttcaagcatgcaaagcagatgcagaatgcaaaggtttccatagcagcaggccaaagcagctcaccatcaagaggcactctcagtgagtcttcaggtggggttgggagtgggagcccactaaaccaaagcacaggagcctgcaacaacaccatgaacaactgtaccaccccaacacaaagctttcaaggcatgccctggaagtag

SEQ ID NO: 2063 - DNA, 1617 bp, Glycine Max
atgtctgcgtccgaagcggagaagaaggtcgaggaggaagagaagaaggaagaggtcaaagggggagaactcctgttctgtggtgccacttgttgggatatcattggtcgtcgtaaaggccccgtcgacggtaacctcgtctctccctcgcgcctccgtcctctcgtcggcgtcgatattcgctacgtcgcctccggctgcgtgtcttgtcattgcgtggcgttggacgttgaagggcgttgttatacatggggacgtaatgagaaagggcaactgggtcatggagatacgattcagcgtgataggccaactgtggtgtctgaactttccaaatacaaaattgtcaaagctggatcagggaggagccatacagttgttgttacggatgatggaaattccctagcatttggatggaacaaacatggacaactaggttctggttctgtgagaaatgaaattgagtcatcacctgttcgctgtcttgtgtctgaagtaaaacatactgcttgtggtggtgacttcactgtgtggttatcttccattgaaggagcttctatactgactgctgggcttccacagtatgggcagcttgggcatggaacagataatgagtataattccaaagacagctctgtgaggttggtttatgaaccccagccacgtcctcgagcaattgctgctcttgctggggaagcaattgtcaaagtggcatgtggaacaaatcatacagtggcggtggataagaatggcttcgtctacacgtggggttttggtggttatggaaggctaggacatagggagcagaaggatgagtgggtcccacgacgtgttgaagtttttcaaaatagaaatgttttgccacccgatgcaatcatatcagcaggttctgtgaattcttcatgtactgcaggtggagggcagttgtatatgtggggcaaattaaagaacactggtgatgactggatgtatccaaagcctctaatggatttaagtggttggaatctactatgcatggattcaggcaatatgcaccattttgttggggctgattcctcttgcataagttggggacatgctcagaatggagagctgggatatggacctactggacagaagtcttcagctgtacccaagaaggtggatttacttgagggtatgcatgtaataagtgttgcttgtggtatgggtcattccatggttattgttgatagagcaaatgttgctgatcgacttgaccagcttgatatatatgatgggaaagctgttggtgaaggtaatgaggccgtaaacacaactccagtgcctaagcaggctgctaaaaagggtgcaaaaggagctgacaattcaaagaagaggaaacaatcaaaagattcatctgactcagatgaggatgctgaagaaagtgaggaggatagtgaggatcaaattaatggtgaggctgaggcgaaaaggccacgtggttctggtaaaggccgaggtaagacacccaaaaagtcaggtgctaagggaaaagggtcggtctctggccgtggtcggggtgggactgcagctaataaaaacagttctaaatcccctcaggtgaaatctggtaagagaggaagaccccgtaagtcataa

SEQ ID NO: 2064 - DNA, 201 bp, Glycine Max
atgttattagatcttttatcaatctattgtttgattgatagttttcatggagtagatgaagtctataattcaattcagaaactcattgaggagagggggagaggtctctttgtatatttcttacgccttgtgtcaatgaatcttgtcccaaacatgccttccatgtgcatgtgtgcacacaccagtgtaatcattacctga

SEQ ID NO: 2065 - DNA, 912 bp, Glycine Max
atgttctcacagtgccattttctctctcactccccaattcccaatactacctttcgtctcagagccatggcgcctcacagcacgcctcttgaactcaatcgcttcgccgaggtcggtaacaaagtcgccgatgctgccggagaagttatccgcaaatacttcagaaaaaacttcgacgttattcacaaacatgatctcagtccagtaaccattgcagatcaatctgctgaggaggctatggtttcaatcatactagacaatttcccttctcatgccatttacggagaggaaaatgggtggaggtgtgaagaaaagaatgctgattatgtttgggtattagatcccatagatgggactaagagctttattactgggaaacctgtatttggtactctcgttgctcttctacaaaatggcacaccaatccttggcataattgatcaacctgtgttaagagaaaggtggatcgggatagcaggaaagagaacctcactgaacggacaagaaatatctacacgcacttgtgcggacctttctcaagcatacctgtacaccacaagcccacatctgttcagtggagatgcagaagaggcattcattcgtgttagaagcaaggttaaaattccattgtatggctgcgactgctatgcatatgcacttttgtcttctggttttgtggatcttgttgttgagtctggtctgaagccatacgattttcttgcattgattcctgttattgaaggcgctggaggtgtcataactgattggaaaggagataaactgttttgggaagcttctccactttcaatcgccacaactttgtcttatttgcatgtggcaggttttaatgttgtggctgctggtgacaaacagattcatcaacaagctctagattcattgcagtggaagtga

SEQ ID NO: 2066 - DNA, 888 bp, Glycine Max
atgttctcacagtgccattttctctctcactccccaattcccaatactacctttcgtctcagagccatggcgcctcacagcacgcctcttgaactcaatcgcttcgccgaggtcggtaacaaagtcgccgatgctgccggagaagttatccgcaaatacttcagaaaaaacttcgacgttattcacaaacatgatctcagtccagtaaccattgcagatcaatctgctgaggaggctatggtttcaatcatactagacaatttcccttctcatgccatttacggagaggaaaatgggtggaggtgtgaagaaaagaatgctgattatgtttgggtattagatcccatagatgggactaagagctttattactgggaaacctgtatttggtactctcgttgctcttctacaaaatggcacaccaatccttggcataattgatcaacctgtgttaagagaaaggtggatcgggatagcaggaaagagaacctcactgaacggacaagaaatatctacacgcacttgtgcggacctttctcaagcatacctgtacaccacaagcccacatctgttcagtggagatgcagaagaggcattcattcgtgttagaagcaaggttaaaattccattgtatggctgcgactgctatgcatatgcacttttgtcttctggttttgtggatcttgttgttgagtctggtctgaagccatacgattttcttgcattgattcctgttattgaaggcgctggaggtgtcataactgattggaaaggagataaactgttttgggaagcttctccactttcaatcgccacaagttttaatgttgtggctgctggtgacaaacagattcatcaacaagctctagattcattgcagtggaagtga

SEQ ID NO: 2067 - DNA, 387 bp, Glycine Max
atgttgaagttcttgtcgagagtgaaaatcgagttcaacgcgttggacccgcgaacggcatcgtgtatagagtttctggcgcaatgcaattcacggagggcgaaggagtcgaacccgacgtgcgaagtggacgtgaagcgcgtgagggaagagcgcgcgccgcagataacggtgacattcgttaacggcgtcgaggaagtgttcgacgcgacggcgacgccggctcagagcataagaaacttgattctggaaaagggtcagcacctcgagacggagcagatgtttcgcgaagcaggggaaccctggccggttatcatccccgacgaggagctctcccaaatcgcactccctaccaaaccaaggaaagcggaagacaagaagcaatag

SEQ ID NO: 2068 - DNA, 2490 bp, Glycine Max
atgttgctaaaaaaatatcgcatattttggtactccttgtattttgagcggttcaaaaaattcgtaccatcatatactaacactgatatgtcacattttataattaaaagatgtggggaaatggcacgtaggctacggttgtttaaggaacaaatgacgaaagcaggtgtatctccctcaatgtggtcaacaagagacgatcattttgatctggaacatttggaggttaaacttgaagaacttgaagctgagctcctcgagattaatgcaaataatgagaagttgcagcacacttacaatgagctattagagtataagcttgttctagagaaggttggtgagcttttctcttcagcaaaaaataaggctgtagctcaccagaaagagcttgaatttcagacaactgttgaagggtctattgacagtccattattattggaacaagaggagacgacaacaaagcaaattaagctggggtttattggtggacttgttcatagggaaaaatcaattcctttcgaaagaattatatttcgtgctgctaggggaaatctgtttctcaaacagggtgtgattgaacatcctgttcttgatcctttgtcaggagagatggttcataaaaacgtatttgttgtcttttattccggagaaagagttaaaagtaaaattctgaaaatatgtgatgcttttggagcaaatcgttatgctttctcaaatgactcgagtaaacaatttcagacgataagagaggtttctggaagaatttcagaattgaaggctaccattgatgcagcgttgattcaccggagcactctattgcagacaattggatatcaccatgggcagtggaggcttctgttgaacattaatgtgacgaagaaatgtctccttgcagaaggttggtgtcctgtttttgcaacaagtcagattcacaaagtattgcagcgggcaactatggactgcagttctcaagttgtggcgatattccaggttttagagacaacggaatcaccacctacctatttttgcacaaacaaattcacttcttctttccaagaaattgttgatgcctatggaatcgccaagtaccaggaagcaaatcccggtgtatacacagttgtcacgtttccattcctttttgccgtaatgtttggtgactgggggcatggcatatgcttattactggcggctttgtatttaatgatcagagagagaaaatttgctagtcagcaagtaatgagttcttctctgttccatttgaactatttggaccatctgcctatggatgtcgtgatccttcatgtaggtggctattacacttatccatttggcgtggatcctaaatgccatggtactcggagtgaactgccatttcttaattctttgaagatgaagatgtcaattctgctgggggtatcccagatgaaccttggaatcataatgagttactttaatgcaaaatacttcaaaaacaacataaatatctggtaccagttcgttccccagataatattcttaaacagcttgtttggctatctttcactcctcataattataaaatggagcactgggtcgcaggctgacctgtatcatctgatgatatacacgttcctaagcccaactgatgatttgggtgaaaaccagcttttcgttggtcaaaagctccttcaactcgtgttactactgttggcagttgttgctgtgccatggatgctactaccaaagccctttctcctgaagaagcaacatcaagaaaggcatcaaggccaatcttacgatttgctctgcggcaccgatgacactcttgaatcagaatcacaaagtattgcccatgaccatgacgagtttgacttcagcgaggtttttgtgcaccaacttatacatacaatagaatttgtgcttggagctgtttctaacacggcatcgtctctacgtttgtgggccctcaaagttcttccggtaacttatccggaagaaggttcttccggtagaacaaattgttcatccggaaaaaccttctttcggaagaataaattgttctaccggaagaaccttcttctggaaacttttcggaagaaggttcttctggaaaaaggttcttccggtagaacacaaattgttcttccggaagaactttcttccggaagaagaaattatttttttaatgcaaggacaattttacccattcacctaattgctgggtgcaccagcaatgttgctggcctagctcattcggagttgtccagtgttttctatgacaaagttctgcttctggcctgggggtataataacactattgttcttattattggcatttttgtttttatctgtgcaactgttggtgtgttactgttaatggaaagtccaagtgctttcttacatgctttgagacttcactgggtagagtaccagaacaaattttatgagggagatggttacaagttcttcccgttttcatttacattactcacggatgaggatgaactgtaa

SEQ ID NO: 2069 - DNA, 486 bp, Glycine Max
atgttggcaatggaagagctactgtgtgaacttagtgatcatgaaaagagaaacgagcaaggtctgcccccgggtttcaggtttcaccccactgatgaagaacttataaccttttacttggcttctaaggtctttaatgacactttctctaacctcaagtttgctgaggttgacctcaatagatgtgagccttgggaacttccagatgtggcaaagatgggggagagagaatggtatctgttcagcttgagggacagaaaatacccaactggactaagaacaaacagagcaaccggagctgggtactggaaagccactgggaaggacaaggaagtgtacagtgcatccagtggaaccctacttggaatgaagaagacccttgttttctacaaaggcagggcccctcgtggtgaaaagaccaaatgggtcatgcacgagtaccgtttggacgctcacttttcccttccccatacttacccatctaag

SEQ ID NO: 2070 - DNA, 1203 bp, Glycine Max
atgttgggctatgcgaacccgtcggggaatctggctgtggatggagacatgacagtgttggaaagacagagggcgaggatgaagtggcaagaagagcaagagtacttttctggaaacagcttcaacggtgttttttcttcttcttcttctctgcacgttccagattccattatggtggctgctgactccggttgtgcacttgctgaggtcgtggctcaggctcagcctcgctcaatcaataagccatctgctgctcctgggcttcatgccaattcttcttctatttcaaggacttttagttgtccacctgctctggtggaccccgagcccaagcccactgactcctcaattgggaaagacagtttcaagaagaggaaaactgacaagcctcacaatcccaaggttgttgcagaaaatgagaacaaagacaagaggatcaaagtcggcgctgatgatggagaatccaaaatcaccaagtgtaacacaataaacacaaataccaacaacaaagaaacttgcacagatacttcaaattcaaagcaaaattcaaaagcctccgaaaaacctgattacattcatgtccgagcacgtcggggccaagccaccgatagtcatagcttagccgaaagagttagaagggaaaaaattagtgagagaatgaactatttgcaagatttagtacccggttgcaacaaagtcacgggaaaagctggaatgcttgatgaaatcatcaactatgttcaatctcttcaacgacaagttgagtttctctcaatgaaattagctgctgtgaacccaaggcttgacttcagtatggatgatctatttgacaaagatgtgtttcctacttgtgctgcaaattttccaaacattggaatgtcatcaacatcatcagacattactaaccctgcctatcttccgtttaattcaccgcagcaaatttttcaatatgatggattagacacggggattaacccttctgatgtggggcttagaaggaccataagtgcccccgtatcaatgcctgaaacatatcttcaatcgtcctgtttcacacaaatgctaccctcctcaacatgggaaggtgatttccaaaacctttgcaattttgatgttgatcaagcacgagccacatctttcccttctcagctgttatcaggtaactataaatttgtgccgtgtcggatcactttttttccttag

SEQ ID NO: 2071 - DNA, 1197 bp, Glycine Max
atgttgggctatgcgaacccgtcggggaatctggctgtggatggagacatgacagtgttggaaagacagagggcgaggatgaagtggcaagaagagcaagagtacttttctggaaacagcttcaacggtgttttttcttcttcttcttctctgcacgttccagattccattatggtggctgctgactccggttgtgcacttgctgaggtcgtggctcaggctcagcctcgctcaatcaataagccatctgctgctcctgggcttcatgccaattcttcttctatttcaaggacttttagttgtccacctgctctggtggaccccgagcccaagcccactgactcctcaattgggaaagacagtttcaagaagaggaaaactgacaagcctcacaatcccaaggttgttgcagaaaatgagaacaaagacaagaggatcaaagtcggcgctgatgatggagaatccaaaatcaccaagtgtaacacaataaacacaaataccaacaacaaagaaacttgcacagatacttcaaattcaaagcaaaattcaaaagcctccgaaaaacctgattacattcatgtccgagcacgtcggggccaagccaccgatagtcatagcttagccgaaagagttagaagggaaaaaattagtgagagaatgaactatttgcaagatttagtacccggttgcaacaaagtcacgggaaaagctggaatgcttgatgaaatcatcaactatgttcaatctcttcaacgacaagttgagtttctctcaatgaaattagctgctgtgaacccaaggcttgacttcagtatggatgatctatttgacaaagatgtgtttcctacttgtgctgcaaattttccaaacattggaatgtcatcaacatcatcagacattactaaccctgcctatcttccgtttaattcaccgcagcaaatttttcaatatgatggattagacacggggattaacccttctgatgtggggcttagaaggaccataagtgcccccgtatcaatgcctgaaacatatcttcaatcgtcctgtttcacacaaatgctaccctcctcaacatgggaaggtgatttccaaaacctttgcaattttgatgttgatcaagcacgagccacatctttcccttctcagctgttatcaggtctggttgaagctggcaatctaaagatggagatgtag

SEQ ID NO: 2072 - DNA, 1293 bp, Glycine Max
atgttgggctatgcgaacccgtcggggaatctggctgtggatggagacatgacagtgttggaaagacagagggcgaggatgaagtggcaagaagagcaagagtacttttctggaaacagcttcaacggtgttttttcttcttcttcttctctgcacgttccagattccattatggtggctgctgactccggttgtgcacttgctgaggtcgtggctcaggctcagcctcgctcaatcaataagccatctgctgctcctgggcttcatgccaattcttcttctatttcaaggacttttagttgtccacctgctctggtggaccccgagcccaagcccactgactcctcaattgggaaagacagtttcaagaagaggaaaactgacaagcctcacaatcccaaggttgttgcagaaaatgagaacaaagacaagaggatcaaagtcggcgctgatgatggagaatccaaaatcaccaagtgtaacacaataaacacaaataccaacaacaaagaaacttgcacagatacttcaaattcaaagcaaaattcaaaagcctccgaaaaacctgattacattcatgtccgagcacgtcggggccaagccaccgatagtcatagcttagccgaaagagttagaagggaaaaaattagtgagagaatgaactatttgcaagatttagtacccggttgcaacaaagtcacgggaaaagctggaatgcttgatgaaatcatcaactatgttcaatctcttcaacgacaagttgagtttctctcaatgaaattagctgctgtgaacccaaggcttgacttcagtatggatgatctatttgacaaagatgtgtttcctacttgtgctgcaaattttccaaacattggaatgtcatcaacatcatcagacattactaaccctgcctatcttccgtttaattcaccgcagcaaatttttcaatatgatggattagacacggggattaacccttctgatgtggggcttagaaggaccataagtgcccccgtatcaatgcctgaaacatatcttcaatcgtcctgtttcacagtaggtttcctctctgtctttacctactccttgtttgttatattggtcacttttttttctcaatttgatcttatttatgtgtgtttgcagcaaatgctaccctcctcaacatgggaaggtgatttccaaaacctttgcaattttgatgttgatcaagcacgagccacatctttcccttctcagctgttatcaggtaactataaatttgtgccgtgtcggatcactttttttccttag

SEQ ID NO: 2073 - DNA, 1281 bp, Glycine Max
atgtttcagagtcccagaaagtttgtgacgccctttactaaatgggtttctgatcttaattggcgtttaggtttaactgggttgatcatccctctggttttattcatcacgttcttctctctgcattattcatccacttcaaacggtttttcagccttttaccctgttcagcagtttctcttcaacatcccttttaagtttatctgcgaggacgatcctgttatttccaaggatgaattgttgcggtcgaaaattgcggtgtgtttggtaggtggtgccagaaggttcgaactcacgggaccttccataatcgaaatggtgctcaaagaataccccaattcggatctttttcttcacagcccgttagataaagacacgttcaagttctcgatcttgaagtttgcgccaaacgtcgccgccgttcgaatcttccacccccaaccgttgccggagaacgagccgtatgttcgagtcctcaccgcgcataactcgcctaacggaatccaggggcttcttcagtactttaacctagtggagggatgcctaacgatgataaaatcacaccaacagaagcacaacttcacgtacgattggataatccgaacacgtgtggacgggtactggaacgcgccgttgggtcccgaaaacttcgttccgggaaaatacctggtcccaccgggctcctcgtacggaggactcaacgaccgtttaggaatcggcgacctcagaacctcgacggtggcactgtcgcgtctctctttagttccaaacctcgattccgctggcttcaacaacctcaactcggaggcagcgttcaaggcccaactcaccacgctgaacgtgagccacgtggcgaaacgactcccgttctgcgtcgtttcggaccgcaggtacgattttccgccggggcggttcggggtgccggtggcggcgctttcgagcccgggcccattgagtggggccaagtgcaggccgtgcaggccggcgtgtgagggtttgtgcgtggagactgtgatggataacgttgagaaggagtggagttggacccattgggaaaacggtgcgcttcagctctgcgacgcacacgatgcctgggagagtggttgggagaagatttttgaccggttttctgggaacaaatttgcggcggctaggaagcgaattcactctatgagaatgggggagtgcgttaaggattttgttcagttgaggaaacggagtgcgcattggagtgcgcctccggtggatgagatttgtacattgggtttgagtccaccgtga

SEQ ID NO: 2074 - DNA, 1689 bp, Glycine Max
atgtttccattcttcaatttgcagtcatcattgccagacctcagaaaatgcaatctcagggcaataacaaatttacagtcacttctagtctccttaaaagtgttcaactatgattactgcttgaggcgtgtggaatggagcttcgccgctctctccccctttggcgacctcaactacgctcgtcttcttctctccaccaatccctctactacaacactctccttcgcgccttctcccaaaccccccaccccaccctataacttcactttccccttcctcctcaaatgctgcgctccttccaaactccctcctcttggtaaacagctccacgctctcctcaccaaactcggcttcgccccagatctttatatccagaacgtcctcgttcatatgtactccgagttcggcgacttggtcctcgctcgctccctgtttgatagaatgcctcacagagacgttgtttcctggacctccatgattagcggccttgttaatcatgatttgcccgttgaggccatcagtttgtttgagagaatgttgcaatgtggagtagaggtgaatgaggccacggttatttctgttttaagagcccgtgctgattctggagccttgagtatggggaggaaggtgcatgcgaatttagaggaatggggaattgaaattcactctaagtccaacgtttccactgctcttgttgatatgtatgccaagagtgggtgcatagtgaggaaggtgtttgatgatgttgtcgacagagatgttttcgtttggactgcaatgatttctggcctcgccagccacgggctttgcaaggatgccattgacatgtttgtggacatggaaagttctggggtaaaacccgatgagaggacggtgaccacggttttaacggcgtgcaggaatgcaggcttgattcgtgaaggtttcatgttgttcagtgatgtgcaaaggcgttatgggatgaaaccttcaattcagcattttggctgtttagtggaccttcttgctagagcagggcgtttgaaggaagctgaagattttgttaatgcaatgcctattgaacctgatgcagtcctttggaggaccctcatatgggcctgtaaagttcatggcgatgatgacagggccgagcggttgatgaagcaccttgagatacaagacatgagggctgatgatagtggaagttacatacttactagcaatgtttatgcgtccacgggaaagtggtgtaacaaggcagaagtgagggagttgatgaataagaagggactagtgaagccgttgggatctagtaggattgagattgatggtggtgtgcatgagtttgtgatgggagattacaatcaccctgaggcggaggaaatatttgtcgaattggctgaggtgatggataagataagaaaagaagggtatgatcccagagtttcggaggtcttgcttgagatggatgatgaggaaaaggccgttcagttgcttcaccatagtgagaagctggctcttgcttatggtctaatcaggataggtcatgggtctacaatctggattgtgaaaaacctaaggtcttgcgaggactgtcacgagtttatgaaactaatctctaagatatgcaaaagagatatcgtagtgagagacagaatacgtttccatcattttaaaaatggagagtgctcttgtaaggattattggtag

SEQ ID NO: 2075 - DNA, 1740 bp, Glycine Max
atgttttctgaaagattgggggcagacgaatctcattgtcaagatttacagagtttgagtgtgtcaaagcgacttgtgaggagtgttagccagaagtggaggaagaagagtaacaggaattctggggaagaagctgacgatgtaaatggagtttctttaagatgcttaaatctgtatggacgaggtgggggctgcaaggtaggtgctgacactggtgatgattttggcgattcaagcagtagaaggagatctagtgccagtgacgaaggaaagggatataagccgatttgtggcccagaagaaactgctgtggattgcttttcatatggggtgaaggacaggttctggaggagacacaaccgaaagaattctgagcttgaagaattgtttacaaacaatagaatgcatatttttcttcctgatgatattcttgaaatgtgtttggttaggcttccactgacaagtctcatgaatgcccgtcttgtgtgtaaaaaatggaggtcgttgaccaccacgcctaggttcctccatatgagaagggagggttcatatcaaagtccatggttgtttctgttcggggttgttaaagatggattttgttctggtgagatacatgcgctggatgtgtctctgaatcaatggcacaggatagatgctcattttctcagaggaaggttcttgttctctgttgctggtatacaggatgatatcttcattgttggaggatgttcgagcttgactaactttgggaaagtggataggagctcattcaaaacacacaaaggggtgcttgcatttagccccttgacaaaatcttggcgtaaaatgccatccatgaaatatgctagatcaaatcctatattaggaatctctgaggtcagcttggattttccaacttgtcaaagtcatcaaagtcggcaggatagacgttttccaagatcaaggattggtggggtttcagacgtctatgaggatcctcacaagctttcaatgagacgtcattgcaaacctgcttttaatgagactgaagcttcatctttgcccagtcgaaaggcatacaaatttcttagacaaaaaagtgaccattcaagctcaaagggcagtaaaagatttttgttgatagctgtaggaggtctggggtcttgggatgagcctctggacgctggggaaatatatgattctgtgtcaaataaatggactgaaatcccaagattaccttttgattttggggttgctcgttctggaattgtttgtggcaggatgttttatgtttattctgaaacagacaagcttgcagcatatgacatagaacggggtttctggattgcaattcaagccactccaatcccacctcgtgtacatgggtactaccccaaacttgtatcttctgatggccgccttttcatgctctcagtgtcctggtgtgaaggggatggtcagattgggagacgaaacaaggctgttagaaaattatgggagttggatctcatgtatcttacctggactgaagcctcagtgcatccggatgccccaatggactggaacgctgtttttgtgtcagataaaagcctgatttttggggtggagatgttcaaaataattggccgggtattgggttttttcaccgtttgtgatgtgtctgatatggcaaactggaaccatatttcaagggatcatgttactcatgagctggacgtttcttcgtgcttgaccaaatctgtggcagtgttacacctttga

SEQ ID NO: 2076 - DNA, 888 bp, Glycine Max
atgttttttaacggatatgggtatcaagggacatcatcatttgagcagacatttcgatgttactctgcttcgtttattgaaaagcccgaaattgaaaatggtgataaaattataatgcctccttcagtccttgaccgtctagcatttctacgtatggattatccaatgatgtttgaactcagaaatggtgcttctgagagggtttctcattgtggggttctggagttcattgcagatgaaggaactatatatatgccatactggatgatgcagaatctgcttttgcaagagggagacatcgtaagagtgaaattcgtatcacttccaaagggaacatatgttaaattacagccacacacaaaggacttttttgatatttccaatccaaaagctatcttagagaccactttgagaaaattttcctgcttgactactggagatactatcatgatgacatacaacaacaaaaaatattacttggatgttatagaaacaaagcctgctaatgctataagcatcatcgagacagactgcgaggtggactttgctccttccttggattacaaggttactactgcaagcaaaacactagacaaaggcaagttcaatccattttttgggactggtagacgtttggatggaatctcaattcctcctgtttattcttcacggccttccgatgttccaaatgtcaattcattgtcttctacaacatctagttcaccaaatttcgctcgtccatctcagggaaagctagtgtttgcatcgaatttttaccgcacaaaagaaataggaaaggaaaagaatgagtcaaaacaagagccaccccatcagaagcaaccgaaatttcagcctttcattgggaacaagtattccctaaggggttga

SEQ ID NO: 2077 - DNA, 92 bp, Glycine Max
atttatacaacgttcacaaatcacatgttactgttacattttgtatgtttctgtagcagaatctatttactatattttcttgacagcaaaat

SEQ ID NO: 2078 - DNA, 495 bp, Glycine Max
catttcttcaatatcatttcactaagcctcaaacttgacgaattgttggatttgcatgactgcacttataagttgcttcaagtgccaacgaaacaacaagccttggcacgagaatgcagtcacaaatgcgttgatgacattctagagggcatgcacgaacttcactctgtcatccgaaaaaggaaaggtgataaaactattttcacaattgagggtggaaaatacttggcttcaaggaacaagttgaagaagaaaattagaaaggccttgagaaatttgaaagccatgaaaagtgagtttcacaatttttcaatgcttagcatcttaacagaagcagaagaggtcacattgaggtcattagaatctttgttgttgtttatctgtgaccccaagggacaaccaaagcaaagcagatggtcagcaatctcaaagctgatgcatcctaaaagaatggtttatgactctcaagaatcacgcacaaatgaatttgacaag

SEQ ID NO: 2079 - DNA, 711 bp, Glycine Max
cgtttcaacttccagtgcgacctcccggaaccggttcgccgtcgccgcattttctcccagcccatgctcgtcacatcaacgtcggagaccgagctcctgaagtggaacttcctcgtgtacgagtccttctccacgaaaaacgacgtcgtcgtgttcgccaaaggggtcaaccaccgcaacggaaacgatcgctccccgaaggaactccgttccgtgtttgacctaggtaacggcgtccgtaactccgcctttacgagctccgtccaagaagtgttccgttgcccccacccagatccatctgaattagatttggattctcatcatggcttacccaatagaatcggaatctcccttgagatcgttgcagaaaacattattaatgccccctcggtagcgtattacattcccaggcccaagcccatgaagaatgctctagccgtacaagcccggcccgaacatttcttatgcgcgtgcacgatggtttacaacgtggcaaaagtgttacgggaatgggttatgtaccatgcaaaagttggcatggagaatttcgtattgtacgacaatgcaagtgatgatgatttgtatagtgtgatcgaggagcttggcgcccaagacacgagaagctggattctcccacagtgtggtgtactcgaaatcgaagggattgtgcagttggatcatgtacgtgttttctccttcatgggggcatga

SEQ ID NO: 2080 - DNA, 171 bp, Glycine Max
ctgccacctccaccaaaagttcctgaattaccaaagctagagatgtctaaagtccttgaattgtctaacgttcctaaattgttaaaagtagagcggtctaagctgcctaaggtccccgaattgtcaaaacttgagctgtctaatatgcctgagattcctaaggtccctgaa

SEQ ID NO: 2081 - DNA, 269 bp, Glycine Max
gaacccgccttcgagtcatggctctgcgacaccagcttcctcaaagtcctcgaccaccgcacctcctcctccaccgtagccgcctccctcgctccctcctccgccgcctccaccctcttctcccgcctcttgaccttcctttccctcttcaccctcaacgccttcgccaagctcgctgctgatgacttcgccacgcgattgagagttcaggaaaacgtgaaacgctacacccgcaactatttgttcattattttctttgcctgcactct

SEQ ID NO: 2082 - DNA, 499 bp, Glycine Max
gctccaggtgctgctgctcctacacccgttttgacacgtcgctcccgtcgtgcctcgtctcaacgccgccgccggagccaaggaaagagcgaaaccatccctgcaccttttccttgggcgacggatcgccgggccaccgtccacaaccgcaaatatctattggaaaacaatgttctcgtcatcaccggaagggttcagtgcaggaggtgcgagcaggagttcgagatgacgcttgatctggaggagaaagtgaacgagttgcgcaaattcattcagaaagaaagcaggtccatgcatgatagagccccggcggcgtgggtgaatccggtgacgccgaaatgtgtgcattgcggacgagaaaattgcatcaaaccaatccttgtgtacactaagaaaagatcaattaattggttgttcttgttgctgggacaaatgctgggtttctgcacccttaatcaactcagatatttctgcaagcacaccaataaccatcgaactg

SEQ ID NO: 2083 - DNA, 732 bp, Glycine Max
gctgaaaaattgggcattaaggaacttttgccatcacatttcgatgcaaatctccaaccaagcgatctcgtcactggtgtttgctttgcatccggcggttcaggatacgatacgattctctcacatctaaattcgcttttttttcctcttaattattacatgttcaaagaatacataagaaagctaaaaggactctttttgagtcatgctagagaagtagaatatgatatatattcgtgcttacgtacactgaccaaatgcaaattaaagtttattcaagaaatatatcaactaggtgctcggagggtaggagtattcagtgctccaccaattgggtgtgtgccatttcagagaacactgtttggaggaatagttagaaaatgtgcagaaaagtacaatgacgcggccaagttattcaacaacaaacttgcaaatgagttggcttcccttaaccggaacgtgcctaattccaggatggtttacgtaaaccttgatgtttgcaaccctctacttgatatcattgtaaattaccaaaattatggatttaaagtgggagacagaggatgctgtggtacgggcaaaatagaggccgctgtgctatgcaaccctttgcatcccacgtgtccagatgtgggagactacgttttttgggatagttttcatccttcagaaaatgtttacagaaagctcgtagctcctattcttcgaaaatatttgtaccagttcctctga

SEQ ID NO: 2084 - DNA, 396 bp, Glycine Max
ggaagatccgggcgacgcaggcgttggtctacggcattggtctctccgaggagagacatggccaagctgcaggtcggcgtctccttggtctggtgcgagggcaaccgttgtgtgacgacggacaactcttctctgccatggtggttcgcaagccgttgggcactgaatttgaaagcagaagacacaacatacactataccatgccttctgctccttccaaactctacgcagggtccgatgttttgggcgatgatgatatcagagcagaaggtggctcatttggcattgaagccgttggggaggaacaatgcaattgatggaacgtgtggagttggaacgaaagaaccccagcttattttcgcttctgcagacagtgaggaaattgttgatgattaa

SEQ ID NO: 2085 - DNA, 251 bp, Glycine Max
ggtacttgtgtggtcaagaaagaaatcagtttggagcgaccaggcatctcaggcacctcaattcggcctgatggaaaaattgctgcaactgctggctgggaccacaggttgaggatatataattaccgcaaaggaaatgctttagctattttaaagtatcaccattgcacgtgcaatgctgtaacttattcgtccgattgtaaacttatggcctctgcatcggaagacacaaccgtgggactatgggaatt

SEQ ID NO: 2086 - DNA, 2214 bp, Glycine Max
ggttatttgaaatttggatttaacagagaagaaggtggtattgtttactgtgagtgggcacctgctgcacaggaagcacaaattattggagactttaatggatgggatggttccaaccaccagatggaaaaaaatcagtttggtgtttggagtattaggatccctgatactgatggaaattctgccataccacacaattcaagagtgaagtttagatttagacacggggatggagtttgggttgatcgcatccctgcttggatcaaatatgccactgttgatcctaccagatttgccgcaccatatgatggtgtctactgggatccaccactttcagagaggtatcagtttaaatatcctcgtccaccaaagccaaaggccccgcggatatatgaggctcatgtggggatgagtagctttgaaccccgcataaactcttacagggaatttgcagatgagattttgccccgtattcgggcaaataactataatacagtccagctgatggctgtgatggagcattcttattatgcatcatttggatatcatgtaacaaattttttcgctgtgagcagtagatctggaacccctgaagatcttaaatatctgatagataaggcccatagcctaggtttgcaggttttgatggatgttatccatagtcatgctagtaataatgttactgatggactcaatggctttgatgttggccaaacctcacaagattcttacttccatactggagatagaggctatcataaattgtgggacagtagactcttcaactatgctaactgggaagttcttcgtttccttttatcaaatttaaggtggtggcttgaagagtttaaatttgatggatttcgatttgatggagtaacatcaatgctgtatcatcaccatggaatcaacattgcatttacaggggattataatgaatattttagtgaagcaacagatgtggatgctgttgtctatctgatgctggctaattgtctgatccatagtattttgccagatgcaactgtcattgctgaagatgtttctggcatgcctggacttggtcaaccagtttctgatggtggaattggttttgactatcgtctagccatggcaatccctgataaatggattgattacttgaagaacaagaacgactatgcatggtcaatgaaggaaatctcttggagtttgacaaataggagatacactgagaaatgtgtttcctatgctgaaagccatgatcaggccattgttggagacaagactgttgcatttctcctaatggatgaagaaatgtattctggcatgtctagcttggttgatgcttctcctattgttgagagagggattgctcttcagaagatgatacacttcataacaatggcattaggtggagagggctaccttaatttcatgggcaatgagtttggccatccagagtggattgatttcccaagagaaggcaatggatggagttatgagaagtgcaggcgtcagtggaatctggtggatacagatcacttgagatataagttcatgaatgcatttgacagagcaatgaacttgcttgatgataaattctcattccttgcatcaacaaaacagattgtgagcagtgcagatgatgatgacaaggttatagtctttgagcgaggagatctgatatttgtattcaattttcatccagagaatacatatgaagggtataaagttggatgtgacttacctggaaagtatagagttgcattggatagtgatgcttgggaatttggaggacgtggaagagtggggcatgatgtagaccacttcacatccccagaaggcataccaggagtccctgaaacaaattttaataatcgccccaattcattcaaggtcctctcccctgctcgtacttgtgtggcatattatagagtggaagaaagtcaagaagacgacgataataacagtttggttggggtagaagagacttctgctgcagcagatgttgcaaaaattcctgatgaatccgcttctacagaaagtgaagatatcaaattggatggggtgaaagagacattagctgcagcagatgttgcaaaaattcctgatgaatctgcccctttagaaaaaactgaaggtatcaatttggataagttggaagagacaatagtagcagcttctgttgaaagtgaggtagttcgagacaaaccagaagatgcagccaactga

SEQ ID NO: 2087 - DNA, 930 bp, Glycine Max
gtagtagcaacaacatcgttcacactggttaacaaatgcgactacacagtgtggccaggcattctctcaaacgcaggaatcgccacgcttccaacaacaggtttcgttcttcaaaccggagagtccaaaaccgtaaccgctccaacctcttggggtggccgtttctggggccgcacactctgcacgcaagactccgccggaaaattctcttgcctcagcggcgattgcggctccggcaagctcgaatgcgccggaaacgccgccacgccgcctgctaccttagccgagttcactctcgacggcgccggaggcctcgatttcttcgacgtgagcctcgtggacggttacaacgtgccgatgctggtggctccccagggtggctccggcgataactgcacgagcactgggtgcgttggggacctgaacggcgcgtgtccttcggagcttagggttacgagcgtggatgggaaacagagcgtggcgtgtaagagcgcgtgcgaggcgttcgggtccccgcagtattgctgcagcggcgcgtatgggtcgcccaccacttgcaagccttcgccttactcgcagattttcaagaacgcttgcccacgcgcctacagctacgcgtacgatgacaagaccagcacgtttacgtgcgcttctgctgcggcttacaccatcactttttgtccttctcctagcagtaaccccagtcagaaatcgtggcaagggcaaaaccctaaatcagatagtagtggctcggcttcggcttctgcttctgggtcgccgcaacttaacaacggcacaatggtatatgtaggtagcatggatgaaagtgaattatggtccgcaggtagtacccatgggccggaatctcaaaccattgcgggctttgttagtatcaccatcgctgtttggctcttgtgccacctctactaa

SEQ ID NO: 2088 - DNA, 1374 bp, Glycine Max
gtgcaccctgccacggcggaggatgtggctagggtggtgaaggcggcgttcgagtctccgttcgccgtgtcagcgagggggcacgggcattcgataaacgggcaagccatgataaaagagaagaaaggagtggtgattgaaatgggaaaaagtgatagtggtgaggatggtagtagtattagagtgagtgagaaaggaatgtatgtggacgtgtggggtgggaagttgtggatagatgttttgagtgcaacattggagtatgggctggctcccatgtcttggaccgattacttgtatttgtctgtgggtggaaccctatccaacgctggaattagtggacaaaccttcaatcacggtcctcagatcaccaatgtttatgagctcgatgtcgttacaggaaagggtgagctggtgacatgttcagaagatcgtaactcggagttgttccatgctgttctaggtggtcttggacaatttggaatcatcacaagggctagaattgctctcgaaccagctcctcacagagttcggtggatacgagtactgtattcgaattttgcaaggttttgtaaggaccaggagtatctgatatctctgcatgggaaagcagcaagggagagattcgactatgtggagggtttcgtgatagttgatgaagggctgatcaataattggaggtcttcgttcttttcagctagtaacccagttaaaatcacttccctcaacgctgacggaggtgttttgtactgcttggagattaccaaaaattacgaccaaggaaacgcagattctgttgatgaggaaatacaagctctattgaaaaagttaaattttataccaacatcggttttcacaacggacttgccttacgtggattttctggatcgtgtacataaggcagagctgaagcttagatccaagggtttatgggatgtacctcatccgtggctcaacctttttgttccaaaatcaaggataggggacttcgacaagggtgtgttcaagggcattcttggaaataagacaagtggacctatcctcatataccctatgaacaaaaacaagtgggaccagcgaagctcggtggtgacaccagaagaggatgtgttttacctggtggcatttctaagatcggcattggatactgagacgctggagtacctgactaatcagaaccgtcaaattctgaaattctgccatgatatagagatcaaggtaaaacaatacctgccccattacactacgcagcaggagtggatggaccactttggtgataagtggacccagttcaatgctaggaagatgcaattcgatccccgccgaatcttagccacaggccagcaaatttttcagtttcatccctcactcaccctc

SEQ ID NO: 2089 - DNA, 2090 bp, Glycine Max
gttcgcaacttcaagcatggtttctccgggtttgcagctcgtttaacaaaagaggaggcgaactcaattgcccagaaacctagggttgtgtctgttttcccagacccaattctgaagctcctccacacaacccgttcttgcgatttccttaaggaccaaagtacccctgtcaaaatccaccacccaaacacggtctacaactctgctccctcgtcagacgtcatcattggcatcttggactcagtccttttaaccgaatttctctggattggtctctataataatcagaattttaaagtattgatatacgatccaatcaccttcaaatatttagatgcaccaaaaaagtggcataaacataatcatgcaccgagacccattagagataggtatatggccagaatcgacaagggtatgggccctgttccatgccgttggaaaggcacgtgtatgaaatcctactacttctattcatctaactgtaacaggaagataattggagcaagacattaccccgaccctcaaggagacagtgagtatgagacaccaagggataaaaatgggcacggaacccacgtggcatccacagcggcgggagccaccgttcctggtgcgtcatactacggtgtcgcggcagggaccgcccaaagtgggtccccaaaatcactactggcgatttacaaagtgtgcttcaaatatgagtgccctggctctgctgttcttgcagcgtttgatgatgccattgctgatggagtggatgtgatttcgttgtccgttgcttccctctccgagttgaaatataacccaatcgccattggagcattccacgccgtcgagcgcggcattctcgtgcttaaacaccgttgtcaaagatgtaccttggatttgaccgttacagcctcttccatagaccgcgattttatgtccaaggttgtcttaggcgataacaaactgatcatgagtcaatcaattaaaatttttatagtaataaagacgattttaaagatttatttggataaccttctccttaaatattcacgttggcgaagccttaaatttctcccctctttcacattccccaagtatccactgatatatagtgagtctgcccaggcaaaagacgccaagttatctgacgcaagacaatgcttcccatattcattagataaagtcaaagggaaaattgtggctgtgcaaggggtaagtggaatacgtgtggttcatatttttgacccaataggaggaacagaaagaaaagattttggggacttcccagtaacagagattaagttcaaaagatgcaaacagaatccttcagtatgtcaattcaaccagaaacatcattggagactaaggttaaccatcatagttgatcacaacaatccagtggcaacaattctaccaacagtttcagtcattgattttaagcctgcacccatgatgccatcctttgcagcaaaagggccttcagcaatttcgaagaatattctcaagcctgagattacagcaccaggagttaacattcttgcagcatggattggcaacgacaaagaaggagttccaaaagggaaaaagccctcccaattcaacatcaaatcgggaacttccatggcatgctcacatgtttcaggacttgcagctaccatcaaatctcagaaccctacttggagtgcctctgcaatcaaatcagcaaccatggccacagtaactcaagaaaacaatttgaaggctcccataacaacggataaaggatcagtagccacaccttatgactatggagcagggcaaatgacaatatatggagcattccacccagggctagtttacgaaaccaacactattgactacttgaactatttatgttacgttggatttaatataaccttggttaagactatctctagaaatgctcctaataatttgagttgccccaagcattcgagttctcatcatatttccaacatcaattacccttccatcgcaatctccgatctcaaagggaaagaattagtggacgtgaatataactgtaacaaacgttggtgaagaggatgaaacattgtactcccctgttgtcgatgctcccattgg

SEQ ID NO: 2090 - DNA, 1539 bp, Glycine Max
tccgaggatgaaaggaagaaaaagcttggatcgttcaagaaggtggcaatcagcgcctcatctaagttcaagcattcctttgccaaaagggggaggaggcacagcagggttatgtctgtttctattgaggatgatcttgatgcagaagagttgcaagcagttgatgcttttcgccaagcactcatcttggaagagctattgcccgcaaaacatgatgatcatcatatgatgctaagattcttgagagcaaggaagtttgacattgagaaaacaaaacaaatgtgggcagatatgcttaagtggaggcaagaatttggtgctgacactatcatggaggattttgaattcaatgaactagaggaagttctaaaatactacccacaagggcatcatgggattgacaaggatggccggcctgtttacattgaaaagttgggtcaggtggactctattaagctgatgcaagtaacaacaatggaacgctatctcaagtaccatgtaagagagtttgagaggaccttcgctgttaagttgcctgcgtgttccatctcagcaaagaagcacattgaccaaagtacaactcttttggatgtgcaaggagtgggtcttaaaagtttgaacaaagctgcaagggatctcctccagaggcttcagaaaattgacggtgacaactaccctgagtcactgaaccgtatgttcatcatcaatgctggttctggatttaggctcttgtggaactccattaagtcattcctagatcccaagaccacctcaaaaatccatgtcctaggtaataaataccagaggaagttgcttgaaatcattgatgccagtgaacttccagagttcttgggtggtacttgtacttgtgcagataaaggtggttgtatgctttctgacaagggtccatggaatgacccagatatcttgaaggtagtttactgcagaaagataagtttctctaaagatggtacagcacatcaaaatgtaggaaacaaagaatcatttccagagacatacgatgttgatgaacaatgtttatctccaaaaaagcaatgtgctgtgtataaatatgacgcatttgtccctgtgctgggcaagccagtcgattcatcttggaataaattaacacagaaagataaagatgctctttctaaaggaatcatggccattgttatgggaattgtaacagtgatccgcttgacaaggaacatgccaaggaaaatcactgaagcaatagtgtatggcagcagctcagggtattatgatggcactatgatgaaagcacccaccatttcatgcaatgattacatggcagtgatgaagcgcatggctgaacttgaagagaaagtcactgtcctcagcatgagacctgtcattccacacgaaaaagaggaagtgctgaataatgctctgtgcagagtcaccactctcgaacaagacttggttgcaaccaaaaaggcacttgatgatgcacttgctcgacaagtagaactccaagctcaaattgacaagaagaagaacagcaacaagaagttg

SEQ ID NO: 2091 - DNA, 2661 bp, Glycine Max
tcctcaagacccgcctttgtgcacattggagcaatcttcagcatggattctgttcttgggaaagtcgctaaaattacattggaggaagccgtcaaagatgtaaacgccgacaaaaccattctacatggaactcaacttgttctctctatgcaaaattccaatcacagtggtttcgtaggcatggttcaagctttgcggttcatggagactgatgtgattgctataatagggccacaatcttctgtgactgcccacataatatcccatgttgcaaatgaactccgggttcctttagtgtcatttgcggctacagaccccaccctttcatcgctgcagttccctttctttgtgaggacaacacagagtgatttgtaccaaatgaaggcagttgctgaaattattgattattatggttggaaggaggtgattgccatatatgtggatgatgattatgggcgaaatggcgtggccgcattggatgatgaactagcttcaaggcgttgtagaatctccttcaaagaaggaattaaatcaggaaccaaagttgaccggggtgaaattacaagtttacttgtgaaagtggcactgatgcaatctcgggtcattgttctccatgcacaaactgattctggatttatgattttcaatttggcgcgttatcttgggatgacagacaatggctatgtgtggatagtcacagactggctctcttcttttctggattcctcttctctcccttcagagacaatggatgttctccaaggagtgcttgttttgcgccagcatacacctgattcggatagaaaaagggcatttctctctaggtggaagaagttaactggtggctctttggggttacattcttatggcctctatgcttatgattctgtttggctagttgcacgggctattgatgcttttttcagtcagggtgggattgtttcgtgtaccaattacacaagtttaggtggtgataagggaggtgatcttaaccttgatgcaatgagcatttttgacaatggaactcttctgttgaagaacatattgcagagtgactttgttggattatcaggtcaaatgaaatttgaaccagaccggtctcttgttcatcctgcctatgacgtccttaatgtggttggaaatggccttaggagggttggttactggtccaactattctggtctgtcaattgtatctcctgagatattctatgcaaagccacctaatagatcaagtgcaaatcagaagctatacagtgtgatatggcctggagaaacattatctaaacctcgtgggtgggtcttcccaaacaatggtagacaattgagaattggtgtgcctatccgagtcagttaccgtgaatttgtggcaccggtgcagggaacagagatgtttaaaggtttctgtgttgatgtattcacagcagcagtaaacttgttgccttatgctgttccttaccgtttcgtcccatttggagacggccacaaaaatccaagctacacacaacttgtcaacttaatcacaactggttactttgatggcgccattggtgacattgctattgtcacaaaccggacaaggattgtagattttacacagccatatgctgcgtctggacttgttgtggtggcccctttcaagaaaatcaattctggtggttggtctttcttgcagccatttactcctcttatgtggattgtgactggttgtttattccttttcattgggatagttgtatggattctggaacacaggataaatgatgagttcaggggtccacctaggcagcaaattataaccatgttgtggtttagcctatcaactctgtttttttcccacagagagaataccatgagttctcttggtcggttggtgatgctcatatggttatttgtggttttgatcctcacttccagctacactgcaagtttaacatccatactcacagtgcagcagttatattctcctatcagtggaatagagagcttaaaagctagtgacgaacctatagggttcccagtgggttcatttgcagaacattacttgattcaagatttaggaatagccaaatctaggcttattccacttggatctccagaagaatatgctaaggcactccagcttggtcctaaaagaggaggagttgctgctattgttgatgaacgaccctatgtcgaaatcttcttatcaagccagtgcacattcaggattgtaggtcaggagttcaccagaagtggctggggttttgcattccctagggactctcctttggctgtagacatgtcaactgccattctacagctttctgaaactggtgatctacagcggattcatgataagtggatgacacgaagctcttgtagtttagagaatgctgaaattgattcagatcgtcttcagcttaaaagcttctggggtctctttctcatttgcgggatagcttgctttattgctcttgttttgcattttatgcagcttatgttccagttatggcaatctcctccttctgaacctgcttctagtgctagctcaatttctggtcgttttcaaagatttcttacactcattgatgagaaggaagatccatctaagagtaaaggaagaaagaggaatggagatgaaagatcgcttgaagatcaactgggaaggcagccaaagagg

SEQ ID NO: 2092 - DNA, 330 bp, Glycine Max
tctcttcatactcgttcgaacagcttgccctccgcacctcacccactcatatcacaacatgaggagcatctgcaaaaattgagggactctgaagccacttcttcaatatcatcatcttcgctaagccacaaacttaatggtttgctggatttgcaggactgcactgataagttgcttcaattgcctatgaaacaacaagctgtggcacaaaagttcagtgacaaatgtgttgatgacattctagaagggtctttgaggctcttggatatctgcagtacagccaaagaatgcctacagatatcaaaggaaactctgtcatcagaaggaaaa

SEQ ID NO: 2093 - DNA, 164 bp, Glycine Max
tggttgagcttgattctgatcattggtgtgctggtaactaccatgctgtgtcttccacatctaagagataaaaaattgtggctgctcaagttgtggaaatgggaggcgacaattctggttctaatctgtggcaggaattcccttttgaggaagagggtgctcct

SEQ ID NO: 2094 - DNA, 1549 bp, Glycine Max
ttcgcagctcgtctatcaaaagaggaggcaacctcaattgctcacaaacctggtgtggtgtctgttttccctgatccagttctgaagctccacacaacacggtcctgggatttcctcaaataccaaactcacgtcaaaattgacaccaaaccaaatacggtctccaaatcttcttccgtcattggtatcttagacacagggtatatatgggtcctgttccatctcattggaaaggcacctccatgcatgaaatcgcaagacttcaattcctccaattgtaacaggaagctaattggcgcaaggtattacgtggaccctaatgaagggggcgacaacatggcaagggattctaccattcttgccgcacttgacgatgccattgaggacggagtggatgtgttgtcggtgtcgttgggtgcatccactgggtttcgacccgacttgacgtccgatccaattgcgattggagcattccacgctgtggagcgtggcatcctcgttgtgtgctttgttgggaacgatggaccaagctcgtacacgcttgttaatgacgcgccttggattttaaccgttgcagcttccaccattgatcgggattttcagtccaacgtcgtcttgggtgttaacaaaatcatcaagggcagagctataaatctatccccctttcaaattctccgaagtatccattatctgtcacaactcaaaacctctaagcaaaaaattaaatcatttgttaaatgcagacaatgccatccaaattcattagatgtgaataaagtcaaagggaagattgtggtctgtgaaggcaaaaatgataaatattcaactagaaaaaaagttatcacggtgaaagcggtaggaggaataggcctggttcatattactgatcaaaatggagcaatagcatcaaattatggggacttcccagcaacagtgataagctcaaaagatggcatcacaatcctacagtacatcaattcaaccagcaatccagtggcaacaattctaccaacaacaacagttcttgattctaagcctgctcccctggtgccaaacttttcatcaagagggccttcatcgctttcaagcaatattctcaagcctgatattgcagcacccggagttaacattcttgctgcatggattgaaaatggcacgaattccatggcttgcccacatgtttcggggcttgcaagcagtgtcaaaacacggaagcccacttggagtgcatccgcaattaaatatgtcatcatgacttcagggtcggtagccacaccttatgactatggagtaggggaaatggcaacatctgaaccattgcaaccaggactagtttatgaaaccagcaccattgactacttgaacttcttgtgttacattggattcaacgtaaccgcggtcaaagtcatctccaaaactgtccctcataatttcaattgccccaaggatttgagctctgatcatgtctctaacatcaactacccttccatagcaataaacttcagtggcaaaagagccgtgaacgtgagtagaactgtcacaaacgttg

SEQ ID NO: 2095 - DNA, 927 bp, Glycine Max
aaaaataaacttggagaaggaggctttggtgctgtatacaaggggactatgaaaaatgggaaagttgttgcagtcaaaaaattaatttcaggaaattccagcaacatagatgatgaatttgaaagtgaagtaatgcttataagtaatgttcatcatagaaatcttgttcggctccttggttgttgcagtaaaggccaagaaagaatccttgtttatgaatacatggcaaacgccagcctagacaaattcttatttggaaaaagaaaaggctccctcaactggaaacaacgctatgatataattttgggaacagcaaggggattggcctatctacatgaggaatttcatgtttctatcatacatagagatattaagagtggcaatatcctcttggatgaagaacttcaacccaaaatatctgattttgggttggtgaagctcctaccaggggaccaatctcatcttagcacaagatttgctgggacattgggatacacagcacctgagtatgcactccatggtcaattatcagaaaaggctgatacatacagctatggaattgtagtcctagaaattataagtggtcaaaagagtattgatgccaaggttgttgatgatgatgaggatgaataccttcttcgacaagcgtggaagttgtatgagagaggcatgcacgtggagttagtagacaaaagcttagactctaatagctatgatgcagaagaagtgaagaaagtcataagcattgctttgttgtgcactcaagcatcggctgcaatgaggccagccttgtctgaagtagtagtcctactcagtagtaatgacttacttgagcatatgagaccttcgatgcctatctttattgagtcaaatttaaggccccacagagatttctctgcttcgactgatggttataattatttgtaa

SEQ ID NO: 2096 - DNA, 229 bp, Glycine Max
aaaatgaaaagttcaattaatgaaaaagtgattcagctggaaaaacaactagaaagcattccaaagctggaatttgagaatcagcaacttaaagagaaattagatgtgatgaagcacatggaagatgaatttctgaatatggtaggcactttacatatgaatgtaatggaaaaggaacggtcacttgtagactcagaagatttcaaccaatcactaatcattaaagagc

SEQ ID NO: 2097 - DNA, 267 bp, Glycine Max; identical to SEQ ID NO: 23

SEQ ID NO: 2098 - DNA, 503 bp, Glycine Max
aaacatatcggcgggacttctaggattcttcttcgtgaagacatgacgaagctgcttgcgaaaacaaaaaattctgttattcaaacttgcgatgttgcttctagtgacattgctttcagcggaggttttggtagctacatgtttggaatgagttcagaaattgctaaagcgtattcactagtattcactgcgcaggatatcaaagacccaggtttaggatggatgatagcatttgcatttgttgttagctttcttggcctcttttcattgattatgatcgtagacttcaaattgacatatcacagtggtactgcaacagctcatcttatcaatagtttccatacgacagagggtgccaaactagccaagaagcaagtacatttgctgggaaagttcttctcttttagcttcttgcggggcttcttccaacggttttacactgcgagtgatggttgtggctttaataacttccctacatttggtctggaatcctataaatacca

SEQ ID NO: 2099 - DNA, 237 bp, Glycine Max
aaacccactttgaacccaactcactcttgtattcgagaataccatagcctctgcacagctaccaccccacaacccttctttgtccaatgttcaaccttgacaacctctaaatacgcagcatctcttagccatcatcatttgatcctcccgaaacacacttccgcacgcaatctctgccacgcacaccaagctcgggggtttcttttcaagatgtatgtgacgacagacttgaaatag

SEQ ID NO: 2100 - DNA, 1546 bp, Glycine Max
aaagaagatcatggaattgccataggaatcgaccttggcacgacttactcatgtgttgcagtatggcaggagcatcactgtcgagtggagatcatccacaatgatcagggtaacaatacaacttcttttgttgctttcacggacgacgaaaggttgctaaaaatcaggctgctaccaatccagagaacaatgtctttggtgcattttctagtcttaactacgaatgctaggagattgattggtaggaaatatagtgatcctatattgttcaaaaggacaagatgttatggccatttaaggttgttgctggatgaggagaagcacttttgtgccgaggaaatatcgtccatagttcttgcaaagatgtgggagattgcagaagcgtttttggagaaacgtgtaaagaatgcagtggtcactgtgcctgcttatttcaatgattctcagcgtaaagctaccatagattgctggtctcaatccattgcatatggcctcaacaggaggactaataattgtgttggagagcgaaaaattttcatctttgaccttggtggtggtacttttgatgtgtctctccttactcataagggtaagatcttccaagttaaggtaacaactggaaatggtcaccttgggggagaggaaatcgataacagaatggtggactactttgtaaaggagatcaaaaggaaaaaaaaagtagacattagtgggaacccaaaagcgctaaggaggttaaaaactgcgtgtgagaggtcaaaaagaatactctcatgtgctgtagctactcacattgagacatatgctttatctgatggcattgacttctgttcttcaaccactcgtgcaaggtttgaggaaatcaatatggatctctttaaggagtgtatggagacagtagataagtgtcttactgatgctgaaatggacaagagcagtgtacatgattgcaagagctattgccaggctttttcaatggaaaggatctgtgcagggagcatcaacactgatgaagctgttgcttatggtgaagttacttgtgctgatggatgttacaccactgtcacttgtattatgcgtgtagaacctattgtccaaaaatccgtccaatctaatggtggacgagttgcaatcttaaaaatgctctcggtgatttatgataatcaatcctctgttggaattaaggtttatgaggatgagagaacaagagccagtgataacaatttgctgggttcttttagtctttctggccttcctccagctcctcatggccatccttttgatgtgtgttttgccattgatgaaaatggtatcctatctgtttctgctaaggaaaaaaccactggcaatagcaataaaattgtcataaccaatgaaagagaaagattcatacaaatggagaatgcgttggaaaatgggaatttaagttcaaaactttgctcagaagacaaggagaagatcagttctgcaattacaaaggccacaaagttgcttgaaggtgaaaatcaaaatggtgaaatagatgtgtttgagaatctctttgaac

SEQ ID NO: 2101 - DNA, 136 bp, Glycine Max; identical to SEQ ID NO: 24

SEQ ID NO: 2102 - DNA, 358 bp, Glycine Max
aagaaaaataagagaacaaaacagcaatttggtgatgagaaggcttgtgcggcaagaatgacatttagtaggtatgaactagctcctcatccttattttgaactacatattaggaaatatgagataggtcatgaattttgtcttaaaattcaggttgcagtgtacccagtaaatgtcttggccttgcacatgtctaaatcacaaggatttaagtactctagtagacagtataattttgtgaattgcctagatgtctcgctttttcaatgtttcatgaatcatcgatgtggaagtaaacatattctacatcgtttatcaagagacgaccgacttagaagatataatttctacatcggtg

SEQ ID NO: 2103 - DNA, 1449 bp, Glycine Max; identical to SEQ ID NO: 25

SEQ ID NO: 2104 - DNA, 1143 bp, Glycine Max
acagatgatgatcttcctccttcccatcaatgtcgaaatagatttcaacgccctgatcatgccactggaactggaaacggaagatctgcaattgtaggctctggtccatatcctcggatgcagaacgacatggaaacacaaatccataacattgagcaagaagcatacacctctgaaaaagaaagtttaattacagagcttaggaaggagctaagagtatcagatgaagaacacagaacttctatcaagatgagcagtttctgtatagcattgagcaaacagtggttttttctgcattttaaagtggggtgtatccaattctctaccgttttggcatctcgtaagaaaaaaaagacatcacaatctgtggcttcattatccttgggtgcaccatctcctgcagttcatccatctatgcaaccatcatcatccgcattgaagcatgaacctccatcaggaactaagaccacaaagcaaaaatcattcccttctacaggacttacaagccaaagccaggatcagggggttcttcaggtgcctttgcagcaaaaggacctgctgaaggagcttcttatgatccctggattggaaggaaagtttggacaaggtggcctgaagaccaccacttctatgaagctgtgctggcctcgaatccagtctcataagcttggactacatgctttggtttatgatatgaattcagcaaatgaaacatgggagtgggtcaatcttaaagagatatctccagaagatattcgttgggagggtcaagatcctggaatatctggtaaaggtggccggcccggtccaggtagaggattgaagaagtctatgcctcacggtggtgcagttactggttctggaagaggtaggggaatgatgaaggtgcagcctaagaaagatttcactttgtcacaaaaaggggcaggaagaaggctacaaatgatattgagatactccatacagatacccttatcaaggagaatggaaccaaaacaggttgaaaaggtgtttactgcaagccatcctgatcccatggaaatggagaaagcaaagaaaatgctaaaagaagatgaacaggctcttgttaatgcaattaccaggctcggagatgtgtctgagggtgaaagtggtaataactaa

SEQ ID NO: 2105 - DNA, 1242 bp, Glycine Max
accaagacacaagtggctggcggtgcaatctatgccattgcacaatgtgctgaaactctcacacaagacacttgttcggattgtttgtcaattgcacagagcggcatacaagattgtcttccaaacacagatggtaggggagtcaatcctccttttccttacctatacaattttttagaaaataatggatatgcacgaaggtgtcaacttcttttctgtcttgaaggaggaggaggttcaatcaagaattgggtctttattggtggtggtgttggaggtgcactacttgttgtgatccttatttcattagttcggtggcatagaagatcccaaagtcccaagagagttcctagaagtaccatgatgggagcaactgagttgaaaggtccaaccaagtacaagtatactgacttgaaagctgcaacaaaaaattttagtgagaaaaataaagtaggagaaggaggctttggcactgtgtacaaggggactatgaacaatgggaaagttgttgcagttaaaaaattaaaatcaggaaattctagcaagatagatgacgaatttgaaactgaagtaacacttataagtaatgttcatcatagaaatcttcttcggcttcttggttgctgcagcaaaggccaagagagaatccttgtttacgaatacatggcgaacgccagcctagacaaattcttatttggaaaaagaaaaggttccctcaactggaaacaatgctatgatataattttgggcacagcaaggggattgacttatctacatgaggaatttcatgtgtctatcatacacagagatattaagagtagcaatatcctcttggatgaacaacttcagccaaaaatttcggactttgggttggcgaaactcctacccggggaccaatctcatcttcgcacaagagttgcaggaacaatgggatacacagcacctgagtatgtactccatggtcaattatcagcaaaggttgatatatacagctatggaattgtagttttagaaatcataagtggtcaaaagagtactgatatgaaagctgttgatgatgatggtgatgaagactatcttcttcgacgagcatggaagttgtatgagagaggcatgcttttggaattagtggaccaaagcttagaccctaataactatgatgcagaagaggtgaagaaagtcataggcattgctttgttgtgcactcaagcatcggctgcaatgaggccagccatgtctgaa

SEQ ID NO: 2106 - DNA, 256 bp, Glycine Max
accgaatcttctccttgggaatcccacccaaacggtccctatgattcacaaccaaaatggtcaacagcgacaccaccccagaacccaacgagtgccccgcgaaaaccatctcatactccgaaccattctccacccacaaccgcttcagcgtctccgattcacggttcaacaaccacactgccgatttcaacaacccatgatgaacatacccaccatcaaacatttgttgccctaaccggttatcgaggagaacctt

SEQ ID NO: 2107 - DNA, 500 bp, Glycine Max
actataatgttcaaaatcttcaacgctaaatatttttcatcaatggatttcttggatgtccaccttgggcacaatcccatttttcaaggtgttattggaggattggcaatggtgattctactcatgtctggactcaaccttggctctaacaataatcttaatccttttgtctcaaccaccccaataatggtatctctcctcttaaagaatgatattctagattcaaacttcaaccaagaggatgctcaaaaaattcgttccctaacactattgaatatcacggagagagatcaactaagccggaaatattcaacgaatggtgagtacactgttaagagcgcatatcatgccattatggatcatttgctagacaatagccacctcaaggttaaagggaattggaagaccatttggaatcttgttgcttcttcgaaaatgcattccaacaagatccaacctgcgcaagaaaaatatcctctatcccttacattgtgtttgct

SEQ ID NO: 2108 - DNA, 744 bp, Glycine Max
acttgggactacttggatcagtcccaggatgcacttatatgttgtgcctcgtctttggattcaagacctaatctttcatctctaaacttctttcatacgatgggcagattatcaaggaactggaggagagtaaagctctacatgatctacaacagaacttcattgaggagattgaaaagaaataaattaaaggacaaaatggaatatttggaccatgtagaaaccctttatagttctttagtagttaaagagaaccagtatagacaagaactacatgatgctcgtgaagaatctataaagagtttgcgaggtatgttcagaggtcgatctcaacttggaattaagagaatgggagaattagatccaaaaccttttcaacatttgtgcttgcaaaagtactcagatgaacaatggcaggagaaatctgctaagttatgttcagcatgggaggaaaatctgaaggatccaacttggcaccctttcaacaaaattgaggtcaatggcatattacaggaaacattagatgaaaatgatgaaaaattgaaagggctgagaagtgaatgcggtgaagctgtgtaccaggctgtaacaaatgcattaatggaaatagaagaatacaattcaagtggaagatatgcaattgctgaaatttggaactggaaggagggaagaaaagccactttgaaagaaattgttcaacatattattaggcaattgaatagtcacaagcgcaaaagaaagtag

SEQ ID NO: 2109 - DNA, 371 bp, Glycine Max
agaagaactaatgcttggtggtggccagaagaaaagataattttaacaatcattataccgaagaaaaaaaatactctcccaggaccagttagcgacccttcaaagcttcccaagtggaactatgatggttccagcacaggccaagctcctggagaagacagtgaagtgattatatacccacaagccattttcagggatccattcagaaggggcaacaatatcttgattaccgcgacaaccattccagaaaatactcaagacatgattcttaaagtaattattacaaagatcaacaattatatcatttcattaattggggtaacaatggaaaaaatctttactgacaaaatcaagttgggttttattttttt

SEQ ID NO: 2110 - DNA, 402 bp, Glycine Max
agatataacgttagtagaagtaacccaccaatattatttgacattcgtggagattttcccttttctgatgatgaggaacaagaacaagccattaggcaccccatatggttcatccccacagagggtctccaacaatcaatcatagactccatcacagtctgcaaatacagaaaagatgaagggttagctaaagaaactttaactgagtgtcttgtttgccttggtgagtttcaacaagaagagagtctcagagtgttgccaaagtgtaaccacgcttttcacatctcttgcattgatacttggttgagatcacataaaagttgtcccttgtgccgtgcccctattgttcttgatgctgctagtctgtgtgatatcaaccaagacatagaagaaagtatttga

SEQ ID NO: 2111 - DNA, 699 bp, Glycine Max
agatggtctctcaatggaatgacggctcttgtcactggtggcactcgtggaatcgggcacgccatagtgaatgacttagccgcgtttggcgctgcagtgcacacttgttccaggaaccaaacagagctcaaaaagtgcttacaagagtggcaaactcaggggtttcaggctactgggtcggtgtgtgatgtgtcttcaccaccccagagagagaagctcattcaggaagtggcatccaccttcagtactgagcttaacatctatataagagagttcaaccctttaaatggatctaactatcttgacggattaattcttgtgaacaacgtcggaacaaactttagaaagccaaccgttgaatacagtgctgaagaatattcagagctgatgacagttaatttagactctggttaccatctgtgccaacttgtatatcctcttctaaaagcatctgtaaagggaagcattgtgttcatttcatctgttgctggtgtggtcagcttgggtactggatctgtctatgcagcatgtaaagaagtgttgggactaaaacaagtagttctcagatataagaacaaacacttaaagattgaacggttatatagacttagcaaaaatctggcttgtgaatgggcaaatgacaacataaggagtaactgtgttgtaccttgggcaaccagaaccccacttgttgaacat

SEQ ID NO: 2112 - DNA, 696 bp, Glycine Max
agtccaataccttcgcctcttcaccaaccagtcccactttcaattccgtgggttcctgccatcaatgatagagatcacatgtatctaaaccttgcacctatcattataattgtcatagctggcacaacttgcataattttttttctcatcaccttgttcaaaatcctaaggtactattatccaaatagatacaacgttagcagaagtaacccaccaatattatttgacattcgtggagattctcccttttctgatgatgaggaacatgatcaagccattaggcaccccatatggttcatccccacagagggtctccaacaatcaatcatagactccatcacagtctacaaatacagaaaagatgaagggttggttaaagaaactgagtgtcttgtttgccttggtgagtttcatcaagaagagagtctcagagtattgccaaagtgtaaccacgcttttcacatcccttgcattgatacttggttgagatctcataaaagttgtcccttgtgccgtgcacctattgttcttgatgttgctagtgttggtggtggcaccgagtctgactcaaatgtttctgatatgaacgaatacgtagaagaaagtaatagtggtggagtgagggttggagatgaagaaaattctagtgaagaggggagggatgatggaattcatgttttgaatgaatgtgtcgag

SEQ ID NO: 2113 - DNA, 1041 bp, Glycine Max
agtgaatttgaaaattttgtaacttactctcttgaacttttctctctcaaactcaactcaacgtacctcatcatcgtcgtcttctcctactctcccattgaccccgtcaacttcgatctcttcatcccgtcacctccgctgtcggcaaaaccatcctccacctcgaccccaactccttctacaacggtcacttcgcttctctcgatctccttccacgatctcacttcctacctcacttccccacactccctcccctccgccgcaaccgccaccgcatcctccgactctgacaacatcgttgtcattgacctcatccaccaacccctctgcaccgacgcagaaaccacgacctacgatgaatctgcatttctcaacaaaaattcaacattgatttggaagacgatcaatttgttgatgaaatcgggcgcggcgcagtatttggagttcaaagaaatcgacaagagcttcgtctacgaagtgaacgcgagtttggcgaacgtgccgaattctcgaggagcgatttttagagacaagaagctttcgctgaaggagaagaaccaattgatgaggttcttcaaactgcatcggcaactatgtttgcaattgcatcactgctcaatcatccttcatgaccactgttcttgtctgacctcacatctcacatgtcacgttattcatcaaacaccaacacgaacttattttgtaggaacagcggtaacaatgtcggtttctttagaagcgttggcaatggctggcgcaagtgatgtggaatttgccatggatattgaagaatgggaacgcaaagatttggagcagtatccaccaccccatttactagcccatgaaaaagaagggaacaatggagtatatggccttcctaccacccattttcttccgaatcacaacacatgggaatatgacaaggaagaagaacatgaattcacgaggtcaattaaaataatcgcgagagcacttgaaacattaatcatgttcagtttgctagttaacaaggatgacattcggtgcgtgctcagaacaaat

SEQ ID NO: 2114 - DNA, 81 bp, Glycine Max
atacccctgttagttggcttttgtagcatattctatttgttcttcgcagctttgggttgtggggcttacttcctagcctca

SEQ ID NO: 2115 - DNA, 678 bp, Glycine Max
atatatatgaattcacaacaatttgctgaagctgagttggtccagagaaagatcctgcatgttgtggaattgtcaaagggatggaattccttggacactgttattgcagctgaatctttggctctgaccctgcaagcatctggcaatacaaaagattcaaaagagtttcttgaaagatgtcttaatgtccggaaggacttacttcctggtgaccatattcagataggtgcaaacttacttcatctagcaagagtggcaatgcttgattgcagtcaacataaaaagttggatgtttctagagctaaagctgagcttgatatggcaaagaatcatttgcataattccataaggatttcatgtcaatgtttagagaaggtattgaaacaaaaggataagttaaagaaattcagtaagcctggagattctagaaaggaaggccaagtagcactggccatattgttgcaatcactcaatacattgtcatcagtggagttagataagcaagaattgcaggagattcaggaaaaagatattaaccttgaggctcgggaggcacttcttcaatgcatttctgcttacaaggagtttgtacataagaggtcaattgctgatacccctgaaataaagaaagaatatctttcatgtttaaagcgcgctcaaaatttgtttggtcataaa

SEQ ID NO: 2116 - DNA, 1470 bp, Glycine Max; identical to SEQ ID NO: 26

SEQ ID NO: 2117 - DNA, 408 bp, Glycine Max
atccctcttgagtgtggcagctggcatcaccttcagtacctcgccctcttcggcaacaagctcgtcgacaacgtcgcactcgagctcggaaatctctccaccctctacgagctctacatcgcctactacaacacctacttcgacgacatcccgcccgagattgaaaacctgtccaacctcgtttggttagacgtcgcctactgtggcctctccggcgagattccgacaaagctaggaaagctccagaatctgaacacgttgtttcttcaggtgagtgcgctctccggctcactcacccccgagctggggagccttaagagcctcaagtccatggacctctccaacaacatgctctccgacgaggttccagcgagttttgcgaagctgaagaatctaactctctgttga

SEQ ID NO: 2118 - DNA, 210 bp, Glycine Max
atctcactaattctgcccatagctttgttgaatcatacaatgaccctaatcgttatgggcgtggttgctacatatagtcgcaatatgcttcctcatattcaacttagacactggcggaaagggtctcagtggtttgaactaaattgtgctctagccgtttatatagtctctgacaccaaatattattctctcttccgaaaatactgttag

SEQ ID NO: 2119 - DNA, 660 bp, Glycine Max; identical to SEQ ID NO: 27

SEQ ID NO: 2120 - DNA, 2043 bp, Glycine Max; identical to SEQ ID NO: 28

SEQ ID NO: 2121 - DNA, 930 bp, Glycine Max
atgaaaacgctgccatggtcgggctggattccatgcaaatggcaaattctacacttgaggattttatcttattttatgtttcacggattggatgtaagcaagccacaatcaatcttcaaatacttacctattctttcattcacagagagttatatttatcagctagataaaatgaatgagaaattgctgcaaacaccatgcaatggaaattgtgtatttggagaaaaagatgagagagaaactaaagtattggtttcttgcttctcaaatgagccagttagaccacttgtttctattcttgaacacaaaggccttttgacagaaaggataagagaagaacttagacttggagaagagtactgggctcttgaaagaaagctctgttctgcactaacaaacaaagaggagattcttgttgaagatgtgatgaaggctattcatttaaagtcttttgattatcgagtgctgaatcttcttctctatcaacttcaagggactaaggtggaggagttgcatatggaatttctctcaatttcggagttcctagtggaagtttctgatgatctttgttccccatcaccattttcagataagaccaaactctttttttttttttgtagcttctttgctgttgttcaagatgatgttttagagaacaatttcaatattttgcgcatgtttatccgaatatatggaccttcagctgcccctgctatgctggcgaagtgcattggtgaggctgaagacaagtatgcaagtttactgaaatcacttgatccacatctctctctgagctaccagaaaagatgtgcagaagccactaaagaaggtggaaaggtatcagagcaccctcttggaacatggagtattccaaccgtgattcaagatgaggaattgtatagattaaagttgaagtcagatatttcgtga

SEQ ID NO: 2122 - DNA, 1089 bp, Glycine Max
atgaaaagtgtcatcgtcatcggaatgaatgtagacgcagcaggagttggctggctcaacgttgaacactgttccatgctgttaaagcctccgctctcactcaacttcagattttccccacaaacgagcattttccgggcacgaaactcgaggaattcgcgcatggcgcctccaatcctctcgctcgctcttccctcgaacaccggtcgagttctcagcattcaatctcacaccgttcaggggtatgttggtaataaatccgctgtcttccctctgcaactactgggatatgatgtcgatccaattaattccgtgcagttttcgaatcatacaggatatccgacgtttaagggtcaggttttgaatggacagcaactctgggatctaatcgaaggccttgaaggaaatgatttattgttctatactcacttgctaacaggttatattggttcagagtcttttctaaacactgtattgcaagttgtcagcaaacttcggtcaacaaacccaggtctttcgtatggatgtgatccagtgatgggtgatgaaggaaagctttatgttcctcaagagctagtatcagtctatcgtgagaaggttgttccagtagcttcaatgttgactcccaaccagtttgaagcagaactactgacaggctttaggattcagtctgaaggacatggccgggaggcctgtaggcttctccatgcagctgggccttcaaaggtcataattacaagtataaatatagacgggattcttctcctcattggcagtcatcaaaaagaaaagggagagcctcccagacaatttaagattgttattccaaaaataccagcttattttacgggaacgggagatctcatgactgcacttcttcttggttggagcaatgaatacccagacaaccttgagattgctgcggaacttgcagtgtcaagcttgcaggcagttttgcacaggacactcagtgactacaaaagtgctggacatgatcctgagtcaaccagtttagagattagattaattcaaagtcaggatgatatttgcaccccacaggtaaaacttaaagctgaaatatacagctaa

SEQ ID NO: 2123 - DNA, 756 bp, Glycine Max
atgaaacaacactttgatcttgaagtggtggcctcagcagaatatgaatctgaagttagcagcaaggttgcttccaatatatctatccaagaaacctatgcaggtccttgcagtgacaacctcaccaactcttccaatgtgacaaatccaatagagcttcatctccattcagatgctatctcccttgacttaactctcaaattcaacaacaatgacttctcattctcaagcacaagtgagagcagcaatggtcctctctctcaaactaatttagcagccaacccgcgagtcttctcttgcaattactgcaagcgcaagtttttcagctcgcaggctcttggcggccaccaaaatgcgcacaagagagaaagaacaatagcgaagagagctatgcgaatggggatattctctgagaggtatgcaagtctagcatctctcccttttcatggttctttcaggtccttaggaataaaggcacactcttcactgcaccacggcttttcgccaacaatgaggcctcctgagatgaaaagcagtgcaagatttgagcaaggatatgttggtcttccaatattcttggaggaggatgaggcagaactcttgtggcaaggtagctaccatcaggttccctctgagggaggccatactcatcagaatttcacactcagtggaagttcaaatttgagttttgttggttcgagtcttccaccagttgacttagagaactcaacacctgagttgacattgaaactttga

SEQ ID NO: 2124 - DNA, 468 bp, Glycine Max
atgaaacctctctctaagctcttaaacaagctttgtgggaaaatgataatgctattagcatcccttctaatagagcttatcattctcattcagaagctaagggaatcacgtcccatcagcacccgccaatacatcaaactcatcgagaagaagaaccccacaatttgctacaccaaaagatttaacttgaaggcagagcacgctacagagtgcagggtatgcttgtccgaattcgagcaaggggagaagctgaggaagctcaaatgccaacacacgtttcatagggattgtttggacaagtggttgcaacagtactgggctacgtgcccactttgtcggaaacaggtgttgcctgatgatgttgtgttcaagcaccgtcagcatcagaatcaaccagaggctgcttctaatgggaatcatgacaatcttctctatcttttttcagcatttcgtggtggcaacacttaa

SEQ ID NO: 2125 - DNA, 879 bp, Glycine Max
atgaaactagaagcccataatcctgtgtttgcacattgttgtgtggggacagatgcaaatacaaacaaaagacaactcagtctcgcttttgcttgggataattgtaaagttagaagaacttgggaagaacccgatactggaagtgacagtgagggtgatgatgaagaatatgaggaagttgaaaatgagaattttggatttgaaagtggttcaggagaggaagggatgaagacttcagttgttactgatgttaatataacttcaggggacaactatgaagaacttattaagaaagagattgaacagcttttggaacctggagaaagagcaatattgaaacagaatgttactcctaacttggaaaaaatatcaaccgcaaaatggagcccactgcacactcttgtgctatcaatgcagatgagttgtgtggataagcttcttgaaaatggtgttgatattgatttacctgataaggaaggtcttactgcacttcataaggcaattataggtaaaaaagaagcagtgattagccatcttttacgaagaggtgcaagtcctcatgttatggataaggatggagccactccacttcattatgcagttcaagttggtgccaagatgactgtgaaattattgatcaagtacaaggttgatgtcaatgttgaagataatgaaggttggacccccttgcacgttgccattcaaagcagaaatagagatatagcaaaaatattgttagtcaatggtgctgataagactaggaaaaataaggacggaaaaacagccctggatctaagcttatgttatgggaaagatttcaagtcttatgaccttgccaaattactgaagacggttccagctgacagtgatctattctga

SEQ ID NO: 2126 - DNA, 1281 bp, Glycine Max
atgaaagaaatgaacaccgaaattgcgtgtattcgcttaggaaatgcctatgttatcccagtgacatgccccaccattgccagtgagttcttgagaaaacaagatgcaacttttacatcaagatcactaagcatgtccgctgatctcatcactagcggatactcaaccacaatttttgtgccctttggggaccaattgaagaaaatgaagaaaatcattaccaatgattttctttcttcacccaagcacctatggcttcatgacaaaaggactgaagaagctgacaaccttatgttttacgtctacaacgagtgcaaaaatgtgaacgatggtgtctgcatgtggactagagaatatcaggagaaaattatttttaatacaaggtattttgggaagggcagagaggatgaatggcctggttttgaggaaatggaacatgttgattccatcttcgatttgctcaactacatttatgcattttctgtttctgattatatgccatgcttgaggggacttgacttggatggccaagaaaagaaagtgaaggaagctttgaggatcatcaagaagtatcatgatcccattgttcaagtgagaattaaacagtggaatgatggattaaaggttgatgcagaggactggcttgattttctgatctctctgaaagatgccagcaataacccatcattgacattggaggagatcaatgcacaaattatagaattgatgcttgcaacagtggacaattcatcaaatacctttgaatgggcacttgctgaaatgataaaccaacctgagttgcttcaccgagccgttgaagaattggacactgtggtagggaaagagagactggtccaagaatcagatatacctaagctcaactatgtaaaggcttgtgcaaaagaagcttttcgccttcatccaattgcaccctttattcctctccatgtctctatgagtgacacaatggtgggaaattacttcattcctaaaggtagccatgcaatgctaagcagacaagagcttgggagaaacccaaaaagtgatgggtctgatgtggttttgacagaaccaaatttgaagttcatatcatttagcacaggaagacgtggctgtcccggagtgatgcttggcaccacaatgaccgtgatgctattagccaggttgctccatggcttcacttggagtgcaccacccaatgtttcatcaatcaaccttgccgagtccaacgatgatatccttcttgcagaaccacttgtggcaattgctaagccaagatta

SEQ ID NO: 2127 - DNA, 696 bp, Glycine Max
atgaaagaaatgactggaagtggtatattttctgccaatggggaagattctgcatcagaagccaattctgcaaatttgaataacagaacaagcatacgcatgtgtcagcaagcgatgaatggaattagtcagatatcattcagcaccgacgaaagcatttctcctaaaaagcctacctcaatacctgaggtagcaaagcagcgtgaactgagtggaactatgcaaagtgattcggacacaaagagtaagaagcaaatatcaaatgccaagaccaaggagctcagtggaaatgacatatttggccctcctcctgaaatcctgccccgttcagttgcggctgcacgcactttggaatcaaaggaaagtaaagacatgggagagcctcttcccagaaatctgcgaacatcagtgaaagtttcaaatcctgcaggtggccaaagtaatatcttatttggtgaagcaccagttgagaagacggcaaagaagatacataaccagaagtttgcggagctgacaggcaataatattttccaaggagatgttcctccaggctcagcagagaagcctctgagcagggctaagctcagagaaatgactggcagtgacatatttgctgatggaaaggcagaaatcaaagaccctgtgcgaggtgcccggaaaccccctggtggagagagcagcattgccttggtttaa

SEQ ID NO: 2128 - DNA, 1562 bp, Glycine Max
atgaaagtttccctgattttggtcctcctttcaattttctgtgtcactttcaaaccatacactgaagttgatgttcaaaatgatcacaacaatgatccaactctcgccaacaaagaattttgcaagaaagccaaaagttcagaatcaactagattaaacaaggaagaagatggagatgatgctatatcagcaaagcctcacaaaaggtcagcaaagtttcacctaaaacgcaggccaatcaatcatgggaatgagcctaaaacacacgcactggactcagcactcagggatttggtcagaattcagactcttcatagaaaagtcatagagaaaaaggacacaaaaagcatgtcatggaagcaagaagtcaaggttatcaccatccagcagcagaacaaccttgctaatgctgttgtagcatcattgaaatcttctaaagatgagttttcaggtaacatcatggcaaccttggaatctggggcctctcttggcacaggagagtacttcatagacatgtttgtaggtacacctcctaaacatgtttggttgatacttgacactggcagtgacctcagttggattcaatgtgatccttgttatgattgttttgaacaaaacggaccccattataatcccaatgagtctagttcttataggaacataagctgctatgatccccggtgtcaattggtttcttcaccggaccctcttcagcattgcaagactgaaaaccaaacatgtccttacttctatgactatgcagatggttcaaacacaacaggagattttgcattagaaacatttactgtgaacctcacctggcctaatgggaaagaaaagtttaaacatgtggtggatgtgatgtttggttgtggccattggaacaaaggcttttttcatggggctggtggattgctaggacttgggagaggacctctctcctttccctcacagcttcaatctatttatggtcactcattttcttattgtctcactgaccttttcagcaacacaagtgttagcagcaaattgatctttggtgaggacaaggagctattgaaccaccacaacttgaactttactaaattgcttgcaggagaagaaactccagatgatacattttactatctccagataaagtccatcgtggtaggtggggaagtgcttgatattcctgaaaaaacttggcattggtcatcagaaggtgttggtggtacaattattgattctggctctaccttgacctttttccctgattcagcttatgatgttatcaaagaagcctttgagaagaaaattaaactgcaacaaattgctgcagatgattttattatgtctccatgttacaatgtgtcaggggcaatgcaagtggagctaccggactatgggattcattttgcagatggggctgtgtggaatttcccagcagagaactatttctaccaatatgaacctgatgaagttatttgtttggcaattctgaagacacctaatcattctcatctcacaatcattggaaacttactacaacagaattttcacattctgtatgatgtaaaaag

SEQ ID NO: 2129 - DNA, 1407 bp, Glycine Max
atgaacagcgacatttcccggtgggtcatggagttcctcctccgcagttccgtccccgattccctcatccagaaaaccctaaccgccctccctctatcccccgccgaaccccgcctcaagaaaaacctcctcctccgcaccctccaaaccctcctccgtagagccacactatcggaaaccgcgctcgacatcctcgaagacctcgcccctgtctctgacgcgcaacgccgcgcgtactgcgcagtcgccgtggagtgcaccgtcaagtacctcgctgcgtgccccgacgttatcgatggtgagtacgccggcgctgtacggcggatctggcgcggacgcgtggcggcgctgcaggcgcgccggagcgggctggtctctggggagttggtgcggtggcgcgatgagatagagaacgcgcttggggaggattccagggcggctcgcgagaggctggcggggttgaatagtcggagggacgcgatgaatgaggtgagggtgtatttgaaggaagcgtgggaaatgatggggccttcgtttttggaaacggttgcggcaacggagaagaagaacgatgaaggtgcctgtgataatggtagtggtaatggtaatgatgatgatcatgatgatggtgcatgcatggaggatgtggcaatgcattatgagaatcaggaaccattggaagagagtgttgatgcgaatcaggaagtgggtgggtctgacttaactcctcagagggataaaggaattctgaagcggaatcctcagcttaaacacaaacactctgcatttcgtgcatctcataagggaaggggaattaaaatatctagtccggaggaagtggagtcaaccaaaccatggagaaaacatgatcctgtgcctagtgctgaagttaaaaaaattcgggaatccctaaaatcaagttcttcggagttacaggcattggttaatgatcctcttcccgatgcattgcatatatctgatgttgtaagatccaaattggcaactagtgatacaaaaattgagccaccgattgaaaaccagcatgaagatgtagaagtacaggatccagatgtttgcctgagtattgtaccttttcagcccaatgatgtcaatcttgggaagaagtcttctgttcattgtagtaacattcaccagcccagcttgatggaacggaacagaagtgctcgtacctttgagggggaggattcaatagacaactcacaacaagcaagacagccaaggaggaggaaaaggaaatggagttcgttggaagaagagacactaagggctggtgtaaaaatgtttggagaaggaaactgggcaacaatccgaagtttttacagtaacatatttgaaaatagaagtggagttgatctgaaggacaagtggagaaacatgatacggtga

SEQ ID NO: 2130 - DNA, 1320 bp, Glycine Max; identical to SEQ ID NO: 29

SEQ ID NO: 2131 - DNA, 483 bp, Glycine Max
atgaagaaggtgaaactggtgtatataaccaatgactcgaagaggaaggcaacatcaaagaaaaggaaaaatggtttgatcaagaaacttgatgaaattggcaccctttgtgggattgaagcatgtgctataatctataatccaaatgatcctcagtcggaggtttggccatctgaccttggaatccaaagtttgctttctaggtttaggagaatccctgaactgcaaaagagcaaaaagatgtttgatcaggaaagctttttgaggcaaagtatcatcaaagcccaagagcagccgaagaaacaaaagaatgaaaacaggaagcatgagatgacacatcttatgtttcactacctgactatcgggaagatttttaacaatcctaacttgattgatttgaattatctctcatggttgattgatcaaaacttaaacgaaatagaaaagaagattaataggatcctaacccaagaagtgacacca

SEQ ID NO: 2132 - DNA, 477 bp, Glycine Max
atgaagaatgctaatggtgttgctgccttggagccaaaacgaaaccctctttcagatctcaccaatactaattctaacccttccaaaccccaatcccttctatcgtcttcttcttcctccgctactaacacaacacgcgggacagttggccttaatgtttctgagccaatttcatcattctgcagcagaatacacgctttgaatgaaaagaaaaggaatgctaaaaaagcaatagcaaatcccaagacctctactgttcgggataaaaatgatggagttgaacttggaagtttggatctaactaacgctaggcctagggtgttaacagttcgctgcaggaagaagcggcgtgaacaagacgtgtccaatgatccacagatgcaagattatattgtaaaacagaaggcatacttcaaagagattgatgaatttgaactagcggaggaggaggttgaatctgttcatgagctggattaa

SEQ ID NO: 2133 - DNA, 759 bp, Glycine Max
atgaagacagtgtataaagcaattgatgaggtacttggaatagaagtagcatggagccaggtcaaactcaacgaggcacttcgcaaaccagaagacttggagcggctttatttagaggggaagctaccggcatcatttttcaggattgaagacacagaagcacaaaggtttattggcaagtgtctaataactgcagcaaagagaccatcagctaaagaattgttgaatgatccatttcttttgtctgatgatgcatcatccatgacaaagatcggaattcagaaaccctttttaaattacaatgaaatggaaaagcttcaattggatgatgtttcacctaggactgaaatgtcaataactgggaagctaaatccagaacatgatactatctttctcaaagtgcaaatttccgacaaggatggttcttgtaggaatgtatactttccttttgacatatacacagacactcccattgatgttgcaatggagatggtgaaggaattggagatcacagatttgaagccttctgatattgcaaatatgattgaaggagagatatctgtgctgctgccaaataagaggaatagtaactgttcagttatcacgatgacgacgacaacgaatcatcatttccactctgcctcttctcgttcatcatcccaaggatcaatatcaggctcagacagtagagctgatgacttattgaatggagattattggctccatgtagctactgtggaagtgtgcaagtgtgagtaa

SEQ ID NO: 2134 - DNA, 969 bp, Glycine Max
atgaagagacttagcagctcagattcttccagtgccctcatgacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgtatggttccaaaaccgtcgagccagatggaaaaccaaacaattggagagagattatggtgtactcaaagccaattatgatgctcttaagcttaactttgacaccctcgatcaggacaacgaagccttacgaaagcaggttaaggaattgaaatcgaggctgctgcaagaagagaacacaggaggaagcggtgtttcggtgaaggaagagataataacgaggcctgcagactcagaagacaaaacgatggaacaaagtaagagtgacccatcttctgaaacctcaaatattaatcctagttcggagtcggaggaggatcacttgaactacgagtgtttcaacaacaacgacgactgcgtcggaggaaccgccgcatcgcttttgcaagtggacttcaaagacggttcttccgacagcgacggatcaagcgcgattttgaacgaagacaacatgtactctcccttgaaattcaacaattgctccatatcaacctcgccgtcatcgtcttcgatgatgaactgttttcagttccagaaaccgtatcatcaccacgcgcagtacgtgaagatggaggagcacaatttcctcagcgcggatgaggcctgcaatttcttctcggatgaacaagcaccgacccttcaatggtactgtccagaacagtggagctga

SEQ ID NO: 2135 - DNA, 1755 bp, Glycine Max
atgaagagggatcaccgagatagctgcggcggcggcggcggagggagtgtgaagggtgagtgttcctcaatgccgtcgaacgggaaggcaaatatgtgggaggaacaacaacaacaacaacaggggatggacgagttgctggcggcgttggggtacaaggttcgtgcttccgacatggccgacgtggcacagaagctggagcagttggagatggtcatgggttgtgcccaggaagagggaatttcccacctcgcctccgacaccgtccactacgatcccacggatctttattcctgggtccaaaccatgttaaccgaactcaaccctgaacccaacaacaacaacaatagcctcctcggtccatcttctctcttaatcgacaacaacaccgcccctgttttcaacgacgattccgaatatgacctcagagccattcctggtattgcagcctaccctcctcctcctccacaagacaacaacaacaacaacaacaacctcgacgaaatcgaaacagctaacaacatcaacaagcgtctcaagccatctccagttgaatcagcagactccgcgtctgagcccacgcgcacggtgctgctcgttgaccatcaggaagccggcgtgcgtctggtccacactctcctggcgtgcgcggaggccgtccagcaggagaatctgaagctggccgacgcgctcgtcaagcacgtgggcatactcgcggcttctcaagccggcgccatgaggaaggtggcttcctacttcgcccaagccctcgcgcgtcgtatctacggaatcttcccggaagaaaccctcgactcctccttctccgacgttctccacatgcacttctacgagtcctgcccttacctcaaattcgcgcacttcaccgcgaatcaggctatcctcgaagcatttgccactgctgggagagtccacgtcatcgatttcggcctcagacaagggatgcagtggcctgcactcatgcaagcccttgcattgcggcccggcgggcccccgactttccgtctaaccggaatcggcccgccgcagcccgacaacaccgacgcgctgcagcaagtgggctggaaattagcccaattggcccagaacatcggcgtccagttcgaattccgcggcttcgtttgcaacagcctcgcggatctcgacccgaaaatgctcgagatccgacccggagaagccgtcgctgtcaactcggttttcgagctccatcgtatgctggcccgccccggatccgtcgacaaggtcttggacactgttaagaaaatcaagccgaagattgtcaccatcgtggaacaagaagcgaaccacaacggaccgggttttcttgaccggttcactgaggccttgcattactactccagcctattcgactcgctggagggttcgtcctcttcgaccgggttgggctcaccaaatcaggatctgttaatgtccgagttgtacctggggagacaaatatgcaacgtggtggctaacgagggcgcggaccgggtagagcgtcacgagactttgagtcagtggagggggagattggactcggccgggttcgacccggttcatctcgggtccaacgcgttcaagcaagcgagtatgctacttgctctattcgcaggcggtgacggctatagggttgaggagaataacggctgcctcatgcttggctggcacactcggccactcatcgctacctccgcctggaagcttccctccccgaacgacttgcactgtaaactgtag

SEQ ID NO: 2136 - DNA, 897 bp, Glycine Max
atgaagcaaagtggtggttatttggatggggttgctccagatggcctattaggtttggggcctggggagagttcagttccaagttttcttgctaaatcaggattaatccacgattctttttccttgtgctttaatgaagatgattctggtagaatattttttggggaccagggaccaaccatccaacagtctacttcattcttgcctttggatggattatattcaacctacattattggagtggagtcatgttgtgttgggaattcttgtcttaaaatgacaagttttaaagtgcaggttgatagcgggacatcatttacttttcttcctggtcatgtgtatggagcaatagctgaggagtttgatcaacaagtaaatggttcaagatctagctttgaaggatctccttgggagtattgttatgttcccagttcgcaagagttgccaaaggttcccagcttaactctcacgttccaacagaataacagttttgtggtctatgaccccgtatttgtattctatggcaatgagggagtcattggattttgtttagccatacagccaactgaaggagatatgggaacaatcggacagaacttcatgacaggataccgtttggtatttgataggggaaacaagaagctagcgtggtcacgctcaaattgtcaggatctgagtctaggcaagaggatgcccctttctccaaatgagacttcatcaaacccattgcctacagatgagcaacaaagaacgaacgggcatgcagttgctccagctgttgctggaagagctccccacaaaccttcggctgctccatctcggatgatttcatcgtgccgggtacattggcactgctatttgtttcttctacttctacttgtgtctgccctttactga

SEQ ID NO: 2137 - DNA, 1758 bp, Glycine Max; identical to SEQ ID NO: 30

SEQ ID NO: 2138 - DNA, 2244 bp, Glycine Max; identical to SEQ ID NO: 31

SEQ ID NO: 2139 - DNA, 1383 bp, Glycine Max
atgaagctcgacgtagatgtcttgagatatctctccaaagatgattttagggttctcactgccgttgaattggggatgcggaatgatgaaatcgtacccaccgaactcatcgaccgaattgcgcgtctcaagcatggaggcacgtacaaggttttgaaaaacttgctcaaacacaagttgttgcatcacgactcttctaaatgtgatgggttccgccttacctaccttggttatgattttcttgccattaagactatggtgaacaaaggagtgtttgtagctgttggacgccagattggtgttggaaaggaatctggtatatttgaggttgcccgtgaagacggaacagttctggctatgaagttgcataggcttggaagagtctctttccgagccgtcaaatctaagcgtgactacttgagacatcgcagtagttataattggctctatttgtctcgcctcgctgcacttaaagaatttgctttcatgaaggctttggaaacacatggcttccctgttccaaatgcaatagaaagcaatagacattgtgtagtcatgtcactcgtccaaggttatcctctggttcaggttaagcagttactgaatccagagacagtttttgaggcaattcttggtcaggtcgttcggttggcagagcatggtctcattcattgtgatttcaatgaatttaacatcatggttaatgatgatgaaaaaattacaatgattgattttccacaaatggtatctgtgtcacaccgtaatgcgcagatgtactttgaccgtgatgttgaatgcatctttaagtttttcaggaaaaggttcaatctttcttttcaagaaagcatagatgatattgatggttctgatgaagggagagatgaagctggaaagccaagtttttcttcaatagaaagaagtgctggttttctagatagagagcttgctgccagtggctttactagaaagaatgaagaagatattcagaggttcattgaaggtggggcagaaagtgatacaaattcagatagtgaaggggttgacttggtggaagacctgaatgaagcagacactgtagatgatgattcttcacatttgtcagaacagaatgagggatccgaaagtcaagggaaagaggagatttgtgaagcacgtgaaagcagtggatctgaaaaggaagatgcaagtgacaatggggaaagcaatgaagatacattgcaaaatgaagctgaactcgttaagaacttgagtaagcaacgacgacatgccatagcgaaagctcataagggacgaaagactgttgcagccagaaattcctacaaagacaaaggtggtagatcatctcacaattctaaaatccagaaacagttgagcagctggtga

SEQ ID NO: 2140 - DNA, 2502 bp, Glycine Max
atgaagctttcaacatcagggttggggcagcagggacatgaaggaggggagaagaagtgtctgaattctgagctatggcatgcatgcgcgggccccctggtgtccctaccaactgcagggactcgtgtggtttacttccctcagggtcatagtgagcaggttgctgccacaactaacagagaaattgatggacacattcccaattaccctagcttgccaccccagttgatttgccaacttcataatgtcacaatgcatgcagatgttgaaacggatgaagtatatgctcaaatgacattgcagccattgactccgcaagagcagaaggatacatttctttctatggaattgggcattccaagtaagcagccgtcaaattatttttgcaagacattaacggccagtgacaccagcacgcatgggggattctctgttcctcgtcgtgcagctgagaaagtttttcctccactggatttctcgctgcaaccaccagcacaggaactaattgctagggatctccatgatgctgaatggaaatttcgacatatttttcgaggacagccaaaacgacaccttcttactacaggctggagtatatttgttagtgccaagagacttgtggctggagattctgtgcttttcatatggaatgagaagaaccagctccttttgggaatacgtcgtgccaatagaccgcaaactgtaatgccgtcatcagttctatccagtgatagcatgcatattggacttcttgcagctgctgcccatgctgccgcaaccaatagctgttttactgtgttttataatccaagggctagtccatccgagttcgtcataccactttcaaaatatatcaaagctgtgtaccatacacgtatttctgttggtatgcgtttcaggatgctttttgagactgaagagtcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttacagaacttaggtagtggatatctcatgaagcaacaaatgatgaattttcagcagccttaccactatcttcaacaatctggaaacagtaattctcctttgcaacttcagcagcagcaaccaattcaacaatctgtgtcttctaacatgctgcagccacaagctcacgtgttgacagagaacctctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccagatttcttggattcgagcatgaagttccctgcttcagtttctcccgggcaaaacatgcttagttcactttgtcctgaaggaagtggcagtctcttgaatttatcgaggagcagtctgtccttgctgactgaacagttaccgcaacagcaatggactcaaaaatatgcacctgtgcaggtcaacacctatggaggcactgtgtcacatgcacaatattctggaaaagattctgcaatggtgctaccacattgtaactcggatgcccaaaattctacgctttttggtgtcaatattgattcatctggccttctccccatcacagtccctggttacaccacctcgtctgctgacactaattcatcaacaatgccattagcggattctggtttccagggttctctatatggttgcatggattcatcggagttgttgcaaagcgcagggcatgttgacccagaaaaccagagtcaaacctttgtcaaggtttacaaatcagggtcagttgggcgctcacttgacatatccaggttcagcagctatcatgaactacgcgaggagttggctcagatgtttggaattgaggggaagttagaagaccctcttagatcaggctggcagcttgtgttcgttgacagggagaatgatgttcttctccttggagatgatccgtgggaatcattcgtcaataatgtttggtatatcaaaatactttcacctgaagacattcagaaaatgggggaacaagcggtagaatcccttgcattagtttttacattatttccccttttttttcgtgggggaggagaacttcatcgtttccatttgtaa

SEQ ID NO: 2141 - DNA, 429 bp, Glycine Max
atgaaggatgattttgaaagtgaagtgaagcttataagtaatgtgcatcattggaatctcgttagacttcttggttgttgtagcaaaggccaagagagaatcctggtttacgaatacatggcaaatagcagcattgacaaattcttatttgatataaagactgctaatatcctcttagatgatgatcttcaacccaaaattgttgattttgggggatacacagcacctgaatatgcaatgcatggccaattatccgagaaggctgatacctacagctatggtattgtggtcctagaaatcataagtggtaaaaaaagtaccgatgtgaagattgatgagaagggtcgtgagtaccttcttcaacgagcatggaaactgtatgagagaggcatgcagttggagcttgtggacaaaggaaatagatcctaa

SEQ ID NO: 2142 - DNA, 1086 bp, Glycine Max; identical to SEQ ID NO: 32

SEQ ID NO: 2143 - DNA, 540 bp, Glycine Max; identical to SEQ ID NO: 33

SEQ ID NO: 2144 - DNA, 924 bp, Glycine Max; identical to SEQ ID NO: 34

SEQ ID NO: 2145 - DNA, 165 bp, Glycine Max
atgaatatcaatgaatcaaataatgaatacctcagtgtcccaaaaccctttgtgctgtattccatcaacatcaatgatgcgcatttgaaaatgtttatgaaaagttgtttaaagagaaataatccttctacaacaaatgtagaacaatgcatttataatttataa

SEQ ID NO: 2146 - DNA, 1428 bp, Glycine Max
atgaatcacactcgcttggagtcttgtcatgaatctccccttaaagtatacaaattctgttttgtcccagaaaaacttggtgatatggttatactcttaataaggtttggcattcttgtgtgtcttgttgcatccatatcacttgctctccactcagcattctctaaaccagaccggtggttcccgttaccggagcatattcgcgccgtccagaatacttcagtcattgacaacagaccaacaaacatctcacatcttcaatttggcattgctggatcagcaaacacgtggcatggccgtagcaactacactaaactatggtgggatcctaacaccactagaggttatgtttggcttgacaagaagcctaagattttgcacagtgacatattagtaccaccttatcaaatctcacggggctggactcggttcaagcacgtgcactcagcatctgctgttcggatagctcggatagtttatgagagctttaaacttggtttgccaaatgtcaggtggtttgtgatgggagatgatgataccgtgttctttactgagaacttggttactgtgttaggaaaatatgatcacaatgaaatgtattatattggtgggaattctgagagtgtggaacaagatgtgatgcattcttataacatggcatttggtggtggtggatttgcaatcagttatgcattagcagctcaactagccaaaataatggatggttgtctaagtagatacttctatttttatggttctgatcaaagagtctgggcctgtattcatgaaattggggtgccccttaccagagaaaatggattccaccaggttgacataagaggaaatccatatggttttctagcagctcaccccttggtaccacttgtatcactccatcaccttgaccaattgagccccttctttcccaaccagactcaattacactcaatgaaaaagctcatcagtgcataccacattgaccctgcccggatagtgcagcaaagtatatgctatgatcataagcgtagatggtcaatatctatttcatggggttacactatacaaatctatacaaaattgttgatagcagcagacttgcagatgccattgcagacatttcagacttggcgaagttggaaggatggtcccttcatattcaatactcgacctatgagctctgacccgtgccagcagccagctaggtttttcctggatcaggctacaaaggtgggaaaaagtggaagtatcactatctacaagagacatgaaggcaaggaagcaaagtgcaacagagaaggcactaataatgaggaagtgcaaagaattagagtttctgccttgaagctggatccagaatattggaagaatgtacctctctctctttctctccctctctctccacacacacatgcgtgcacatacaattaa

SEQ ID NO: 2147 - DNA, 1806 bp, Glycine Max; identical to SEQ ID NO: 35

SEQ ID NO: 2148 - DNA, 1155 bp, Glycine Max
atgaatctctctggaaccatcggttgttcaagtcctggacgagataaggttgtggctccgattgtaagattcgaaaatgttgacagaatagctgagccttctgctgtattggtgtcactggatgagttcccaactctctttactaggatatcggatgactctagctttgctagtaaagttggtggtgtactggttgaaccaagcactgattttcagaagaagttaaagggattttctccagaccaaaaatttccacaagctcaattcgctctttatcataataccagctatgaatggaatccaattggttctggtattatgtggaaatcctacaattttcctgtatttttactcacagaaagtggctcaaagactcttcaagaggttgtaacaaagaatgaggacacaaagaaatcttatacttctaatgtggctgagtttgacctggtgatgcaggcagtgaaatctggaacacatgattcagagtcttgtttaaaagaagaaacttgccttcctttaggtggatacagggtctggtcatctcttcctccgatcaacatttcatccttacaacggtctaagcccattttattgacagtggcatctatggattctgcttcattttttcgggacaaaagccttggtgcagactcccctatttctggtttaattgcattactagcagctgttgatgcactttctcatttggatggtcttggtgaccttagtaaacaggttgtttttgcagttttcactggagaggcatggggttaccttggaagtaggagatttttggtagaacttgacatgcactcagatgctgttcatggccttaatcagacattaattgaaacggtcattgaaattggttctgttggaaagggtctcagtcaaggtgttaaaaacttttttgctcatacaaaaggggattcttctgccacaaatcagacagtggctgccttgaaacgtgcacaggagtcactgatatctgaaaacataaagatagcatctgcaagtgcctcaaatcctgggatacctccatcctctttaatgtcctttttggaaaaggatcctgcaatctctggtgttgtcctagaagattttgactctgtctttgtcaacaagttctaccatagtcatcttgatgatttatgt

SEQ ID NO: 2149 - DNA, 1419 bp, Glycine Max
atgaatggcgaggggagtgaagcaatgcaagtggagaaggagagcttggtgtacatgtggggttacctgcccggagctctgccgcagaggacgcctctgttgacgccgcttcttgttagggttccgccctctggttacttttggaaggatgtctgcggcggtggttgtggattcgccatggctatctctgagcctggaaagctcataacatggggttcaacagatgatttaggccaaagctatgttacatctggcaaacatggggaaactccagagcctttccctcttccaactgaagtgactattgttaaagctgcagctggatgggcacattgtgtttctgtgacggattgtggagaagtttacacatggggatggagggaatgtgtaccctctgggaaggtgtttggtgaatcattaactggggtaagccctgaaaaggatgtacccagaaggcaaagttcattcttgacggagcaagtgagccctcgttctcaaggttcaaaatctactggaggaactgcctctggtaccagtggagaagaaagttcaaagagaagaagagtatcttcagcaaagcaaacagctgaaacctcatcatctagtgatgatactcagactgcattgccatgtcttgtcacactaaatcctggtgtaaggatagcaagtgtagctgctggtggtcgccataccttagcattgtcagatataggacaggtgtggggttggggctatggtggtgaagggcagcttggtttgggttctagaatacgaatggtgtcctctcctcatctagttccttgtattaattcctcttcttatggtaaagatatggctcgagtaagcataagttcagatgggcaaaatttcagagttcctggaagttatattaagggaattgcctgcggaggtcgacacagtgcagtaatcacagatgctggagctgttcttacatttggttggggactttatggacagtgtgggcaaggaagtacagatgatgaactgagcccgagttgcgtatcttccttattgggtattcaaatagagggagttgctgcaggactgtggcatactgtgtgtacatctgtggatggtgatgtatatgcatttggtggaaaccagtttggacagctgggaactggtggtgatcaagctgagactataccgaggctcttggattgtccgagcttggaaaatgtgaatgtaaagaggatatcttgtggggctcgtcacactgctctaatagcagataatggaaaagtcttctgctggggatggaacaagtatggacagcttggccttggggacgtgatagaccgtaacatcccttctgaagttaccatcgaaggttgtgtagctaaaaacgttgcatgcggctggtggcatactcttcttctggcggaatcacccacttga

SEQ ID NO: 2150 - DNA, 606 bp, Glycine Max
atgaatgtgctcgtagcagtcataaacctagaaccaaagaaaggaccggttcatgatcaatacgatgatcttgttggttctttttcttcttcttcttcttcaacatcatcttctgtttctggaatttcaagtgggtcatcattggaatctgattcttttgaagaagtaacatcctctgcctcctcttcttcatcatcagcagctgatgatcaacttgtagttgtagctgatccattgggtgacatgacttctctctttcaacaacttcccatcaagagggggctatcaaaattctaccagggaaagtcacaatctttcacttcactgacaaatgtgaggagcttggaggaccttgcaaagccagagaacccttacaacaagaggttgaagtcttgcaagagctatgcaggagggttggcagagagccattcaacaagggctgtttctaagaggggaatggtgcattcaacaagttcaagaggttcatgttcttcttttagaaggggcagtgctactactaatttcatgggtagtaggccaccaattcctcctcatagatctaccagcaccaacaccatccctaatcaaactgtgttgtttgcttga

SEQ ID NO: 2151 - DNA, 1089 bp, Glycine Max
atgaattcagcatccccgcagtttgtttcctcaagaaggatgagtgtgtacgatccgatccaccagattagtatgtggggagaaggcttcaaaagtaatggaaatttaagtgcagccatgcctctaattgatgagacagacatgaagtttgatagtcagtcagaggatgcttctcatggtatactgggagagcctaataagtatgaccaagaagctaacaaacctactgataagatacaaagacgtcttgcacaaaatcgagaggctgctcgtaagagtcggttgaggaaaaaggcctatgtgcagcagttagaatcaagtcgtttgaagttgatgcagttggagcaagagcttgaacgtgcaagacagcagggaatttatataggcggtgggttggattctaatcatctgggttttgctggatcagtaaattcaggaattacaacctttgagatggagtatggacattgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgtcttctatgttatgtccggcatgtggaaaacaacagctgaaagatttttcctatggattggaggctttcgcccctctgagcttctaaaggttcttggccccctgattgaacccctgacggagcaacaacgtttggatatctataaccttggacaatcatgtcaacaagcagaagatgccctttcacaaggtatggacaaactccggcaaacacttgctgatagtgtagcagctgggcagttcatggaaggaacatatattccacagatgacttctgcaatggacaagttgaaagctctggtgagctttgtgaaccaggctgatcatcttcggcaggaaactttgcagcaaatgtctcgaatacttacaatccgtcaggcagctcgatgcttgcttgctttgggggaatatttccaacgcctgagggctttgagctcactgtggtctaatagacctcgtgaacctgcttag

SEQ ID NO: 2152 - DNA, 1089 bp, Glycine Max; identical to SEQ ID NO: 2151

SEQ ID NO: 2153 - DNA, 1089 bp, Glycine Max; identical to SEQ ID NO: 2151

SEQ ID NO: 2154 - DNA, 1089 bp, Glycine Max; identical to SEQ ID NO: 2151

SEQ ID NO: 2155 - DNA, 2634 bp, Glycine Max; identical to SEQ ID NO: 36

SEQ ID NO: 2156 - DNA, 505 bp, Glycine Max
atgaccagaaaaaaggtgcaacccgcattcatttcgtttgattctgcaaggaagttaacatacaagaaaatgaagaagggaatgctaaagaagattgatgaacccagcaccctttgcggcattgaggcatgcgccatagtttatagcccaaggatcctgaggcagagggtgctggaaaagttcatgagtatgcctgaattggagcaaagcaagaagatggtgaaccaagagagtttcactgcacaaagtatcatgaagggtaacaagcaaatgatgaagctcatgaaggacaataggagaaggagtagggctcgtcctgataataacatgactattgctaatttgaattttctttcacggatggttgatcagaacctgaaggacattgataaaaggatggaaactctgaaaatgcaaactccagcattgaattatgccctagggtcggatatgaatactgctgagcccatgcaaaacctgtggtttatggactttcttaataatg

SEQ ID NO: 2157 - DNA, 756 bp, Glycine Max; identical to SEQ ID NO: 37

SEQ ID NO: 2158 - DNA, 341 bp, Glycine Max
atgaccatgtgggtaaacttaaaagcagttaaaaggcttgttgaagctgatgctctgaagatggaaattattcccaatccaaagttctttgacaaagctattggaattaatgtgcctcgatcccgcttccttcccgtgaaggcaacttcagacttgcttcttgtccagtgggacctttacactttacaagatggattggttattaggaaccaagctagggcaaatcctgaaaatccttccattgaattggggccagaatttaagaaggttaagagcaatatttctattaactttgtgttaggtggtgaatatgagtttgacattcccagtctcattcacag

SEQ ID NO: 2159 - DNA, 873 bp, Glycine Max
atgacccggagaaagacgaaactcacattcatagccaatgatactgagaggaagacttcatacaagaaaaggaagaagtcactgctgaagaagacggaggaacttagcactctttgtggcattgaagcatgtgccatagtttatggccccgatgatcctcagccagagacttggccatccgaagcgggtgtcaaaaatgtgctgggaaagttctctaccataccagaatgggagcagggaaagaaaatggcgaaccaagagagtttcattgcagaaagcatccagaagggcagagacaaggtgaagaaaatagggaaggacaacaaagaaaaggagatgaccatgttcatgtatcagtgcttcaacacaggtactgttcatcctgataacaacatggccatagctgatttgaatgttctttcatctgtgattgaacagaagctgagggacattagtagaaggatggaaacgctgaatgttaacgagacaacaccacagcaacccgagatgcaaacaccagcgcttcccgtagcgcctgaagagacaacgacgacaccgctgaattatggccctgatgagtcggatgtgaatgctgaccccttggaaagccagtggtttatggacttgcttaatggtaatggggatgagacaccaatgactccatttggagatagatcaacatcttataaacagacgcagatgagaaagaagggtgcacccagaccccctattttcacgagtctggcatatcttggtccaaataaacctcggacaacactaaaccgcacccccatgctcttggaaaaggggagaaataaatcctttaaacaattgctgccacaacaactcgattcagcttgtcagatcgacttg

SEQ ID NO: 2160 - DNA, 1992 bp, Glycine Max
atgaccggccattttctccggacacccctcacactcaagatcgctgctttcttcttcatcgcagtcaccttcttctacttcggcaagcactggtccgatggctaccagcagctcgtcttcttcacccagcgatccgacccggattcgaactcgaacccgtttgtttccacgtccccgaataacgccaagtccttcaacgtctccgccctaattgagaacaacacacaaccggcaccgccggaaaatgcccctccgccgccagcgccggaggaggggtcgatcgagaaacttggggtggtgaacgagaatggcacgatgtccgatgagttcgaggtgggggatttcgatccgggaatggtggatcagtgggtgaacgagactcaggttgatgagagcgagggttcttcttctgatgtgggatttgggatcaagaagttcgggttgtgcccccgcgagatgagcgagtatataccgtgtttggataacgaggacgagattcggaagctgccttcgacggagaaaggggagaggttcgagcggcattgccctgagcaaggtcgaggcttgaattgcttggttcctgcacccaatgggtaccgtacccctattccatggcccagaagccgagatgaggtatggtacaataatgttcctcatacacgtcttgttgaagataaaggaggccaaaactggatttctagagacaaggataagtttaaattcccgggaggtggtacgcagtttatacatggggcaaatgaatacttggaccatatttctaagatgattcctgatattacttttggtaagcatataagggtggttcttgatgttggctgtggtgttgctagttttggtgcgtacttactgtcacggaatgtcgtcaccatgtctgttgctcccaaggatgttcatgaaaatcagattcagtttgctcttgagcgtggtgtaccagcaatggctgcagcatttgcgactagacgcttgttatatccaagtcaagcttttgacttggtacattgttcacgatgtagaattaattggactagagatgatgggatactgcttcttgaagttaataggatgctaagagcaggagggtactttgtctgggctgcccagccagtttataagcatgaagaagttttagaagaacaatgggaagagatgcttaatcttaccactcgtctctgctggaattttttgaaaaaagatgggtacattgcagtatggcagaaaccttctgacaatagttgctatcgagaccgcgaggcaggaactaaacctccaatgtgtgacccaagtgatgacccagacaatgtttggtatgttgatctaaaagcatgcatctctgaattgcctaagaacggatatggagcaaatgttactgaatggcctgcacgtttgcaaaccccccctgataggcttcaaagcataaagcttgatgctttcacatccagatcagagctttttagggcagaatcaaaatactggaatgaaataatagcaagctatgttcgtgttttacactggaaagaaatcagattaagaaatgttatggacatgcgagcaggttttggaggatttgcagcagcattgattaatcagaatcttgacagctgggttatgaatgtggttcctgttagtggcccaaacaccttgcctgttatatatgaccgtggattgattggagttatgcatgactggtgtgaggcatttgacacctacccaagaacctatgatttactgcatgctgcaaacctactttctgttgagaagaaaagatgcaatgtctcatccattatgcttgagatggatcggatactacgacccggtggacgtgtatacatccgcgattctcttgatatcatggatgaacttcaagagattgcaaaagcaataggctggtacgtgatgttgcgagacacggaggaggggcctcatgcaagttatagggtattggtttgtgataagcacttgctacgctcttaa

SEQ ID NO: 2161 - DNA, 1992 bp, Glycine Max; identical to SEQ ID NO: 2160

SEQ ID NO: 2162 - DNA, 849 bp, Glycine Max; identical to SEQ ID NO: 38

SEQ ID NO: 2163 - DNA, 132 bp, Glycine Max
atgacgactcttgtcattggtggcactcgtggaatcgggcacgccatagtgaatgacttggccgcatttggcattgcagtgcacacttgttccaggaaccaaacagagctcaacaagtgcttacaagaatga

SEQ ID NO: 2164 - DNA, 1098 bp, Glycine Max
atgacgcagcagaatgtggtagtgtctgatactaaatccggagtttccttaacggtttttccaacaacaacacaaaagccaccggcggcgccaggagggtacatttccattccgaggaggagggttttgaagaaccttgaaatcaatggaggccaaagaatcaatgcatgggttgagtccatgagagcctcctctcctacccatcataaatccacacctttgtcgcaggagcataactcttggattcttcaccatccatcagcattagacatgtttgaccaaattattgacgcgtcaaagggaaaacaaattgtcatgtttctggactatgatggcacgctgtctcctatagtcgacgaccctgaccgtgctttcatgtctgattcgatgagaaaaacagtgaggaaacttgctaggtgtttccctactgctatagtgaccggcagatgcaaagacaaggtttacaattttgttcgattggcagagctatattatgcaggaagccatggcatggatattaaaggaccaacaagaagttccaaatacaacaaagatagcaaagctgaggcaatcctttgtcaacctgccagtgattttcttcccttgatagatgaggtgtatcaacaattagttgaaaagacaaaatcaactcctggagctctggttgagaacaacaagttctgtctttcagtccattttcgttgcgttgatgaaaagaaatggagtgaactggcacgccaagtgaaatcagttttaaaggagtacccgaagcttcgacttacccaaggaagaaaggtgctagagattcgtcccactattaaatgggacaaagggaaagccttggaatttttattagagtcactaggtttggccaattgtagtgatgtctttcctgtttatattggcgatgatcgatccgatgaagatgctttcaagaaattaagagacagaggacaaggttttggcattcttgtctccaaatttccgaaagacacaagtgcatcttactctttgcaagaacccaacgaggtgatgaactttcttcaacgcttggtggagtggaaacatgtgtccctgggagcacgttcccgagtgtaa

SEQ ID NO: 2165 - DNA, 792 bp, Glycine Max
atgacgcatgctcatacgcacacaatcaaacacaaagcgtgtgcctccaaagggtataaaagcaccaccaccttctcccttctccatcttcaagcgttctactatttcgtcaattccaacaacaccacaatgggaagaagaccggcgaggtgttaccggcagataaagaacaaaccgtacccgaaatcccgtttctgccgcggcgtgccggagccgaagatccgaatctacgacgtgggaatgaagaagaaaggcgtggacgagttcccgttctgcgtgcacctggtctcgtgggagaaggagaacgtctccagcgaggctttggaggcggcgcgcatcgcatgcaacaagtacatggccaagttcgccggaaaagatgccttccacctgcgcgtgagggtgcatcccttccacgtgctccgcatcaacaagatgctatcgtgcgccggggccgacaggctccagaccggcatgaggggcgcctttgggaagccgcaggggacgtgcgctagggttaacattggtcaggtgctgctctcggtgaggtgtaaggatgctaacagtcaccatgctcaggaggctcttcgtagggccaagttcaagttccccggccgccagaagatcattcttagcagaaaatggggatttacaaagttcagtcgaagtgagtatttgaagttgaagtctgagaacagaattgtgccggatggggtcaatgccaaggttcttgggtgtcacggacctttggcaaatcgtgagcctggaagagctttcttaccagctactgcttag

SEQ ID NO: 2166 - DNA, 1773 bp, Glycine Max; identical to SEQ ID NO: 39

SEQ ID NO: 2167 - DNA, 900 bp, Glycine Max; identical to SEQ ID NO: 40

SEQ ID NO: 2168 - DNA, 975 bp, Glycine Max
atgacgtcttcagtggtggaaggtggacgcgacgaggggaaacacgagccgtcggatttgatcacggaaaccatgaatctgacggctccaaacctttcacttcccagtgaaactgaaacattcttgagcgcagcaatttccctcaaggacaaggtggtggaggagacttggaaccggagagatcaagtggttgatccgacggtgtacacgggactgttgggcaccgcctttacttgcttgcggtcctaccaggttaccggttgccggaacgacttaatattatccagcgaaatcattgacacgtgtgtcaccgctgcacgtgcctccctcaggcacgtgacttttttgtgtggtagaggaggcgtttatgcgcttggtgctgtcgttgccaattacatgggggaccttcaaaagcgtgacctgtttttgggtctattcattgaggtggcaaaagagagagccctaccagttggaccagaggaaggtggttttggaatgtcatatgatcttctgtatggacgagctggattcttatggggtgcattgttcgtgaacaagcacctaggagaagatgcagtgcccaaagacattttgatgcttattattgatgcggtgttggctggtggtagagcaggagcatctgatattaaagactgcccattgatgtatagatggcatggaacaaggtacttgggtgcagcaaatggccttgctggtatccttcatgtgctgctacattttccacttccaagtgaggatgctgaggatgtcaagggaactttgtggtacctcatgagtaagcgtttccctcacagtggaaactatccctccagtgaaggtaatccaagggataagttagtgcaatggggtcatggggcgactggcatggccatcacgttgtccaaagcagcagaggtaaattactttccaaaatactctaatcattccatgttcttcataatgcatgtgtcttaa

SEQ ID NO: 2169 - DNA, 1236 bp, Glycine Max
atgacgtcttcagtggtggaaggtggacgcgacgaggggaaacacgagccgtcggatttgatcacggaaaccatgaatctgacggctccaaacctttcacttcccagtgaaactgaaacattcttgagcgcagcaatttccctcaaggacaaggtggtggaggagacttggaaccggagagatcaagtggttgatccgacggtgtacacgggactgttgggcaccgcctttacttgcttgcggtcctaccaggttaccggttgccggaacgacttaatattatccagcgaaatcattgacacgtgtgtcaccgctgcacgtgcctccctcaggcacgtgacttttttgtgtggtagaggaggcgtttatgcgcttggtgctgtcgttgccaattacatgggggaccttcaaaagcgtgacctgtttttgggtctattcattgaggtggcaaaagagagagccctaccagttggaccagaggaaggtggttttggaatgtcatatgatcttctgtatggacgagctggattcttatggggtgcattgttcgtgaacaagcacctaggagaagatgcagtgcccaaagacattttgatgcttattattgatgcggtgttggctggtggtagagcaggagcatctgatattaaagactgcccattgatgtatagatggcatggaacaaggtacttgggtgcagcaaatggccttgctggtatccttcatgtgctgctacattttccacttccaagtgaggatgctgaggatgtcaagggaactttgtggtacctcatgagtaagcgtttccctcacagtggaaactatccctccagtgaaggtaatccaagggataagttagtgcaatggggtcatggggcgactggcatggccatcacgttgtccaaagcagcagaggtatttcctaatgacagagaactaagagatgctgcaatagaagcaggtgaagttgtatggaagagtggattggtgaagaaggtgggacttgcagatggggtatctgggaatgcctatgccttcctttccctctacagactcactaaagagagtatatacgaagagagagcaaaatcattcgcttccttcttgtatgataatgcaaaatctctggctgctgccaatggctattcacttttccaaggacttgctgggacagcatgcctctggtttgatctgcttgcacccgacaactctaggttcccaggttatgaattatag

SEQ ID NO: 2170 - DNA, 461 bp, Glycine Max
atgactagaaaaaaggtgaaactcgcattcatagggaatgatgctgcaaggagggcaacatacaagaaaaggaagaaggggatgctgaagaaggttgaggaactcagcaccctctgtggcattgaagcgtgtgctatagtttatggccacaatgatcctgagccagaggtttggccatcccattggggagtccaaagggtggtggaaaagctcagaactatgcctgaattggaacaacgaaagaaaatggtgaaccaggagggtttcattggacaaaagatcctgaagggtaacgagaaggtgatgaagcttatgaaggacaatagggagaaggagataaccatgttcttgtttcaatgccttaatgcaggtaggattcagcctgataataacatgaccactgctgatttgaatgttctttcatctttgattgatcagaacctgaaggacattagtaaaag

SEQ ID NO: 2171 - DNA, 720 bp, Glycine Max
atgactagaaagaaggtaaagttggcattcatagccaacgactcagctaggaaggcaacattcaagaagaggaagaagggtctaatgaagaaggttagtgaacttagcaccctttgtgggattgatgcatgtgcaattgtttacagtccctatgatcctcaacccgaggtttggccatccccgatgggggttcaaagggtgcttgctaagttcaggagaatgcctgaattggagcaaagcaagaagatggtgaaccaagagagttttctgaggcagagaatcatgaaggccaaagaccagttgaagaaacaaaggaaggataatagggaaaaggagatgactcagctcatgtttcagtaccttagtgcaggtaagattatgcacaatataagcatggttgatttgaatgatttggcatggttgattgaccagaacttgaaggacatcaacagaaggattgaggtgttgactaagaatgctcaaagtcaaccgcaaattgcagcaccagcggtgactgatgttgctgccaaggttgaagacaagggacaagggagtcagcatggccatcaggggtttgatatcaacatggatctcatgcagaagcagaattggttcatgaatttgatgaataatggtggtggtggtgggaatgaggctatgcctattgtcggagatgttaatcaacaaaatggcttttggcctaatccttttttccattga

SEQ ID NO: 2172 - DNA, 1509 bp, Glycine Max; identical to SEQ ID NO: 41

SEQ ID NO: 2173 - DNA, 2526 bp, Glycine Max; identical to SEQ ID NO: 42

SEQ ID NO: 2174 - DNA, 222 bp, Glycine Max
atgagaggcgttgccaagtccaccggcttctcccaagttaaggatgttgttgctgtctgcaactgcctttccaacactttctctcttcccaggattttgttgcttggttcttccgcaggtgcacctatagcagggtctgccgttgatcagattgaacaagtcattggttatgtaagcataggttatccattgggaatgactgcctcaatcctttttggatga

SEQ ID NO: 2175 - DNA, 1935 bp, Glycine Max; identical to SEQ ID NO: 43

SEQ ID NO: 2176 - DNA, 321 bp, Glycine Max; identical to SEQ ID NO: 44

SEQ ID NO: 2177 - DNA, 333 bp, Glycine Max; identical to SEQ ID NO: 45

SEQ ID NO: 2178 - DNA, 333 bp, Glycine Max; identical to SEQ ID NO: 46

SEQ ID NO: 2179 - DNA, 333 bp, Glycine Max; identical to SEQ ID NO: 47

SEQ ID NO: 2180 - DNA, 333 bp, Glycine Max; identical to SEQ ID NO: 48

SEQ ID NO: 2181 - DNA, 333 bp, Glycine Max; identical to SEQ ID NO: 49

SEQ ID NO: 2182 - DNA, 1179 bp, Glycine Max; identical to SEQ ID NO: 50

SEQ ID NO: 2183 - DNA, 615 bp, Glycine Max
atgaggaagaagatcgaagaagaacaagatatgttgcttggaaaacgtcctcgggcaccgattatgaaaagaactacaagcatgagtggtggtttggccgtggaaaccaaaacaaccaacgaggaagtagtagtcatgtctgattcgcaacatgatgaggtggccgctaacaacaaactcgtcgatccacatgttgttgttgccatgggaacaccaaataataatgaattcgtgcctgaccacaccaaacatgtttctgaggccaaaggatcatatgtatatgctgatcgtttgatgggcatcaacatgagcatgcccctttctcccacaacctcaaataatcatcgtcacactcacatccacaaccatacaacaaacactaacaacatacacactacttctcactttcttcggacttgtggcctctgcaactgtcatttggcacctggtcgagacatctatatgtataggggtgatgcagcattttgcagtttggagtgtagggagaagcagatgaagcaggaccagagaaaagagaagtggaaggcggggtctaacaaggagcaccaccgtgcatcaccacccggcgccaccgcgaaggcttcttgtaattga

SEQ ID NO: 2184 - DNA, 963 bp, Glycine Max
atgagggttggaaccagtttccttgcactgctctcattgttgccattgcttctttctccgcaattttcaagtgctcagcttccacctgacactggcatctcatcacgcacccttgatgccattctccaagattgtgcctttaaggcatttttgaggccaaaaactggggtaccctatggtggccaagttcccagaagcctaaatggaattagagtttcagcaatgaggcttaggagtggtagtttgaggaccagaggtgttgaaagatacaaagagtttcagatcccaattggggttgttgagcaaccttatgtggagaggcttgttttggtgtaccataacttaggcaattggtctgagaagttttaccctttgcctggttacacatatttggctcctgttttaggtctaatgccatatagtggtgccaatttgtctgcttctgagttacctgaattggacataagagcttctgataagccaattttgatcaacttccctcatgtgaaatcagcaccattagggtcagtgcccaagtgtgtgtactttgatctacatggttcagtgcaatttgacatcctattacatgggaatgtttgttcaacagtccaacaagggcacttctcaattgttgtggagtctaatgccccttccccagcacctgctgctgcggctgtggctgcggctgcggctgctgatgttaggaaaagtggtagtgggaggaacaagtccaaggtgtgggtaattgttgcatctttggttggtggatgcctcttgttgatcatgttgagtcttttggttgctaaagtgaggagaacaaaaaaagggatgaagattcagcaattggaatgggcagctgagagcaatgaaactttgcagatagcatctattgggggcaccaaagcaccattggcagtagggactcgcacaagaccaacaattgaaaatgattacataccttag

SEQ ID NO: 2185 - DNA, 414 bp, Glycine Max
atgaggtctgcacttcttaatcctgatattcatactgccattctttatgcttccaccacccaaaagttgacagcaatgcctacggggtacattcttccaatattctggatccagcttcaaggcagaaactctaattctttgcacttcctcattattagtgccttctctgttgcactttgcttccttgccttcatgtctcttgtagatagtgatacttccactttttcccacctttgtagcctgatccaggaaaaacctagctggctgctggcacgggtcagagctcataggtcgagtattgaatatgaagggaccatccttccaacttcgccaagtctgaaatgtctgcaatggcatctgcaagtctgctgctatcaacaattttgtatagatttgtatagtgtaaccccatga

SEQ ID NO: 2186 - DNA, 780 bp, Glycine Max
atgagtacacatagtacgttggatattgttgtaaatgatatacttcgagtggtcacaccagtacaagaagattgggagatacgatttgcaattattaatgatttacgaagtattgttgaatctgtagaaagcctgagaggagcaactgttgagccatttggatcatttgtatctaatctcttcacgcgatggggtgacttggatatttcaattgagctatcaaatggtttgcatatttcatctgctgggaaaaaacaaaaacaaactttcttgggggatgttttaaaagctttgagaatgaaaggtggagggagcaacttgcagttcatctccaatgcacgagtgcccattttaaaatttaaaagctaccggcagggtgtatcttgtgacatttcaattaataacctgcctggtcaaatgaaatccaagattttgctttggatcaacaagatagatggccgttttcgtcatatggttttactggtcaaggaatgggccaaagcacataaaatcaataactcgaaagctggaactttcaactcctattcactaagtttgcttgtgatattttattttcagacatgtattcctgcaatttttccaccgcttaaagatatataccctggcaacatggttgatgatcttataggcgttagatctgatgcagagaatcttattgcacaaacatgtgatgctaacataaaccggttcatatcaaacagggcaaggtcaattaacagaaaatctgtggctgagctttttgttgaattcataggaaag

SEQ ID NO: 2187 - DNA, 1086 bp, Glycine Max; identical to SEQ ID NO: 51

SEQ ID NO: 2188 - DNA, 1098 bp, Glycine Max
atgagtgagaatagtaaaaccctgcgtttcggcatcttaggctgcgccaacatcgccagaaaagtggctcgagccattgctctcgctccgaacgccactctctgcgccatcgcgagccgttccagagagaaggcggagaagttcgccgccgagaacgggtttccggcgaccgtgagggtttacgggagctacgatcaggtgttggaggatccatgcgtggacgccgtgtacctccccctccccacgagtctgcacgtgcggtgggcggttatggccgccagtaaaaagaagcacgtgctggtggagaagcccgtggctcttgacgtggcggaactcgatcgaatcttggatgcggttgaatccaacggcgtgcagttcatggatggtagcatgtggctgcatcaccctagaactgcccacatacaacgcttgttctctgttcctcattctgctagtagcgttggaccagttcgttttgtccacagcacatcaacaatgccagcaacacctgaattcctagagagtgacattagagtaaagccagagttggatggtcttggtgcacttggtgacttggcctggtactgcattggtgcttccttgtgggcaaagggctaccaactaccaacctctgtcactgctcttcctgattctacaagaaacgattctggagtcatcgtgtccatcacagcctctttgctgtgggatcaaccaaaccaaacatttgcaaccattcactgctcctttctttcccacacttccatggacctggccatatgtggttccaatggctctctgcatctcagggacttcataatcccatatggtgagactagtgcttcgttcgatctcacacttggtgctaagtttgttgatcttcacattgggtggaatgtgagaccagaggaagttcatgtggccaatgagctcccacaagaggctctaatggtgcaagagttttctaggcttgttgcaggtattagagattgtggatctaaaccctctaccaaatggcctgaaatcagtagaaagactcaactagtagttgatgcagtgatcaagtcactagagcttggctgcaaacctgtttgcttgtag

SEQ ID NO: 2189 - DNA, 825 bp, Glycine Max
atgagttttgtttttcgaggaacaagagcagatattgaaaatgggtttccaggatttatacctgagaggcgagcattgcgcgttcatgcaacacgtcctagtaattccaattcactcacttttctcgtgacagttcttctgttattcatgatactgaactctcaccagatgtccccaaactttctgctctggctggtgcttggtgttttcttgatggcaacaatgttgaggatgtatgcaacatgtcaacagcttcaagcacaggcccaagctcatgcagctgcagccagtggcattcttggccacacagaattgaggttgcatatgccaccatcaatagctcttgcaagccgagggcgtctgcagggtctcagacttcaacttgcacttcttgatcgggagtttgatgatctagattatgaaactttaagagctctggattctgataatgtttctactgcaccctctatgacggaggaagagattaatgctcttcctgtccacaaatacaaggtttctggtcctcaatgtggtggttcctcaatgcaacaagcatcatcttccactcctgctgagaagaagcaagataattcaaatgctgttgggagcatgaaagcctctgatgatgacctcacttgcagtgtatgcttggagcaagttaatgttggtgacgtactgcgaagcttaccttgcttgcatcagtttcacgcaaattgcatcgatccctggctgcgccaacaagggacatgccctgtatgtaaatttcgagctggatctggttggagtgacaatggacataatgatatcatcgcggacatggtctga

SEQ ID NO: 2190 - DNA, 855 bp, Glycine Max
atgatatggtcaaggctaagtaggagaactcatctcttgccataccttagggctttgcaaacagactcaattgaatccaggtgcctatctatcattcctaaaggatcaagttacaagttcattaatcctaataccagcttccaacacaatttctcttgtaatatacggctatcaaagtttaagcaagaattgagtacaaaaccattccatctgtgttaccgctcttcagctttggcttcacagtatgttggaaagtcatgttccatgcctggtttccgacacttctcttctcatgcatccaaagaacagaaatcacgaaagatgcttttatacttgacgggcttagtttttgctatggttgggtgcacatatgctgcagttcccctttacaggagattttgccaagcaactggctatgggggaactgttacccggcgtgagactgttgaagaaaagattgctcgacatgatagcaataatacagtcaccacaagggaaatcgtggtgcagttcaatgctgatattgctgatgggatgcaatggaagtttgttcccacacagagagaggttagggtcaagcctggtgaaagtgcccttgcattttatactgccgaaaacaaaagttctactccaataacaggtgtttctacgtataatgtcactcctatgaaggctgcagtgtacttcaataaaattcaatgcttctgctttgaggagcagcgacttcttcctggagagcagattgacatgccggtattcttttatattgacccggaatttgagacggatcctaaaatgaatggtatcaataacattatattatcatataccttcttcaaggtttctgaggaataa

SEQ ID NO: 2191 - DNA, 2433 bp, Glycine Max
atgatattcgcttctcttctgatgtccaaacattgtatctactggatgcatgataatcactggcgctgggatgggaatttttcagtcaaggaagtctacacagaagagaagcaatactttgaacaaaggaaacgacaacaacaaaatctgcagatgataggatcagataactgttttgatggtcagggaataagtggacaaaccctcaaagaacaaaggtctctggacattcttaatttgctaaacttgtcaacaaatcctcagcaatgcaatccattctgccctaacgggagggatgatggagaaatcagcatttctaccatgccaggcagtgtctcaacaaatccaccaacaatgtttaccaatgtggatacttcagtaaattcttgcagatttgaagaggcaaaagcaggggcacctttgtgctgccagattgaaacatcatcaaagaagagtgctcctgatcaccagaatactgcttttaatggacccccaaatcaatggaagacagtaactgatcaatactcggaattttctgttatggatttgttttgtgatgatgagcctaatgccactgcagaaaagtgtccaacctgtgaagatcatgtttctttttcacttgaaggtttgggtaaagttggtacagagacaccagttcattctccagaacagcaggctagaaatccatatagctactatccattgcagaaggatggaaggaaatcaaaattaaagaaacttagccatgtgctgaatgacatagaacttgaagtggatacaatgatgcaagatatcaaggtttcacctatatgttcttcggactacccatttaacaaagtaaggcaaagctcggcaattgttggaaacgacaagcatttttatgaccatagtaagagaagtggcttttctgttattgaagaattcttcaagactaaaaatagagatgaagacttgtggaatgcatgttccggcttccttgatgagagttttgacaacgagatgggatatgatacctcttgtaagaagacttttcaaatgggttctaaatctcctgaattattgaaaagtggggcctacaaaatggaaaattatgcttttgaagacctactcccaaagaaatggtcttcagctatagcgatgaaagagatcgacatgagtgagccacggtcttcattttccaaagatgaattagagaatgattttgacttttacgttgctagcagctcaagattaggtgggaacttcaatgctcaaaatttaattccagaagatgtaagggataattcgagcttgctgagcgaagagtcaagctcacgcactgccgagaggggtgtgtccactgcgcattcaccatcaacaatattgacgggagagaacagaagaaaacacagaaatgcttttgcaagccctagaaaacatagaaatgtttttgcaagcactagaaacaagtacagtactaaggacgaaaagtacagaagtatgccaaattcatcaaagcgaatgccatctcatgactcaaactctattctacaggaagagttggacgcacataacagttggcagtttgaggaaataaatccttcagttgataagagttctgttgccgcctcattctgtctagatttggaggcagattttgcagtcttcggatccaagaataaaattgaagatccttttagcgtctttattacccctgaattaagtaacaaggccagtccttcctttggtggatttagaaaagctgcacctcttgcagattcacctccttgcagtttcacctctgagaagtttgcatttgattcttcaatcgcattccccaatgttggttcatggccaaccggtccaagtttatctccagattttcagcccaagggaaagtctgaagatgcttgtggtggtttcgattgtgagacttcatctactgatatgtcagtgcagggaagtgtaagcaaaggggagagacaagtgaaaatgcaaaaagacaccaacaaaagttttgagcaagaagatgttttcctgggagataatgaattgtcctcagaaaagaaaatgtcagaagatgctccatcttccaaaaatcacacgaaagaatgtgaaggcaccgaggacacaaatccaaagacaacaacacagtgttttgtagcagctgactcttctggtcatgtggaggagatatcatccttactgaagaagcctgacaaacaagaaagccaagtagataaaagaaagaacaattgtgatgctgaaactcctcttaaatgtaataagagtacaaaagaagaagtgaaattttggtcacctgaaggaagaaccacgatgagtggtggaaaacataaaaatggtaaaattagcttgtcgggtcaggtgatgtttgaaagctacgtctttaagcttctgcgtgttcagaaggtattgaaggaggcatgtacatga

SEQ ID NO: 2192 - DNA, 4341 bp, Glycine Max
atgatcaattcagagattggtgctgttttggcggtcatgagaagaaatgtaagatggggaggtcgttatatgtctggcgatgatcagctggaacactctcttattcagtcttttaagacagtaaggagacaaatcttttcgtggcaccaccatcagtggcaagctattaaccctgccttgtatctacagccgtttttagatgtaattaggtctgatgaaactggtgccccaattactagtgttgctttgtcatctgtttacaagattttgactcttgatgtgatcgatcataatactgtcaatgttgaggatgccatgcacttggttgttgatgctgtcactagctgcagatttgaggtcactgatccttcttcggaagaagttgttttaatgaagatactacaagttcttctagcttgtatgaaaagtaaagcatctataatgctgagtaaccaacatgtttgcaccatagtgaatacttgtttccggattgttcatcaagcaggaagtaaaggtgagttgttgcagcagatagcacggtacacaatgcatgaacttgtaaggtgtattttctctcaccttcaagatacattcaaagtgattctgttagttgttttgccaagagttaacagtttgggtgatcaagaacttaatatttataacatctgcctagataatgagtatgcgtttggaagtagacaatcggagaatggcagcatgacttctgaatatgataatcagtcattatctacaaactctgctcccaatgctgcaagtgttgtgaaaacaactgtgatggacgaaaacacagcgataactattactggaaaggagggtggaccacatgacatgcatctcatgactgaaccatatggtgttccttgcatggtggaaatatttcactttttgtgttctttgctgaatgttgtcgagcatacaggaatgggtcctagatcaaacacactagcatttgatgaagatgtgcctctctttgccttaaatttaattaattcagcaatagaacttggaggaccttctatttgtcgtcacccaaggttgctgagcttaatccaggatgaattgtttcataatctgatgcagtttggtttgtcaacgagtccccttatactttcgatggtgtgtagcattgttctcaatttgtatcatcatcttcgtacagaactcaaattacagctggaagcatttttttcttgtgtcattttgagacttgcacaaagcagatatggggcttcataccagcagcaagaggtagccatggaggcccttgttgacttctgtaggcaaaagacatttatggtagatatgtatgctaattttgactgtgacataacttgcagtaatgtctttgaagaccttgctaatttattgtccaaaagtgcatttcctgtgaattgtccattgtctgccatgcatattcttgctttggatggtcttattgctgttatacagggaatggctgaaaggatagccaatggatctgtaagctcagaatattctccagttaatcttgaagagtatactccattctggatggttaaatgtgagaattataatgatccaaatcattgggttccttttgtccgccgaagaaagtacataaagagaagactgatgattggtgctgaccactttaatcgtgatcctaagaaaggtctagagtttctccaaggaacacatcttttgcctgacaaacttgatccccaaagtgttgcctgcttcttcagatacactgctgggttggataagaatcttgttggtgatttccttggaaatcatgatgaattctgtgttcaggttcttcatgaatttgctggaacatttgatttccaagacatgaacttagacacagctctgcgtctattcttggagactttcagacttcctggagaatcacaaaagatacatagggtgcttgaagctttctctgagagatattatgaacaatcgccacatatcctagctaacaaggatgctgctcttgtgttatcatactcaatgataatgcttaatacagatcagcacaatgtgcaagttaaaaagaagatgacagaagaggattttatccggaataataggcatataaatggtggcaatgatctgcctcgagaaatgctgacagagatttaccattcaatttgtaagaatgaaattcgcacaatccctgaacaaggtgttggatttcctgaaatgacaccaagtcggtggattgatctaatgcataagtccaaaaaaactgctccatttattgtatctgattctaaggcctaccttgatcatgatatgtttgccataatgtcaggcccaacgattgctgccatctctgtggtatttgatcatgctgaacaggaagaggtataccaaacatgtatggatgggttcttagctattgctaaaatttcagcttgccatcatcttgaagatgttcttgatgatctggtagtgtcgctttgcaagttcactacacttttaaacccatcatcagttgaggaaccagtccttgcctttggagatgacatgaaagcaagactagcaactgtgacagtattcactatagcaaacaggtatggggattacatacgcacaggttggagaaatattcttgattgcatcttaagactgcacaagcttggtcttcttcctgcccgtgttgccagtgatgcagctgacgaatcagagctttctgctgaaactgtgcatggaaagcctattatgaattctttatcctcagctcatatgcaatctattggcactccaaggagatcctcgggattgatgggtagatttagtcaactcttatctcttgacactgaggaaccaagatcacaacctactgaacaacaacttgctgctcatcagcgcaccctacaaaccatacagaagtgtcatattgacagcatattcacggagagtaaattcctgcaagctgaatctctattgcagctagcaagagcactcatttgggctgcggggagaccacaaaaagggaacagcacacccgaggatgaagatacagcagttttctgcctggagttgctgattgcaatcactttgaataacagggatagaattgggattctttggcagggtgtgtatgaacacatatccaacattgttcagtcaactgtaatgccctgtgccctggtagagaaggctgtttttggactcctgcggatttgccagcggttgcttccctacaaggagaacattgctgatgaacttctgaggtcattgcaacttgtcttgaagcttgatgcccgggttgcagatgcatactgtgagcagattactcaggaggtcagtcgccttgtgaaggcaaatgcttctcatataagatctcagttaggatggcggacaattacatcactgctttccatcacagctagacacatagaagcatctgaggctgggtttgatgcactattgttcataatgtctgacggtacccacttgcttccagctaattacattctgtgtgtagatactgccaggcagtttgctgagtctcgtgttggacaagcagagcgatctgtgcgggcactagatctcatggcagggtctgtcaattgcttggcccagtggactagtgaggctaagggagcaatggaggaggaacaaatgtctaagttgtctcaggatatcggagagatgtggttgagactagtacaaggtctaaggaaggtatgtttagaccagagagaggaggttagaaatcatgctttattatcgctgcagaagtgcttgacaggggccgatggcatttatctaccatacagcttgtggttgcaatgttttgatcttgtgatcttcactgtgcttgatgacctgcttgagattgcacagggacactctcaaaaggactaccgcaacatggaaggcacacttatcttagcaatgaagctcttgtccaaagtttttcttcaattactcccagaattatcacaattgacaaccttctgtaagctatggttaggtgtactgaccagaatggaaaaatatataaaggtgaaggttagggggaaaagaagcgagaagcttcaagagacaatgccagagctgcttaaaaactccttgcttgttatgaagatgaggggtatactggcgcagaggagtgccttgggtggtgatagtctgtgggaacttacatggctacacgtgaataacatttcaccatcattgcaacttgaggtattccctgagcaggattctgagcatttgcagcacaagcagggcgaatcaataggaggtacggtgcctgatgaaaaggtttccatgccttcaagtgaaacagcaagccgtgaagatgctggcattgttggttga

SEQ ID NO: 2193 - DNA, 384 bp, Glycine Max
atgatcatggcttcattcaattcaattcagaactccaccaccccaatcttgcttattactattctcattacatttctactccaccatcttctgtgcccagtttcttgtttcaaccagccacaacatgcaattcctccaccggaccctttatgtgaggagaaaaacagattaggttcaatgcctcctacttgccacaacaagtgcaaccggtgtcatccatgcatggcagtgcaagttccagcctcgcctagccatgaacgagttcacccaggtcttgccccaactgctgcaatggaagttttctttctccaaggtaacaggtactccaattacaagccattgagttggaaatgccattgtggtgaccactttttcaacccttag

SEQ ID NO: 2194 - DNA, 126 bp, Glycine Max
atgatcgaagttgattctaactttgctattcacgtaattcaatcttcttttggaggattgaaattccaagccagaattctgatctccctaccaactcacttgttagaatatagaggttttaattaa

SEQ ID NO: 2195 - DNA, 517 bp, Glycine Max
atgatctttgctttatcatgtctctcgtgcactcaacttgaagaagccataacatcttctaagaagttagaccaaccagtgtttcctccaccagcatacactgagatcaagtgtgcatcatgtccttgtggagacacctgtggtgagcaacttcccccaccacctccaccatctcctcctcctccctgtcaatcaccaccaccactgctaccatcgccaccaccaccaccaccacagtctccaccacctcctaagtttccctcttgtccacagaattgcaaccccttgccaccaccaccaccaccaagattcgtatatgtgcctgtgccaggtgtaccaaaaccatacacttggttgattttttttcttctattctttacgtgtgtgtattacttttcagttgatgatttagttcatgcaggatcaccaggttgctataatatgtatagtatggtatttatttacattgcaatgaagcaactgatggttgacaaaatattcacaaaccaaaaaaaaa

SEQ ID NO: 2196 - DNA, 417 bp, Glycine Max
atgatgaaaaggtgcgaattggtgtttgaagaagcaagaagaggagggtgcaaggagcacccatatgataagcaatcaccaggtgtttgctcctcttgcttaagggaaaagctctctcagctatacaacacaaaccctattattgatcctcgttgtttttctccagcttcttcgcctgcttctcctcatcaatctttttcttcttcgaaacacggctcctccggtcaccggaggccgcgcttccggaggaacgcttcgcacgtggcggaatctgcctcgtgcatgctgagcttgaacttgaagaagagcaagtcgctggcgtttgcttcgaggcacagggatgtgatgatgagtggaaggaagaaagatgggttttggacaaaggtgctcaaactcaagagaaatgatgagttctag

SEQ ID NO: 2197 - DNA, 969 bp, Glycine Max
atgatgaggttgactcgtgattttggtgatacaatgcaaagagatgttgtgcctgcagtttcttctgatgttgtaattggagctaacaataagataatagagacaaaggatgacccaaaagtgctatcaatgaaggaggttgttgcacgtgagactgcacagttgttggaacagcataatcatctctccgttcgtgaccttgctagtaaattcgagaagggtttggcagcgccaactaagttttctgaagaggctagacttagagaggcagcatcattggaaaaacatgttcttttgaagaagcttagagatgcacttgaatccttaaaaaggcgtctggcaggcagaaacaaggatgatgtagaagacactattgcgatgagggaaggggaactaatacaagagaaggcagaggtgaagaagcttgcaaatttttttaagcaggcttctgaagatgctaagattgttgatgaggaaagagcttttgctcatgctgaaagtaaggatgccagagcagcagttcaaagagtggaagtggcactacaagaacacgagagaatgtctcaagcttccgggaaacaagacctggagcaattaatgagggaggtccaagaggctcgaagaattaaaatgctgcatcagccaaggaaggtcatggatatggaacatgagcttcgagcattgagggttcaacttgcaaagaagactagacatgatttaacaaggacgaagaaaggtggggaaaatgttccacatttatatgaacttgaagggaatgaaatgttaggttcttatttgcaaattcaaccttgctctgataatgcccttgaagtttcaaaatgttcaattcagtggtattgtgtatcatctgatggttccaaaaaagaacttatctcaggtattgttcctatgtggacgtttcctacaccaataattaataacagacataaaatacagattttcattgat

SEQ ID NO: 2198 - DNA, 1065 bp, Glycine Max
atgatgatgtcttccgggacatcctcgtactggtgctaccgctgcagccgcttcgttcgcgtctggccccaccacaccatcgtctgtcccgactgcgacggcggcttcatcgaagaaatcgaacacccgccccgctccgtccacgtcgacccccgcggccgccaacgcttccccgccgccgccatgtacatgatcggccagcgcccttcctcggaccacccctcccgccccgctgccctccgccgcacccgccgcaacggcggcgaccgctcccccgtcaaccccgtcatcgtcctccgcggcggcgcagccaccgcggaggatgaaagtcgcggctttgaactcttctacgacgacggcgccggctccggcctccgacccttaccacctagcatgtcagagtttctcctcggatctggcttcgacagactcttggaacaactctctcagattgagatcaacggtattggacggtacgagcaccctcctgcttcaaaagcagccattgattcattaccaaccatcgaaattgatgacacccatttagccatggagtcacactgcgcgagaatgccatgcaagcacatatatcatcctgaatgcatattaccgtggctcgcacttcacaactcttgccccgtttgtcgccacgagttacccgctgataccccgaatccaaatcaaaatcaaaatccgtctcaaaatgttgccttgaacgaggaggagaatgtggggttgacgatttggaggttgcctggtggagggtttgcggtgggtagattctccggtgggagaagaggtgctgagagagagcttcctgtggtttacactgaaatggatggtgggtttaacaatggggggggtgagccgaggaggatttcttggtccagagggaatagagggagggagagtggagggttgactaggtttttccgcaatctgtttggttgcttcagaggaaagtctatgagggcgagttcctctcgttctagtactatggatccttcgttgcggtctcggaggacttggtctatggatgtaaacagtgggatgagagcgtggtag

SEQ ID NO: 2199 - DNA, 432 bp, Glycine Max
atgatggaagaacaggcaaaggaagagttgaagctgcttgaagcccaatatcctaaccatcatgagcatctaaagaatgagctcaggtcctttatctttcaactccagaccaatcaccatgattctgaacagcttccagaaaacaataacttcagcactcaccttgctttctttgatactgaagaatccactagcttggaggagctaaggaagaggagtgactatgatttggaacttggtttggcagacagagtagtgatagagaagattgatggaagttctaagcttgaaactcccaagagtgttgtagtgaagcatttctcaagcaggaagaacaagagaaaagatagggtggatttggttcttgagagggcacaagtttgtctcaaaaaaattaaacacttgaagacattcttattgccgccctcctga

SEQ ID NO: 2200 - DNA, 735 bp, Glycine Max
atgatggctgcagatcagcaaagaattcatcctgttcatgatgttgaggcaccacacagacctttggtgcctgaaaactatgcaaaatctgataagggtattcctcagcgcacttttcctgtgatgcattcaaagccacctaagagaagaagaagctgttgctgtaggttcatgtgttggacactaagcatattgctgattttgatcattgctattgccatcacaatagggatcctataccttgtgttcagaccaaagctccccaaatactcagtggaccaactgaggataagccagttcaatgtttcagacaacaacaccctctatgccaccttcaatgtggcaatcactgcaagaaaccctaacaagaagattggaatatactatgagggtggaagccacataagtgcttggtacatggacacaaaattgtgtgaagggtccttgccaaagttctaccagggtcacaggaacaccacagtgcttgatctgcctctaactggtcaagcacctgatgcaagtggtttggtgaatagaattcaggagcagctgcaacagaccaacaatgttcctctcaatcttaaggtgaatcagcctgtgagggttaagtttggtaagctgaagctcttcaaagtcaagttcagggttaggtgcaggcttgaggtggataattttggtgctagtaatgatattagaatttctagcagtagttgtaagttcaagctcaggctgtga

SEQ ID NO: 2201 - DNA, 2118 bp, Glycine Max; identical to SEQ ID NO: 52

SEQ ID NO: 2202 - DNA, 630 bp, Glycine Max; identical to SEQ ID NO: 53

SEQ ID NO: 2203 - DNA, 876 bp, Glycine Max
atgcaacctttatcacattggtgtatatttcaccggagcaaagaagaactggttgttgccacttggaaaaaacaatttgacaaatcagagatgattcaaagggtcctccttctgtatcttgcaaatgacattctgcagaactgtaagcgtaaagggaatgaatttgtgacagagttttggaaggttcttcctgcagcacttaaagatgttatcaagaaaggtgatgatcatggaaagcgtgtggtatctacattgattgaaatatgggagcaaaggagagtgtttggatcccaggctaggaaccttaaagatttgatgcttggagaagatgcacctccaccattggaatttggcaaaaagcgatcacgttctgtaagaattgcgaaaagggattctcactccatcaaatcgaaactgtccataggaggtacagcagaaaaaatagtgtctgcatttcatttggtgctcagtgagcaatccgctgaagatgcagagatgagtaagtgcaaatcttctgttcagcgtgtgaggaagttggaaaaagatgttgataccgcgtgctctgttgagaaatactttagcaaaggaactagaggaggaggaaaatgttttgaaacaatgcatagaaaacttaaattagttgaagcaagcagagtagcccttgtatctcagttaaaagaagctttgcatgagcaggaatctgaactagagaatgttcgtacacagatgcaggttgcacaggcacaagtagaagaggcttgcaacatgcggaagatacttgacaatgaagattcctctcagaaaacatccactggaaagtccgctgcaaatgggaaagtttcagacacattctcaagaaactatgtcctcagtttg

SEQ ID NO: 2204 - DNA, 291 bp, Glycine Max; identical to SEQ ID NO: 54

SEQ ID NO: 2205 - DNA, 249 bp, Glycine Max
atgcaccctcctttaacattgcacaaacacccaatgtgtgctgaagttattgagcagtttcaaaagtgtcatatagaacatcctattgcaaaattctttggtgaatgtactgatttaaaaataaaattggatcgctgtttcagagaagaggaagctttgaagcggaaggccaactttgaagagagcaaaaagttgaaggaacagttgcgagctttgaggaaagaaaatgctgcaagcagtggtcaatag

SEQ ID NO: 2206 - DNA, 912 bp, Glycine Max
atgcagagaggcacgccagtgagaaagccacacaccaacacctccgatctcctcacttggtcggaaactcctccgccagaatccgccgccaccgtcgcctccgccacccgctctggccagccttccgatagaatcagcaaggttctccatggcggccagctcaccgacgaagaagctcagacgctagccaagagcaaaccatgctcagggtataaaatgaaagaaatgactggaagtggtatattttctgccaatggggaagattctgcatcagaagccaattctgcaaatttgaataacagaacaagcatacgcatgtgtcagcaagcgatgaatggaattagtcagatatcattcagcaccgacgaaagcatttctcctaaaaagcctacctcaatacctgaggtagcaaagcagcgtgaactgagtggaactatgcaaagtgattcggacacaaagagtaagaagcaaatatcaaatgccaagaccaaggagctcagtggaaatgacatatttggccctcctcctgaaatcctgccccgttcagttgcggctgcacgcactttggaatcaaaggaaagtaaagacatgggagagcctcttcccagaaatctgcgaacatcagtgaaagtttcaaatcctgcaggtggccaaagtaatatcttatttggtgaagcaccagttgagaagacggcaaagaagatacataaccagaagtttgcggagctgacaggcaataatattttccaaggagatgttcctccaggctcagcagagaagcctctgagcagggctaagctcagagaaatgactggcagtgacatatttgctgatggaaaggcagaaatcaaagaccctgtgcgaggtgcccggaaaccccctggtggagagagcagcattgccttggtttaa

SEQ ID NO: 2207 - DNA, 912 bp, Glycine Max; identical to SEQ ID NO: 2206

SEQ ID NO: 2208 - DNA, 2136 bp, Glycine Max; identical to SEQ ID NO: 55

SEQ ID NO: 2209 - DNA, 1422 bp, Glycine Max; identical to SEQ ID NO: 56

SEQ ID NO: 2210 - DNA, 1149 bp, Glycine Max
atgcaggatagagatctgaatgagtatagtccgtctcggtccttatccagtaagcatctatcttgcagtcatcagttgtgtgataagggttcgaattgtaaaagttcacagcagcagtgtccatacatggtcagttacttgtcggagaacacgtcgagttctggattgttggttgaggacatactgcatcttcagtcaggcggcagtttatcaaactcatctgttcaggctccagttgttcttgggtgtggtatgaagcaaagtggtggttatttggatggggttgctccagatggcctattaggtttggggcctggggagagttcagttccaagttttcttgctaaatcaggattaatccacgattctttttccttgtgctttaatgaagatgattctggtagaatattttttggggaccagggaccaaccatccaacagtctacttcattcttgcctttggatggattatattcaacctacattattggagtggagtcatgttgtgttgggaattcttgtcttaaaatgacaagttttaaagtgcaggttgatagcgggacatcatttacttttcttcctggtcatgtgtatggagcaatagctgaggagtttgatcaacaagtaaatggttcaagatctagctttgaaggatctccttgggagtattgttatgttcccagttcgcaagagttgccaaaggttcccagcttaactctcacgttccaacagaataacagttttgtggtctatgaccccgtatttgtattctatggcaatgagggagtcattggattttgtttagccatacagccaactgaaggagatatgggaacaatcggacagaacttcatgacaggataccgtttggtatttgataggggaaacaagaagctagcgtggtcacgctcaaattgtcaggatctgagtctaggcaagaggatgcccctttctccaaatgagacttcatcaaacccattgcctacagatgagcaacaaagaacgaacgggcatgcagttgctccagctgttgctggaagagctccccacaaaccttcggctgctccatctcggatgatttcatcgtgccgggtacattggcactgctatttgtttcttctacttctacttgtgtctgccctttactga

SEQ ID NO: 2211 - DNA, 756 bp, Glycine Max
atgcatggattgagctctatgctgttcagatcccgtaagaaagaacatcaaattcgggagtttgtggacgggaatggaaacgtagctgtcggtttgaagttgcataataaaccaagtaatgatggccttaaccgacagtttcctctagagattccgccgattctatttgaagagacttcacttccagcaggattgcacggttcacatactaaagatgtttatagtatttcagtgttgcctgaggaagatgaaaatgcaaattgcgcttcaccactacctttcttgagcatcttaggggttcctaatcaagttaaaagcccaatgtgcttagatgatcccataaattgtcaaaactgcattgattttcaaatgaagaatgagggtgtgtattcccagtgcataattgatatccctagtgtcaatggaaactcagtttcacctgaatcctatgaagaggcagttgaaggttttaaaactgggaactcaccaacaagtgtactgtggagagaatcaagtttcaaagcggggaaacttatgcagagtctggtgaatgtgagcaatccaagagataaaccagtctctgagaagctacatgatttaccgagtaacagatggagaaaatataagcgtgctgcctcatttgattccagaaaagttgctcttctgttttcaatattgtcaagtttcggaacattggtattgatatatctgacattgagagtgaggcagagggctgatgggtttgctcttatttga

SEQ ID NO: 2212 - DNA, 762 bp, Glycine Max; identical to SEQ ID NO: 57

SEQ ID NO: 2213 - DNA, 1515 bp, Glycine Max; identical to SEQ ID NO: 58

SEQ ID NO: 2214 - DNA, 960 bp, Glycine Max
atgccaaaggagagaagggataggtctttgtcacatgaaagtagcagagcctcaccttaccctagcagctctagtcgtgttggaagatcttctcttaaagagtcagaggaaaatgttaaagaatgggaagaagctaggtgtccagtgtgcatggaacaccctcacaatgcagttctcctcatatgttcatcccacgagaagggatgccgcccttacatgtgcaacactagttatcgccactcaaactgtcttgatcagttctgcaagtcttttgcagacacctcatcaaccattcctcaagtagaaggtcaaatttcagatacttttgaaagtagaattgatgtgcccgaagacagaaatgaggggactgtccaaagtagaattgatgtgccagaagacagaagtgagggtttggttacaatgcaagccttatcctgcgaaaatgatgcaaaatcaaagttagtatgccctttatgtagagggaaaataaaagagtggaaagtagtggaggcggctcgtcatttcatgaatgaaaaatcaaggaattgttcttgtgagacttgcaacttcagtggcacatacccagatcttaggaaccatgcaagacttgaacatcctctcgagcgcccatctgcggtagacccagagcgtcagcgtagctggaggaggttggagcgccagagggatcttggcgacctccttagcacacttcaaacttcatttggggttgatgaccccatagatgatggtggtctgctggctgtgtttttcctcattcttcagcctgcttccatgtccaggggtaccacactccaaatgcgaataaggagacccactactacactctggggggaaaattatgatggacaatctggatctgatgatgcaaacgaatcttcagatggaggctctgataatagacctcgccgtgtccggaggcggcggacacctccaccatga

SEQ ID NO: 2215 - DNA, 960 bp, Glycine Max; identical to SEQ ID NO: 2214

SEQ ID NO: 2216 - DNA, 960 bp, Glycine Max; identical to SEQ ID NO: 2214

SEQ ID NO: 2217 - DNA, 1104 bp, Glycine Max
atgcccttggaagggattttcattgaacctacttcaacttctacacctgatctttcccttcacataactcacattgagctttctttgggaaggaatttcagtgttggaggaggaagaggaggaggagctcatttccatcatcttcaacaccattctaatgcttcaagagcaacaacaacgacaagcactactacaagttcctccaatcacatgagtcacataaattatggggtttctttgcttgatgtgtcatcagaaggattgaggccaatcaaggggattccggtgtatcacaaccgttcattccctttcttgccctcggaacattcaagagacaacaaggatcatcatgccaaaatctgcaccctacttcgccgctgctgccgcggcgctttcaaatctcatcatccattgcaccaccatcactcatcatcaccacactatggggttggacttggaccctctcatgagacctctgcagggttgatgagatcaaggtttttgccaaagttgccagcaaagaggagcatgagagcaccgagaatgcggtggacaagcacactccacgctcgatttgtccatgctgtggagcttcttggtggccatgaaagagctacaccaaagtcagttcttgagctcatggatgtgaaggatctcacattagctcatgtcaaaagccatttgcagatgtatcgaactgttaagaccactgacaagcctgctgcttcttcaggcctttcagatggatcaggagaagatgacatgtctccaatgggaagcagtggtggaatgcgtcaattttcagaccaaagaagcctttctgatcgaccactgcaacaagatatggactactcttcaggcaacaacactctatggagtaactcttcaagtagagaaacatggcaacaaaataactctaatgacgtagatggtttcagacccccaatcttccagtcacaacaaatatcaggagggcatcaaattcaggagtgtgattcaacccaactcaagaacagtttgtcaggatcaaatttagagtgcaagaacccaagtttggagttcacattagggagaccagattggaatggcaaaggacaagcctaa

SEQ ID NO: 2218 - DNA, 321 bp, Glycine Max
atgccgaccgggacaaatgtaagaatcgcgttctccaatgatgctgcaaggagggcagcatccaggaaaaggaggatgggaattctgaagaagatggaggaactcaacttcctagggcaaaggatcgagaagcaccaagagaagataaagaaactacaaaaggaaatcaggaagaaggagatgaccatgttcatatatcggtgcgttcatgcagggaggcttctgcctgtggaaggtttgaagccatggatgttaaggagaagacaccacaccaaccacagatccaatcaccagcgttggatgagtgcaaaccccatttaa

SEQ ID NO: 2219 - DNA, 2835 bp, Glycine Max; identical to SEQ ID NO: 59

SEQ ID NO: 2220 - DNA, 1779 bp, Glycine Max; identical to SEQ ID NO: 60

SEQ ID NO: 2221 - DNA, 1479 bp, Glycine Max
atgcctcgcagcagcatactttgtggaaatcatacagcagatgaaagcacaactttcagtgaagctggacagcaagtgttgatggatctacagatagcaacaccaaaaattactggcttctatgcagctaccaagacacaagtggctggtggtgcaatctatgccattgcacaatgtgctgaaactctcacacaagatagttgtttggattgcttgtcagttgaacatagcagcatacaaggttgtcttcccaaaacaaatggtagggcattcgatgctgggtgctttatgagatactcggagacacccttctttgctgataaccaaaccattgatatcaaccccttcttaaaacaaggaggaagttcaagcaagaagtgggcaatttttggtggtggtgttggaggtgcagtccttgttgtgatccttctttcattatttctccggtggcgtagaagatcccaaagtcccaagagagctcctagaggtaacatattgggagcaactgagttgaaagctgcaaccaagtacaagtatagtgacttgaaagttgcaacaaaaaattttagtgagaaaaataagctaggagaaggaggctttggcgctgtatacaaggggacaatgaaaaatgggaaagttgttgcagtcaaaaagttaatttcaggaaaatccaacaagatagatgacgattttgaaagtgaagtaatgcttataagtaatgttcaccacagaaatctggttcaactttttggttgttgtagtaaaggccaagacagaattcttgtttacgaatacatggcaaacaacagccttgacaaattcttatttggtaaaagaaaaggttcactcaactggagacaacgcttagatataattttgggcacagcaaggggattggcctatctacatgaggaatttcatgtgtctatcatacatagagatattaagattgggaatatcctcttggatgaacaacttcagcccaaaatttctgattttgggttggtgaagctccttccaggggaccaatctcatcttagcacaagatttgcagggacaatgggatacacagcacctgagtatgcacttcacggtcaattatcagaaaaggctgatacatacagctatggaattgtagtgctagaaatcattagtggtcaaaagaatattgatgtgaaggttgttgatgatgatggtgaggatgaataccttcttcgacaagcatggaagttgtatgagagaggcatgcacttggatttagtggacaaaagcttagaccctaataactatgatgcagaagaagtgaagaaagttatagacattgctttgttgtgcactcaagcatcggctgcaatgaggccaaccatgtctaaagtagtagttctacttagtagcaattacttagttgagcatatgaaaccttcaatgcctatctttattgagtcgaatttgaggtcccatagagatatctctacttga

SEQ ID NO: 2222 - DNA, 1401 bp, Glycine Max
atgccttatcggttatttattcttcaaaggcaattggaggggttgcatggaggttctaaagtgagaggagtgaacttaggagggtggctggtcatcgaaggttggatcaagccttcactttttgatggcattgccaatggagacatgcttgatgggacagaagtgcaatttaagtcagtgacattgcacaagtatgtatccgctgagaatgggggaggaatgaatgtgacagttgacagggatgtcccatcttcatgggaaaccttcaggttatggagagcatctgaatcagaatttcaatttcgtacctccgaaggccaatttcttacatgtgatggtgggggctgctctgtctctgcaacagcaaaatctccttcgacatcagagacatatggaattgagcggaatggaaaaaataggattcacctcaagataaagggaggggcatatcttcagagacatagaaatagctttatcaccatagaagatttcaaatttctatataaacatggaataaatactgtgaggataccagttgggtggtggattgcttatgatcctgatcctccgagtccatttattggaggaagtcttgaagctctagataatgcattttcatgggcacaggaatatgatattaaatgcataattgaccttcatgctgctcctggttcccaaaatgggatggagcatagtgcaagcagagatggatttacaggctggccaacttctcctgattatatttccgactcattatatgttattgaatttttagtttctagatatgcaagaaatcctgctttgctgggaattgagctattgaatgaaccatctgctgccacagtttcattagatgttttaatttcatattacaagcaaggctaccaaattgttcgaaaatattcatcatcagcttatgtgataatctgccagagaattggtgttgccgatcctatggaactttatcaagccaacataggatctcacaacttagttttggatttgcatttctacaatctcttcgacacatttttcaataatatgagtgctatggataatattcaatacatatacaaaagccgggaaggtcaactgcaggccttaaacaattcaaatggcccacttattttagttggagaatgggtgaatgagtggaatgtaacaaacggatcccaaaaagattatcaagactttgcaagagcacagctagacgtctataatgcagcttcctttggatggtgctattggacactaaaaaatgatgagaagcactgggattttgaatggagcattaggaacaactatcttcaattaggtaactcacccagcaaacggagcttgaacattctaggattgttaggattagcatgcacctggttttgtctacttccatttttgtga

SEQ ID NO: 2223 - DNA, 324 bp, Glycine Max; identical to SEQ ID NO: 61

SEQ ID NO: 2224 - DNA, 576 bp, Glycine Max; identical to SEQ ID NO: 62

SEQ ID NO: 2225 - DNA, 1563 bp, Glycine Max
atgcggtggcggttgctgcttttgttgcttttggtaacggctcgcgcaatgccggttccgatcacgttttccgcccgcctcgttcaccgcttcgccgacgaaatgaaaccggttcggcctccgaccggatactggccggaccggtggagcatgggctactaccggatgcttctcaccggcgacattctccggcgcaagatcaaagtcggaggcgcacgctaccagctactgtttccttctcacggtagcaaaacgatgtcgctcggcaacgacttcggctggttgcattacacgtggattgatataggaacaccgagcacttcgtttctcgtggcgttggacgcagggagtgatctcctttggattccgtgtgattgcgtacagtgtgctccattgtcatcgagttactattccaatctggatagagatctgaatgagtatagtccgtctcggtccttatccagtaagcatctatcttgcagtcatcagttgtgtgataagggttcgaattgtaaaagttcacagcagcagtgtccatacatggtcagttacttgtcggagaacacgtcgagttctggattgttggttgaggacatactgcatcttcagtcaggcggcagtttatcaaactcatctgttcaggctccagttgttcttgggtgtggtatgaagcaaagtggtggttatttggatggggttgctccagatggcctattaggtttggggcctggggagagttcagttccaagttttcttgctaaatcaggattaatccacgattctttttccttgtgctttaatgaagatgattctggtagaatattttttggggaccagggaccaaccatccaacagtctacttcattcttgcctttggatggattatattcaacctacattattggagtggagtcatgttgtgttgggaattcttgtcttaaaatgacaagttttaaagtgcaggttgatagcgggacatcatttacttttcttcctggtcatgtgtatggagcaatagctgaggagtttgatcaacaagtaaatggttcaagatctagctttgaaggatctccttgggagtattgttatgttcccagttcgcaagagttgccaaaggttcccagcttaactctcacgttccaacagaataacagttttgtggtctatgaccccgtatttgtattctatggcaatgagggagtcattggattttgtttagccatacagccaactgaaggagatatgggaacaatcggacagaacttcatgacaggataccgtttggtatttgataggggaaacaagaagctagcgtggtcacgctcaaattgtcaggatctgagtctaggcaagaggatgcccctttctccaaatgagacttcatcaaacccattgcctacagatgagcaacaaagaacgaacgggcatgcagttgctccagctgttgctggaagagctccccacaaaccttcggctgctccatctcggatgatttcatcgtgccgggtacattggcactgctatttgtttcttctacttctacttgtgtctgccctttactga

SEQ ID NO: 2226 - DNA, 345 bp, Glycine Max
atgcgtgaagtgaagcgtgttgctgatctcacagatgatgagactatagatttatggcgcatagcaaagaaacttggtaggcagctagagagctaccataaggcatcatcacttagctttggtatccaagatggacctcaagcagggcaaacagtgcctcatgttcatatccatatccttccctggaaaagtggtgattatgagaacaatgatgacatttatgatgacatgaatgaaaaagagaaagagttgaatcgagcgcttaaggtggatgtagaaaggaaagacaggagcattgaagaaatggctcttgaggcagatgaatacagaaaatttgtcttctga

SEQ ID NO: 2227 - DNA, 705 bp, Glycine Max
atgcgtgttgcggttgctgcagtggtgcgagcgggcacccgtaactgggcccggtgggcttcgagtggggcgtcgagcccaagcctttcgatatggcggcggaagaaggagatggggaaggaagggctggtggtggccaaagagctgaagaggttccggtcggacccggtccggctagaccgcttcatccggtccagcgtctcccgcttgctcaagtccgacctcgtcgccgtcctggccgagttccagagacagaatcaattcttcctctgcgtcaagttgtatgatatagtccggaaagaaatatggtaccggccagacatgtttttttatagggacatgcttatgatgcttgcacgaaacaaaagggtagaagaagctaaaaaggtttggggtgatttgaaaacagaggaagttttatttgatcagcatacattcggagatattatcagagcttttctagataacgggttgccctcagaggcaatggacatatatgaagaaatgagacagtctcctgaacctcctctttcattgccttttcgcgtgatattaaaagggctcattccctatccagaattacgtgagaaagtaaaagatgacttcttagagattttcccaggtatgatcatctacgaccctccagaggatttgttcgaagataataaacagcacaatgatagagataactatagaattgcttaa

SEQ ID NO: 2228 - DNA, 366 bp, Glycine Max
atgctcctcatatttctcaccacatgctctcacaattgcatatcctattattgtctcatcaaccctttctctcccctttcatttttatttgtgtacaaagtttttgtgtctctagctgctgagtatgaaactcctaagaattccttcaatcagatatctctatggggtggtatccttccctctaaagagcatgccaagttttggattcatacatcaaataagcaccgcttcattgaccagggaagcaatttgcgtggcaaagaatataatctgactttgcattggcatgttatgccaaaaactagcaaaatgtttgcagataaaatagtcatgccaagttaccgattgccagaggaatatagatga

SEQ ID NO: 2229 - DNA, 3087 bp, Glycine Max
atgctgaaaatcgccgcgattctggacgaggcccgaacctcatacgccacgcacaaccgaaagctcaaggaattgtcgctcctccgatccaaatcctcttctcattcgcacttcttctccggcttctccaaaaccataactcctctcttcgacttccagaggcgcctcgcctctgccgaccgtatcgtttccttcgtctccgccttcgccgccaccgctgctgcctccggtgacttcctcgaccacttcctcaagttcctcctggctgccgccgcagcatcaaacaaaaccgccaggttccgagcctgccagatcgtttccgagataatattgcgtcttccagatgatgctgaagtgagcaatgagatatgggatgaggtgatagagtggatgaaggtgagggtgcgagacaagatccctgttgtacgtacttttgcggttagagcgctttcgcgctttgtgaatgactctgtgaatagtgacatccttgatttgttcctcgaggtgcttccattggaacagaatgcggatgttcgtaagatgattgtgttatctttgcctccttctagtgcaacctctcaagttatcattgattgtaccttggatgtgagtgaatctgtacgcaaagcagcatactgtgttctagctaataaatttcctcttcaaagcttaagcattaaactcaggacagtaattcttcggagaggacttgctgaccggtctgttgctgtctcaaaagaatgttttaaactattgaaagatgaatggctcatgaagtgttgtaatggtgatcctatagaacttttgaagtatcttgatgttgaaacctacgaatcagttagtgagtctgtaatggaagcgcttcttaaagctggtttagtagaactacagaatggtgcaagtatccagcagtacatatcatcaaatggtgacagaacagaaggggattcggttcattgcccaccaagcattcagccgatggaagcagaggctgctctttattggagaactgtttgcaagcatttacagtcagaggcacatgccaaaggctctgatgctgcagcaacaatgggtactgaagcagaagtatatgcagcagaagcatcagataaaaatgaccttctagaaaaaattcttcctgcaacagttggtgaatatatagaattggtcagagctcatactaatgctggatcaaaccatcgctttgcatgccggcagctgcttttgcttggtgcaatgtttgatttttctgatgttacaaatagaaagactgctggtgcatttctgcatgagcttatgtgcaagcctcctgagcatgaggatgatgatgaagggaatatagttgttcttggagatggattaagttttggtggagacaatgactgggctgaagctgtagccagtttagcaaggaaagtccatgctgctcctggtgaatttgaagaagttattctagcaataatagaagagctcgcccaaccttgcagggagagaacagcagattatgtgcagtggatgcactgcctctctcttactggtcttttgcttaaaaatgcaaaatcacttcgctttcttcagggcaaggctattggacctgatgagctactccaatcgttactactacctggggcgaaacaatctcacttggatgtgcaaaggattgcaatcagatgccttggcctttttggacttttggaaaggaaaccaagtgcagaacttttgaaacagttgagaatttcatatattaaggggccacattcaatcagtatagaggcatgtaaggcattaattgatcttgtgatgtggtatggtcctcaagaagttgacaagatgttaaacctcagtattccatgccaattaaacagtgagaagacgactttttctcctgtgaatttttctgattcagaaagggaattagatgttgggacgctcgatatcttatatggcggctttgaaaatgatgactgggcgagtcctttacctagcaacgaagatgagtgcgttcatgctatacttggagaggggtttgccaaaattcttctcttaagtaacaactatccaagcataccagcttctttgcatcctgttattttatcaaagctcatttacttgtatttcagtgacgtgtcggaacacttgcacagattgaagcaatgcttatctgttttttttgagctttacccatgtctctcagccaatcataaggcaagcatcacttatatcatattttctagttgcataacgaagagtttcattccagcaatgcgttcaatgtggccaggaattttcggcaattcttcgggttctacttttatggtgtcgcagatgcgtaagcgtgctgttcaagcttcccgatttatgctgcagatggtgcagattcccttatacgctaaagagattcaaccagattgtgaaaatactaacacggaacatccacaagtcatagatagttgtgtggaacttccatttgaatgtggagaggaggggctcgcactacgcttagccgtagaggtgacaagctttcaatcgaagaaaacagcttctgagaaggcatatgtgtcggctttatgtagaatacttgttttgcttcaatttcggatatcagaacaagggccagtaaaatttatgaagagacttttatgtcgcgtgattgaatgtgcatcttcagagaaggatcttgttaaggaattgaaacgcatgtctgaacgtctcatgacagtagatagtcaaccagatcaggaattgatgcaagatgaagttaatcttattttggggaaattggaacttgactgcgacctggatttggatggttctgtgtcaatgccgcaaacaccagctgcacccgcaactaggcccacacgttctaggagaagggtaaggattgaagaagaaagttctgatgaagattcaccttctgtggttcctaccacccaacacactgtacaaagtcgctcacaaagagcaagcaaaacggcagcaatgaaaaagatgtcttctgctactagatcgctcaaaattgatgaaatggaagaactagatgaagaagactctgatgtgacagcagaagattatgatgcatcggattag

SEQ ID NO: 2230 - DNA, 576 bp, Glycine Max
atgctgagtgaaggttccaacaacaataatcactcatctaaaatgtccttcagaataacgaaggacgatggtttcttctctaggctaatggccaaggaagccaccacccccaactcttcttcaaggatcttctattacggagaaacttcggttgctgttcctttcacatgggaggcacaacctggtaccccaaaacaccctttgtcggagacatctttgcctcctcttacacccccaccttcctatttttcaaacaaaaagtcccacaatgccaagagtagaaactactccaaagccagcaacatattttcaagcattttgccaaggcgtgtagggtcaagaaattctcatcctgtgtcaccagcatcgtcatcttggtcactttcttcatcgtcttcgtcttcttcttcgtggtctttggcgcattacaataataattattcatcgccctcgttttccatgagagacaaaggtccagctccttcgaaacacaacaaatgttctaatggatttagaggctgctatccctttggcaacacgaggaacgcaaatgtaaaccatggtactgtggactag

SEQ ID NO: 2231 - DNA, 1920 bp, Glycine Max
atgctgcagcaacttattaagctcctagccttaaatttgatatggtggagcagtattaatgttgaatatgcagttgcagccacacgtgacacacgtgtgataaactctgggtgcagcccaatcaacgctaccaacacggttagcttctttgggaatgtcaatgagacattctcagagctgagaggagaaattaggaaccaaagcaagcactttggcacatcattgaactccagaggagctgtcaatgcatatactatgtttcaatgcagaaactatgtctccagaaatgactgtcttgcttgcttcaacactgcctccgcccaaatccgggatatatgcaaaatagccaacggtgccagagtcatctacaatgactgcttcctcaggtatgagagtgagagattctaccaacagaccaacgaaattggtggaggggtaacatgtgggaacatcagttcaaatgccactaatttaaaagtagttggacaacaagcattaatggaccttcaaacagcaacacctaaaattaaaggtttctatgcagctactaagacacaggtggagggtggtagtgcaatttatgccattgcacagtgtgttgaaactgcctccccacagaaatgtctggattgcatgcaagttggatacaacaacttacaaagttgccttccaagcacagatggtacagcatatgatgctggctgttttatgagatactccaccaaacctttctttgctgataatcagaccattgatatcaaaccctatttaaaagaaggaggttcaagcaagaagtgggctattattggtggtgtcgtaggaggtgttgttctcctccttgtgttgtttgcttggagattgtttattaaacaaaagagggttcccaaagctgacatattgggagcaactgagttgagaggtccagttaactacaagtatacagatttgaaagctgcaacaaaaaatttcagtgctgacaataaacttggagaaggaggttttggcgctgtatacaagggtactctgaaaaatggaaaagttgttgccgtcaagaaactagtgttggggaaatcaagcaagatggaggatgattttgaaggtgaagtgaagcttataagtaatgttcatcatcgaaatctcgttagacttcttggttgttgcagcaaaggccaagagagaattctagtttatgaatacatggcaaatagcagccttgacaaattcttatttggtgacaaaaagggttccctcaattggaaacaacgctatgatataattttgggaacagcaaggggactagcatatctacatgaggagttccatgtgtccatcattcatagagatataaagactggtaatatcctcctagatgatgatctccagcccaaaattgctgattttgggttggcaaggcttttgccaagggatcgttctcatcttagcacaaaatttgccggaacattgggatacacagcacctgagtatgcaatgcaaggtcaattatcagagaaggctgatacctacagttatggtattgtagttctagaaatcataagtggtcaaaagagtaccaatgtgaagattgatgacgagggtcgtgagtaccttcttcaacgggcatggaaactgtatgagaaaggcatgcagttggagcttgtggacaaggacatagaccctgatgaatatgatgcagaagaagtgaagaaaatcattgaaattgctttattatgcactcaagcatcagctgcaacaaggccaacaatgtctgaattagtagtgctactcaaaagcaagagcttagtggagcaactgcgaccaactatgcctgtgtttgttgaaacaaataagatgaatggggaaggcatctctgatgatccatctaatgctactatctccatttctgttctatcggcccgatga

SEQ ID NO: 2232 - DNA, 1584 bp, Glycine Max
atgctggcgagttcaagggagatagtgatcggacctggatccgtggattcactgctactttcctcaatgattcaaacattgaaagttcctattcatgattctagtacttacatccaacttgttttcactgtgactttttttgcgggcatttttcaagttgctttcgggctctttaggtttggttttctggtggaatatctttcacaagccacgatcgtggggttcttggcagcagctgccgtgggcattggactacaacaactgaaaggattatttgggatcgataattttaacaataaaactgatttgttttccgtggtgaaatctctttggacatcgttcaaaaaccaatcagcatggcatccctacaatttaattattggattctcatttctctgtttcatcctatttaccagattcctggggaaaaggaacaagaaactgatgtggttgtcacacgttgctcctctcctttctgttattggatcatctgctattgcatacaaaataaactttaatgagcttcaagtgaaggactacaaagttgcagtcttgggaccaattaaaggaggcagcttgaatccaagttcactccatcagttaacatttgatagccaagttgtgggtcatttgatcagaatagggttgacgattgctattatttcactcacgggatccattgctgttggccgatcatttgcatctctaaaaggacacagtattgatcccaatagagaagtggtatcattgggcataatgaacattgttggatccttaacttcttgctatattgcatcagggtctttgtcacgtactgctgtgaactataatgctggatctgaaaccatggtctccatcatagtgatggcacttacggtgctcatgtcacttaaatttttgacggggcttttatatttcactccgaaagcaatccttgcagcaataattctctcggccgtaccaggactgattgaccttaacaaagcacgtgaaatttggaaggttgataaaatggatttccttgcttgcactggagcctttttgggagtcttgtttgcatctgtggaaataggccttgcaattgggatcgcgatatcatttgcgaagataattataacctctattcaacctgctatagcggttattggaaggcttccaggaacggctgcattcggcgatgttgaacaatatccaatggctgtcaacattcctggggttttgatagtctctttaaaatcttcttggctttgttttgcaaatgcaaatcttgtagaggaaaggattgagagatgggtgaacaatgcaaaagctaaggatggcaaaggaggagaaaacaccttcatacacgtcattattgatgcctcaagtcttacaaatattgacactgtgggaattgcttctctggtggagctcaacaaaaatttgatttccagtggagtaaagttagctatcgctaaccctaggtggcatgtaattcacaagctaagattagctaacttcgtgagcaaaattggaggaagggttttcctttctgtaggagaagcagtagatgcatgtgttggcactaaaatggttgctgtataa

SEQ ID NO: 2233 - DNA, 705 bp, Glycine Max
atgctgggtgtgaccactcttactctgggttcgtccaccacattggtggctcagaaccatgctcaacaacatgccaccactcttgcctcagccaatggaaacagaagggacagtgtttccaacaggactcaccccttgcctatgagtttggtatcttccaccgaccaaagtttcagctttctctcttccttcaaggaaccaacacatgcacgccccttcaccacagctgttgcatctgttgattctgacaagctcaattcatctgatcctcccaccaagaatgaagcctccaagtattattttcttgttgcaaatgcaaagtttatgttggatgaggaggagcatttccaagagcaattgtttgagcggcttcgtctctttggagagcgtaatcaagaacaggatttctggcttgtcattgagcctaagttcttggataagttccctaacattaccaagagattaaagagacctgctgttgctcttgtgtcaaccaatggtccctggatcagattcatgaagttgagactggaccgagttttatctgacagttttgaagctgagagcctagaagaagcattagctttcaatcctactgatctgaagtttgagaagcctgaaaaatgggtggcaccctatcctaaatatgaatttggatggtggaaacccttcttgccccctgttcagacagaggtgcagccttaa

SEQ ID NO: 2234 - DNA, 2574 bp, Glycine Max; identical to SEQ ID NO: 63

SEQ ID NO: 2235 - DNA, 2037 bp, Glycine Max
atgcttctaaacctctcccatgcttcctttcagcaggaaagtatgacagcccacaaagtttactccaaatttaactgtcaatatcttattcctttcagcaaacaactctccatgaagttccattctacttcagtggcatcttttctttttgtcatagttattctctttcctctggctattgctgatctaagttctgataagcaagcccttcttgattttgctaatgccgtcccgcatcgtcgaaacctgatgtggaatccatcaacctcagtctgtacatcttgggtaggcatcacttgcaatgaaaatagaactcgtgttgttaaagtccggctccctggagttggactagttggcaccatcccatccaatacacttggcaagcttggtgctgtgaaaattattagccttcgctccaacctactcagtggaaatcttcctgctgacattggttctcttccttctcttcagtatctctacctccaacataataacctttctggtgatatacctgcctcattgtctctccaactcgttgtactcgatttgtcatataattccttcaccggtgttattccgacgacatttcaaaatttgtcggaattaactagtttgaatctccagaacaactcgctatccggacagatacctaatctcaatgtcaatctgctcaagcttttgaatttaagctacaaccaattgaatggctcaattcctaaagctcttcagatttttccaaattcttcctttgaaggaaactctctcttatgtggaccacctctaaagccatgctctgtggttccccctacaccttctccttcctcgactccacctcaatcaactcctggaagacaaagctcaaaaaacaagttgagtaaaatagctatcattgctattgctgttggaggagctgtggtgctattctttgttgctcttgttttctttatttgctgtttaaagaaggaagatgacagaggctccaatgtaattaaagggaagggtcctagtggtggtaggggtgagaaaccaaaagaagagtttggaagtggggttcaagaacctgagaagaacaagttggttttctttgagggaagttcttataattttgatcttgaggatttgctgcgagcttcggctgaagttctggggaagggtagttatggtactgcatataaggccatactggaggagtcaatgacagttgtggtgaaaagattgaaagaagttgttgtaggcaagaaggactttgaacagcagatggagattatgggaagagttggacagcacacaaatgttgtgccgcttcgtgcttattattattcaaaagatgaaaaacttttggtatatgactatgtccctggtggcaacctacacacactcttgcacggtggtaggacaggtggaagaactccattagactgggactctcgaataaaaatatcccttggaacagccaaaggacttgcccacgttcattctgttggtggtcccaaatttacacatggaaatattaagtcctcaaatgtcctcctcaaccaagataatgatggctgcatttctgattttggccttgctccccttatgaatgttcctgctaccccttctagaactgcaggttatcgtgctcctgaggtgattgaagcccgtaaacactctcataaatccgatgtgtatagctttggtgtcctccttcttgagatgcttaccgggaaggctcctctccaatctccgggacgtgatgatatggttgatctccctaggtgggttcagtctgttgttagggaagagtggacggccgaagtttttgatgtggagctaatgaggtaccaaaacattgaagaagaaatggttcaaatgttgcaaattgccatggcctgtgtggcaaagatgccagatatgagacctagcatggatgaagtagttgcttttcttaaattcttatgtattaacatcctgattcaattaatgatctcgattcaagcacatttggtcccttgtaatgttgagagaaaaaaatcaacctctcttcagtcttaa

SEQ ID NO: 2236 - DNA, 606 bp, Glycine Max; identical to SEQ ID NO: 64

SEQ ID NO: 2237 - DNA, 747 bp, Glycine Max; identical to SEQ ID NO: 65

SEQ ID NO: 2238 - DNA, 444 bp, Glycine Max
atgcttcttgctcaatgttatggatttgtgtttccatgtcgttctgcatccgaggatatggaccagagcctacaattgcagatcttccgtttccagttccagtggcatgatcagggcgttgaaatctatttcgacattgatgggaaggaggaagatcatcatctgttcctgtggttatttcagattatggaaattaattgcaagcaaccttttgaaacgttcactcatataatttccacatctgaaatgttcactcatcattctatgagatttatctttatcaaagaaaatttaggacagtcggacagatcactatcatggtctgtacttaacattgtgcacaacaattatgcctgtgtgatagatatcttgtgttctataacgatgataataattagaaaggagcgacatagatattttgtacgaaaaaaattgctgccttga

SEQ ID NO: 2239 - DNA, 1164 bp, Glycine Max
atgctttgcgtcaacactgccttcacctctttcttgcccagaaaatcaatttgcttcttttcctccaaatcaaccaccccaatttcctgcaccctccaaggaacagttgcagaaccaaaatctacagctgctggtgaacctcttttgctaaatgcagttcgtgggatagatgttgaaagacccccggtttggctcatgaggcaagcagggaggtacatgaagagttaccaaaccatctgtgagaaatatccttcattccgtgaaagatctgaaaatgttgatctcgtggtggaaatttctctgcaaccatggcatgtttttaagcccgatggagtgattttattctcagacattcttaccccactttctggaatgaatataccctttgatattgtgaagggtaagggtcctgttatatttgatcctattcacacagctgcccaggttgatcaagtgagggagtttattcctgaagaatcagttccatatgttggtgaagcactgacaattttgaggaaagaggtggataataaagctgcagtccttggttttgttggggcaccattcaccctggcatcatatgtggttgaaggtggttcatcaaaaaacttctcaaaaataaagagattggctttctctgaatccaagatcctgcactcattactgcagaagtttacaacatcaatggccagatacattcaataccaagctgacaatggagctcaagctgttcagatctttgattcatgggcaacagaacttagtccagtggattttgaagaattcagtttgccttacttgaagcagattattgatactgtgaagaaaagtcatccaaacctccctttgatcctctatgcaagtgggtctgggggtttgcttgaaagactagctttgacaggcgtggatgtagttagcttggattggacggttgatatggctgatggtaggaggcgactgggaccgaatatagctgtccaggggaacgtggaccctggcgttctttttggttcaaaagagttcatcactgatcggataaatgatactgtgagaaaagcaggtagagggaaacatatcttgaatcttggacatggcattaaagtaggtacgcctgaggagaatgttgcacatttttttgaggttgctaaatcaatcagatactaa

SEQ ID NO: 2240 - DNA, 1593 bp, Glycine Max; identical to SEQ ID NO: 66

SEQ ID NO: 2241 - DNA, 1164 bp, Glycine Max; identical to SEQ ID NO: 67

SEQ ID NO: 2242 - DNA, 1815 bp, Glycine Max; identical to SEQ ID NO: 68

SEQ ID NO: 2243 - DNA, 1113 bp, Glycine Max
atggaaacggaaaattaccatactgttggcacaacctcactagatattagtgttggtattgtttgccactatcagtttgaaaatgggtcatctcagtttgctttcatggatgttgaaagtgaaagaggagcttcccttgaccattccctcagcttctctacagaaaactttgtgcagacccttgctttttgcaacggcttgattctcttgtctggctttagtggtgaccaatcctgttaccatgtgttcaaccccctcaccaagcacaatgtcatgatccctcaaactagtacccaagggggtgttgttagagttggattggcctatgatggagaccaatttgaggttgttcttgttgaagcagggtcttcaaattccaatggactaaaactgcatgttttctcttctgacactggccaatggaggtgccactaccccaccaatataacttctgccccatctttgcaagaacttgagttccaagaacttggcacacctcctctttatgcgaacagcgcgattcattgggaaatatgtggatatttgttggtctatcaagttcaaggcagccattgtgcactatatgagctacccaactactttgatgattggtcttggcaatcaactttgagttatcgccgtagcttgtgcgaatcaggaggagaggtctactactgctacactgatttcgacggctttcacatttggaaactcctcaatgaggaagagcatcccggattcttcaattattgtgattacaaaaggtttccatggaaactagtccatagtgtcatgcatcaagtgcttatgcctaagcaccaaaacttttttggcagctcctttgtttgggagccttacaaggttgcacccattgcctatagtgaacaagcccagatcatatatttgcagcttccaggaattgttgttgcttacaactttgatacaggaactatgggatcagtctgcacctactcttatccaggcataaacttcaattgctgctcattcttttcttcaactgcttctgggcctcaccatgcacaaagagacagcacaaatggacaatcggagctgaatctacccatagcagagatggaaaagttaaccctctaa

SEQ ID NO: 2244 - DNA, 6405 bp, Glycine Max
atggaaagaaatggtgatgggaaggctcaagattcagagcctctacctcctcattcagttctgaagatgggattgagagaacgtagcaacagcagcagcatggaggatccagatgggacattagcaagtgttgcccaatgcattgagcagctgcgtcagagctcatcttctatgcaagagaaagagtattctttgaagcagttattggagcttatagatatgagagaaaatgctttcagtgctgttggatctcattctcaggcagttccagtacttgtttcccttctccggtcagggtcattgaatgtgaaaatacaggcagcaactgtcttgggctcactttgtaaagaaaatgagctgagggtgaaagtcttgcttggaggttgcattcctcctttgcttggtctactaaagtccagttctgctgaaggtcaagtagctgctgcaaagactatttttgctgtctctcaaggtggtgccaaagatcatgttggatcaaaaattttttcaactgaaggagttgttccagtgctatgggagcagctgcaaaagggcctgaagactggaaatgtagttgataatttattgactggggcattgaaaaatctctccagcagcactgagagattctggaatgccacaatacaagctggaggagtggacatattaattaagttactgacaactgggcagtctagcactttagccaatgtgtgctttttacttgcttgtatgatgatggaggatgcatctgtttgttcaaagttgttgacagcagagacaacaaaacaactcctcaaacttttaggccctggtaatgatgcccctgtcagggctgaggcagctggtgctcttaaatctctatctgcccagtgcaaagatgcaaggaaagagatagccaattccaatggcattcctgctttgattaatgctaccatagctccttccaaagagttcatgcagggtgagtatgctcaagcgttacaggaaaatgctatgtgtgctttagcaaacatctctggtgggttgtcgtatgtcatctccagtcttggtcaaagccttgaatcatgctcctctcctactcaagctgctgacacattgggggctttagcttcagctcttatgatatatgatgacaaggcagaatctacctgggcatcagatcctttggtagttgagcagacattacttgaacaatttaaacctcacttgccattccttgtgcaggaacggaccattgaagccctagctagtttgtatagcaatcctatattgtcaattaaacttacaaactctgatgcaaagcgtttgcttgttggtttaataacaatggctgccaatgaagtgcaagaggagcttctaaagtctctcttgacattgtgcaatactgaatgcagtctatggcgtgcacttcaaggccgtgaaggagttcagctgttgatatctcttctggggctttcatcagaacagcagcaagaatgtgctgttgccctcctttgccttttatctaatgaaaatgatgaaagtaaatgggccattactgctgctggtggtatacctcctcttgttcaaattttggagtcaggatctgcaaaagcaaaggaagactcagcaacaatccttaggaacctatgcgatcacagtgaggatatacgtgcttgtgttgaaagtgctgaagtcgttcctgcattgctgtggctgttgaagaatggaagcccaaatgggaaggagattgcagcaaagactttgaatcacttaattcataaatctgatacagcaactatcagtcagcttacagcattattgactagtgatttacctgaatctaaggtttatgttttagatgctttgagaagtatgctttcagttgttgctcttactgatcttctacgtgaaggtagtgctgctagtgatgcaattgttacaatgataaaactattgagctcaaccaaggaagaaactcaggcaaagtctgcatctgctctggcgggaatttttgaaacgaggaaagatgtgcgtgaaagcagcattgctgttaaaactctttggtcagcaatgaagttgcttaatgttgaatctgaaagtatcttaatggagtcctcgcgctgcttggctgctatatttctttccatcaaagagaacaaggatatggctgctattgctagagatgcattaccctccctagctgcactagctaactcttcagttttagaagtggcagagctggcaacatgtgctgtggcaaatcttattttggatagtgaaattgctgagaaagctgttgcagaagaagtcatcttggctgctaccagagtattacgtgaaggcacaatttctggaaaaacacatgctgctgcagcaattgctcgcctcttacattctaagaggcaagttgattattctgtaactgattgtgtgaatcgagctggcactgttcttgcattagtttctttcttagactttgctattgatgaacatagttccacatcagaagctcttgaagcacttgccatgctttccaggtcagatttgaccagtgcacacagtaaacctgcttgggcagttttagctgaatttcctaaaagcataatcccaatagttttgtctattgctgattcaacgccagtgttgcaggataaagctattgaaatattatctcgattatgtaaggatcagccttttgttctgggagacactgttgttactgcctctggatgtatatcttctatagctaaaaggataatcaattccacttctaaaaatgtaaaggtcaaaattggaggagctgctgttcttatttgtgctgctaaagtaaatcatcagaagctggtggaggacctcaatttatcaaacttgtgtgctaatcttgttcagtctctggtcgatatgcttattttttcacaggctacattggataatcagggtgatgacagcagggaagttatcagcatttgcaggcatacaaaagaagccaatgattgtaaatcaagcactggcaccgctcttatttccagtgccaacttagctatatggttactgtctgttcttgcttgccatgatgaaaaaagtaaaattgcaataatggaggctggagcaattgaggttctcactgacaggattgcagattgtttctcacaatatagtcagattgattataaagaagatagcagtatgtggatttgtgctttgttgttggcagtattatttcaagatagggatatcatacgagcgcatgcaaccatgaaatctataccagcccttgccaacttattgaagtcagaggaatcagcgaacagatattttgctgcacaatcaatagctagcctagtctgtaatggtagcaggggaacacttctgtctgtggcaaattctggggcagcaggtggacttatctccttgcttggctgtgctgattctgatatacaggatcttctggaattgtcagatgaattttctttggtgcattatcctgatcaagttgctcttgagaggttgtttagagttgatgacataagagttggtgccacttctcggaaggcaatacctgctctagttgatctgctcaaaccaattccagaacgcccaggagcaccatttttagcacttgggcttttgactcagctttctatagattgtccatcgaataagattttaatggttgaggcaggggccctagaggcactttccaagtatctttcactaggtccgcaagatgcaacggaagaagctgctacagatttgttaggaattctgtttagcagtgcagaaattcggagacatgagtcagcatttggagctgttactcaacttgtagctgtcttgcgtttaggaggaagagctgcaaggtatagggctgcaaaagctttggaaagtttattctctgctgaccatattagaaatgcagagactgctcgacaagctgttcaacccttggtggagattcttaatactggtttagagagagagcagcatgctgcaattgctgcattggttaggttactgagtgaaaacccttcaaaagcacttgctgttgcagatgttgagatgaatgcagtggatgttctttgcaggattctctcatcagattgctcaatggacctcaaaggggatgctgctgaattatgttctgttctttttggaaatacaaggattcggtctacaatggctgctgcacattgtgttgaacctctggtctctctccttgtaagtgagtttagtcctgctcaccattcagttgtccgtgcattggataggcttgttgatgatgagcaactggctgaattagttgctgcacatggtgcagttattcctcttgttggcctactttatggtaggaatcatgtacttcatgaggccatttccagagctctggtcaagttaggaaaagacaggccagcttgtaaaatggaaatggtgaaagctggagttattgaaagcatacttgacatccttcatgaagcacctgattatctatgtgcagcttttgcagaattgttgcgtatattgaccaataatgctagcatagctaaaggaccatcggctgctaaagtagttgaacccctgtttatgttgctgacaagagaagaatttgggccagatggacaacatagtgcattgcaggttttagttaatatcttagaacatccgcagtgtcgtgctgattacacattgacttgtcaccaagttattgaacctcttatccctttgcttgattctccaatatcagcagtgcaacagttggctgctgagcttctctcgcatctacttttagaagaacaccttcagaaagatccggtgacgcaacaggtaattggccctcttatacgagttcttggttctggtatacatatattgcagcaaagagctgtaaaggccctggtcagtattgcattgatatggccaaatgaaattgcaaaagaaggtggtgttattgaaatttcaaaagttatattgcaatctgatccttccattcctcatgctttatgggagtctgctgcctctgttttggctagtattctacaatttagttctgaatactacttggaagttccagttgctgttttggttaggctgcttcggtctggcttagaaagcacagttgttggtgcattaaatgctcttcttgtgttggaaagtgatgacggaactagcgctgaagcaatggctgaaagtggtgctatagaggctctattggagctcctaagatctcatcagtgcgaggaaactgctgcaagactcttagaagttttgcttaacaatgtaaagatcagagaaacaaaagttaccaagtcagccatcttaccattatcccattatctcttggacccacaaacccaagcacaacaagcaaggctattagcaactttggctcttggtgatctatttcagaatgagggtcttgctcggacaagtgatgcagtttcagcttgtcgtgctttagtgaatgtgcttgaagaccaaccaactgaagaaatgaaagttgtagccatatgtgctctgcaaaaccttgtgatgtacagtcgatcaaataaaagagcagttgcagaggcgggtggggttcaggttatactggatctgataggttcaagtgatcctgaaacatctgttcaggctgcaatgtttattaaacttctattttcaaatcataccattcaagagtatgcttctagtgaaacagtcagagcaataactgctgctattgaaaaggacttatgggctactggatctgtgaatgatgagtatcttaaagccttaaattctctatttagcaacttcccaagactgagagcaactgaaccagcaacacttagcattccccatttggttacgtccttaaagacaggctctgaggctactcaggaagctgccttgaatgcacttttcctgcttaggcaagcttggtcagcatgtccagcagaagtttcaagagctcagtcaatagcagctgcagatgctatacctttgctgcagtacttaatccagtctggcccacctcgctttcaggagaaggcagaatttttattgcagtgtttgccaggaacattggtggtgatcatcaagcgcggtaacaacatgaagcaatctgttggaaacccaagtgttttttgcaagcttacactcggaaacactcctccaaggcaaaccaaggtggtctcaactggccctaatccggagtgggatgagagctttacatggtcctttgagagtcctccaaaaggccaaaagcttcacatttcttgcaaaaacaagagcaaaatgggaaagagttcatttgggaaagtgacaatccagattgatcgggtagtaatgctaggtgcagtatctggagagtacactctgttgccggaaagtaaaagtggaccctcgaggaatttagaaatagaatttcagtggtctaacaagtga

SEQ ID NO: 2245 - DNA, 894 bp, Glycine Max
atggaaataagtattgcaaggtctcatctcgaaacacagggaatattcttttcaaatatttcaagaacaataggatgggaaagcattaggaaacttccatgtaatgtggctgcccagggttcaagacgggattttcacagattggcctcttcctgtcaagcttttactgcagtgtatcctagaaggtcttttatctgtagagcaaattctatgccaattagtttacaggaatctgcatcatatggagataattctattgaggatgaggatccatatacagacttggaagaggaagctttggcaaaaccacctaccagtgaacagataatgacattgcttgctgacacacagagagcaaaactcactaagaagcttagtgaggccaaccagcaaaaccggttcctaaaaagacagttgaatgtaaaggaggatgcattggtaaaattcaaaagtgaacttgctgtcatggaacttgaaattcaggctttggtcagattagcagaagaaatagctcaatgtggtattccagaaggttcaaggaagatcaatggaaagtacattcattctcaccttgttgctagattagaagctgtaaatgaactactgaaggaacaaataaaagatgtcgatgcggcacaatcgaaggaggtttctgtattttgggttggcatggctgagagcgtgcaagttatgggcacctttgatggctggagccaaggggagcacctttcacctgagtatactggttcttacacaaggttttccactacattgttgcttaggccaggaaggtatgaaatcaaattcttagttgatggtgaatggaagctgtcaccagagtttcccattattggtgaagggttaaccaaaaataatttgttagttgtcgagtaa

SEQ ID NO: 2246 - DNA, 1535 bp, Glycine Max
atggaacgcaacgtgaggcaaatgcagaagttgatggaagaggatggagactcatttgcacaaaaagctgagatgtattacaagaagaggccagagttgatttctcttgttgaagagttctaccgtgcctacaaatcaatggctgaacgttttgatcacatcaacacaccgtgtgatcttcaatcacaggcttcaggtgtttcagattatggttctgagccaaactcttacgtgccttctccttctcctaggaagatggggcgtcgtatatcaacaaatcgcgccgcggggtttgatgtttttcttggttctggtgggaatgtgaatacttttgatgcatgtcaaaaggatggagatggttcttctacattgacagagactgatgaggattatgatgatgcttcatccatgaacagtttttcaggcttctttgggaatggaaatgatcataatagtatccacagaagggtgatggaattggatattgagataccacatgaggggaaagaaaagcatgaggaggaacgtgtgaagaatgatgaattgaaaattgagaacaacgccgaagattttcgtgtcaagattaatgcatatgaacaagagctaaggattgtgaatgagaagttgagggtatcagaagaggagattggtaagctgaagattgagcttgaaaaatataggtcaatggaatcaaaaaatttgaagggtggtgttggattatcttcaattgtagaagggatcaaggtgggaggggaaaccttggagttgaagaaacttcgggaggagctaagggtgactaaagaaaaacttgagtcttcagaaatgcaaattgtttcgttgaaattcggggctactaaaacatttgagactattcagcaattgcaggaacagcttgacttggctcagaaggacattgcaagttggaaaacaaagttcaactctcagaaaagagagaactctaaactccaagaaaggcatgcaaggatgaagactaatgtagccgaccgggatcacgaggttagagatttaaaagctgctctatctgatgtagaacggaaaatcttctttgagagagcaaatatgaagtccgaaatgtccaagttgttgggggaacaaactcatttggaggagaagttcaaggaatgggaatgccaatgccaatctttggaagaggaaataagaaaaatctactttgaaaaaatagagatgggagagacactcaaaggtgaaattgagctgttaaaggaagagattgaatcaaaaaagaaaaacatagaagatgtcaatgtaaaccttgatgtcatgaagttagatagagataatctcaaagaagaagttggttcactcaaggaagttataaactcaagagatgatgagattgaagaggcacataaacaagtggaggaactaacatcaagagctaagaaacaagaggaagagattgagaggcaaagggttgagatcttagaaggagctgaagagaaacgtgaggccataagacaactatgcttctcacttgagcattacagaaatgg

SEQ ID NO: 2247 - DNA, 1017 bp, Glycine Max; identical to SEQ ID NO: 69

SEQ ID NO: 2248 - DNA, 1191 bp, Glycine Max
atggaagaaagtcctggtggtcgcagaaagcgagcacacccttcttcttcatctccttcaccaatctccaagaagccccaaaccttcccttcgttccaagacatccccaacctcccttccaacatcaaatccctctgccatctcatcgccaccacctccgccgcctccgtcgagcactccctccaatccgccgccatctccgtcaccccccacgacgtcgaagaagtcctcaaactctcctacggcttccccggccaggccgtcaaattcttccgctggagcggccgccacctaaacgacaaccacacgccctactcctggaacctcgtcgttgacatcctcggcaaaaaccgcttctttgacgcgatgtgggacgctattaagtcaatgaacaaagaagggttgctctcactcgccacattcgcctctgtcttcagcagctatgttgcagctgatagaatccgggaagcaattatggcattcgagattatggacaattattgtgttgtgagggatgttgttgctttgaattcgctgttgagtgctatttgtagcaatggtaggactcttgatgcttgtgattacttgcaggttgccaagaaattggtccggccggataccgatacttatgcgattttaatggaggggtgggaaggggagaatggtgtagttggtgctaaggagacatttgctgagatggctattaagtttgttgattcgatgagggataggaggtgttttcctggtgtgaggactgctgagtttttctgggaggtgttggtggttgggaaggtggtgcagcccaccgctgagatgtacaatttgatgattggtttgtgctgctatcgtggtgacaccgatgctgcgaggaggatgcttgatgagatggtttaccaaggggcttttcctgatgtggagacttataacttgttgtttaagttcttgatcaaggggaggaagttgcgggaggcttccgtggtgtttgcagagatggtgaagaatgagtgtgtgcccgagcaggataactgtgatgcggcggttaaggcgtatgtggactgtggggagcctgttatggccatcaaggtttggaaggaaatcaggttgtcctctaacacaatgtcaaagctgagacaaagccttatcaaggagagaagagaatttgttttgaaatttttcgctaaaactgtctag

SEQ ID NO: 2249 - DNA, 1218 bp, Glycine Max
atggaagaattacggaaactcgagaaagtacagagcatgcttgaattcatggaatcacattcacggggcgtttcaaactccgatcaacactctaaccgcttcctcgctaatttcattcttttcttgatcgaaccctgcggagacctttccatcaaccacaagtgctccttgctctcccactttattcccactctctcatctgcattcctcgaagacgcgtatcaacaccaccttttcaccacctctaaacaacaaaattctggtggttttcaacaaagtcttgttggaaattctttgcttagttgcaatcagatgaaagaatacagtttgttgcaaagatgtaatgaaaacgctgccatggtcgggctggattccatgcaaatggcaaattctacacttgaggatttttgcagatcttattttatgtttcacggattggatgtaagcaagccacaatcaatcttcaaatacttacctattctttcattcacagagagttatatttatcagctagataaaatgaatgagaaattgctgcaaacaccatgcaatggaaattgtgtatttggagaaaaagatgagagagaaactaaagtattggtttcttgcttctcaaatgagccagttagaccacttgtttctattcttgaacacaaaggccttttgacagaaaggataagagaagaacttagacttggagaagagtactgggctcttgaaagaaagctctgttctgcactaacaaacaaagaggagattcttgttgaagatgtgatgaaggctattcatttaaagtcttttgattatcgagtgctgaatcttcttctctatcaacttcaagggactaaggtggaggagttgcatatggaatttctctcaatttcggagttcctagtggaagtttctgatgatctgtatgattatgaggatgatgttttagagaacaatttcaatattttgcgcatgtttatccgaatatatggaccttcagctgcccctgctatgctggcgaagtgcattggtgaggctgaagacaagtatgcaagtttactgaaatcacttgatccacatctctctctgagctaccagaaaagatgtgcagaagccactaaagaaggtggaaaggtatcagagcaccctcttggaacatggagtattccaaccgtgattcaagatgaggaattgtatagattaaagttgaagtcagatatttcgtga

SEQ ID NO: 2250 - DNA, 1710 bp, Glycine Max
atggaagccaaagcagattacacccaagatggcactgttgatttccgtggccagcctgcagtttcatctaaaactggcaaatggaaggcttgcgcttttcttgttggctatgaagcatttgaaaggatggccttctatggagtggcttcgaacttagtgaattaccttacaacccaacttcatgaagatactgtttcatcagtgaggaatgtgaataactggtcaggatctgtgtggataacgccaattcttggggcttacgtagcagattcttatttgggtcgattctggactttcactctctcatctctcgtttatgtcttggggatgactcttctcacagtagccgtgtcactcaagagcctgaggccaacatgcaccaatggcatatgcaacaaggcttcaacctcacaaattgcatttttttacacagccctttacactatggcaattggggctgggggaacaaagcctaacatctcaacttttggtgctgaccaatttgatgacttcaatcccaatgagaaagagctaaaggcctcattcttcaactggtggatgtttacctcattcttgggtgctttgattgccactttaggattggtgtacattcaagagaatttggggtggggacttgggtatgggatccccaccgctggtcttctattgtctttggtcattttctatataggcacaccaatatatcgccacaaagtaagcacaaccaaaactcctgctagggacataattcgtgtgccaattgcagccttcaggaatagaaaactccaactcccaattaacccctcggatctttatgagcacaacctccaacattatgttaatagtgggaaacgccaagtctatcacactccaactctgaggtttttggacaaggctgctattaaagaagtcagtgctggctccacaagagtaccattgacagtatcccaagtggaaggagcaaagcttatctttggcatggcccttgtatggctagtgacactgattccaagcaccatttgggcacaaatcaacactctttttgtgaaacaaggcaccactttggacagaaaccttggccctcattttaaaattccatcagcctctcttggaagctttgtgacactctccatgcttctctcggtgccaatgtatgaccggtttttcgtgccgttcatgcgccagaaaaccggccaccctagaggaatcacattgcttcaaaggcttgggattggattttcaatccagatcatagccattgcaattgcctatgtagtagaagttagaagaatgcatgtcataggagcaaaccatgtagctagtcctaaagatattgtccctatgagtatattttggctgttgcctcagtatgtactaataggaatagcagatgtgttcaatgccattggattgctagaattcttctatgatcaatcccctgaagacatgcaaagtcttggaactacattcttcactagtgggatcggtgttgggaacttcttgaacagctttttggtgacaatggttgataaaataacaggaaggggtgacaaaaagagctggataggggacaacttgaatgattgtcacttggactactattatgggtttttgttggtcatgtcaagtgtcaatatggtggtttttctttgggtttcaagtagatacatttataagagggaatcaataagggtcaaggagggtctttgt

SEQ ID NO: 2251 - DNA, 1293 bp, Glycine Max; identical to SEQ ID NO: 70

SEQ ID NO: 2252 - DNA, 876 bp, Glycine Max; identical to SEQ ID NO: 71

SEQ ID NO: 2253 - DNA, 870 bp, Glycine Max; identical to SEQ ID NO: 72

SEQ ID NO: 2254 - DNA, 1848 bp, Glycine Max
atggacaaccttcaaaaatgccaagcaaactacacagcactcacacctttaacgtttttgatgagggctgctgcatgctatgcaaacagaacctcagtgatacatgaaggaacccgtttcacttgggcacagacttatgagcgttgtcgccgcctcgccttctccctccgtgcccttaacattgctaggaatgatgtggtatcagtgctggcccctaacatcccagcaatgtatgagatgcatttcgcagtgcctatggcaggtgctgtgctgaacaccatcaacacccgtcttgatgccaagaacattgccaccattctgcgccactccgaagccaaagtcttctttgtggactacgagtacgtgtccaaggccaaagaagccctcagattgctcatggacgacaacaacaacaacaacctcaaaaagggtgttccaaaaccaacaaatcaaccacactcaacgacattttctcttccactagtcattgtcatagatgacataaacacccccactagaatccgtcttggtgagctagaatacgagcaaatggttcatcatggtaacccaaattacttccctgaaggaatccaagacgagtggaccccaattgcgctgaattacacatcaggaacaacctcggagccaaagggtgttgtttatagccacagaggagcatatcttagcaccctaagcctaatcttggggtgggaaatgggtagtgaacctgtttatctctggacactacctatgttccattgcaatgggtggaccttcacgtggggcgtggctgcacgtggtggaacaaacgtgtgccttcgcaccacagctgcacgtgacatatacaggaacatagtagtccacaatgtgacacacatgtgctgtgcccccattgtgttcaacataatcttggaggcaaaacaaagtgaaaggattgacataaaggtaataaatgggaagagaaaatcaccggttgagattctcactgggggagcaccaccaccagcatcattgctagagcaaattgagtcacttgggtttcatgtcacacatgcatatgggctaactgaggcaacaggcccagcacttgtgtgtgagtggaagaaggagtggaacatgttgccaaagaaggagcaggcccaacttaaggcccgtcaaggggtgagtgtgttgactatggctgatgttgatgtgaagaaccttgagacaatggagagtgtggctagggatgggaggacaatgggggagattgtgctgaagggaagtgggatcatgatggggtatttcaaagatcataaggcatcttcaaaggcttttgggaagaatggcgattggttcaaaactggggatgttggtgtgatacaccctgatgggtatttggagattaaggataggtctaaagatgtgatcatttcaggaggggagaatattagtagtgtggaagttgagtcacttttgtataagcaccctagggtgttggaggctgctgtggtggcaatgccacaccctaggtggggtgaaactccttgtgcttttgtgtccttgaggaagaacaacaacaactcatcatcatccaaaattgatgatgtcactgaggctgagataattgcctattgcaggaagaatttgccacactttatggtgcctaaggtggtgaagttcatggaggagctgccaaagacttcaactgggaagattcagaagtttgagttgagggtcatggctaaggttttcgtgcagaccaagaataatactaccactgtcaacaagaagtcttgccaagtgagtcaaaatagtattgttggggggtacaataatgagcaagttttggctgcgtctcgtctttga

SEQ ID NO: 2255 - DNA, 625 bp, Glycine Max
atggacaactacaagaaccttgtcaaagtcattgccattcaagacctcatccttgcaaacccaaagaaccgatcagtctccattgacttcctccgcaagtttcctcacatcttccacatttactatgacccttccaagttgaagcccttttgcagaatagtgcctcttagagctgtttttaaggtttggaaggagcttgggctgcctcatgatttcgaggactcggtcatatctgctaactctggtgtttttcagttgtgtgatgcgcaggaaccgaatactcatttgttgaagctggttgatggtgcttgtaacaatggttttagggcagctgttgaagattggagggttgttgagtgctgcaaggaggactgtagtgttgataggatgaaaatgtggttcagtttcaaacatgggtatcctccggggatgaggttgaccaagaatttcaaggccaaagtgaaggattggcaaaggttgccatacgtggggccttatgaagtggtggtggagaagatggtggaagttgagaagatcagccagcatagaaaatggtttgggattgatttaaatataagggatctgttcctggaccacccagggatcttctatttgtctactaagg

SEQ ID NO: 2256 - DNA, 855 bp, Glycine Max
atggacacgcgcggccacgatgaggaggagccaccgaaacctgtggttctgatcacaggatgttccacgggagggataggccacgcgcttgcacgcgccttcgctgagaagaagtgcagggtggtggccaccagcaggtcgcggtcgagcatggcggagctggaacacgaccaaaggttctttttggaagagttggatgttcagtccgatgagagcgtgcgtaaggtggttgatgctgttgtcgacaagtacggtcgcatcgacgtgctcgttaacaacgccggtgttcagtgtgtgggcccactcgccgaggctcctctctctgccatccaaaacactttcgacaccaatgtcttcggttccttgagaatggttcaggcggttgttcctcatatggcaactaagaaaaaggggaagattgtcaatattggtagtgttgctgccttggcctctggaccttggtcaggagcttatacagcttctaaagctgctcttcatgctttgacagatacattaagactggaacttggacattttggaattgatgttgtcaatattgtccccggagctatcaaatcaaacattggagattctgccatagccagctacaaccgcatgccagaatggaaattattcaagccttttgaagcagcaatccgagatagagcttatttttcgcagaagtccaaaacaacccctacagatgagtttgctataagcactgtagctgctgtccttaaggagaaaccacctgcatggttcacctatgggcattactctactgtcatggctatcatgtatcatttaccgatctctgttagagattttgttttgaagaaagcaatgaaaggctga

SEQ ID NO: 2257 - DNA, 285 bp, Glycine Max
atggacattcggggtcactgtagtatttatcttttctactcttctgttatattatatactcatattattaatcccgttaaaaagtattttttgtatattcattttaatcttgtgtgtctatatatatatatatgtgtgtcccttaatttcagttttggcatgagcagcagctttttacttttacacgatgtgtgtggatttttgtttattttttttgaaggggatgtgttaggaatatcaatattaatattatacacatatttgcactttcagtactgctcttaa

SEQ ID NO: 2258 - DNA, 1509 bp, Glycine Max
atggaccctaatcacctcttcttcacgcatttccgcgatggtgctattgcctcacgcattgagggccaacacagaggagctcttccttctgttattgtgattggtgctggaatatctggacttgcagcagcacgaagtctctatgatgcatcttttaaggtgactgtactggagtcacgagataggcttggtggtcgcattcatactgacttctcatttggctgtccagttgacatgggagcctcatggctacatggagtttgtaatgagaatccattggctccattgatacgtggcctggggctttcattatatcgtaccagtggtgacaactctgtcttatatgaccatgacttggaaagttatatgctttttaacatcgatggtaagcaagttccacaacagatggtcattgaagttggagacacctttaagaaaattctggaagagacagggaaagtgagggatgagcataccgaggacatttcagtttcccaagctatttcaattgtgctagataagcaccctgatctaagtgctgtaattgacatagttttctgcaggcaacaaggacttgcccatgaagtgctacaatggtttatatgcagaatggaagcttggtttgctgctgatgcagatatgatttcactgaaaacctgggatcaggaacatgtcctgtctggtggtcatggactcatggtgcaaggatatgatccagttataaaagttcttgcaaaagatattgacatacgcttgaaccacagggtgaaaaagatatctagtggttacaacaaggtaatggtgacggtcgaggatggcaggaactttgttgctgatgctgctatcataactgttcctattggaatcctaaaagcgaatttgattgaatttgaaccaaaacttcctgattggaaggtttcagcaatttcagatcttggtgtgggcaatgaaaataagattgccctaagatttgacaaagtattttggcctaatgtagaactcttgggcactgttgctccgacctcttatacctgtggctattttctcaatcttcacaaagcaacaggccatcctgttcttgtctacatggtagctggaaggttcgcttacgacattgagaaactatctgatgaagcagctgcaaattttgtgatgcaacagctcaagaagatgtttccaaatgcttctaagccagttcagtatcttgtgtctcgatggggaacagatccaaactctcttggatgttactcgtatgatttagttggaaaaccaactgatgtgtatgacaagcttcgtgcacccttgggtaatctattctttgggggagaagctgtaagcttggacaatcaggggtctgtgcatggagcttactctgctggggttatggctgctgaaaattgtgagagctatatgttagagaaactaggccacgcagaaaagctatctctagcttctgttaggcatgaaatgcttgaaactcttatacctcttcagatctcgaggatgtga

SEQ ID NO: 2259 - DNA, 420 bp, Glycine Max
atggacgaagaagaggtgcgcaagatcttcagcaagttcgacaagaacggcgacggcaagatctcgtgcgcggagctgaaggagatgatggcggcgctgggatccaaaacgacgtcggacgaggtgaagcgcatgatggcggagctggaccggaacggcgacggctacattgacttgaaggagttcggcgagttccactgcggcggcggtggcgacgggagggagctccgggaggcgttcgagctgtacgatctggacaagaacgggctgatctcggcgaaggagctgcactccgtgatgcggaggttgggggagaagtgctccctcagcgactgccggaggatgatcggaaacgtcgatgccgacggcgacggcaacgtcaatttcgaagagttcaagaagatgatgagtcgctcgtag

SEQ ID NO: 2260 - DNA, 1083 bp, Glycine Max
atggactcggaatcttcaaactccgattctcaaccgcaccctctctcgaacccaatcgacgacgcgtgccacgacatgagctccctggaagagctcgcgaaccgcggcgcgtggcgttccatcattgacaaggtctcacgcgcccgcgccctctctctcctccacaagccccacgaccacctcacctaccttgccttcaacgccctctccttcaccaaactgcgtcgtttcaacgaagcctctgcggaactcgattccctcgaagacctcgacagctcccactaccgctacgaaacctaccccaaaatctaccccaatcggatcggatccatggtccccttctccctccggtggctccacgccctaatccccatcaaattagggcaacgtcagcaaggcatggaccgattctacattcttctcgatttcgtgcgcgggaagattaaggaaaaggagaaactgagcaacctcggcgtctcccttaatctgtggagaaaaagagaggtttttgtggtgaattgcatcatagggaaccatttaagtcagaaagagtttggggtgtgcttgagcttgatgaaggagcttctctctcgcgattgttctgaccctttgctggtttcccagcttgggtacatgcagttgcagattggggacttggagggtgcgaaagtttcgttcttgaaggtggaggagttggggaagagtaatgggtcgttgagcgaggttgagtttaggaaccttgtgaataggaacaaggcgttggtgtatttggttgggaaggattatgtgtcggcggtgagggagtacgaggagtgcattgagagggacagtgcggatgttgtggcggtgaacaacaaggctctgtgtttgatgtatctgagggacttgtcggattctattaaggtgttggagagtgcgcttgagagagttcccactgtggctctcaatgagactcttgttgtcaatttgtgtagtatgtatgagttggcgtatgttaatcactctgatattaagagaacgcttagtaattggattgctcgtgttgcacctgatgattttgatgcatcttgtactcgtacatga

SEQ ID NO: 2261 - DNA, 1098 bp, Glycine Max
atggacttcaccacttttgcaaattccatatcctcttctcatgcaattcctccaatacacacttatcgccttcaaccctctccttttcctctccacctcccattttcgaatttaaagcgttcaggtttggttaagaatcggcttattgctcgttgcacttctatgtccgatgaatttggttctgttaatgggttgcaattctcgcccaataagctttttgtggaggaggctattggggctgaatatggggaaggctttgagacttttagggcagatggaccactaaaagttgatgtggactatttgaatgagaaattgcaagatggttttcttcagcgcatacgctatgctatgaaaccagatgaagcttatggtttgatcttctcttgggacaatgtggtggctggtacacgagctctgaaaaggaaggcatgggagcagctggcctttgaagagggaaaggatattccggaaggtgatatgcacaaattactattttatgcaggtgctgattatgtgttacataagttttttctctcagataaggcagaaaatgagctgaataggctaaagttgaggttttctcagatatattatgataatcttgtcagacttgaaaaaccaatggatggcctcaacgactggttggaagcagtttatacagctcgcatcccctgtgctgtggtttcaagccttgatagaagaaatatgttagaggctttggagcggatggggctcagcaagtatttccaggcaattgtgacagaagaggatggaatggagtcaatagctcatagatttctttctgctgctgtcaagttggatcggaaaccttccaagtgtgtggtttttgaagatgatcctagaggagtaactgctgcgcacaattgtacaatgatggctgtagcattaattggagctcatcctgcgtatgatttggggcaggctgatcttactgttgctaactttagtgaactttctgtgatcaacttgcgaagactatttgctaacaagggttcttcatttatggacttacagaagcagatcatagagaaagctcctcccaaaaggaaacttacaatagacaccattttttaa

SEQ ID NO: 2262 - DNA, 1236 bp, Glycine Max
atggacttggactgttattgttctggttggcttgtttttaaattaagattattatgtttacccaactcaaacttgcatttcctgcagatgtttgattattgtgttgttgtgcagcagtatgcatttgcatctgaaggtgtgagtttggatgtgcaggtatgtgacaagggcaagtggttcgtctcttgcaaagatgttcccatgtctcttagaaatgtagtttttcccagcatgtttccaaatggtggaaactatcaggatgttgttgatagtaattgtaatatcagcaatggagatgatattattatagatgataatcctgtgatgcatgaatttactgaggaagtttctgatttcccacttgagcggttcatgaggttactgcctcatgatcagaataccggagctttctttattgcagtattgcagaaagtttctcctctgccaggtaatttgttatatgatttcagttgtttttctctctcaaaccctggcaaagatagtcaaggaattctagtaaaacctagaaaagaagttgctaaacatgttaatccattggaaagtacacctgaagaaatttcagaggctaatataaatgacaatggacctaatacagatttgaaagttagttctgctacatttgaagaagtggatttcaaggcagctcaagatccgtgcaatgtagaaaacataacaaagaatactccaggcaaaagaaaactgcagattcaaggcaaatggagaggcattgaccctgttgtcttcttcaaagatgaagtagttattaacagcataaaggaattttatgctattgacgagcagtttccattcaatggtcaccttgtaactaggaacagtgatacaagccacatgaaaagaatttactacatctccaagtcagtcaaagatgttctggagttgaacttctcagtcggacagcaacttaaaataacttctgttggcctgaagatttttgaaagacaaacgtcatgtgaaggtaggtctgcaccatgtgcttttcggatcacttctgaaggattgccccttattctccctcacatctccaaacagattctgagttcatctgctatagacttcaagcatcttctgcagtatagagctgtaaaatttgcagattttgtcgatgccaagtttggtgaaagggctgcaaacctaatgcccggctgttgtgttgtagttctgggtgaaggaatgcaccaccatgatgcaaagtaa

SEQ ID NO: 2263 - DNA, 1350 bp, Glycine Max
atggagaaaagagggaatgtgttgatggagaagtatgagtttgggaagctattaggtcaaggaaactttgcgaaggtttaccatgcaagggacgtcagaactggggagagtgttgccgttaaggtgattgacaaggagaaagttctaaaaattgggctggtggatcaaacgaagcgagagatatcgattatgagactggttaaacaccccaatgttttgcagctttatgaggtcttggccaccaagaccaagatttacttcatcatagaatatgccaaagggggtgaacttttcaacaaggtagctaaaggtagactcactgaggacaaggcaaagaagtactttcaacaattggtcagtgctgttgatttttgccacagcaggggtgtttatcacagagatttgaagccagagaacttgcttttggatgagaatggagttctcaaggttgcggattttggattgagtgcacttgttgaatctcaccggcaaaaagacatgctgcatacaatttgtggaactcctgcatatgtggctcctgaggttataagtagaaggggctatgatggagcaaaagctgatgtatggtcttgtggagtgatcttatttgttcttttggctggtcatttgccattctatgatttgaatcttatgtcactgtataagaaaataggcaaggcggaatacaaatgtccaaactggtttccatttgaagtgcgcagactgttagcgaaaatccttgaccccaacccaaataccaggatatccatggcaaaagttatggaaaattcgtggttcagaaaaggattcaaacctaaatctggtcaagtgaaaagagaggctgttgatgtggctttagttgtttctgatcaaatttttggcttgtgtgagaatacaagtgctgctgttgttgaggcagagcaagcagtggttaaacctgcacattttaatgctttcaatataatttctctgtctgctgggcttgacttgtctggcctctttgctggcaatgttgaactggatgataccaaatttacatttatgagctctgcctcatcaatcatgtctaccatggaggatattgctcgcactttgaggatggagataattaagaaggatggagggttgctgaaattggagagatccaaggagggtagaaaaggaccactttccattgatgctgaaatatttgaggtcgccccatctttccatttggttgagctgaagaagtccagcggtgatacattagaataccagaagatattggaggacttaagaccagctctcaaagatattgtcggtgtttggcaaggtgagcagcatgcagtagcaaggttgtgtactccttaa

SEQ ID NO: 2264 - DNA, 540 bp, Glycine Max
atggagaaagcaggctctaacagtcctaaatctgctttgaagacaaaagatgtactcaaagacaagttctatgacaagactaaggcttcacgaaggtctccacccaaagaaagtaacatggcttcaagaaggtctccacccaaagaaagtaacatggcttcaccaaggtctccacccagagaaaatactaagccacaagaatttaaactccacacccaagaaagagctgtcaagcgtgcaatgttcaattatgcggtgacgacaaaattctatatcatggagctgcaaaagaaacaagaggaaaagctgcaaaagttgattgaagaggaagaggttcgtttgctgaggaaggaaatggttccaagagctcaattgatgccttattttgataagccattcttcccacaaagatcaagcaggagtattccaagagagtcatgcctccacatgatgagcagcaagtgttggagctgctcggttggcaatgaaatctacaacttgcaccactatggtcatcaaactctcaagcccattaagtag

SEQ ID NO: 2265 - DNA, 612 bp, Glycine Max
atggagaaaggaagtgtggttgaagttgcagcaccaagatctcccatgcagatgaagatgggggatgaattagaaggcaacaccagtgccctacgcactgctgagacgtttctgcgtttagttcctgttggtctatgtgtttcagcacttgttctcatgcttaagaactctcagcagaatgaatatggatctgttgattacagcgatcttggagctttcaggtatttggtgcatgccaatggcatttgtgcaggctactctctattttcagcggtgattgctgctatgccacgcccttccactatgcctcgtgcttggactttctttttgcttgatcaggtgctgacatacataattctagcggctggagcagtgtcaacggaggtgctgtacctggctgagaaaggagacgctgcaacaacgtggagctcagcttgtggctcttttggtcgattttgccataaggtcacagcatcagtagctatcacatttgtggcagtgttttgctatgtcttgctttccctcatttcctcatacaagctcttcaccaactatgatgcaccagcaagcaggcccactgcagccattgaggttgctgctttccctggctag

SEQ ID NO: 2266 - DNA, 612 bp, Glycine Max; identical to SEQ ID NO: 2265

SEQ ID NO: 2267 - DNA, 477 bp, Glycine Max; identical to SEQ ID NO: 73

SEQ ID NO: 2268 - DNA, 2157 bp, Glycine Max; identical to SEQ ID NO: 74

SEQ ID NO: 2269 - DNA, 498 bp, Glycine Max
atggagaacttgttgggtctgctgagaattcatgttgaaaaaggtgtcaatcttgccatcagggatgtggtgagcagtgacccttatgttgtcatcaaaatgggaaggcagaagctgaagactcgggtagtcaagaagaatctaaatcctgaatggaatgatgacttgaccttgtctatttcagaccctcatgctccaattcatctgcatgtgtatgacaaggacacatttagcatggatgacaaaatgggggatgctgagtttttcataggtccatttattgaagcagtgaagatgcgcttgtcaggtctccccaacaatactatagttacaaaagtgctacctagcagacaaaactgtttagctgaagagagtcacataatgttgaaggatggcaaggttgtccaaaacatggttcttagactaagaaatgttgagagtggggaagtggagctccagttgcattggattgacattcctggttcaagacatctctag

SEQ ID NO: 2270 - DNA, 1776 bp, Glycine Max; identical to SEQ ID NO: 75

SEQ ID NO: 2271 - DNA, 1773 bp, Glycine Max; identical to SEQ ID NO: 76

SEQ ID NO: 2272 - DNA, 1272 bp, Glycine Max
atggagaagcttaacttggcccttgtgtcttccccaaagcctttgatgttgggacatggtcttaattgctcctcatcgttgcagattccgtgtttctgcactctcttcctcccatcccatgaataccctatgttgacatttttaaggataagtgtttctatggtgaagcacttttttcttaagaaagagaagctgatagtaaagcattttgctagtatttcttcttcgaatactcaagaagcgacgtcaactggagttaacccacaattatcaccatcttcaactatagggtcacctctcttctggattggtgttggtgttgggctttctgcactgttttcagtgaaatatgcaatgcaacaagctttcaagaccatgatgggccagatgaattcacaaaataaccaatttggcaatgctgccttttctccgggatctccttttccctttccaatgcctacagcagcagggcccactgcacctgctagttctgcaactactcaatctcgagcaccttcagcatctagtgcatctcaatccactatcacagtagatatacctgcagcaaaagtagaagttgctccaactactaatgttaaagatgaagtcgaattgaagatggaaaacattcagggaattatctttataaatgtttctccagaagaaactgtgcaggagagtccttttgaaagttttaaagatgatgaatcaagttccgtcaaggaagctcgggttccagatgaagtttctcaaaatggagccccctctaaccaaggttttggtgattttcctggttctcaatctacaaaaaaatcagtcttgtcagtggatgctttggagaaaatgatggaggacccaacagtgcagaagatggtttatccctatttacccgaggagatgaggaaccctactaccttcaaatggatgctgcagaatccacagtaccgtcaacaacttgaagaaatgctaaacaacatgggtggaagcacagaatgggacagccgaatgatggataccttaaagaattttgaccttaatagtcctgaagttaagcagcaatttgatcaaattgggctttctccagaagaagtcatttcaaagattatggccaatcctgaggttgcaatggcatttcaaaatcctagagttcaagcagctatcatggattgttcgcagaatccaatgaatattactaaataccaaaatgataaggaggttatggatgtcttcaataaaatatcagaactcttccctggagtaggttcaccttga

SEQ ID NO: 2273 - DNA, 165 bp, Glycine Max; identical to SEQ ID NO: 77
  misc_feature (83)..(165): n is a, c, g, or t

SEQ ID NO: 2274 - DNA, 303 bp, Glycine Max
atggagacagttcaatcatgggtttcaaagcacaagctcgccagcattggggcactctgggcctctggaattggagcaacacttgtggcttattcatgcaaaaagtctccaatgaagccaagtctcaggcttatccatgctaggatgcatgctcaggctctaactttagcagtgctatcaggtgcagctgtttatcatttttatgagaaacgtgatgttcagccaaaaccagtggcagattatactattcctgctcccaatgtcactcagatggttgaatatgaacttcaatgtcctttctaa

SEQ ID NO: 2275 - DNA, 1155 bp, Glycine Max
atggagagtccccattcactgtctccctcttcctcctccgacggcgtcggcttcgagacggaggagccgcggacgccgctggccgtgcgccgcgcgctgcagctcctcaactccggcgatcccgacctgcgcctccaagctgctcgcgacatccggcgcctcacgaagacgtcacaacgttgtcggcgccagttatcccaggctgtcggtccactcgtttccatgctccgagtcgactcgcccgagtcacacgaacccgctctcctcgccttgctcaacctcgccgtcaaagacgaaaagaataaaatcaatattgtggaggccggtgcattagaaccgataattagtttccttaagtctcagaatctaaatctgcaggagtctgcaactgcatctttgctcactctatctgcctcttcaaccaacaaaccaatcattagtgcttgtggtgtcattcctcttcttgtgcagatccttagagatggaagccatcaagctaaagctgatgcagtaatggctctctctaatttatcaacacacactaacaatctcagcatcattctcgagacaaacccaatcccttacatggttgatcttctcaaaacctgtaaaaaatcctcaaaaacggctgaaaaatgctgtgctttgatagaatccttggtggattatgacgagggcagaactgccttgacatctgaggaaggcggggttcttgcagttgtggaagttctcgaaagtggcacactccaaagtagggagcatgctgttggagcactgttgacaatgtgccaaagtgaccgatgtaaataccgggaaccaattcttagagaaggtgtcattccaggacttcttgagcttactgtccaaggaacaccgaagtctcagtcaaaagcacgcaccctcttgcagttactgagagagtctccttatccgagatctgaaattcaacctgatacccttgagaatatagtatgcaacatcatatctcagattgatggcgacgatcaatctggtaaggcaaagaagatgctggctgagatggtccaagtcagtatggaacagagtctgagacatttacagcaaagggctcttgtatgcaccccaagtgatcttcctatagctggctgtgctgcttctgaagtttcttcaaaatga

SEQ ID NO: 2276 - DNA, 1890 bp, Glycine Max; identical to SEQ ID NO: 78

SEQ ID NO: 2277 - DNA, 717 bp, Glycine Max
atggagcatagtgcaagcagagatggatttacaggctggccaacttctcctgattatatttccgactcattatatgttattgaatttttagtttctagatatgcaagaaatcctgctttgctgggaattgagctattgaatgaaccatctgctgccacagtttcattagatgttttaatttcatattacaagcaaggctaccaaattgttcgaaaatattcatcatcagcttatgtgataatctgccagagaattggtgttgccgatcctatggaactttatcaagccaacataggatctcacaacttagttttggatttgcatttctacaatctcttcgacacatttttcaataatatgagtgctatggataatattcaatacatatacaaaagccgggaaggtcaactgcaggccttaaacaattcaaatggcccacttattttagttggagaatgggtgaatgagtggaatgtaacaaacggatcccaaaaagattatcaagactttgcaagagcacagctagacgtctataatgcagcttcctttggatggtgctattggacactaaaaaatgatgagaagcactgggattttgaatggagcattaggaacaactatcttcaattaggtaactcacccagcaaacggagcttgaacattctaggattgttaggattagcatgcacctggttttgtctacttccatttttgtga

SEQ ID NO: 2278 - DNA, 1770 bp, Glycine Max; identical to SEQ ID NO: 79

SEQ ID NO: 2279 - DNA, 2631 bp, Glycine Max
atggaggaaccaaacccgtgtatattcaaccctgcaattttggattctctcactgatgatgcggtgcaagaaatcctcgacggctacaatggcttctgcaacgctacgcaatcacttctcgtcggtaacggcgatctctccgtcgctcccgactttgtttctcttgttcacgttctctgcaaacaccgcctccgttccctcgttcaagaccacttttttcgactcctagaggagacgtttgaacgaaatggggcatcgagattttggcgccattttgatccttattctcgtgttgcagtgtggattgtgtgtattcagagtgtgttgtataaagctttggaagatattactttggagaaacaatatcaggagaagtgtctattgatgttggtgcatgctttgcaatcttacaaggaccaggtgtcagaggataagcatggttttgaaggagacagaaattaccttacctctaagtatcaatggattgtctcttctgtactcatggcctcacttcctcggcatttccctgttatactgcattggtattttaaaagaaaactggaggagttgagtaccattatggatggagagttcggtgatgatgcatctcaaaataaggattgcatggatttagatgaaaaaggaaaactatgcaacaaagttggtgaaatggatgttgatgagtgctataatgaccataggttctcggaaaactgtaaacttgtgaagaacattggaaaagttgttcttgatcttaggaatcttggatttacttccacggctgaagatgcttatgcttctgctatatttttactactgaaggcaaaagtacatgatgtagctggtgatgattttcggagttctgttttacaatctatcaaaagctggatacaggctgttcctcttcagtttcttcatgcgcttcttgtctatcttggtgatgtcgttagttatgagagtacttcatcaggtctgaaatcacctttggcaccacagccatcttcatgctgtcctggaattgatactccctctgaagggcttgtgagatggaagttgcggctggaatattttgcatatgaaacactacaagatttaagaatagccaaattattcgagataattgttgattatcctgagagctctcctgcaattgaagacttaaaattgtgtcttgaatacactggacaacattcaaagctggtggaatcatttatttcagcactgcgttatcgcttgcttactgcaggcgcctcaaccaatgatatattacaccaatatgtttcaactatcaaagcacttaggacaatagaccctgcaggtgttttccttgaggcagttggtgaacccataagagattatttaagaggaaggagagataccataaagtgcatagtaaccatgatgacagatgggactggtgcacattcaagttcatctggaaatcctggagatagccttctcgaagagttgaacagagatgaagagattcaagagaatgctggtgttgatgatgattttaacactgatgataggcaagcatggatcaatgccatgcgatggcaacctgaccctgtggaagcagatccattaaagggaagcagaaaccaaaggaaggttgacatccttgggatgattgttggcataattggttcaaaagatcaattagttcatgaatatcgaactatgcttgccgagaaacttctaaataaatcaaattatgatattgattcagagatacgtactttagaactcctcaagatacactttggagagagcagcctacagaaatgtgagattatgctcaatgatctaattggctcaaagagaatcaacagtaacattaaagctaccataaatcagccatctcagaccagtgttgaattgggagacagtgcaatatccatggatgtaatttctgctactatcatatcttctaatttctggcctccaatacaggatgagccccttaacctgcctgagcctgttgaccagctcctatctgattatgcaaagagatttaatgaaatcaaaacaccacgtaagctgctgtggaaaaaaagtcttggaaccatcaagctggagttgcagtttcaagatagggaaatgcaattcacagtagcacctgttcatgcatctatcattatgaaatttcaagatcaaccaagttggacctctaaaaagcttgcagctgctattggggtacctgcagatgttttaaatcggagaataaatttctggataagcaagggaatcattgcagagtcacaaggggcagattcctctgaccatgtatacaccattgtggaaaacatggctgagccaagtaagaatggagccagtactggttgtgctcaggaacttctaggaggtgaagaggaggaagagagatctgtggcatctgtggaaaatcaacttcgtaaggaaatgactgtatatgaggaatttatcctggggatgctcacaaactttggtagcatggcattagatcgaattcacaatactctcaaggtgttttgcattgccgatcccccatatgacaagtcactccagcaactacaaagctttttatctggtctagtttctgaggagaagttagaacttcgggatggaatgtactttctaaagaagtag

SEQ ID NO: 2280 - DNA, 2367 bp, Glycine Max
atggaggagactgagaaagttattctggaaccttcaaaagtcaattgtaagctaaaggcagataacgttgatatttgttaccccccaatttttcagagtggtggagagtttgatctgaagcccagtgctgtcagcaatgatgagttattgcattatgattctgccagcgtgattatatgtgcagttggagctcgatataagagttattgctcaaacatagctaggaccttcttgattgatgcagaccctcttcaaagtagggcttatgaggttcttctgaaagcccatgaagctgtcataggttctatgaagcctggaaacaagttaagtgttgcataccaagctgcagtttctgttgtggaaagggatgcacctgacttgatttcatatttgacaaaatctgctgggacaggcatcggcattgagtttcgtgaatcaggattgaatcttaatgcaaaaaatgaacagataattagagaaggcatggtctttaacgtgtcacttggttttcagaatttacagtgtgagaacagtaagtctaagaacaagcaattctctttgttgcttgctgacacagtcatcatcaccaaagataagacagaaattgtgacttctacaagctcaaaagctctgaaggatgtagcatactctttcaatgaggatgaggaagaggaaaggccaagcacaaaatcagatgccaagaaagcggagccctttatgtgtaagacaactcttaggtcagacaatcatgaagtttcaaaggaggagcttcgcaggcagcatcaggcagaacttgctcgccagaaaaatgaagaaactgcaaggcgtcttgctggtggtggaagtgaaacaggagaagcccgttcctctgcaaggacttcagcagaactcatggcctacaaaaacataaatgaccttccccctcccagagagatgatgattcagattgatcagaagaatgaagcagttctcttgcctataaatggaagcatggtaccttttcatgtggctttcattcgaactgtttccagccagcaggacaccaaccgcaattgctatgtcagaattatttttaatgttcctgggactcctttcagtcctcatgatgcaaactcaatgaagttccctggatctatatatttgaaggaggcgtcattccgctccaaggattcgaggcacataagtgaggttgtgcagtccattaaaacactcaggcgtcaagttgtagcaagggagtctgagagagctgagagggcaaccttggctcatgttaatggatttcgttattctaccactaggcaagatgagcgtgtagacataatgtttggcaacattaagcatgcatttttccagccagcagagaatgaaatgatcactctcctacacttccatctgcacaaccatattatggtaggaaataaaaagaccaaggatgttcaattttatgttgaggttatggacatggtccagaatgtcgggggtggtaagaggtcagcctatgatcctgacgagcttgaagaagaacaacgagagcgacagaggaagaacaaaattaatgtagaattccaaacctttgtgaatcgggtgaatgatctctgggggcaacctcaattcaatggctttgacctggagtttgaccaacctcttagagagcttggcttccctggggtgcctcataaatcttcagtatttattgtacctacttctgcctgccttgttgaactgatagagacccctttccttgttgtcacgcttagtgagattgagattgttaatcttgagagagttggacttgggcagaaaaactttgatatgacagtagtttttaaggacttcaagagggatgtcctcaggattgattctatcccttctacatcactggatggcatcaaggagtggcttgacacaacagacatcaaatattatgagagcaggctgaatctgaactggcgtcagatcctgaagacaatcacggatgaccctcagagctttattgaaggtggtggttgggagtttctgaatttggaagctactgattcagaatctgagaactcagaggagtcagataaaggttacgaaccatctgatgtggaacctgaatctgattcggaggatgaagcttctgatagtgaatcacttgttgagtctgaggatgatgatgacgatgaggattccgaggaggattcagaagaagagaagggaaagacatgggaggaactggagagggaagcaagcaatgcagatagggagaagggaaacgagtctgacagcgaagaagataggaaaagaagaaaggcaaaaggctttggtaagtcacgaggagctagtctaagcagtagtatgccaaagcggtctaagttaagatag

SEQ ID NO: 2281 - DNA, 4689 bp, Glycine Max
atggaggagagtgaacggttgtcgaaagaaatttctcggctttcgagttcgctgagtaagcccttgcgacttggcgtgcacaacgagttggtggagaagaagaaagggcttgttgatgagaagaatcttgttgaaaggaggttgaaggagtttgagtctgcgatgcagtgtttattgaagtatttggagggtggtgttgacgtggagggtgtgactgtctttaggtttgatggaggttttgattggaagcggattcattgtctgatcaaaagggagtgtcggaggcttgaggacgggttgcctatttatgcttaccggagtgatattcttcaggaaatacattatcaacagataatggtattaatcggagagactggttctgggaagagtacgcagttggtacagtttcttgctgattcaggcattggtactgacgaatccattgtgtgcacccaacctcgcaagattgctgccaaatcagtggctcaaagggtccaggaagaaagcattggatgttatgaaggccaatcaatcaaatgctgttctacattttcatcctcacgtgagtttgattccaggatagcattcatgacagatcattgtttattgcagcactacatgagtgataataatttatccggggtctcgtgcatcataattgatgaggctcatgagaggagcttaaatacagatttactgttgactttgttaaagagtttactttgtaggagggttgaaatgagacttatcattatgtctgctacagctgatgcaaagcagctgtctgattacttttttgcttgtggaatttttcgtgtgcttgggagaagctttccagtggatatcaaatatgttccttctgactatgcaggagattctggttctgctgttgttgcctcatatgtttctgatgttgtcagaatggcaactgaggttcacaaaactgagaaagagggaactattcttgcctttttgacctctcagatagaagtagaatgggcctgtgaaaagtttcaagctccctctgcagtagctttgcccttgcatggaaaactttcttctgatgagcaattccgtgtttttcagaactacactggaaagagaaaagtgatattttcaacaaatcttgcagagacatcacttacgattcctggtgttaggtatgtgatagattctgggctggttaaagacagcagatttgatcctggtagtgggatgaatgtacttaaggtttgctggatcagccagagctctgctgatcaacgggctggtcgtgctgggaggactgagcctggtgtgtgctatagactgtacacggaagctgattatcagtctatggacctaaatcaagagccggagattcggagagttcatcttggtgtagcagttctgaggatccttgctttaggagtgaaggatgtgcaaggttttgattttgtggatgctccaagtcctagctccatagatatggcaatcagaaatctaattcaattaggagccattgaactgaacaatgatgttcatgatttaacttctgaaggttggtgcttggtaagaatgggaattgaacctaggctgggtaaacttattcttggttgtttcaaacatggtttgggtagggaaggtatcatccttgctgctgtgatggccaatgctagtagcatcttttgcagagttggcaatgaatttgataaacaaagatctgattgtcttaaagtgcaattttgccattgtgatggtgacctctttactcttctctccgtgtacaaggaatgggaagctttgcctcgagaaaggaagaacaaatggtgttgggaaaacagtatcaatgccaaatccatgaggaggtgccaagacacaattttggagttagaaacttgccttgagcgtgaacatgacgttgttactccgagttactggcgttgggacccttgtatgccctctaatcatgataagaatttgaaaagggtaatactgttctcacttgctgagaatgtagccatgtactccggctgcaatcaacttggttatgaagtggcacaaactgggcaacatgttcaactacatccatcttgttcattgcttgtatttgctcagaaaccaagttgggtagtttttggtgagcttctttccatttccaatcaatatttggtctgtgtgagtgcatttgattttcaatcattatacgacctttgccctgctcccctgtttgatgtatccaaaatggaagagcggaagttgctaatgaagacactgtctggtcttggctgtattcttctcaagagattttgtggaaaagccaactgcaatttgcttgctcttgtttcacgtataaggaaagcttgtatggatgaacgcatcttcatcgaagtgaatgttgacaataatgaaatccacttatatgcctcttcaaatgatatggatatagcccttgggttggttaacgatgttctagaatatgagagaaagtggttacgcactgaatgtatggataagtttttgtatcatggttctggtttctctccacctgtagctttgtttgggtctggtgctgagataaaacatttggaacttgagaaacgttccttgagtgttgatgtgtgtcatccaaacataaatgaaattgatgacaaggagctcttgatgttttttgagaagaatacctctggttgcatctgtgctgtgcacaaattcacaggcaatacgagggatgaagatagggataagtggggcaggataacatttatgtccccagatattgtcagaagagctgctgagctagatggacgggagttttgtggctcatccttaaaagttgttccttcacagttgggaggggataaaacattttcgttccctgctgttaaagcaagaatttcttggcctcgtaggcttagcaggggatttgccatagttaaatgtgatataaaggacgttgattatatcttgagagatttctataaccttgcagtaggagggaggtatgttcgatgtgaagttggcaaaaagagtatggacagtgttgttataaatgggcttgacaaagagctttcggaagctgaaatatcagatgtgctaagaactgctacaactagaaggattttggattttttcttggtgagaggggaagcagttggaaatccaccatgcagtgctttggaagaggcactcctaaaagaaatttacccctttttgcccaaaaggaaccctcacattagtccttgccgagttcaggtgtttgcacctgagcccaaggatgctttcatgagagctttaatcacttttgatggaagattacatttagaggcagcaaaagctttggagcaaattgaaggaaaggtgttacctggatgtctttcatggcaaaagataaagtgccagcagttgtttcatagctcccttacatttcctactccagtgtatcgtgtgattaaggaacaactggatgaagtacttgcaagcttcaggaatttgaaaggtcttgaatgcaacctggacaggacatttaatggttctcaccgagtgaagataacagcgaacgccacaaggacagtggcagaagttagaagacctctggaagaactattgagagggaaaaccattgagcatgacagcctcacccctgcagttctccaactcatgttgtccagagatggctttagtcttaaaaactcattgcagcaagagactggaacttatattctttttgacaggcacaacttgaatttacgggtgtttggttccccaaacatggttgctttggctcaggagaaggtgatacagtccctcctttctctccatgaagaaaagcagttagaaattcatctgagagggagggatctacctcctgatttaatgaagcaaatgattaagaattttgggccagatctccatggattgaaagagagggtacctggggtagatcttacactgaacatacgtcgccacataatcattcttcatggtagcaaggagttgaaaccgagagtagaggaaatagtttttgagattgctcgttcaagccatcatttggttgagagatttggcaatggacccagttgcccaatttgcttgtgcgaggttgaggatggataccggcttgaaggctgtggccatttgttctgccggatgtgtttggttgagcaatttgaatctgctattaaaaaccaaggcactttcccggtatgttgtactcacagggactgtggagatcccatcctgcttacagatttgagatctcttttatttggtgataagttggaggatcttttcagggcttctttgggagcttttgtggcaacaagtgggggaacttacaggttttgcccttctcctgactgcccctcaatttatcgagttgcagatcctgggtctgctggcgagccatttgtttgtagggcttgttattcagagacttgtaccaggtgccacttagagtatcatccttacctttcatgtgagagatacaaagaattcaaggaagatccggattcatctctgatagaatggtgcagagggaaagaacaagttaagtgctgctcggcatgtggatatgtaattgagaaggtagatgggtgcaaccacgttgaatgcaagtgcggaaagcatgtctgctgggtttgtttagagttctttagtactagtaatgactgttatgaccatttaagaactatacacttaaccatataa

SEQ ID NO: 2282 - DNA, 876 bp, Glycine Max; identical to SEQ ID NO: 80

SEQ ID NO: 2283 - DNA, 708 bp, Glycine Max
atggaggagtctcagtacttgctgtggatcaagagaaaacaaatcttgaacaacaacaacaactcatcatcatgggaggaaagggcttttgcagaagatgctgctaggatacttggtgggtgcatatggcctccaaggtcttactcatgcaatttctgtaaaagagagtttaggtctgctcaggctctagggggacacatgaatgtgcacaggagggacagggctagactcaaacaaagccttagtacagttgcaacaagcaaagtctcatcttctagggcctcaactatatctacccaagaaatttgttctcatcagcctaccatgtccctttattcttccttaattgggtggggacatcatcaccacatggagtctcctgattcagaaccaaaagggcaagtgaatgcaagggaagaatttttaaaaggtttgggttgtaatgattatgttgaaacaagtttgtctgtgggacaaagtgcagtgtttggccaaaaattaccaacaactgaatcatgtggggacgaaagcatcagttataaaagatcaaagacttctatgcctcctttgcctggagttttcctcaagccatgttcaaatgatagaaacctaacttttcagtctgcagaatttgtacttggactcaagcctggaatggaagacttagatcttgaactcaggctggggaagccacagaaagttatttag

SEQ ID NO: 2284 - DNA, 323 bp, Glycine Max
atggaggatgattttgaaagtgaagtgaagcttataagtaatgttcatcatcgaaatctcgttagacttcttggttgttgcagcaaaggccaagagagaattatacccaaaatagctgattttgagttggcaaggcttttgccaagggatcgttctcatcttagcacaaaatttgcaggaacattgagatacacagcacctgagtatgcaatgcaaggtcaattatcagagaaggctgatacctacagttacggtattgtggttctagaaatcataagtggtcaaaagagtaccaatgtgaaggttgatgatgagggtcgcga

SEQ ID NO: 2285 - DNA, 1581 bp, Glycine Max
atggaggcgaagaaatcgggtttgaatctcccagctgggatgtccggaacctcactccggctggacactgcagcagcatcttccatctcgaccctcaattctccttcttctctccgttccatctctaatctcacctcgccttcgaaatccaactcggcttgcagcgacaggttcattccgtgccggtcctcctcgaggttgcacacgttcgggctcctggacaggccctcgccggtgaaggaagggagtaacgaggcttattccaggttgttgaaatcagaactctttggatctgactttgcttctccttctctttctctttcttcccctgcaggtgctgctcctccttcgccgctcagccccagcaagaacatgctccgcttcaagaccgaccactccgtcgcgccttcttcgccttattcgccgtccattttgggacagcagaatgcctttccttctgactcttctaccccgcctcccaaacctcccaggaaagtcctcaagacgccccacaaggcaaatatatgggcctttactaaacaatttaagctttgggaaaagttgaataagagcctctttgatcaaacccgggggggaaactgtagtagaaacaagaaggatattgaggttttggatgccccatcacttcaagatgacttttatttgaatctggtggactggtccacacaaaatgttcttgctgtggggctaggcacttgtgtgtatttatggagcgcttcaaacagcaaagtgactaagttatgtgacttggggccttatgatggtgtctgctctgtccagtggacccgggagggttcttttatatccattggtacaaatcttggtcaagttcaggtttgggatggaactcagtgtaagaaggtcagaaccatgggtgggcatcagacaaggactggtgttttggcatggaattctcgcattttggcttcagggagcagagataggaacatacttcagcatgacatgaggattccgggtgactttgttagcaagcttgttggccacaagtctgaggtatgtggattgaaatggtccagtgatgacagggaacttgcttctggtggtaatgataatcagctcctggtatggaatcaacactctcagcaaccagttttgagacttaccgagcacactgctgctgtgaaggccattgcttggtcacctcaccaaagcagtctccttgtgtccggaggtggaactgctgataggtgtattcgtttttggaacactacaaatggccatcaattgaactgtcttgacactgggagccaggtctgcaaccttgcttggagtaaaaatgtgaatgaactagtaagcactcatgggtactcccaaaatcagatcatggtgtggaaatatccatcattgtcaaaggttgcaactctaactggccacagcatgcgagtgctataccttgcaatgtctcctgatggccagacaatagtaactggtgcaggagatgagactctacggttttggaatgttttcccatcaatgaaagcacctgtcccggttaaagatacaggcctttggtcactggggcgcacacaaattcgatga

SEQ ID NO: 2286 - DNA, 396 bp, Glycine Max; identical to SEQ ID NO: 81

SEQ ID NO: 2287 - DNA, 384 bp, Glycine Max; identical to SEQ ID NO: 82

SEQ ID NO: 2288 - DNA, 1587 bp, Glycine Max
atggaggtagctgcgaacgcgcggaaccccgccgctaagcgaaaattcgacgacgccgtttctaacggcgtcgccgcccccgccgacgtcgatctctccctcctcgaagccatcgagaagtcgcagaacgcggtcgaagccctcgatctccgagccctaaagaagcacgtgctctccttcgagcgtcgcctgaaggataacatcgaagcgcgccttaaataccctaaccaaccggaccgcttcgccgattccgaagtagaactccacgaagagcttcagaagctgaaggtcctcgccggcgcgccggagctctacccggacctcgtcaacctcaacgtggttccctccatcgtcgacctcctcaaccacgacaacaccgacatcgccatcgacgtcgtgcaattgctccaggacctcaccgacgaggacgttctcgacgacaacgacgactccgctagggttttggtcgacgcgcttgtcgacaacagcgcgctcgagctcctcgtgcagaacctgcaccgcttgaacgattccgatcccgacgagaacgccgccgtgtacggctccctcgccacggtggagaatatgatcgaggtgaagcccgcggtggcggagctggtttgcgagaagacgaagttgctgaagtggcttctcgggaagataaaagtgagggagtttgacagtaataagcagtatgcttccgagattttggcgattttgctgcagagtagtactgtgaatcagaagaagctgggacagatgaatggggttgatgtggtgcttcaggctgtggctatgtataagtctaaggatccgaagagttccgatgaggaggagatgttggagaatttgtttgattgcttgtgttgtttgttaatgccgttggagaataaggaacggtttgtaaaggctgaaggggttgagttaatgataattattatgaagcagaagaaattggcttatgggtcggccattagggcgcttgattttgctatgacgaagtacccgccggcttgtgagcgttttgtggatgttttggggttgaagaccgcgtttgcagctttcatgggtaaggttcctttaagtaagaagaacaagaaagaaaggtaccaagaggatttggaggagcgcattgtgtcactgattgcgtcattatttggtggaatcttgaggggttctaggagagaaagattattaagtaaatttgttgaaaatgagtgtgagaagatagacaggctaatggaactatacatcaggtattcagatagagtcaaagcagaaactgaacggttgaatcaagttgagcttgatgacttggaggtggatgaagatgaaaaatacaaccgtaaactagaatctggactatatactcttcaggtgattgctgtcattttgggtcatctttggtgctcagagcatccacaaatgagagggagaattgaactacttctcaagcagaacaaacttagtaagaagcatatcaaggatatacttcaggagtatcatgacaatattggtgaccttgatggaccggaagagaaggagagagcacagacaaaaattcagaagttcataacggccttataa

SEQ ID NO: 2289 - DNA, 1404 bp, Glycine Max
atggatatgtatgctggaaatactactttgaaggccaaaggtggcctatctgtagcagttcctggagaacttgctggccttcatgaggcgtggaaacaacatgggaagcttccatggaaaagacttgtaaagccagctgagattctagcacgtagagggtttaaagtatcaccatacctccacaagcagatggaagaaacagagtcagatatattggaagacaagggtcttcgtagcatatttgccccaaatggaaaactcttaaagataggtggcatttgctacaataagaaactagccaagactctcagaacaatatcagagtctggtccaaaagccttttatgaaggattgattggtcttaatttagttaaagatgtccagaatgctggagggatattgagcatgaaagacctcaaaagttacactgttaaacagaaggaacccatatctaatgatgttcttggtctaaagctccttggcatgcctcccccttcaggtgggcatccaatgatgctactgctgaacattctagatcaatataaactcccttctggcctttctggtgcccttggtttccatcgagaaattgaagctttgaagcatgtatttgccgtgagaatgaatcttggtgaccctgattttgtaaatataactggggttctttctgatatgctttctcataggtttgctaacgtgttgaaaaatgacataaatgataataaaacttttggccccagtcattacggcagcaggtggaatcagatccatgatcatggtacaagtcatttaagtataatagatcctgagagaaatgccatttccatgactagcactgtgaatgcatattttggttcaaagatcctttcaccaagtacaggaatagtactgaacaatgaaatggatgatttttccatgcctagaaatgttaccaaggatgttccaccaccagctcctgccaatttcatcatgccaggaaagcggccactatcatccatgtcacccactattgcccttaaggatgggaagctaaaagctgtagtaggtgcaagtggaggtgctttcatcattggtggaactgcagaagttcttttgaatcacttcgttaaaggaatggatcctttttcttctgtaacagctccaagggtctatcatcagctactacctaacgtggttaattatgagaattggaccactttaggtgaacactttgaacttcctgctgatatcagggaagcccttaaaagtaagggtcatgtcctaaagggccttgccggtgggactatttgccaatttattgttctagacaattctgtgccgtccagacaaaataaagggattggaaatggaaagcttgtggcagtgagtgacccaagaaagggtggttttcctgcaggcttttga

SEQ ID NO: 2290 - DNA, 1782 bp, Glycine Max
atggatcatcagggtcgtcttcttgtttttattttgctctcgttcttattaagaggcgagtcatggggttggttttcatcatctaaggagactccctctagtgacaagactcataccaccaatgaaggcaattttagaggttcaagtgctgagttctctattgaatccttcaatgaccataagggagtgaagttaatagaaaatgctaagaagaaaatgattagctcaaactcgtgttggcaaaatgcttatcaacatctttttgctggatgttctgaaatcttggctgttgatgagaagaggtctagattggcttggcaccttagtgattgctttcagagggattctggcaggtctccttttccccattgtgaccccaaatcttccattgctgtatgctcaagatccttagatgaccttgcccataaggtttaccttgaattctacctcgaaaccaataccatttgttatcagttgcagacacatgcattcaaatatgaaacagagagacttgtgactgaattaaaaagttcggcccagtatgttgaggacaagttagatagcattgaagagaaatcagaacatctattacaaggctcaagacaaattcatgattctcttgattcaattggtagccacacaaaacaagtagctcaaactgctaaaaatttggaaggtcacattgattctgtattaacgcattcgaagagtgtttacgagcaaactacaaaaattgcactatcacaaacacagttaaaagaagggcaagagaatatgaagagaaacttggaggatggggtagggatgctcaaagactcttacaattatttgggtagagaaattgaaaagttaagaaatgaagccattgagattgagaatgaggtaattaaagttggagatgctatgtcatcaaaaatggacaacctgcaaagcaaagctgaagatattgggaatatggctgaaatttccttagataagcaacaaattcttttagacgggcaatccgcagcacttgagggcctaaactcattgactgagtctcaagctaaagcactagaagagagcaggaagaccctacaatattttgctgaatatgggcatagacaacatgaagagcttcttcagcgtcagcaacagattcaaggatttcatgatcgtttaatggaaaactcaaaggaaatactgtcttctcaggaatcttttgaatcaaagcaggcttccatgtttgttgttttagacaggatttttgctttgcaaaataccttgttacttgaatctagaatgatcaaagctttcttcgtttattccgtattaatctttgtcatcttcatgttgaccagtacaaagcaaacatacaatatcagaccattcctatatattgagctttgtgctactctctttgtggaagtactcattatccgtttaaccggtgataacattgagcaccaaacctggataataaacatggcccgattatttttcctggtagcagctttagtgcaacttctacatgcaattttcacatacaagaactatgagaccttgaaccatcaaatgctgctaactctaataaacaaggttaacagcatgcaaaaagaaaaggagttgtcatgggacttgtatactgattatgaggattggtctgaatggatagatgccgatttacctgatgatgtgaattgccttgatgatcctgactatatacttccacaagaagttgcagagaattcaatcacagttacaaaaaattataatctacgcaaccgcaatctttttcattga

SEQ ID NO: 2291 - DNA, 594 bp, Glycine Max
atggatcattcccataaacttccttcctttagttgtgaacttagaataatacaagcccaaaacgttgagtccataaagtccacaaaaaacctatttaccaggttatatcttccagcaggaagcaacaaaagaattcaactcaacaccaaaaaagtttcctccaataccaaatatgttcccttttggaacgagtccttcaacttaaattgttcatgtccccaagaattcttggaaggtctaaagaaggaaagccttgtggtggagctaaggcaaagcaagatttgggggtcacatgtggtgggaaagggtgagattccttggaaggcaatttttgaatcaccaaacatggagttcaaggaatgggtgaagatggatttggtgagtggaattgattgtgaagatgttatgttcaaggcaccacaagtacaagtggagattaaaatacaagtggagaaagagaataataataggagaaagagattgaacaataggtgggacgagtgtggatgcaaacaagggcatgatcaacatgcatggtgcagtgctgaagattatgatatatttgctttgggagcagttttggaggctttttga

SEQ ID NO: 2292 - DNA, 1254 bp, Glycine Max
atggatccgacatcctcctccagacgcgggagtggttccctccctcacgcaccctcggcgccctctccaccttctaccaaactctgcgcctttgcctccaacaagcactccgcccctgatgatgcctatgccacagaatccatcggtgacgacccccttgcgacgtccagcggccctaaaacatggccctccgtggaggtgcattcccttgaacaccaggctgggatcaacaccttcacctttgcgaccttcgaattgccatcgaagacgctcaaggctagggacgaggtcgccgccagcctcgcccccgccgtgctggagcctcaggaggagccgcagcaaaagcaggatgaatctcaggtggaaaaggatccttttgcggcgagtgatgtgttgttttctgttggtgagctggccgcttgtgcttatgtaatgagaaatcttccagagaagcatcaaacactgctgtttagtgcgactatgcctgtggagattgaagaattatcaaaggagtacttggctaacccagtgcaagtgaaggtggggaaagtgagtagcccaacaactaatgtttcacaaactcttgtgaaaatttctgaaaatgagaagattgatcggcttctagatttgcttgtagaggaggcatcacaggctgaaaaatgtggtcatccatttccattaacaattgtgtttgttgagaggaagacaaggtgtgatgaagttgctgaagcgttggtagctcaaggattatctgcagtttctcttcatggtggtcgcagtcagagtgaaagagaagctgccttgcatgattttcggagtggcaccaccaacattttggttgccactgatgtcgcatctcgtggcttggatgtcacaggagtgtcacatgtcatcaatctagatcttccaaagaccatggaagattatgtacaccggattggaaggacagggcgtgcgggatcaactggcttagctacttcattttacaccgatcgtgacatgttcctcatggcaaatataaggaaagcaatagctgatgctgaatctgggaacacactgacatttgcaactggaaaggttgctagaaggaaggagaaagaagcagcagctgcacaaaaagaggcaaacattgctttatccaaacagttaggattgggagctgcttcaatgaacattgaagataaatataaattcatgattactgccacaaacactaaaagagagggagcagcagatagtgcctgggatgattaa

SEQ ID NO: 2293 - DNA, 414 bp, Glycine Max
atggatgctgaaaaagtggtgcataccggaggttgtcattgtaagagtgtaaggtggaaagtggttgctccttcaagtgttgtggcatgggactgcaactgctcaacctgctacatgagagccaatactcacttcattgtacctgctgacaattttgagcttctgggagattctgagaagtttcttacaacttacacctttgccactcacactgcaaaacacacattctgtaaaatctgtggcataacctcattctatcacccacgctcaaacccagatggggttgcagttacatttaggtgtgttgacccgggaaccttgacacacgttgaaatcaggcattttgacgggaagaattgggacagcgcatataatcagacaggcatctcttcattttcaaaggtgcagaagtaa

SEQ ID NO: 2294 - DNA, 930 bp, Glycine Max; identical to SEQ ID NO: 83

SEQ ID NO: 2295 - DNA, 1191 bp, Glycine Max
atggattcagctccttcttgttcttggctacaagccttctccttcttagcattggtttggttatttaactgtggatgtgtccatggagccaccccagcagtgaaagtaggtaacttttcaaaggtggaagatgctggaaacttccatatttactatggccagaccttcaaagtcattaagaattctgctgatggccagagctaccttcttctccaggataattcaaggattgcatcaaggactaaatattgcacatcaagaatcaagtcatttgtcataccattgtcaaactattctgtcgatacaacttattttccgggtttagtggagagcttgaaaggcataacctcagactatgtggcttctccatgtgtgttgaaactgtacgaaggaggacagatagaattgttcaataatagtgattaccaaaagcttgcagagttctcttcatactttcttagtgacactgatcagcagccagcttgcaattttgcaacttttgttccatttatagaggatatccctttgcagggagcagaatggatcaaattcatgggagcttttgcaaatgttgaagctagagccaatcaagtctatacagcagttaaggcaaactatttgtgcttggctaaaattgctacaagtaggacaacattcaagccaacggtagcttggatgaggtataaaaatggtctttggtcttttacacaggaaaagtatcaattgaaggacgtgcaagatgcaggcggagagattttgggtgccaacaagaacacttacaatgtctctgatcctgatgacttggaggaatttcatgccatcctatgtgccgtggaagtagtcattgatgaaacactaacatctgatccagtcaactacaccttttcaacatttatccaaaatctaaacgttgaagatcgttcttgtttttcttttatttcaaacacaagtctatggagatatgacaaaagggtttataattctgtagctcttggctggtataatggagcagtgtcccaacctcaattggcactagcagatcttattgaagttttatttcccactgaaaattacacaacgacctattttaggaacattgcaaaggcagaagtacctataaatattggtcttgaaatgtgtgacagggacacatccacagcaatggagcctaccatagtagcatgtggatga

SEQ ID NO: 2296 - DNA, 1770 bp, Glycine Max; identical to SEQ ID NO: 84

SEQ ID NO: 2297 - DNA, 1365 bp, Glycine Max
atggattcgggcaacagtgggagtatgcaatcttccagcaccgccggtgatgaagagtacgactcacgcgccgacccatcatcgtcttcatcaatctctgcgttctttattaacagtaacccccaccctccaccacaacaaacaacgttagcaactcacgttgttggtcctcctttctcttctcagcaccacgtgttcgaccctttatccaattacttggatccgacacaaagaccgccgcaatcaaaccaaatcctcaacctggacatggtgtggtccaaggttgccgccagatccgaccccggtcttagttccttcgtaccttcatcttccccacacaacaacaacaacaacaaccaagcttttctgttaactcaattgggaggagcaggaggtcaaagtcaaccacgcggaggaggagttaacaacgttgctgtttttcccagtaccactctccctctagaaagtggaggaggattaccagtgaatgaacaagtaaacagtagcagcaccaacacggtggttcgaaacccgaagaaaaggtcaagagcatctaggcgtgcacccaccactgttctcactacggacaccacaaatttccgagccatggttcaggaattcactggcatcccagcacctcctttcacttcctcctcctcctcctctttccccagaaccaggttagatctctttgcctcttctaattctattgcttcttcttcttcttcttccattattagagagcaaacacaaacacctccttatcttcttcgcccctttgcacacaaagttcaagctcaacttccttcttcaatcccaccaccctcttcctttccacccatgttgaacaactaccagcagcactctctcaacatgcagcaaaacccaattctcagcttccaatccattctccaaccacaaccactcattggttccaaaactcaacaaccctcattggaaataccgcctagtgctgttgattcttcacacctcaagatgggtgggttggaagagttaggattgagcaatgcgcacgatggtggtcatcatcaaaactttaacatggtttcgtcttcatcggatggagcattgtcaagggtaaccaacagcaacatgcgtggtggtccttcttcggcagactgggccctgtcccaggcccaaagaattgacaacaatgatggaggagttttgaggtctctcggtggtgccactgcgacgttaaactacagaagcaatgtttcggatccgcgagtaaaggttactaataataattcggattttcatggagacaaaggaccggaatgtgctgtggccgcacgaagcgaaggtatggtcgaatcctggattaattgttcttctgattaa

SEQ ID NO: 2298 - DNA, 849 bp, Glycine Max
atggattgttgtgtgtgtacaactatgccattgatattgaggcctccgaggaatacaatatgtggggcttgttatgaaggagttaggagcataatcaacatgatgagcaatgtcgaaagtgagaaagtaaaagcaatggctaatccaaatccaaacagttctccagtttcgcggcgaaattcgaaaaggcgtaataacactaacattgagattatttttcctctgcagacacttgatgattgtataagatggtgctcagagcagatggagcagtttaatcaacaaaaagaagacttggtttttctcagaggctttgtttcagccttcaaagcacagattcacacggatatattggtcagtccaggcaggcatggtccacctatacctgcacataagtccgttttgggagcaagatcagaaatatttaagaacatgctagagtgtgatgaatgcaaggcagcaccaagtaacagcataactatacccgatttgaaccatgaagaactagagtctctccttgagtttctgtacagtgggaccttgggtgtggaaaaattggagaaacatgtttacgctttgtcacaagcagctgataagtatgtgatcccacatttgctgaaacactgcgaacgatatctgctgagttcactaagcacttccaatgcccttgagacattggagatcgcggatacttgttccaaccacaacttgaaggagacaaccttgaatttcttagttaaaaacattgagcacatggtgccttcacctaagtttgaaacttttgtgcataggagtccacatcttactgttcaactagttacaagggcgtttgtgaatggtgccaaataa

SEQ ID NO: 2299 - DNA, 1791 bp, Glycine Max
atggatttgacatttatcttcctttctagttttgtcaaagttgcaaaagatgcattgtatgctttgaaggtatcattgaatgtttctgccaaccagcttacaaactggaataaaaatctagtaaacccttgtacttggtccaatgttgaatgtgaccagaatagcaacgttgttcgaatttcactagaatttatgggattcacaggatcgttgacacctagaattggatctctaaaaagtcttacaattctttctttgcaagggaataacattactggtgacataccaaaagaatttggaaatcttacaaacttggtcagattggatttggaaagcaacaaattaactggtgaaataccatattcacttggtaatcttaaaaggcttcaattcttgacattgagtcaaaacaatctctatgggactattccagaatcacttgccagtctcccaagcttgatcaatgttatgctagattcaaatgatcttagcgggcagattccagagcagttattcagcattcctatgtacaatttcactggaaataatttgaattgtggtgtgaattaccatcatctttgcacatctgataatgcatatcaagattcgtcacataaaacaaaaataggcctcatagctgggacagttacaggtttagttgttattctttttcttggtggcctgctgttcttctggtacaaggggtgcaagcgtgaagtttatgtagatgttccaggtgaagtcgatcgccgaattacatttggtcaaataaaaagattttcctggaaagaactgcagatagctacagacaacttcagcgagaaaaatattttaggacagggaggttttggaaaggtttataaaggtattctagcagatggcaccaaagttgctgtcaaaaggttaactgattatgaaagtcctgcgggtgatgcagctttccagcgtgaagtggagttgataagcatagctgtccataggaatctgttacggctcattggtttttgtactacttcaactgaacgcctcttagtttatcccttcatgcagaacttaagtgttgcctatcgtttacgagaactcaaacgtggggaacccgttttagattggcctaccagaaaacgagtggctctaggaactgcccgtggcctagaatatcttcacgagcaatgcaatcctaggattattcatagggatgtgaaggcagctaatatattacttgatggagattttgaagcagttgtcggtgactttggtttggcaaaattagttgatattcgacatactaatgtgacaactcaagttcgtgggacaatgggtcatatagctccagaatacttgtccactggaaaatcttcagaaaggacagatgtttttggttatgggattatgcttatggagcttgtaacaggtcagcgtgcaattgacttttcacgtctggaagaggaagatgacgtcttattgcttgaccatgttaagaaactgcagcgggagaaaagactagagactattgttgattgcaaccttaataaaaattacaacatagaagatgttgaagtaattgtacaaattgcattactctgcacacaagcatcacccgaggatcgtccagcaatgtcagaggttgtaagaatgttagagggagaagggctagctgaaagatgggaggaatggcagcatgtggaggtcaatacaaggcaagattatgagagactgcaaagaagaatgaactggggagaagattcggtttataataaccaagatgcagttgagttatcgggtggaagatga

SEQ ID NO: 2300 - DNA, 225 bp, Glycine Max; identical to SEQ ID NO: 85

SEQ ID NO: 2301 - DNA, 930 bp, Glycine Max
atggcaacagttatggacatgtacaatactagtagcatcatgataccagatttcttagaccagtgtagtgatcaagagctgatgaaagcacttgagccttttatgaaaagtgattcatctagcattacatacccttcattctcttccttttcttcttctcccaatttctcttcaacaacaagctacgagcaaaaggtttcaataactccaaaccatgctagttccatcaaactgaaccaactcaccccatcacagatgtttcaaattcaagcccgaatccaggttccacgaggccagtttctgagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactcatga

SEQ ID NO: 2302 - DNA, 1722 bp, Glycine Max
atggcaactcccaataacagactctctcttgccatggagagaactgggcaatgggttttctctcaagacataccaactgatgttatagttgaagttggagaaaccattttctctctgcacaagttcatgctagtggcaaagagcaactacataagaaaactgatattggaatcaaatgagggcgaactcaccagaatctacctctctgacataccaggaggcccttcaatcttcgagaaaaccgcgaaattctgttacggcgtcaacttcgagataactgtccacaacgtcgccgttttgcgatgcgccgcggagttcctccagatgacggatcagtactgcgaaaacaacctcgccggccggacggaggagtttctcacgcaggtcgcgttcttcactctaaccggcgccgttacggtgctcaagtcctgccgccacctcctcccctacgccgatgaaatcaacgttgtgaaacgctgcgtcgaggccgtcagcgccaaggcctgcagcgaggccaacttccccagccgctcgccaccgaactggtggacggaggagctcgccgtcctcgacatcgatttcttcggcaacgtcatcgtcgccatgaagcagcgaggcgcgaagcctctcaccgtcgccgctgcgatcatcacctacactgagcgcgctctacgtgatctcgtccgcgaccacaccggcaacggaatccggtacacagatcccggcgattccgattccagatccaaacaacggaagcttctggaagcaatcgtggatctattcccctcggagaaagccgcgtttccgatccacttcctctgctgcctcctccgctgcgcgatctacctccgcgcctccgccacctgcaaaaccgagctcgagaagcggatctcggaaattctcgagcacgtcaccgtcgacaacctcctcgtcctctccttcacatacgacggcgagagactcttcgatctcgaaagcgtgagaagaataatatcagaattcgtagaaaaagaaaaaggcaacgcggttttcaccaccgccgagttcaaagagccttgctccgccacgatgcagcgggtcgcgaggaccgtcgacacctacctctccaagatcgccgcctacggcgatctcagcatctcgaagttcaacggcatcgctattctggttcctaagaatgcgcgtaaggtcgacgacgatctctaccgtgccgttgatatctatctcaaggcgcatccgaagctggatgagatagagagagagaaggtgtgcagcgtgatggatccgttgaagctttcatacgaggcgcgtgtgcacgcgtcgcagaacaagcggttgccggtgcagattgtgctgcacgcgctttactacgaccagttgcggctgaggagcggggcggaggagcgtgacgtggagccggagaagaatcagcttcagatggacgtgtccttggtgagggagaacgaagagttaagaactgaactaatgaagatgaagatgtacatttcggatttgcagaataagaacactaataatgacgcgaaccctcaggtacatggaacgacgtcgtctgccacccccaagaaggccacgttcttctcttccgtgtctaagacgctggggaagttgaaccccttcagaaacgggtccaaggatacgacccatttggaagatgctagcgtggatttgaccaagcccagaaggagaaggttctctatgtcttag

SEQ ID NO: 2303 - DNA, 549 bp, Glycine Max
atggcaactggggtattcattaataaacccccttcacttcctccgtaccccgagatgattttggaggcaattgaagcactgaatgaagacaatggttctaataaatcatcaatttcgaagtacatagaatctacctacggtggattacctcagggccacaaggttttgctcaatgtgcacctcgcgaaaatgagggacagtggagtgttagtgttttggaagaacaactacaccaagcgtgacccaaaggcgccgccaaggcgtggccgtggcaggccacccaagcccaaggagcctctgccaccgggcactgtcttgtcaccgcccaggcccaagggccgtcctccgaaggacccgaatgacccagggaagccacctaaggccttgacagaaagtggcaggcccagaggccggcccaggaagatgacccggcccactggtggacttagcgaagcatcgccagcctccaaggtgaaggcttccaccagtgggaggcctagaggtagacctcccaaagtgaagcccgtgtttactgaaataagtgcttaa

SEQ ID NO: 2304 - DNA, 954 bp, Glycine Max; identical to SEQ ID NO: 86

SEQ ID NO: 2305 - DNA, 456 bp, Glycine Max
atggcaattgggtttatggaggtgcagcttgtgaaagcaaaggggttgtgtgacactgatttctttggtagtatggacccgtatgttgtgatacagtacaacggtcaagagcgaaggagtagtgttgctaagggacagggcaataatccggtgtggaatgagaaatttgagtttaaggtagaatatcctacaccaagtaactcatacaaggtcatcttaaaaatcatggacaaggattcgttatctgcagatgactttgttggtcaagccatggtctatgtggaagacttattagccataggggtaggggatggtgcagctgagctgcaacctctcaagtacagagtaattcgtgaagatcaatcttattgtggagaaattgatgttggtataacttttaaggttgaagaagagttcaatggagaaactaaacgaggaaggaaggacagcaactag

SEQ ID NO: 2306 - DNA, 464 bp, Glycine Max
atggcacacaaggaattttccattgccctagtgactctcattgttctctttgtcaacacgaacctccaaggtgccacggctgactatggtggtggttggcagagtgctcatgccactttctatggtgggggtgatgcttctggcacaatgggtggagcatgtgggtatggaaatttgtatagccagggatatggaactgacactgtggctctaagcactgctttgttcaacaatggcttaagctgtggatcttgctatgaaatgagatgtgatgatgacccaagatggtgcaaacctggctctattaccgtcactgctactaacttctgcccaccaaacccatctttgcctaacaacaatggtggttggtgcaaccctcctttgcaacactttgatatggctgaacctgccttccttcaaattgctgaatatagagctggaattgtgcctgtggccttcaggag

SEQ ID NO: 2307 - DNA, 1515 bp, Glycine Max
atggcacaggaatctggtatgttcatggttagccagacaattggcagtgttttgtgctgcaaatgtggaattccaatgcaacccaatgctgctaatatgtgtgtcaagtgtctgcgatcggaagttgatattacagaaggactgctgaagcgtcttgtgctggtgcattgccctgagtgtgagagttacttgcagccaccaagaagttgggtcaagctgcagctggaatcaaaggagttgctgacattttgcttgaagaaattgcagaagaatttgaattcgaataaagtgaggttggtgcatgccgagtttatttggactgagccccattccagaagggtaaaagtcaaggtcaaggttcagaaggaggttctgaatggagcaatacttgaacagtcttatcctgtagagtatgttcaacaagagcatatgtgtgaatcctgttctagggtccaggctaatcctgaccagtgggttgcttctgtgcaactcaggcaacacgtttctcacaggcgcactttcttttatttggagcagctgattctgaagcatggtgctgctgccactgctataagaatcaagcagatggaacaaggtattgacttctttttctctaatcgaagtcatggagtcaaatttgtggagtttatagggaaagttgctccagtaaggagccgtcacgataagcagcttgtttctcatgatccaaagagtaataactacaactacaaatatacattttctgttgaaatcagccctatttgccgtgaggatttaatctgtctgcctcctagagttgctgctggtttgggaaatattggtccacttgtgatttgcactaaggttactagcagcattgctttgcttgatccatttaccttgaggcactgtttcatagatgctgatcagtactggagagcatccttcaagtcgttacttactagcagacaattggtggaatatatagtgctggatgtggagactgtttcatctgaggttactatcggtggcacgaaatatcgtttagcagatgctcaagtggctcgtgtttcagattttggaaagaacgacaccatatttaacatcaagactcatctgggccatcttttaaatcctggtgattatgctcttggttatgatctgtatggggctaatagtaatgacatggaatttgacaagtacaaaggacacattcctgaagcaatattaataaagaagagttatgaagagaagcaccaaaagaagcgtgggaagcctcgttcatggaagcttaaatcacttgagatggaggttgatgataagggaagagttgatcaagataaaatggtctcagaatatgaacaattcattcaagatctggaagaaaaccctgaaatgaggttcaacatatctttgtaccgaaataaagagtacaagccttctgatggtgatgactcttctgttccattggaggagttgctggctgatcttgatctgagtgagcacgaagatgaagaggataacatgacggaatga

SEQ ID NO: 2308 - DNA, 411 bp, Glycine Max
atggcacgtacgaagcaaactgctcgtaagtccacaggaggaaaggcacctaggaagcagctcgcaaccaaggctgcacgtaagtctgcaccaactactggtggtgtgaagaagccacatcgttatcgtcctggtaccgttgctcttcgtgagattaggaaataccagaagagtaccgagcttttgatcaggaagctccccttccagaggctggttcgtgaaattgctcaggacttcaagactgatctgcgtttccagagccatgctgtgcttgcattgcaagaagctgctgaggcataccttgttggactctttgaggatactaatctgtgtgccattcacgctaagcgtgtaactattatgcccaaagatatccagctggcaagaaggattcgtggtgagcgtgcttga

SEQ ID NO: 2309 - DNA, 1020 bp, Glycine Max
atggcactgtccaaagaccaaagaattccacatgattcaagcatgagcagcaaggttcaaaactgtgttttcagtgagactagtgtggagattacctccatgactgttcatagggtcaatgagtaccacaaatctgtgttagaagaggaagatggctcacaaactactaatggtctcagcaatgattcagctgtaacacgttctcctcctttatgtggcagtcgcaaagattatgcttataagggcacaaactatcagcttgaagaagcagtatctctgattgatttcaaagggtatagcaatatcctgcaagctagtggatctttgcttagctttcagcagaacaagatggtccctctcaactgttacttgaaagataatggtcagaaagagtattgtgtttgggagaataatttgcatcaaggccacaaccattggaatcaaactagtccaagaagcactagagacatgcgcctggtagagaatctcaattgctttcaaacttctagtggctatagccccatagttaataatgcaaaagagaagcaacatggtcaaagttcatctgggtggctctactcagcaccaactatccctaatgatattagtagcctccacaagtcaggagcacaagaatcagttttgcaaaagcgcccttcgatgggagagaacatgaaagctgccaagaagcagtgctcaactgagagcaaaacgccaaaacataagtcaagcccatccaaggatcctcaaagtgtggctgccaagaaccgaagagagaggataagcgagcggttaaagatactacaagaactggtgcctaatggctccaaggttgatttggttactatgctggagaaagcaattagttatgtaaagtttcttcaactgcaagtgaaggtgttggcaactgatgaattttggcctgtccaaggtggaaaacctcctgaaatttctcaagtaaaggaagtcatcgatgtcattctttcatcacaaagagagagaagttcatgctcaaagtag

SEQ ID NO: 2310 - DNA, 819 bp, Glycine Max
atggcagaagcaggaagcagcattaacagaggagcaagatggtctctcaatggaacgacggctctcgtcaccggcggcacccgtgggatcgggcacgccatagtgagtgacttggccgcgtttggcgctgctgtgcacacttgctccaggacccaaacagagctcaacaaatgcttacaagagtggcagagtctgggctttcaggtaactgggtcggtgtgtgacgtgtcctcaccatcccagagagagaagctcattgaggaagtcacttccatcttgaatggcaagcttaacatctatgtgaacaatgttggaacaaactttagaaagccaaccattgagtacactgctgaagaatattcacagcttatgacagttaatttagactcctcattccatctgtgccaacttgcatatcctcttctgaaagcatctgaaaatggaagcattgtgtttatttcatctgttgctggtgtggtgagcttgggtactggagctgtttatgcagcaagtaaaggtgcaattaatcagcttacaaaaaacctggcttgtgaatgggccaaagacaacataaggagcaactgtgttgtaccatgggcaaccagaaccccacttgtagaacatgtgttgagagaccaaaagtttgtggatgatattatgtctcgaactccgattaaacgtatagcagaacccgaagaagtgtcatcgttggtgactttcctttgcttgcctgctgcttcttacatcactggacaggttatttgtgttgatggaggattaacggtgaatggatttcaacccagcatgagaattacctga

SEQ ID NO: 2311 - DNA, 3204 bp, Glycine Max
atggcagaccatcggaatggaagtgcccaagcagccaatggaaaggctagtgcggcaggaactgcctattccattgatctcaatgcatttcaaaccagactaaggtcattttataaacattgggatgctcacaaaacagatctttggggctcttctgatgcaattgctgttgcatgtcctccaccttcagaagatctgagatacttaaaatctactgctctgaacttatggttgcttggatttgagttccctgagacaattatggttttctcaaagaagcagatccatatattgtgcagccagaagaaggcttctattctcgaatctgtcaaaaaaactgccagagaggctgttgatgcagatcttgttttgcatgtcaaacctagaaatgatgatggaactgctctaatggatgctatattccgtgctctgtcaaagtctgatggtcgggatactcccactgttgggtacatatcaagagaggctcctgaagggaaattgcttgaaatgtggactgaaaaattaaaaaatacaaaatttcagttgaatgatgtggccaatgggttgtcttctttgtttgctgcaaagaataatgaggagcttacatcaattaagagagcagcatacctgacaacaagtgtgatgaaaaactttgtcgttccaaagcttgagaatgtaatcgatgaagagaagaaagtttctcattctacgttgatggaagacactgagaaagctatcctggaaccttctaaagtcaactgtaaactgaaggcagataatgtagatatttgttacccaccaatttttcagagtggtggagagtttgatctcaagcctagtgctgtcagcaacgatgagttacttcattatgactctgccagtgtgatcttatgtgctattggggcgcggtataagagttactgctcaaacatagctaggactttcttgattgatgcagaccctctccaaagtagggcctatggggttcttctgaaagcccatgaagccgttattggatcattgaagcctggaaacaggttgagtgccacataccaagctgctgtttctgttgttgaaaatgaggctcctgacttgatttcgtacttgacaaagtctgctggaacaggcattggtattgaatttcgagagtcaggtttgaatattaatgctaaaaatgagcagatagtaaaagaaggcatggtctttaatgtgtcccttggatttcagaacgttcaaagagaaagcaccaagtctaagagcaagcacttctccttgttgcttgctgacacagttatcataaacaaagataaaactgaagttgtgacctctatgagctcaaaggctctaaaagacattgcatattctttcaatgaggatgaggaagaggaaaatcccagtgctaaagctgatgccaatggtgctgagcccttgatgtctaagacaacgctaaggtcagacaatcatgagatgtcaaaggaggaacttcgaaggcagcaccaggcagaacttgctcgtcagaaaaatgaagaaactgcaagacgacttgctggtggtggaaatgagacaggagacaaccgttcctcttcgaggacatctgcagaactggtggcctacaagaacataaatgaccttccccctcccagagaaatgatgattcagattgatcagaagagtgaagcagttctcttgcctataaatggaagcatggtaccttttcatgtggctttcattcgaactgtttccagccagcaggacaccaaccggaattgctatatcagaattatttttaatgttcctgggacccctttcagccctcatgattcaaactcaatgaagttccaaggatctatatatttgaaggaggcttcattccgctccaaggattcgaggcacataagtgaggttgtgcagtccattaaaacactcaggcgccaagttgtagcaagggagtctgagagagctgagagggcaaccttggttactcaagagaaactgcaacttgctaataatagatttaagccaatacggttgtctgacctttggatccgtcctgcttttggtgggcgtggaaggaagatacctggtacacttgaggctcatgttaatggatttcgttattctactactaggcaagatgagcgggtagacataatgtttggcaacattaagcattcattttttcagccagcagagaatgaaatgattacactactgcacttccatctgcacaaccatattatggtagggaataaaaagaccaaggatgttcaattttatgttgaggttatggacatggtccagaatgttggaggtggaaagagatctgcctatgaccctgatgagcttgaagaagaacaacgggagcgagataggaagaacaaaattaatgtagaattccaaacctttgtgaatcggctgaatgatctctgggggcaacctcaattcaatggccttgacctggagtttgaccaacctcttagagagcttggcttccctggggtgcctcataaatcttcagtatttattgtacctacttctgcctgccttgttgaactgatagagacccctttccttgttgtcacgcttagtgagattgagattgttaatcttgagagagttggacttgggcagaaaaactttgatatgacagtagtttttaaggacttcaagagggatgtcctcaggattgattctatcccttctacatcactggatggcatcaaggagtggcttgacacaacagacatcaaatattatgagagcaggctgaatctgaactggcgtcagatcctgaagacaatcacggatgaccctcagagctttattgaaggtggtggttgggagtttctgaatttggaagctactgattcagaatctgagaactcagaggagtcagataaaggttacgaaccatctgatgtggaacctgaatctgattcggaggatgaagcttctgatagtgaatcacttgttgagtcagaggatgatggcgaggaagattccgaggaagattcagaggaagagaagggaaagacgtgggaagaactggagagggaagcaagcaatgcagatcgggagaaagggaatgagtctgacagtgaagaagataggaaaagaagaaaggcaaaaagctttggtaagtcaagaggagccggtctaagtagtagcatgacaaagcggcccaaaattcatagggatgagtaa

SEQ ID NO: 2312 - DNA, 684 bp, Glycine Max
atggcagagaattccaacggcaatggcgtctacgtcgatgaagaagaagaagaagaagaaataaagttgaagcagaaaaagcaaagactgaaagagaccttgccggaggtccttaaccgcatcgcctccgccattctcttccaggaacccgccgatgccggatccctacttcgccggatcaaggtctccgtcgccgacaacgctactctcctccccgaagcttccagaaactccgcccgcgacgttctcatctggactcgccgcggcactcccttccgcgcgctcttcgtcatctcggttgggacggtcacttttgttgctttgacagggctgcttgtgtttatgcttttctttctagctgcgaccgtaaatgccattgtcatatcgttactgatgtctttggcagctgcaggaggattcctggctcttttctttgcttttgttacagctatatacattggagcattatcaattgccatatttgctatttcagttaccacattttgggcaattgtggctattctgatgatcacaggctggattggattcatttacactgtgtggctggtaactagaaaaagctttggatttgctaaacactccttggacgtgaccggctctgcaatttcatcttacactactgcacggcatgcccgctaccaaatacacacgaattcaaagtag

SEQ ID NO: 2313 - DNA, 426 bp, Glycine Max
atggcagcaatttacagtctttacatcatcaataaatctggtggattaatctattataaggattatgggtcagctggacgaatggataccaatgacagcttgcgggtggcaagtttatggcactcaatgcatgctatctctcagcagttatcacctgtttcaggttgtttaggaattgaacttctccaagcagatacatttgatcttcattgctttcaatcactgacagggacaaaattttttgtggtctctgagcctggagcacaacacatggagagtttattgaaatttgtctatgaattgtacaccgactacgttttgaagaatccgttctatgagatggagatgcctatacgttgtgagctctttgatatcaacctaacacaggcagtacaaaaggatcatgtcacatttttgggccgataa

SEQ ID NO: 2314 - DNA, 354 bp, Glycine Max
atggcagtgaataaggtaacattggttgcttcagtgatggcttgcatgctcataacatgctcttatgctgaatcaaccttgtcatgtgaccaaatcactatatggctcactccatgcataccttatggagtgttaggagggaacgtgtcatccttgtgctgccaaggtgtttactctctcaatgctgcatataagagtgctgaggatcgaagaggtgcatgccaatgcattaaggatagggcggcatgcattcctggcattgactacacgcgtgtcaatcaagttggtccaagatgtggctctaagtgtcccttcaaagtgtacccttccactaactgctcagcgattgattaa

SEQ ID NO: 2315 - DNA, 426 bp, Glycine Max
atggcatcgaaacgcatcgtgaaggagctcaaggatttgcagaaggaccctcctacatcctgcagcgcagaaaattgcagacaaacgcggccattactcgaaatcacggtcccgtggcggaggatatgtttcactggcaggcaacaatcatgggacctcctgatagcccatatacaggttgcatttaggactaaggtattccacccaaacatcaatagtaatggaagtatatgccttgacattctaaaagaacaatggagcccagcactaaccatttctaaggtccttttgtccatttgctcattgttgacggatcccaaccctgatgacccgcttgtgcctgaaattgcccacatgtacaaggctgacaaggctaagtatgaagccactgctcgtagctggacacagaagtatgccatgggataa

SEQ ID NO: 2316 - DNA, 846 bp, Glycine Max
atggccaaaacaaaactaaccttattaataatctccttcttcaccactttttctgttgtttgtctctcctcccccgcggattttttcctctatggcgggtgcacgcagcagcgttacacctcgaactcgccctacgagtctaacctgaactcgctcctgacctcgctggtgaactcggccacctactcttcctacaacaacctcaccgtggtggggtccagccagagcgacgccgtctacggcctctaccagtgccgcggcgacctcgccatgcctgactgcgccgcctgcgtctcccgtgccgtctcccgcgccgggcagctctgcccagcaacgtgcggcggcgcggtccagctggacggctgcttcatcaagtacgacaatgtcacattcctgggtgtggaggacaagaccgtcgtgctgaagcggtgtgggccctcggtgggattcgggccggtcgggtcgggtgagagggatgcggtgatgggcgggttggccggttcgggcgggtatttccgggtcggcgggtcgggtgatgtgaagggtgtggcgcagtgttgtggggatttgagtttcgccgagtgtcaggattgtgtgggggatgcgatccgacggctgaggagtgagtgtgctgctgcggattatggggatgtgttcttggggaagtgttacgctagattctccaccaatggtgcacatgcttacaattacaacaaggcccatggaaaatcgggcaatgaaggtgagaagacatttgcaataattgttggattattagcaggagtagctatactcattattttccttgctttcctgagaaggatttgtgagggacacggtaaataa

SEQ ID NO: 2317 - DNA, 1947 bp, Glycine Max
atggccacaaaccttggaaaatgtcagcaagaagagtttttcttcaacgggtttggtggtggtggtgcctccaacataaccttaaacggaggagcagcgattgagcacaagggcctacttcgtttaacaaacgacaatcagagagtaatcgggcacgcgttttatccaacaccaattcagttcaagcacaaaaacgccaaagttgtatccttttccaccgcttttgcgtttgcaatcatcccacagtacccaaaactcggtggccacggtttcgccttcaccatttcacgctccacatcgcttaaagatgcgtaccctagccagtacttgggcctccttaacccaaacgatgtggggaatttctcaaaccacttatttgcagtggaattcgacaccgtccaagacttcgaattcggagacatcaacgacaaccatgtcggcatcaacctcaacaacatggcatccaacaaatccgtggaagctgcgtttttttcccgaaataataagcaaaacctcaatttgaagagtggtgaagtgactcaagcatgggttgattacgattccttaaaaaacaacttagaagttagactctccacaacttcctccaaacccacttcaccaattttgtcatacaaagtagatctctcaccgattctccaagattccatgtacgttgggttctcctcttcaacagggttactcgcgagctcccactacatcctcggttggagcttcaaaacaaacggagacgccaaaactctctccttgaaaaacctcccttcgctctccgcctcctacaaagctcaaaagcgcttaatgttagcactgatcattccaattacactcgcagcaattgctctagcatgttattacagaaagatgagaaagaccgaattgatcgaagcttgggagatggaagttgtagggccacacagattcccatacaaggagctacacaaagctacaaaaggcttcaaagaccagaacctcatcgggttcggagggttcggtcgtgtctacaaaggtgtcctcccgaagtcccacatcgaagtcgcagtgaagcgagtctcgcacgaatcaaaacaaggcatgcaggagttcgtgtcggaaatctcaaccataggaaggctccgacacagaaacctcgtacagttactaggttggtgtcggaaacaaaacgagctattgttggtctacgatttcatgcgaaacggaagcttagacaaatacctattcttcgaccaaccgaggagaatacttagttgggagcaaaggtttaagataataaaaggtgtggctttagggttagtttatttgcacgaggagtgggagcaaacggtgattcacagagacgtgaaagcggggaatgttttgttggacaacgagatgaacggaaggttgggtgattttggtttggccaagctttacgagcacggtgcgaaccctggcaccacacgtgtggtgggaacgctggggtatcttgcgccggagctcacacggacggggaaaccaacgacgagttctgatgtttatgcgttcggggcgttggtgttggaggtggtgtgtgggaggaggccgattgaggtgaaggcgcagccggaggagcttgtgctggtggagtgggtgtgggagcggtggcgcgtggggaacgtgttggcggtggtggaccgtaggttgggtggggtgtttgatgaggtggaggctttgttggtggtgaaggtggggttgttgtgttccgcggaggcgccggaagagaggcccagtatgaggcaggtggtgaggtacatggagagggaggtggcgccgccggaggtgggggatgggaagaaagaaggtggcgggggagatggggagtttaagggttatgttcattcgtattcgacggcgtcgttttttgacgtggagagtgcatctgcgtcgtctctgtcactttccggtggccggtag

SEQ ID NO: 2318 - DNA, 477 bp, Glycine Max
atggccacaggaaagctgaaactcacattcgtagccaacgattctcaaagaaaaacagtatgcaagaaaaggaagcagtcactgctgaagaaaacggaggaactcagcaccctttgtggcattgaagcatgtgctatagtttatggccccaatgatcatcggccagagatctggccatctgaatcgggtgtcaaaaatgtactgggaaagttcatgaacaagccacaatgggagcaaagcaaaaagatgatgaaccaagagagtttcattgcacaaagtatcatgaagagtaaagacaagttacagaaagttgtgaaggaaaacaaggagattgaaatgtccttgttcatggctcagtgctttcagacaggtatgtttcagcctgatatcaatatgaccgcagctgatatgaatgttctttcatcggagattgaacagaacctgaaggacattgataaaaggatggaaatgctgaaa

SEQ ID NO: 2319 - DNA, 1671 bp, Glycine Max; identical to SEQ ID NO: 87

SEQ ID NO: 2320 - DNA, 771 bp, Glycine Max
atggccatgctcaatatcatctccattctctctctcttactcactcaatcccacgccaaaatacccggcgtctattccggtgggccatggcaaagcgctcacgccactttctacggtggcagcgacgcctcaggaactatgggaggagcgtgtgggtacgggaacctatattcccaaggctacggtgtgaacactgcggcactaagcactgctttgttcaacaacggtttcagctgtggagcgtgtttcgaaatcaaatgcacggatgacccgaaatggtgcaaccccggtaacccttccatcttggtcaccgccacaaatttctgccctccaaactacgctctccccaccgacaatggcggctggtgcaaccctcccaggccgcacttcgacctcgccatgcccatgttcctcaaaatcgctcagtaccgcgccggcatcgtccccgtctcttatcgccgggtggcttgcaggaaacagggagggatgaggttcacgatcaacggcttccgttacttcaacttggttttgatcaccaacgtcgcgggtgcaggggatatcatgagggcgagcgtgaaagggtcaaagacagagtggatgagcatgagccgcaactgggggcagaactggcaatcaaacgcggttctggttggtcagtcactctcctttagggtcacaggcagtgaccgacgcacatccacctcgtggaacattgtcccacgtaattggcaatttggccaaaccttcgcgggaaagaattttagaatctaa

SEQ ID NO: 2321 - DNA, 1323 bp, Glycine Max
atggccattgcaccttttggtaatacatcagctactcaatggggaattcatcctcagattttcgcgggatcgactgggttgggaaagattgcatcatccaggaacaatgttacaagcaggataaggtttatggttgccccatgttcgagctttttttcttgtcattccttgcatgcactatttgacaaaggttcatcgcaaactttgcaacatcgcaggggatcgaggttaatagttagagcagatgcagattactattctgtactcggggtgtcaagaaattccagtaaatctgaaattaagaatgcttatcggaagcttgcccggagttatcatcctgatgtgaacaaagaacctgatgcagaacagaaatttaaagaacttagtaatgcatatgaggtcttgtcagatgatgagaaacgatccatatatgacacatatggagaggctggacttaagggttcaggaatgggcatgggggatttcagcaatccttttgacctgtttgagacactgtttgagggcatgggtggcatggggggaagcagaggatcttggaatggagcagttgagggcgaggatgagtattacagtcttgttttgaacttcaaagaagccatttttggggtggaaaaagagatagagattcggcgattagagagctgtggaacctgcaatggtttgggggctaaaccagggactaaatcatccaagtgtagcacttgtggtggtcagggtcgggttgtcacgtcgacaaggactccattaggcatctttcagcagtccatgacatgctcttcttgcagtggaactggagaaacttcaacaccttgcagcacatgtgctggggaaggtcgagtgagaaagacaaagcggataagtctcaaggttcctgctggtgtggattctggcagccgtttaagggtccgaaatgaaggtaatgctggaaggcgtgggggttctcccggtgacctctttgttgttcttgaagttatccctgaccccgtgcttaagcgagatgacacaaacattttatacacatgcaaggtgtcttatattgatgcaatattggggacaacaattaaggttcctactgtggacggcatggtggatttaaaaatcccagctgggactcaaccaagctcaacacttgttatggctaagaaaggtgttcccttgctgaataaaaagaatatgaggggtgatcaattggttcgggtgcaagttgaaatccccaaaaaactgagcaaagaagagagaaaacttattgaggaactagctgatttaagcaaaggcaagactgctgccaccagtaggagataa

SEQ ID NO: 2322 - DNA, 582 bp, Glycine Max
atggcccggaaaaaggtgaaactagcattcatagccaacaattctaaaaggaagacaacatacaacaaaaggaagcagtcactgctgaagaaaacggaggaactcagcaccctttgtggcattgaagcatgtgctatagtttatggccccaatgatcctcggccagagatttggccatctgaatcgggtgtcataaatgtgctgggaaagttcaaaagtatgcctcaatgggagcagaccaagaagatggcgaaccaagagcgtttcattgcagaaagcatcgtgaagggtaaagagaaattgaagaagcttgcggatgagaacaaggagaaggaaatgtccttgttcatggttcagtggcttaaaacagggaaagttcagcctgaacataacatgaccatggctgatttcaatgttctttcatcgatgattgatcaaaatctaaaggacattgctaaaaagatggaaatgctgaatgttaatgaggtgataccaaaccaaccccagatgcaaaccccagccattccaaaccctgatgcaagcaccagcattgacaataatgtctgcatttggaagtgctaa

SEQ ID NO: 2323 - DNA, 411 bp, Glycine Max
atggcccgtacaaagcaaactgctcgtaagtcaactggaggaaaagctcccaggaagcagcttgcaaccaaggctgcacgtaagtctgctccaacaactggtggtgtgaagaagcctcatcgttatcgccctggaactgttgctcttcgtgagattaggaaataccagaagagcactgagctcctaatcaggaagcttcctttccagaggttggttcgtgaaattgcccaggatttcaagactgatctgcgtttccagagccatgctgtgcttgcattgcaagaggctgctgaggcataccttgttgggctctttgaggacactaacttgtgtgccattcacgccaagcgtgtgactattatgcccaaggatattcagctggcaagaaggattcgtggtgagcgtgcttga

SEQ ID NO: 2324 - DNA, 411 bp, Glycine Max; identical to SEQ ID NO: 2323

SEQ ID NO: 2325 - DNA, 312 bp, Glycine Max
atggcccgtacaaagcaaactgctcgtaagtcaactggaggaaaagctcccaggaagcagcttgcaaccaaggctgcacgtaagtctgctccaacaactggtggtgtgaagaagcctcatcgttatcgccctggaactgttgctcttcgtgagattaggaaataccagaagagcactgagctcctaatcaggaagcttcctttccagaggttggttcgtgaaattgcccaggatttcaaggtattgcttgtttttttttttttttttttatcaatattgaaaattgtacaattggatcgtaactcaatctaa

SEQ ID NO: 2326 - DNA, 450 bp, Glycine Max
atggccctcaccctctatatcttccccattgctacagcaacattccatgtcaagggttccgtttattgtgatacctgccgtgctggattcgaaaccaatgccaccttttatattcgaggtgcaagggtcggaattcagtgcaaagagaggaagaccatgaaggtagctttctactctgagggtgtgacggactccacgggaacataccacattgaggttgaaaatgaccaccgtgacaatatttgcgaatgcttgcttgttaaaagccctatcaaatggtgtagcaccccagactctggacgtgacaaatccagcatagtactaacccactaccaaaatggcatagtcaaccatcttcactatgcaaatgctatgggttacttgagggacgaacccttgcctgaatgccacaaactgcttaaatactacttggcagactcagatgtttga

SEQ ID NO: 2327 - DNA, 1320 bp, Glycine Max
atggccgaatctcgagacgccgccgccgccgccgccgatggggttcccggaacgcccgccataagggaagtgagacccgagtcgggaacccatgcgggaatcgggtcgggtggtattcggagggttaatttccgagcggagattgacacgtcgccgccgtttgggtcggtgaaagaggccgtgacccgttttggaggtagcggtccttggataccctattttaacaacattgaaaattttgacttaaagaaagtagaggaacaagcagcagagttggagaaggatttgattgtcaaggaacttgaaacgcttgacgtgcttgaagaattaggagctaccaagaggattgtggaggacttgaagcagcagttacaaaaggaggctatgaaatgtttagcaactcgagatgtaaattcatatgaagaagctggaactcctgttattaaggagaaggatgaggaaaattgtggaaatattgtcaatgatgaagaacagttgaaaaaagccaaattgaatctaggcaaaactataaatgaacttggggtgatacaatcctcgattgaatctttgaataagaagatgaagaaggagaaaaattttctggagaggacacagacaagaagacctgaaccttcaaagcccttaagtgtatatgaagaatatggatttagtgttaaaactgctgagataaggtggcttgcggctaaaaagatggaagaagctgcaagggcagcagaagctattgctcttgctgaaatcaaggctctatctaatgcccagagatctttaggatttgttctgccagaacctgagaaagtcacttttgcttttggagagcgctctcccctaaaccccaaggctcagatacccaaggagtcaaccttgaagaaggtaatagattccaagtttcaaattgatgaaacaaaaatttctaagctgacaattttgaagaacactattaattgcaacaagtttaatcaaactggaatttatcaagattctctgcaggatgtaaccaggtcaacaacagcaaacaatgatccaaagcctgctttaaggcccacaatttcaatgagagatgtacttagcagaaagcaggttcctgaaggatatgctacaagaaaggagatggaagagcacactgaacggcaaaaggtagcgttgagtcaaatgcttcaagcattgagggaagatctaactcttccaccaaagactgagaaagatgggaacaatcagaagccgtacgtagcacagaggaagaaatttggattcattcaaatatcactccccttggcaaagccaaataagaaaaggggatga

SEQ ID NO: 2328 - DNA, 972 bp, Glycine Max
atggccgatcactcagattcttctcctcttgttcctccccttcccctcgctgacccttccgagatcgacctcgaagccggtccctccgaacaaatccagtgccgaatttgtctcgaaactgacggtagagatttcatagccccttgtaagtgcaaaggtacatcaaaatatgtgcatcgagaatgtttggatcattggcgagcaattaaggaagggtttgcctttgctcactgcactacgtgcaaggctccttatcatttgcgtgttcatgttgccgctgataggaaatggcgtaccctgaaatttcggttttttgtcaccagagatattttgtttatttttctgtctgtccagcttgtcattgcttcactggcatatttggtttatctaatagatggttaccagcaatattggcttcgtcttctctggggttttgatagtgaaatgagcttttactatatatgtggagctctattgtttttcgccttgcttggcctttctgggtgcttcattacctgctatgatcgaagagtacgcaatgatttagctcagccttgtagagaactatgtctttgttgctgtcaacctggagtttgtgcagactgtcatttgccaggcactctttgtatgtggactgattgcaccacatgctttgagagttgtggaaccatggcaactgaatgtggtggttgtttggggggtgctggggaagcagggctaccattattattcattatggctttgattgttctgggactttttactgtaattgggatattctacagtgtattggttgctaccatggtaggtcaacggatatggcaacgtcattatcacatacttgcaaaaaggatgttaacaaaggagtatgtggttgaagatgttgatggagagttgacaggatcggattggtctcccccggctcttccacccgagcatattcaacagttgaaaacattaggcctactatga

SEQ ID NO: 2329 - DNA, 870 bp, Glycine Max; identical to SEQ ID NO: 88

SEQ ID NO: 2330 - DNA, 630 bp, Glycine Max; identical to SEQ ID NO: 89

SEQ ID NO: 2331 - DNA, 708 bp, Glycine Max; identical to SEQ ID NO: 90

SEQ ID NO: 2332 - DNA, 1569 bp, Glycine Max; identical to SEQ ID NO: 91

SEQ ID NO: 2333 - DNA, 909 bp, Glycine Max
atggcgaatagatggtgggctgggaatgtgggaatgataagagagcaagagttgatggaaaacagcaacaacaacaacaacaacaacaacgctactactactacaccgacgaatagcagcaacagcaacactaacgcgaacaccaacaccaacacgaccgaggaagaggtgagcagggataacggagaggaccagaaccaaaacctcggcagccacgaagggtcggagcccggaagcagcggtcggaggccacgtggcaggccagcggggtccaagaacaagcccaagccgcccatagtcataactaaggaaagccccaacgcgctccgaagccacgtcctggaaatcgcctccggcagcgatgtcgccgagagcatcgccgccttcgccaaccgccgccaccgtggcgtgtcggtcctcagcgggagtggcattgtagccaacgtcactctccgccagcccgccgcccccgccggcgtcataaccctccacgggaggttcgagatactctccctctcgggtgcctttttgccgtccccctcgccgtccggcgccaccggactgaccgtctacctagccggcgggcaggggcaggttgtcggcggcaacgtggcgggctctctcgtcgcctccggaccggtgatggtgatcgccgccactttcgctaatgccacttatgagaggttgcctctggaggatgatcaaggtgaggaggaaatgcaagtgcagcagcagcagcagcagcagcaacagcagcagcagcagcagcagcaacaacaatctcaaggtttgggggaacaggtttcaatgcctatgtataatttgcctcctaatttgctacacaatggtcagaacatgcctcatgatgtgttctggggagctccacctcgccctcctccttccttctga

SEQ ID NO: 2334 - DNA, 885 bp, Glycine Max
atggcgaatcctgaaggcagtagcagaggctcaagatggtcccttaagggaaccaatgctctcgttactggaggaacacgtggaatcgggcacgctgtggtggaggaactagcggagtttggtgccacagtgtacacttgttccaggaatgaatcagagttgaatgcatgcttgaaggagtggagcagaagggattttcggtttctgggttggtttgtgatgcgtcttctccaccccaaagagagaaactcattcagcaagtggcaactgccttcaacggcaagctcaacatacttgtcctataccctgatgcaactcagtggctctctgcctgtgtttaggatagttggcaggataacctgtgtgtccagctttatcgatgactgtttagtttatattgggatatcagttactgaatatgttagagatcgatcttatgtaaacaatgttggaacaaatgtgaggaaaccaacaattgagtatacagccgaagaatattcaaaattaatggcaactaacttggactctgcataccatctgagccaacttgcttatcctcttcttaaagcatctggaaatggaaacaagcttatgctgcaactaaagcttaccaaatatcttgcttgtgaatgggcaaaagacaatataaggagcaacagtgttgcaccttggtataccctaacatcacttgaggaacctttgcttgcaaacaaacagcttgttaatgagataacatctcaaacgccgataaagcggatggcagaaacgcatgaagtttcatccttggtgactttcctttgtctgccagcagcatcctacatcactggacagattgtttctgttgatggaggattcactgctaatggatttcaacccagcatgaga

SEQ ID NO: 2335 - DNA, 8235 bp, Glycine Max
atggcgacggcttcacaagctcgagctgttaagtctctcaacaagtcccctggaggacgccgttttgtctttaagtcattctcggatagagtagatgagattgatatcaatgtatatcgaagtcttgataaggtcaaagccgagccatccgagggttcttcttttttcagagactgccttatagaatggagggagttgaacactgctgaggatttcatttcattatatgaagaaattatgccttatacacaaacattgcccctggtgctgttgcacaaggaatctttaatatcaaagcttctttctaggttgcacataaaagcaaggctatcccttgaaccaattctcagtggtaacaataaatcatattactttgttttgaaaaacttggacatgctgttgccaataaatctcaaggctttgttttacaggttaattgcagctttatctagggatctcctagaggaatttgttcctctattgccaagaattgttgattctttagtctctcttcttgagagtggtggtgatagggagccagatatcattgagcagatattcatgtcatggtcatacattatgatgtatctgcaaaaatatcttgtacgcaatccatcagaggtgctcaaggtcacgtcaaaattgaggtattatccaaaagaatatgtccaacaattcatggcagaagcaatgtcatttgttttgaggaatgccccagatgagcagctcaaaagaggaatccgaagagtaattgatgatgcagtgaagaagccatctctgtgtagagagtcaggtgttgaagcattggtttttaatattatgaaaggtcactcatccaggttccattcaaaagcagagcgagtgttacagttgttgactagtgaagcaatttatcctattggtgataaagctgaccaagattcaatgatcattctgaaaattgttaaatctgtcttcaagaaactatgcgagaagatggagtctaaggagttggatttggtatggaattgcatatataaggaagtaaatgaatgtcttaatactggaaatagcaggcacctacgacatattttatcagtgcttgtctcggctataaaggtgcaaaatgggcaaaaggtgtctgattataagcctatgctggaactagttctgctgctagtgcagacatttatcaaaccttgtggagttattgattcacaggaagatatatatttagttgttgataagattttgaaattaatgttggccattctcaaagggctctgtaattgcaatacctcaatgatatcagagtgtgctttcaagtgggctccgatttttgaatcacctccaatttttaaatcagcaagctctagtttgctgcgtttcattagagaactgctacaggagaatctttgtttacttcatttcagaagaaatgttataagtgcaatgaatgatttgatggagatttcagaggaagaggtcatacatttgttacgatctttctgtgagaaaatgcaattggataaacagaactcagattttgtagatggaacaagtgaagaagcaccactgactagaatttgcagtcgtttacaagagataatatgttgttggaagggaaaaataaatgatattgcacatgctgatgtattatgtcaaattgatgaaggagtgttggcactgctgtggggagctgttagttgctatgctcatatgtgtattgttggtgccaatccgtccttgatggtggagcttgtggatgctgtagataattttctgactgtgaaatctgactgtattggagatatgtctaaaaaggcctgggaaagcattataggggctgcattaagttctttcaacagattgtacagcaacagtaaccatggagctgatgaaactggaaagtttttaagtcttgcaaaacgatataaatcatctccacaagtgttgtttgctgttgctggttatttggaattcaagcatggttctttgttggaagacgctgtgtatagaatttatcatccagagcttgaagaaaagactgcagatgcagtggcaacattttctgataatttacatcattcagacaaggagattcgcatttcaactcttaaaatactttgtcactataaacctttgggttgggaaaattcttcagtggatcagccagttgctaagaaaaggaaaactgaagtttctccaactctaaatgtcgaatgcacagaaaataatgctctgctgttgctcctttctattgaaacaactcctatttcaatttcttcaagcagaagcattcagctattcatttccaaaatacagatggaactatctgctggaaggattcctaatgtttatgtgcctcttgttttgaacggattgtttggcatcttgaataatcgatttagctacttatggaatcccgtattagaatgtattgctgtcttgattagcctacattttttacgtgtatgggatagccttgttgcttatctagaaaggtgccaaacaatttttgataccccttctaacttgcacgggagtgtcaatggtgcattgtttgatcagccagctggtttagttgattgtttcaaattgtttgtctatcatgcatctgatagcacaccatctgtaacaatattagcattattgctgcaagctttgcaaaaaattccaactgttattgaacctcgctctcggcaattcattcctttatttttgaagtttttgggatatcctgatcttgtaagtgtgggattgtttgattctcatgcttgtaaagggaaagagtggaaggccatcttaaaagaatggttaaatttgttgaagctgatgaaaaatcccaagtcattttactgtggccagtttcttaaggatgttctgcagcataggcttttagaagaaaatgatactgaaatacagatgagagttttggattgcctgttaatctggaaggatgattatattttaccatatgttgaacatttaagaaacttgattagttcaaaaaatttaagggaggaactgacaacatggagtttatcgagagaatctgaaataattgaagaatgccaccgggcttatcttgtgccattagttatccgtcttttgatgccgagagtaagaaagttgaaaggacttgcatctcgaaagaaagcaagcatttgtcatcggaaatctattcttagtttcatagctggacttgatgttgttgagctgcctcttttctttgcactactgataaagcccttgcaaatagtgaagaaaactgatgggcctgctaacttgttttggacttcagataaagtttctattgatgaatttcaagctgatgctttgttggaatattttactttggacaatatagcaaacctatcctggaaaaagaaatatggttttttgcatgtcattgaagacattattggggtttttgatgaattgcatatcaggccttttcttgatctactggtggggtgtgttgttcggttattggagagctgcacttcaagtctccatgcaaatttgaatgggcttccttcagatcagcacaattgtagcactagctcaaattctcttggggaggacagtgtgccaacaaaccaaacccagattaatggtactttgaaccagctgaaggatatgagatctctgtgcctgaaaattatttcccttgtactcaataagtacgaagatcatgaatttagttctgatttgtgggacagattcttttctgcagtaaaaccgctggttgataaatttaaacaagaggctgctagtagcgagaaaccaagttcactgttatcttgctttttggccatgagtgcaaacaataaacttgtagcactattatacaggaaagaaagtcttgtacctgatatattttccattatctctgtcaattcagcttctgaagctgttatatattgtgttctaaagtttgttgaaaacttattaagccttgacaatgagtttaatgatgaagacaattctgctcaaagagttttactttcaaatattaaagtactgatggacagcatgtgctgtttatttggaagtgataatgcaatcaagagaaagctgatcaaatctcctggtgagacagtaataagaattttagaatttttgcccaagtacatcagcgaggcagagttggcaaagcagtttgtggacatattgcttctgttcttggaaaataaaactcaaaattctgatgttagggttgaagctttgcaagtcattcaaaatattataccgatactaggacatggaagtaccgctaaaattctaagtgctgtttctcccttatatatttcggctgagttggatatgcgtttgagaatatgtgatcttcttgatgctcttgtagcttctgatgcatctttactctcagtggcaaaacttcttcgacagctgaatgcaacatctactttgggttggcttgatcatgatgccattttaaatgcttacggaatcattaatactgatttcttcagaagcgttcaagtggagcatgcattacttattttatcacattgtgtgcatgacatgtcatcagaagaaacaacttttatgtttagtgcatatagttcattgctgtcttttgttgatttttctgctcatatcctttgccaagaaggaaacagtgaagaacagttgtcagtgatgagaaacactgatagttgttggacaaaatcttgcatccagcgtacagcaaagaaatttctcttgaagcatatggcagatgcgatggacggatcactttcagttataaagggatggataaaattgttacatcaaatggtgttgaagcttccggaagtgtcaaacctcaaatcacttatggtcttgtgcaatgaggatggtgaagtgaatttttttgacaatataactgactcggtgatacgtaagagagtcaaggcattgtcttggtttcggaatgttatcagtgtgaacaagttttcagagttcatcactgagaaagtgttcatgcgactcttcttcaacatgttgtatgatgagaaagaaggaaaggcagaacatatgaaaaatgcatgcatagaaaccattgcttctgtatctggtcagatgggatggaagtcatactatgcattattgatcagatgtttttggggtgcatcccgtagtccagacaaacagaaactcttcatacgcctgatttgcagtattttggataaatttcacttttcagaagttcctcacaataaagaacctaaggaatctttgggtggagtttctgacatggatataactgatactgatgtgaacaaagagatacagacatgcctgtataaagttgtgcttccaaagatacagaagttactgaattctgattctgaaaaagtcaatgtaaatatcagtcttgctgcactgaagttacttaaattacttccaggagatgtgatggacttgtatcttccaacaattgttcatcgaatttcaaacttcttgaagagccatctagaaagcattcgtgatgaagccaggtcggcattggctacttgtttgaaagaacttggattggaatacttgcaatttattctcaaggttttgcaatctaccttgagacgaggatatgaacttcatgtcttaggatacacgcttaattttattttgtccaagtgtctttcaagtccagttgctggaaagatagattactgtttggaggatctgctttctgtgatagagaatgacattcttggagatgttgctgagcaaaaggaggtggaaaagatagcttcaaaaatgaaagaaacaaggaggaaaaaatcatttgaaagcttgaaattggtggcccaaaatgtaacattcaaaagctatgcactgaagctccttgcaccagtgactgctcatttgaagaagcacatcacaccaaatgtaaaaggaaaattggaaaatatgttgcaacatatagctactggtattgaaagcaacccctctgtagatcagactgatctatttatatttgtttatggcattattgaagatggattaaatgacgaaattggttggcacgagaataaattgttgaaattggaaggcaaagatagccgtattaatgccaaaagaatttctacaggccatgtagttgctaatggcttattgtgttcacaccttattacagtgtttggtctcagaatatttcataagcgaatgaagagtatgaaacaggatgtaaaagatgaaaatactttatccttattagacccttttgtcaagctattatgtgatggcttatgctctaagtatgaggatatcttatctacttcccttgggtgccttgctatactggtaaagttgcctttaccatcccttcaacaacatgctgagagagtaaaggctgctctgttggatattgctcatggttcggtgaactctatcagtcctttaatgcagtcttgcttgactttgctgactgtgcttttgaggaacactaaaatttctctcacctcagatcaaataagtttattaattcatcttcctatatttcttgatcttgaaaaaaatccatcgttggtggccctgtcacttctaaagggaattgtcagtcgcaagatggtggtacctgagatatatgatcttgttactacggttgctgaactgatggtgacaagtcaaatggaacccgttcgcaaaaaatgcagtaaaattctgttgcagtttctgcttgattatcgactttcagagaaacgcttgcaacaacatcttgatttcctgctctcaaatttgaggcaagtgtatgaacattcaactggacgggaatctgttcttgaaatgattcatgctattattgtcaaatttccaagaagtgttttggatgaacaatcacatatattgtttgtccatttggtagcgtgcttagccaatgacaatgataatattgttcgttctatgagtggggctgctataaagaagctcattagttctgttagtcctaattcacttaaatctattcttgagtatgctctttcttggtatttgggtggcaagcagcaactatggggtgcagctgctcaggattgtcacaggaatctttctccacaaagtaagaaactggaggaaagacttgctttggttctggggctgctgattgaagtaaaaaagaaaggatttcaggaacatataaattgtattttgcctgtgactaaacacatcttgcattctgccgtagatgcagttactaacaggcaagagggcttttctgctgaatctgccattccgctttggaaggaggcatactattctcttgttatgttagagaagatgattaatcagttccgtgatttatgctttgcaaagtatcttgagacatttcaggatatatgggaagcaatatctgagatgctgttgcacccgcattcatggatacgcaacagatcagttcgccttgtagccctatactttgcacgtgcaacagatgttagcagagaaactaatggaagctccttaagaagttattttattatgagtccaagtagactatttttaatagccacttctctttgctgccaactaaaaatgccattcataaatgatgctgacagcagcctgatgacccagaatattgtctttgctatctgtggtgtgcattctttgatggggcaaaatgcatgtatagatccccctgcattctggtctactcttgagcaacaagaaaaggatcggtttcttaaagcttttgacttgcttgattcaagaaaaggaagaagcatgttcatgtcctcatctttctcttctatatatgaagataacaatcagctgaatgttgacaatgctcaacgtgcactagtctcattattgctccggaaaatggggaagattgccctccaaatggatgttattcagatgggaatagtcttcaacagttttgggaatattatggcgcagattagtcaggatgactgccaacactatgcacacgtgatcttgttgcctctatataaagtttgtgaaggatttgcgggaaaagttgttactgataatgtcaagaagttggcagaagacacctgtaaaaaactagagaatattttgggtactcagaactttgtgcaagtttacaaccttatcaggaagaaccttaaattgaaaagaaataagaggagacaagaagaaaagctcatggccgttatcaatccgatgcgaaatgccaaacggaagttaagaattactgccaagaatcgtgctaacaaaaagagaaagattacgacaataaaaatggggaggtggatgcgttga

SEQ ID NO: 2336 - DNA, 4191 bp, Glycine Max
atggcgactgcgacggaatttggggtatcgcaattcttgaagggtacctccaggcaaactctgtttttgaagaagaagcctcagaggcagaaaagtcgcatgctttggggtgcactctggaatcggaattggggtctgggatcaactcgcagagctttgcctttaaggtgtcagactcaggaaaatcccagagctgtggtttctggtggcgtaagcagttctgtagaggagcaacctgccttgtttgagaagcccgcttccgaagttgttcatttgtaccgtgtcccgtttatgcaagaaagtgcagctgctgagcttttgaaggaggctcaagtgaaaatctccagtcagatcgtggaaatactaacggagcagtgctataatgttggccttagttcgcaactttccggtggaaaattttcagttcttggatggcttcttcaagaaacattcgagcctgagaatctgggaactgagagctttcttgagaagaagaggaaggagggtctgattccagttattgttgaagttggccccaggttgtcattcaccacagcatggtctactaatgctgttgcaatttgccaggcctgtggtttgacagaagttaaccgtttggaacggtccaggaggtacttgttgttcaccaccactgaactgcaagattatcaaatcaatgattttgcatctatggtgcatgataggatgactgaatgtgtttatattcagaaactaacatcctttgagaccagtgttgttccggaggagattcattatatacctgtcatggagaggggacgaaaggcattagaagagattaatttggagatgggttttgcctttgatgaccaggatttagaatactacaccaaacttttcagagaagacattaagcgcaacccgacaaatgtggaattgtttgatatagcacagtccaacagtgagcacagcagacactggttttttactggaaagattttcattgatggacagcccgtgaatagaactctcatgcagattgtgaaaagtactctgcaggcaaacccaaataactcagttattggcttcaaggataactctagtgcaatcaggggtttcccagtgaagcagctccgaccagttcagcctggttcagcatgtccattagaagttgcagtccatgagttagatatcttgtttacagctgaaacacataattttccatgcgcagtggcaccttatcctggtgcagagacgggtgcaggaggtcgcattagggatacacacgctaccggaagggggtcctttgtccaggcagctacagctggttattgcgttgggaatctcaacacaccgggcttttatgctccatgggaagatccctcctttacttatccatcaaatttggcaccacctttacagattctgatagattctagtaatggtgcatctgactatgggaacaaatttggagagccattgatccagggtttctgtagaactttcggaatgagacttcctggtggggagaggcgagaatggttgaagccaatcatgttcagcgcaggcataggacagattgaccaccttcatatatcaaagggagagcctgacattgggatgctggttgttaagattggaggcccggcttatcgtattggtatgggaggtggggcagcctcaagcatggtgagtgggcagaatgatgcagagcttgatttcaatgctgtgcaacgtggggatgctgagatggctcaaaaactatatcgtcttgtgcgtgcttgtattgagatgggggataaaacccaattatcagcattcatgatcagggagctgggtgctgagatagatgtccgagcaattgtggttggtgatcatacaatgtctgttctagaaatttggggtgcagagtatcaggagcaggatgcaatcttagtgaagcctgaaagccgtgatctcctagaatcaatctgtaacagggaaaaagtttcaatggctgttattggaactatcagtggagatggacgtgttgttttagttgacagtgtagcagctcagaagtctatttcaaatggactccctccacctccccctgctgtggatcttgaactggagaaagtccttggtgacatgcctaagaaaacttttaagtttaatcgggttgtttatgagcgggagccacttgatattgtccctgggattgaagtgatagattctctgaagagggtattgagtttaccgtctgtttgttcaaagcgcttcttgacaacaaaagttgacaggtgtgttactggtctagtggcacaacagcaaactgttggccctttgcagattcccattgctgatgttgctgttacagctcaaacttttgctgatgtgactggaggtgcttgtgccattggagaacaaccaatcaaaggtttgttagaccccaaagcaatggctcggttggctgttggagaagcactaacaaatcttgtatgggcgaaggtcacttccctttctgatgtcaaggctagtggtaactggatgtatgctgccaagcttgatggggaaggagctgacatgtatgatgctgctatatctctatctgaagcaatgattgaacttggcattgctattgatggagggaaagacagtctttctatggcagcccacgccgagagtgaagttgtcaaggctccaggaaatcttgtcatcagtgtttatgttacttgtcctgatataacaaaaacagtgacgccagatttaaaactcaaggatgatggtattttgcttcatattgatttgtcaaaaggtaagaggcggttaggtggatctgctcttgcccaggcgtttgaccaagttgggaatgagtgtcctgatcttgatgatgttccttaccttaaaaaggtctttgaaggtgttcaagaccttctttctgatgaactgatatctgctggtcatgacatcagtgatggtgggctgctagtttgtgccttagagatggcatttgctggtaattgtggacttagtttggactttgcatcgcaaggtaacagccttttccaaacactctatgctgaagagcttgggttagttcttgaggtaagcaagaaaaatctggctttggtagtgaataaattgagcaatgtgggagtttctgctgaaatcataggtcaagtaacagccaatccatcaatagaagttaaggttgatggggagacttatttaactgaaaaaactagtatccttagggacatgtgggaagagaccagttttcagctggaaaagttccaaaggttggcatcttgtgtggatatggagaaagaaggactaaaacatcgttatgaaccctcatgggaactgccttttactccttccttcactgatgaaaagcttatgtctgcaactataaaacctaaagtggctgtgattagagaagaagggagcaatggagacagagaaatggctgcagcattttatgctgctggttttgaaccatgggatattaccatgtcagaccttcttaatggaaagatctctttgctagacttccggggaattgtgtttgttggtggatttagctatgctgacgtgcttgattctgcaaaaggttggtctgctagcataagattcaacgagtccgttttacaacagtttcaggagttttacaagcgtccagacactttcagtcttggtgtatgcaacggatgtcagctaatggctttgttgggatgggtaccgggtccacaagttgggggtgtgcatggtgctggtggcgacctatcacaaccgaggttcattcataatgagtcagggcggtttgaatgccgttttacaagtgtgaccataaaggactcaccggcaataatgttcaaaggcatggcaggtagtacattgggtatatgggctgctcatggtgagggaagagcttatttccctgatgaaggcgtgttggaccgtatagttcattctgagttggctcctataagatattgtgatgatgctggaaatccaacagaggcctaccctttcaatgcaaatggctctcctttaggggtggcagctatttgttccccagatgggaggcatcttgccatgatgcctcatcctgagcgttgcttcttaatgtggcagttcccatggtatccgaagcagtgggatgtggagaagaaggggcctagtccttggttacgcatgttccagaatgcaagagagtggtgttcctga

SEQ ID NO: 2337 - DNA, 624 bp, Glycine Max
atggcgactgtgtcccctctcgccaaatacaagctcgttttcttaggcgatcaatcggtcggcaaaaccagcatcatcactcgcttcatgtatgacaaattcgacattaattatcaggctactattggtattgacttcttgtcaaaaacaatgtaccttgaagatcgaacagttcgtctgcagctttgggatactgcagggcaagaaagatttagaagtctgattccaagctacataagagattcttctgttgcagttgttgtatacgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccaggcagagcagcaaggaggaggttgctcttgctaa

SEQ ID NO: 2338 - DNA, 210 bp, Glycine Max
atggcgaggcgaggcgagactcggaacgagtcgttattgactcgggcggttgcggcggtcttcgccttcgtgagacacgccgagtttgagatcctcttctttcttttctttttcatcgcttatcttctattcaaagacatcgcatcaaggcctgactataatcaaatgttcgtaaagaagcccggtggaccagaattttggcctttttag

SEQ ID NO: 2339 - DNA, 1839 bp, Glycine Max; identical to SEQ ID NO: 92

SEQ ID NO: 2340 - DNA, 1086 bp, Glycine Max
atggcgattcaagatcaaaatggatttaacagatcacagggtggtcctccaataggaggaggagtatctttgagttctggagtgcattctgtcacacatattcaacttagtgaccagttttcttgtggcaatgactatgctctgaaggtaagaaagccttatactatcaccaaacagagagagcgatggacagatgaagaacataagaagttccttgaagctttaaagctgtacggacgggcttggcgacgtattgaagaacatgttggcacaaagactgctgttcagattcgaagtcatgctcagaagtttttttctaagcttcttcgcgatcctactgggaacaatacaaacacagtggagtcaattgaaattcctcctccaaggccgaaacgaaagccagtgcatccttaccctcgtaaactagttgagacccctaataaagaaattttgatcccagaacaacttatgaagtctaattctctgaagtcatcagactttgatcaagaaaaccaatctccaaaatcagtattatcaggagttggttcagacagccttggctcctctgattcagacacaccatatggaagtttgtcgcccatgtcatccattagtggcatccatacaagcagttttacacgtgctgagcacaaaacaacatctgatgaagctgggatggacactgattcagctcatgatgagaaacctcttatgaaattcaagcttcctccaaatgaatgtgtttccatcaaagatgacacagcagaagaatcttccggtcggactttcaaacttttcggaatgactctatttgtaacagacacctgcaaaccatctccaacaatcgaggcatgcaaaccgatacctctaaacattcgtgtgcgatgcctttcctcctccatgggggatgatggcaaattggaacttcgtggccactctacagcaagtgaaacatcagcaatatccaagctaaaggtgagagtgggacctgaagcatgtggtaaagggtttgtgccatataaaagatgcatatctgttgtgacagctgataatagagaagagcaatgcatccatctttccttgtag

SEQ ID NO: 2341 - DNA, 1110 bp, Glycine Max
atggcggaattggaggaggagcggatgggggatttcaagcccttctcggaaggttcttcgtgctcgcgttcgatcagcgaaaccgtgaacggctcgcaccaattcacgataaagggttactctttggccaaagggatgggtgctggaaagtacatcatgagcgacactttcaccgttggtggttacgattgggctatttacttctaccccgatgggaagaaccctgaggacaattccatgtacgtttcggtctttattgcgctcgctagcgacggaaccgatgttagggctttgttcaagttgacgctggtggatcagagtgagaaggggaatgataaagttcatagccatttcgatcgccctctcgagagtggaccttataccttgaagtataaaggcagcatgtggggttacaaacgcttcttcagaagaacacaactggaaacctcagagtatctaaaaaatgattgccttgtcatgcattgcactgttggtgttgttaaaactcgttttgagggatctaaacagggtgttattgtgccacagtcagacatgggccgggattttaaggacttgttggaatctgaggtcggttgtgacatacttttcaaggtcaaaagtgaaagcttcaaagctcataagttgatacttgcagcccgatctcctgtgtttagagcccagttttttgggcttgttggggatcctaccttagaggaagtagtggtagaggatattgagccctttatcttcaaggcaatgcttctctttgtttactctgacaaacttcctggcatatatgaggttatggactcaatgcccttgtgctcatacaccgtcatggtgcagcatctcttggctgctgctgatctctataatcttgatcggctcaaactgctttgcgaatcaaaattgtgtgaagaaatcaatactgacaatgtggccacaacacttgcgctggcagagcaacatcactgtccacagcttaaggcaatctgtttaaaatatattgcaaatcctgcaaacttgggaggcagaagcttttgtgcatttgaaagagagctgcccctcaatgctgttggaattgctggagacatttgcatcagtggatga

SEQ ID NO: 2342 - DNA, 870 bp, Glycine Max; identical to SEQ ID NO: 93

SEQ ID NO: 2343 - DNA, 5103 bp, Glycine Max; identical to SEQ ID NO: 94

SEQ ID NO: 2344 - DNA, 633 bp, Glycine Max
atggcgtacatcgccaccaccacggttggtgcaagcagtgtcaccacagtggattgccagaaacaagtaagatcatggaggctgctacgttccctcatggaatttctaatccccacttgcaactgcaccttcgtagaagaagaaaaccaaccacaaaagtgtctccaaaagcatccacaacaactcatgacttcaaccacaatcactggcaccatctttggataccgcaaaggaaaggtgagtttctgcattcaagctaatgcaaactcaagcaaccctattcttctgctggagttagaagttcccacaagcgttttggctaaggaaatgagagggggcacactcagaattgtgctggagagtggcaacaacaacaaccttaaccttttttccacgcctttgtggagtatcgtacgtaggccttcaaatggtgactttgaagcgctgagtttgatgcgttcagttgctgtgggaactggtgttataaacagttgcaaggaggatgagcttatgtaccttagagcaaactttcaaagggtccgtggctcctccaattgtgagtctttccatttgattgacccagaaggaagcattggccaagagcttagtattttctttttcaggcctaggtga

SEQ ID NO: 2345 - DNA, 1320 bp, Glycine Max
atggcgtatcgacggagacagcagcaagggttttcgaagccttctttttcgacgtttgaagaagaaacgactcggaaccctaacaacccctttccgctgccgaacgacgacgttgaaggttccgcttcgtcgtcgtcttcgtcttcgcttgctgcgaaagctattagagcttcttcggcccgtcgcgactcttcgttgtcctctctctacggcctctcctctgcttcttcttctccggtttcttcttctcaacctactccaactcctcctccttcttccaaggattcaagaccctatgaatatacatctatgaagaacatgaatgagtccaagaatggattttggggtgttctggccagaaaagccaaatcaattattgaggatgataatgtaccccagcaatctgaaatgtctgggactgggaggtcccaatttcctggtgtagcatctaggagcaagttccaaaattcaaatcacttagaggatagcaatctcaaaagggacggtccatcatttataaagggattggatgctatcacatcttctcttactcatattggtggtaccattggtaaatccttggaggaaggtttaacaattgttgagaatcggacttcagatatcattcaggaaactcgtaaacatattaagaagaagcctggaaactctgtaggacaaaatcaggagacaaaccattctactacattgcatcaatcccaactgcggaaccagatgtcaccgaagcaaacagaccaagaacttcaactgaaggcatctcgcgaggttgcaatggcaatggctgccaaagcaaaactacttcttcgggagttgaagactgtcaaagctgatctggcttttgcaaaggatcgatgtgctcagctagaggaagaaaataaaatcctccgtgagaatcgggaaaggggagatagccatgatgatgatgatttgatacgacttcaacttgaatctcttctagctgaaaaagctcgcctggcacacgagaactcggtttatgcccgtgagaatcgctttctaagggaggttgtcgagtatcaccaacttacaatgcaggatgttgtctaccttgacgagagcaatgaggaagtcactgaagttaaccctcttaaccttcccccagtgcctaatatggccctggattctattactccatctgcaacctcccttttgcattctcctgaaccgaaccttggcatggcttcagaattaacaagaggcacctcatctactatatctggaaaagatgcaaagagtaatgagattactataaaggattcacggagttctgaagcgactagataa

SEQ ID NO: 2346 - DNA, 654 bp, Glycine Max
atggcgtccgttgcagttatggctacaagcagcgacagcaggtggtctatggcttccttgcgctctgctttgccctctcattctcctcctgtttcctcttcattgcgcttccctgtattgccatcttcaccgtcttcttcttcaacgaaactccgaatttctcgaaccaaacccaaatcccttctcacctctttcaccggcctcgctcctcttaaccccatcttcctctccgctccttcttcagaatataccggctgtgatcactcttttaccattattgacaatggtggtcgagtcactgccatgagacatgggaggcgagtgcccaaactcaacaggccccctgatcagcgtcgcgcactcatccgaggtcttacaactcagctccttaaatatggtcgcatcaagaccaccagagcaagggccagtgcaattcggaagtatgttgataaaatgatcactttggcaaaggatggttctcttcataaaaggagacaagcccttgggttcatctatgagaagcaaattgttcatgctttatttgcagaggttccagaacgttatggtgaaagaaatgggggttatacaagaattataagaaccctaccaaggcggggtgataatgcacctatggcatatattgaacttgtgtag

SEQ ID NO: 2347 - DNA, 1083 bp, Glycine Max
atggcgtcgtggtgggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagggttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatga

SEQ ID NO: 2348 - DNA, 489 bp, Glycine Max; identical to SEQ ID NO: 95

SEQ ID NO: 2349 - DNA, 702 bp, Glycine Max
atggctacgatcggacacaacaatctcaatgccaaattggtgggtccatcatctctttttcgatttcctttgttttttttttctctctctcaattttcttcgattccgatcatgttctcactctgttctttgcatcaggttcttctcggggacatgggtgctgggaaatccagcctcgttttgcgctttgtcaagggtcaatttctcgaatttcaggaatcaacaataggggcagcgttcttttcacagacgctggcagtaaatgacgcgacggtaaagtttgagatatgggacacagcaggacaagagaggtaccatagcttggctcccatgtattacagaggtgctgctgctgctatcattgtctatgacatcactagctcggactcctttacccgagctaagaagtgggtccaagagcttcaaaagcaagggaatcctaatatggtcatggctcttgctggtaacaaagctgatttggaagataagaggaaagtgacagctgaagaagcacgtgtatatgctgaagaaaatggtttgtttttcatggagacctctgccaaaactgcatccaacgttaatgatatattctatgaaatagccaagaggttaccaagggctcagccagctcagaacccagctgggatggtacttgttgatagacccgccgaaggaactagggctgcatcatgttgttcataa

SEQ ID NO: 2350 - DNA, 573 bp, Glycine Max
atggctagaaagaagctgaatcttacatacataaccaatgacccgaagaggaagacaacattgaagaaaagaaagaatggtttgatgaagaagatgaatgaaattagcactctttgtgggattgaatcatgtgctataatatatagtccaaatgatcctcagccagaggtttggccatctgactcaggagtccaaagggtgctttccaggttcatggaaatgtcagaagtgaaacaaagcagaaagatgttgaatcaggagaacttgttgaggcaaatgatcaacaaaggccaacagcagttgacaagacaaaggaatcaaaacaggaagaaagaaatgaccaatcttatgtttcaatacctgactgctgggaagatttttggcaaccctagcttggtggatttgaatgatctctcatggttgattgatcagaacctcaatgaaatagaaaagaagatcaccatgctccaaatccaagaagtgactccagtgatagaaaatggagaacaggaacacatgcatcatgttcaagggctagagagcaacatggacaccaagcaaaagaaacattga

SEQ ID NO: 2351 - DNA, 555 bp, Glycine Max
atggctagaaagaaggtcaacattagatacataagcaatcccgccaagaggaaggcaacgtttaagaaaagaaaaaatggtttgttcaaaaaggtttctgaaatctgcaccctttgtgcaattgaagcatatgctatcatttattctccagatgaacctgcaaagcctgaggtatggccatctgaccagggagtccgaagtgtgattttctgctttagggaagtctctgaactggaacaaagcaagaaaacgttgtgccaagagaacttattgttgaggaataatttaagcaaagcccaggagcagcccaagaaactgaaaaatgaaaatagaaaaaaagagatgtcccttctcatgatacattatcatactttgaaagaattaacgtatgtgtatctaaatatttggaaagaagacattgatatatatttaattagttattccaattgtcttattgttaatcttatggtatttggaatgttatgcacatgtccatccattggccgcacgcatcaaatgattaaccttacatggttgatgtctggttggttttaa

SEQ ID NO: 2352 - DNA, 672 bp, Glycine Max
atggctagtggaagaagctacggagacgcgaaccagaaggtagattacgtgttcaaggtggtgctaattggtgattccgcggtggggaagtcgcagatacttgcacgcttcgcgagaaacgagttcagtttggactcaaaggccacaatcggcgtcgagttccaaacgcgcactttggtcattcagcacaagagcatcaaggctcagatctgggacactgccggccaagaacgatacagagcagttacaagtgcatactacaggggtgctgttggggcaatgttggtttatgacatcactaaacgtcaaagctttgatcacatacctcgttggttagaagaactgcgtaaccatgcggataagaatatagtcatcattcttataggaaacaaaagtgatcttgagaaccagcgtcaagtacccacagaggatgcaaaagaatttgccgagaaagaaggcttatttttcctagagacctcagcactggaagcaactaacgttgaaacagctttcatgactgttttgacagaaatattcaacattatcaacaagaagaacctagctgctagtgataatcagggaaatgacaactcagcatctttgtctggcaagaagattattgttcctggtcctgcacaggaaattcccaagaggagcatgtgttgtcagtaa

SEQ ID NO: 2353 - DNA, 1428 bp, Glycine Max; identical to SEQ ID NO: 96

SEQ ID NO: 2354 - DNA, 1974 bp, Glycine Max
atggctcacagctgctctgatgaggatactgatattagtgaatctgaaattagtgagtatgaagataaatcctatgaagaactgaaaaatggaagtcaggatgtgagaacatcgggcaagactttcacttgcccctactgccctaaaaagagaaagcaggattatttatacaaggagctccttcaacatgcttctggggtgggtcagagtagttcacaaaagagaaaagcaagagacaaggctaatcatttggctttagtgaaatatttgaaaaaggatctcatgaatgtagatgttccatcaaatgattcaaaaccggaagatgaaagtgatccttctgttaattctaatgatcagtttgtgtggccttggattggagttgtagttaatattccaactagacggacagaagatggacgctgtgttggtgagagtggttctaggctgagggatgagtacagaagcaggggtttcaatccagtgcgagttaatcctttgtggaatttccggggtcactctggaactgctcttgtggaattcaataaaaactggccaggcttacataatgcattggcatttgaaagagcatacgaattagatcatcatggtaaaaaggattggtttactaattctgggcagaagtctggtctttatgcatgggttgcccgggcagatgactacaagatgaacagtatttatggagaacatctgcgaaggatgggtgatgtcaaaaccatatccgagcttatggaagaagaagctcggaggcaagataaacttgtctcgaatttaactaacattattcaggtcaagaataagcacttaaaagagatagaagtgagatgccacgagactacagataaaatgaaccttgttatgaaggataaagataaactcattcaagcttataatgaagagatacagaaaatacagtcaagtgccagggatcacttccaaaggatttttactgaccatgaaaagctcaaattgcaactggaatctcacaaaaatgagcttgagttacggaaagttgaattggaaaaacgtgaggcacataacgaaagtgaaagaaaaaagttggcagaagaaattgaggaggtcatgaatccaaaacatgttaatttctgggatgaaaatggaaatttgggggaatgcatcgaaaatacctctcttcagatggctgctttagagcaaatgaaagctgatgaaaatgttatgaaactggctgaagatcaaaagaggcaaaaagaacaactccatgctaaaatcattcagcttcaaaaacaacttgatatgaaacaagagctggagttggagattcagcaattaaaaggttcattaagtgtgctgaagcacatggaagatgacgaagatgcagaaattctgaataaggtagatacactacaaaaggatttaagggacaaggagcagtcacttcaagacttagatgcattgaaccaaacactaatcattaaagagcgtgagagtaatgatgagttgcaggaagctcgacaagcattggttgatgccattaaagagttgcaatctcatggaaatattcgtttgaagagaatgggggaacttgatactagaccattccttgaagcaatgaagcaaagatataatgaggaggatgctgaagagagagcttcagaactgtgttcattgtgggaagaatatctaaaggacccagattggcatccattcaaagttatcatggttgaaggaaaagaaaaggaaattattagagatgacgatgaaaagctgaatgggttgaaaaatgacttgggtgaaggggcatataaagcagtggtggaagctttgttggaaataaatgaacataatcctagtggacgatacttaacctcagtattatggaactataaacaaggaaggagagcaactctgaaagaaggagtacaatttctgtcaaatcaatggaaagttcttaaacgcaagaggggaatgacgtga

SEQ ID NO: 2355 - DNA, 1356 bp, Glycine Max
atggctccactcttgtaccttggttgcagaagggtgctcctgttctctcttcttttgttcttttttgtttctgtttgctcagaacctcatcaaccagagagcaaagccttgtctggtgatggcagcagcagaagcagaagaagaatgttgttgttggagttggattctgaaaaggaagaatttgaacaacccctgaaaaagaaatccaccaaaaaccaaaccaagttaatcaaacccaccactagcctctcctccaaaaaccaaaccaaaaccatcaaatccaataaccttagttcctccaaaaaccaaaccaagctagccaaaaccaaagccaccaccctcaccgacaccgaggttgtcgtgaagaagctcaactccaccaccttaaagtccaagaagctgaattccacatccaaaggctccacgaaatcatcctcattggatctcgcgaaaacaagtggtactagtggcggcaagaacaaaacgacaaaagccaccgccaccaaggacaaggaagttaccaataaaaagaccaagttggatcaaaccgaagaatccgacaagcagagtaataagaagagtaacaccaccaacaacaagaagaagaaagaacaacaaggacaacctagttgggtgttcgaagacgaggtggacgatgatttggtttcggagttcaaagatctacccatgaagttccaacaaacactgatcccagacctggaacgaatctccacaacctcaaaagcctacataacaaaagccaacaaagagatcacgagagggttcaaaccctacgttggcaacaagtacgcacccaccatcaccactttactctcttgcgcattcgctttgatccctttgcttttggcctcactcctcttcaacaaaatcaaagcctatttctcactccaaaagctcttaatcttcatccaagcctacctcgctatctacttctccattctttgcctttcttccttcgtcactggccttgaacctctcaggtttttctactctgcttcgcgctccacctatctttgcctgcaggtcctccaaactctcgcttacgttctctaccttttgctgctactcatgtatctcgttttggtgttctcaactgattctggattgggctccaaattcttgggcctggcccaaacttttgtgggcttttccgtggggttgcattactacgtgactgtgtttcacagggttgtgttgaagcaaccgcccaagaccaattggaagattcacgccatttatgccacgtgttttttcctcatttgtgtcattgctagggctgatagaaagaagaagacctacttggaagaaggtggagaagagggcaagaaaaattga

SEQ ID NO: 2356 - DNA, 1023 bp, Glycine Max; identical to SEQ ID NO: 97

SEQ ID NO: 2357 - DNA, 1164 bp, Glycine Max
atggctccgaagaaggttcttctcctttgcggggacttcatggaagactatgaagccatggttccatttcaggcattgcaagccttcggtctcgccgtcgacgccgtctgtcccggaaagaaatccggcgatgtctgccgcaccgctgtccatgtacttgccggcgcccagacttatagtgagacggttggtcacaatttttcactcaatgcaacgtttgatgaagttgatgctgcaagctatgatgggttgtgggtgccaggtgggagggctccagagtatcttgctcatgttcctggtgttgtggaactggtgaccaagtttgtcagtttgggaaaacaaattgctagcatttgtcatggacagttgattctggctgctgctggagtggttaaaggccgcacgtgcacggcttttcctcctgttaaacccgtgctagttgctgctggtgctcattgggttgaacctgacactgaggcagcaacagtggtagatggtgatctcattactgcagctacttatgaggggcacccggagctcattcgccatttcgtgaaggcattaggaggaaaaataagtggttttgataagaaaatcctctttatttgtggggattacatggaagattatgaggtcaaggttccttttcagtcccttcaggctttaggatgccatgttgatgctgtttgcccctcaaagaaggccggtgacacttgcccaaccgctgttcacgattttgaaggggatcaaacttacagtgagaaaccaggacatacttttgctttaacagctacctttgatgatgtggatccctcaggttatgacgctcttgtcatccctggaggtcgagcacctgagtatttggcattgaacgagtcagtcattgccttggtgaagtatttctttgaaaacaagaagccagtggcatctatctgtcatggccaacagattttatctgctgctggtgttctcaagggaaggaaatgtactgcttatccggctgtgaagcttaatgtggttctgtcaggagcaacatggcttgagcctgaccctataagccgatgcttcactgatggaaatctagttactggagctgcatggccagggcaccctgagttcattgctcagttgatagcactacttggtattcaagtatctttctag

SEQ ID NO: 2358 - DNA, 942 bp, Glycine Max
atggctcctccaagaggtcgtggtggttttggtggtggcggtgggttcaggggtggtggtaggggtgacagaggcagaggaaggggcggtggaggaagaggaggagacaggggcactcccttcaaagctagaggaggtggcagaggtggtggtggccgtggcggaggcaggggtggtggccgtggtggtggcagaggtggaatgaagggaggtagcaaggttgtggttcagccccatagacatgatggtattttcattgccaagggtaaagaagacgctcttgttactaagaatcttgttcctggtgaagctgtttacaatgagaaaaggattactgttcagaacgaagatggttccaaagatgagtacagagtttggaatccttttcgatccaagttggctgctgccatccttggtggagttgacaacatatggattaaacctggagccagagtcctttacctaggagctgcttctggaaccactgtttctcatgtatcagacgttgttggccctactggagttgtctatgcagtagaattttcccatagaagtggacgtgacctggttaatatggcaaagaagcgaactaatgttattcccattattgaagatgctagacatccagctaagtataggatgctggtcggaatggttgatgtcatattttctgatgttgctcagcccgatcaggcaaggattttggggctgaatgcttcatattatctgaaagcaggaggtcattttgttatttcaatcaaggctaactgcatagactccacagtccctgccgaggcagtgtttgaaagcgaagtgaacaagttgaaggcagatcaattcaaaccattcgagcaagtcacccttgaaccatttgagagggaccatgcctgtgtggttggtggatacagaatgcccaagaagaaaaaagatgctgctgagtag

SEQ ID NO: 2359 - DNA, 1896 bp, Glycine Max
atggctcctgtttcattgcctcctgggtttaggttccaccccaccgacgaggaactcgtttcttattacctcaaaagaaagataaatggtcgtaagattgagttagagatcatccatgaagttgatctttataagtgtgaaccatgggacttgccagggaagtcattgttaccgggtaaagatttggagtggtatttcttcagccctagagataggaagtacccaaatggatcaaggaccaatcgtgcaaccaaatctgggtattggaaggccacagggaaggaccgtaaggtgaactctgagagccgtgcaatagggatgaagaaaaccctagtttactatagaggtagggcaccacatggatgtcgcacaggttgggttatgcatgagtatcgtcttgatgagactcagtgcgaaactaattcaggcttgcaggatgcatatgctctttgccgtgtgtgcaagaagactgcagtgattcccccaaaggttggagatcagcactatgttaatgttcctagccatgtaaatcagattacaagtgatcaatcatcaagcattgacattgagatatactcagaaggaagaggtgaagttttagagagctcaaattatttgatgccgtgggatacatgcccatccccaaacataaatattgggtctgctctcaatatcaatatcaatggtgggacaagggataataacattgggacatggtcacacttcttagcagaagacttacccaatcttccaacatctgcttcttcatttcccaattatggatctatgagttaccctccatcaaaggtggatatagcactagagtgtgcaaggatgcaacataggtttaccatgcctcctttggaggtgcaggacttccctcaagttggcatttccgagctgaagatggcacaagcctcgggttccaatatgtgtggaggaagcagaaataatgaaacagatatcttgcaggaaattctttcagttgctcatgcttcccatgatgattttacttttatggttggcaacaattacaatcgtgtgaatgatatgaacaccatgggatttgttgacaaagcatgggaagaccctaacgcaagatcaatagagatcggggatcttgatgatggattcaagacagagaggatggtggagaacttaagatgggttggaatgtccagcaaaaatatggaaaagggctttatggaggagcaaaagattgtgccgattgagcatatctcaaacttccaaactaacagggaagaaaacgaggtgcaagtaggatctcagcaacacaataacaacaaagaactcaatgacactgacattgacgatttctcaatggggttcatcaatggtgacgaccacaatgagaacttcatagatgagggtaacattaattattcaaattctacaaactttgaggttgttgaggaaacaaaagtcagtcatggaatgtttgtctccactcgccaagtagctgacacattctttcatcaaatagctccttcacaaaccgtgaaagttcaactcaatccattaatggctgaagatcaatctatagagaatgcagtaatggttaaccaagggccccctttctttagaaatgcccttgtgttcctctttgcacttttgttgatgcattgtgtgtttttgaaggaacaagtggaagatttgaaatcggaccccaaatgctttgatggtgctaactccatgaagaaaattatgagacaaccagctgagaacatcatatggaatgaacaagaaaatttttggtctgttggtattaaatgcgggaaaggatttagtgtggtcttgaagaagataggcattttcctcaccatatcattggctctttgtaccatgtgggctaaccatgttatagttgactcttag

SEQ ID NO: 2360 - DNA, 567 bp, Glycine Max
atggctcgtctcgcgatcgctgtcgccgccgtgctcctcgtggccctctccgcctccaccgcgacggcgcgtccctgcaggaccttcataatctcctcctactcgttccgcaaccctaactccaacaccttcgccaccatcaccgagatccgatccttcacccctctctacatcaccgacaaacccaccggcaaaccctcctcctcctacgacctcttcttcccccacgcgactcacctccctgagcccgagcgcgtgaacccacgcgctcccctagggttcgcctccgcgtacgatttctcctccctccgcgaccgcaccaaggacatcctcagcgtcgccctcgccctcctcttcggtgtcggctgcggcgccctcaccgccgccaccatgtacctcgtctggtccgtcttctccacgcgccaccccaccgccgccttcgacgacttctcctccgacgaagacgagatcgagagccccaagaagctaggctacgtcaagattcctgccaccgagaccaccgctgctgtctccaccgctccggcgccggccaagggctcggtatga

SEQ ID NO: 2361 - DNA, 669 bp, Glycine Max
atggctcttgttctcaacgtctcattgtgttccatttctaaaccccatctttctctctcaacctccaatcccaacaaagcttcttcaactcttcctcttcctattctgggacttaaaacaaagcaaagtctccaaccatctcagaaactcacattttcattgggtgaatcagtggctggtgccaccctcgttgctctcctctctgcttctttcatctttgttgatcccgcacttgcattcaagggtggagggccatacgggcaggaagtgacaaggggacaagatctcactgggaaggactttagtggcaagactctgatcaaacaagacttcaaaacgtccatactgagacaagccaattttaaaggtgcaaagttaataggtgctagcttctttgatgctgatttaacaggtgctgacctttcggatgctgatcttagaaatgcagatttttccctggcaaatgtgacaaaggcaaatttaagcaatgctaacttggaaggtgcacttgcaacaggaaacacttcttttaggggatcaaatgttacaggcgctgacttcacggatgtaccactaagagaagatcaacgtgaatacctctgcaaagttgctgatggagtgaacccaacaactggaaatgctacacgtgatacattgttctgtaattag

SEQ ID NO: 2362 - DNA, 471 bp, Glycine Max; identical to SEQ ID NO: 98

SEQ ID NO: 2363 - DNA, 579 bp, Glycine Max
atggctgcagaagactacacttttgggccttacaagatacaccacactgaagtgttctactccaccaatctctcttacgccatggttaacctgcgtcctcttcttcctggccatgtaatccagcacaatatgtttcagggtttccagtccttgactgcaagggacttcttagtatcatcagtgtcaattttaatttatggtttcatcatgtttttacatgtgctcatctgtccaaagcgtgaagttaagcgtttcggtgatctcactgctgatgagacttctgatttatggctcactgcacaaaaagttggtaggcagcttgagacctaccataaggcttcatcgcttactcttgctatccaagatgggccacaagcaggacagacagtaccccatgttcacattcatcttatccctcggaaaagtggtgattttgagaagaatgatgagatatatgatgcagtggatgagaaggagaaggaattgaaacaaaagcttgacttggacaaggagaggaaagacagaagccttgaagagatgagtcaagaggcagatgaatacagaaaacttttcttatag

SEQ ID NO: 2364 - DNA, 837 bp, Glycine Max; identical to SEQ ID NO: 99

SEQ ID NO: 2365 - DNA, 837 bp, Glycine Max; identical to SEQ ID NO: 99

SEQ ID NO: 2366 - DNA, 1296 bp, Glycine Max
atggctgcctccgtctccactgtcggagctgtcaacagagctctgttgaacctgaatggttctggagctggagcttcagctcccagttcagccttctttgggaccagcttgaagaaggttattgcctcaaggattgttgctgtagaagagaagaaagagattgaagagacccagcagaccgacaaggacagatggaagggtcttgcctatgatatctcagacgaccaacaagacatcacaagaggaaagggtttggttgactcccttttccaagctccacaggatgctggaactcactatgcagtcatgagctcctacgagtacctcagcactggacttcgccggtacttggacaacaaaatggatggattctacattgctccagcttttatggacaagcttgttgttcacatctccaagaacttcatgaccctgcccaacatcaaggttcctctcattcttggtatctggggaggcaagggacaaggaaaatctttccaatgtgagcttgtctttgccaagatgggaatcagccccatcatgatgagtgctggagagttggaaagtggaaatgcaggagagccagcaaaactgatcaggcagagataccgtgaagctgcagacatgatcaagaagggaaagatgtgcgctctcttcatcaacgatcttgatgcaggagctggtcgtcttggtggaaccacacaatacactgtgaacaaccagatggtgaatgccactctcatgaacattgctgataaccccaccaatgtgcagcttccaggtatgtacaacaaggaagagaacccccgtgttcccatcattgtcaccggtaacgatttctcaacactctatgcacctctcatccgtgatgggcgtatggagaagttctactgggcaccaacaagggaagaccgcattggtgtttgcaccggaattttccgcactgatggtattcctgaacaggacattgtcaagcttgttgacaccttccctggccaatccattgatttctttggtgcactgagggccagagtatatgatgatgaagtgaggaagtggatttctggtgttggtgttgacagtgttgggaagaagcttgtgaactcaaaagatggacctccaacctttgagcagcccaagatgactctggagaagctcttgctgtatggtaacatgcttgtccaagaacaagagaatgtcaagagagtccaattggctgacaagtacttgaacgaggctgctcttggaaatgctaacgaggatgctattcagaggggaactttcttccagtcttga

SEQ ID NO: 2367 - DNA, 1203 bp, Glycine Max
atggctggaatttgctgtggtgttgttggagaaggtgacactccggctccactcgagcccactcctcgcccctccaggcgccggagtttggacatcttacctttaaaatatatcgccgacatgcccatgccgccgccggaggctttacggaagcgtcccaagctcaacctcagggactgcgataacgcaattgaaaattgcgacgaatccactggacacaaggtgacgaagaaggaatccaaagtagactacgacgacgacgtcgtttcggaaactaagaacgtaactgtttcggaagttgaagaagaatctcccaagttcggcgtgacgtccgtttgcggcaggagaagagacatggaagattccgtctcggtgcggccttgcttcacccaaggcttccactacttcggcgtcttcgacggtcacggttgctctcatgttgcgactatgtgtaaggagcggctacacgagatcgtgaatgaagaaattgaaagcgcgcgcgagaatttggagtggaaactgacgatggagaacggattcgctcgcatggacgacgaggttcatcgccggagccagagcaaccagaccttcacctgcaggtgtgagctccagactcctcactgcgacgccgtcggatccaccgccgtcgtcgccgtcgtcacgccggacaaaatcgtcgtctctaactgcggcgactcccgcgccgtcctctgccgcaacggcgtcgccatccctctctcctccgatcacaagccggatcgacccgacgaattactccgagtccaatccaagggagggcgcgtgatttactgggacggtccgagagtgcttggtgtgttagcaatgtctcgagccataggtgacaattatctgaagccgtacgtgatttcagaaccggaggtgatggtgacggagcggacggaggaggacgagtgtttgatactggcgagtgatgggttgtgggatgtggtatcgaatgagaccgcatgtggggtggtgaggatgtgcctcaaggcgcagaagccgccggggtctccggggagtgacgtggcggctgacggttccgaccgtgcttgctccgatgcgtcgattctgttgaccaagttggcgctggcaaggcatagttcggataatgtgagcgtggtggtggttgatttgaggagggatcaacgacaatcatcaaactacaacgacgttaattaa

SEQ ID NO: 2368 - DNA, 498 bp, Glycine Max; identical to SEQ ID NO: 101

SEQ ID NO: 2369 - DNA, 525 bp, Glycine Max; identical to SEQ ID NO: 102

SEQ ID NO: 2370 - DNA, 741 bp, Glycine Max
atggctgtcgattccttcttccagaaagaacatcaaattcgggagtttgtggacgggaatggaaacgtagctgtcggtttgaagttgcataataaaccaagtaatgatggccttaaccgacagtttcctctagagattccgccgattctatttgaagagacttcacttccagcaggattgcacggttcacatactaaagatgtttatagtatttcagtgttgcctgaggaagatgaaaatgcaaattgcgcttcaccactacctttcttgagcatcttaggggttcctaatcaagttaaaagcccaatgtgcttagatgatcccataaattgtcaaaactgcattgattttcaaatgaagaatgagggtgtgtattcccagtgcataattgatatccctagtgtcaatggaaactcagtttcacctgaatcctatgaagaggcagttgaaggttttaaaactgggaactcaccaacaagtgtactgtggagagaatcaagtttcaaagcggggaaacttatgcagagtctggtgaatgtgagcaatccaagagataaaccagtctctgagaagctacatgatttaccgagtaacagatggagaaaatataagcgtgctgcctcatttgattccagaaaagttgctcttctgttttcaatattgtcaagtttcggaacattggtattgatatatctgacattgagagtgaggcagagggctgatgggtttgctcttatttga

SEQ ID NO: 2371 - DNA, 823 bp, Glycine Max; identical to SEQ ID NO: 103

SEQ ID NO: 2372 - DNA, 267 bp, Glycine Max
atggcttcaaattccttgaacaatagtaacaacaaagaacattttccctcttggaccagattgcagaacaaacaatttgaaaaggcattggtcttgtacgatgaacacacccgagatcggtggcaaaatatagctaaagaagttggcaataaatcggtggaggaagtgaagagacactatgcaattcttttagaagatcttagtagaatggagtcagggcgtgttccaattcctgattataagttctcagaaaacatggatatatga

SEQ ID NO: 2373 - DNA, 2238 bp, Glycine Max
atggcttcttcaccgctcttgagaggcaaagaattcgtaaccagtggcatgcctgatgatgcaatgaggcgaagtaggtaccatgtgaagaggtgctttgctaagtacattgagaaggggagaaggaccataaaacttcataacttgatggaagaaatggagcatgtcatagatgacaacaatgagaggaatcaattgttggaggggaaccttggcttcttattgagttgtacacaggaagttgctgttgatccgccttatgttgcctttgcagtaaggccaaatcctggagtttgggaatttgtaagaattacctcaaattcaagaaaagtgtatatgacgaataatggtatggcaaatgatgaaaactcatttgaagcagattttggagcatttgatttccctattcgaaacttaaccctgccttcttcaattggaaatggactccatttcgtttcaaagttgttaacttcaaggtttagcgggaaactgaccaaaacacaacctatagtggactacttaagcctgatgatcagtgacaccctcagctctgctgcaaagcttcagctggcactgatggtggctgatggacatctctcagcacttccaaaggatgccccttatcaggattttgagcctaagagtggggtttttgagagtggatggggagatactgcaggaagagtgaaggagacaatgggaactcggtcggaaatactccaagctccagatgcagtgaacctggagaagttttttagcagagttcctacaattttcaatgttgtgatattctctattcatggttattttggacaggcagatgttcttggcttgccagacactggtggacaggtagtttacatattggatcaagttagagctcttgaagccgagttgctgctcagaattaagcaacaaggcctaaatgtaaagccccagattcttgtgatgctgaaggaaccgagtgcaatcaggagttggaaccaatcattgataccaaacattccaacattctacgtgttcctttttacacataaaggaatcttgcgtcaatgggtttctcgctttgacatttatccatatcttgagaggtttactaaggatgcgacagccaagattctcaacctcatggaaggaaaaccagatcttattattggaaattacactgatgggaatttggtagcatctcttatggctaacaaacttaggataactcagggaactatcgcacatgctttagagaagactaagtatgaagattcagatgtcaagtggaaagagttagatcccaagtatcacttctcatgtcaattcatggctgataaaattgcaatgaatgaatcagatttcatcataaccagcacctatcaggaaattgctggaagcaaagatagaccaggacaatatgaaagtcatgctgcatttacactcccagggctgtgtagggttgtttcagggataaatgtatttgatcccaatctgtctatttcccttacacagacaaagactgaagactcactcaattctatccttccattgaagacctattgtataaatgactatattcttccaaaatttggatatctagaaaacaggagaaaacccatcaccttctcaatggcaaggtttgatgttgtgaagaacttaaccgggttagttgagtggtatgggaagaaccaaagactaagaaagatggtgaaccttgtcatagttggaggcttctttgaccctttgaaatccaaagacagagaggaaatggcagagataagaaagatgcatgatttggtagagaagtaccaactcaagggtcaattcagatggattgctgcacaaactgatcggtattgcaatggagagctctaccgcttcattgctgacacaacgggagcttttgtgcagcctgctttgtatgaagcatttggtctcactgtcattgaagctatgagctgtggttttcctacttttgctaccaaccaaggaggtccagcagaaatcattgttgacgggatctctggcttccacattgatcctcacaatggagaagaatctagcaacaaaattgctgatttctttgaaaaatgcttacaagattcaacacattggaacaaaatttctgcagccggattgcagcggataaatgaatgcatttataccttctggaggtgggttaacaatgaacaaaaagaggcaaagcaaagatacatcaagatgttctacaaccttatgtacaagaatttg

SEQ ID NO: 2374 - DNA, 1962 bp, Glycine Max
atggcttcttcagctatggaaacctgcaaatcagaggatttgcacatgcaggttgacattgagaagaacgcgaaggacataaggtctcagtgggtgcttaacgctcctgagcccccaagtccatggcgtgtggttgcagattctgtgagcaaaactatctcccactataaacataaactttcctctctcatagatcaaccctgcaccacactcctcctttcagttctgcaggtggtttttccaattcttgcttggggcagaaactacactgctactaagttcaggaaagatcttcttgcaggtctcactattgctagtctttgtattccccagagcattgggtatgccaccttggcacatcttgatcctcaatatggcctttatacaagtgtggtaccaccacttatctatgctgtaatgggaacctcgagggagatagcaattggtccagtggcagtggtttctcttctgttatcctcaatgatggagaaattagtagaccctgctactgatccagtgggttatacaaagctgattttgcttgctactctctttgctggtatctttcagacttccttcggactcctcaggcttgggttccttgtggatttcctatcccatgctgcaatagttggatttgtggcaggagcagccattgtgattgggcttcaacagttaaagggactcttaggaattacccattttacgaccaagaccgacatagtctctgtcatgaaagctgtttgggaagcagttcataatccatggaaccctcgaaattttatcctgggatgctcgttcttggtcttcatcctaacgacgagatgtttgggtaaaaggaagaagaaactattctggttggcatcaatctctcctcttgtatctgttgttgtgtcaactctaattgtgtttatcacaagagctgataaaaatggagttaaaattgtgaaacatgtcaaaggggggttgaatccaagctccatccatcagttagacttcaacaacccctacattggagaagtggccaaaattggactagtggttgctgtcgttgcccttactgaatctattgctgttgggcgatcgtttgcatccatcaaaggataccaacttgatggaaacaaggagatgatgtcaataggtttgacaaacatcataggatctttcacctcctgctacgttgcaactggttcattctcccgtactgctgttaattatgcggctgggtgtgaaactttggtgtcaaacattgtgatggccatcacggtgttgatatcactgcagtttttgacaaagctattgtattatactccaacagctattcttgcttctgtgattctctctgccctaccaggactcattgacctcagtgaagcttacaaaatttggaaggttgataagatagactttcttgcatgcgctggagcattctttggagtactgtttgcttctgtggagattggtctacttgttgcggtggtaatatctttttcaaagatcattctcatttcaattcgaccagggacagaaactctaggaaaacttccgggaactgatttgttctgcgatgtctatcagtatcctatggcagttaaggttcccggggttatgataatacgagtcaagtctgcgttgctttgctttgcaaatgccaatttcgttagagaaaggatcattaaatgggtcactgaggaagaatcagaagatgacaagggaaattcaagaagcaccattcaacttctaattcttgacacctccaatttggtgaacattgacaccgctggaatcactgctctagaggaactgcataaaagtttgtcttcacatggaaaacagttagccattgcgaaccctaggtggcaagtgatacacaagctaaaggtgtccaactttgtcggcaaaatccgaggcagagtctttctgactgttgaagaagctgttggctgcaagagccgctgctaa

SEQ ID NO: 2375 - DNA, 657 bp, Glycine Max
atggcttcttccttggatatgtcgcttgatgatagaataaagaacagaagtaacagagggagaggtagaggaggacgtggtagagcccattctggccgtggaccaagtggcgctcttaatggtggaagaatggctggtgctgttagtagtagaagaatggctggtgctagtaatggtggaagaacaactggtgctgttcgtagaggtcctcttatggttaacactcggccgtcatcgtatgctattgccaagtctattcgcagagctaggccctttccatggcagcatgatttgtttgaagatagcttaagagctgctgggattcaaggagtagaagttggcaccaagttgtatgtttccaatttggaccatggagtgaccaatgaagacataagggaacttttctctgagcttggagagttgaagcgttttgctgttcattatgacaaaaatggacatccaaggggttcagctgaagtcgtttatactagaagaagtgatgcatttgctgctcttaaacgatataataatgtacttttggatggaaagcccatgaagattgagattgttggttccaattcagaattgcctataagtgctcgggtgaatgtcactggggtgaatgggcgcaggaagaggactgttgtaatgacgtag

SEQ ID NO: 2376 - DNA, 333 bp, Glycine Max
atggcttcttctaattgtgcaatatccacatgtactagtggcactactgcaggcatcaacaacaacactgatcaaagtactgtcccacctattatgtacttgagtaatagtgagaagtggaataagttgtcaaagaaagaaggccgttcctcaacaacttcttcttcctctctcatgaagaattcttcttcttcttcttcttcttccactcagaggaagtgtgcttttgctagaaagtgtgctaggctggtcaaagagcaaagggctcgtttctacatcatgaggcgctgtgtcattatgctcatatgctggcatgagtacaatgattcatga

SEQ ID NO: 2377 - DNA, 1692 bp, Glycine Max; identical to SEQ ID NO: 104

SEQ ID NO: 2378 - DNA, 183 bp, Glycine Max
atggctttctggaatgagtctttatttacatacattctacggaaccatgttacaaggtgcatgctatcctctggttgggtatcatcaagtgctcttcttccagttatcagctccatcaatattaccccaaagctgaacacatcaactttagtagtcacacgaccagtgactgaaagcagataa

SEQ ID NO: 2379 - DNA, 786 bp, Glycine Max
atgggaaaaagacaatctttgcgcaacaaagccacccaccttgtttctgtccttctcaaccccatctccgattccgacacttccaatcccaaaacctccaaacaacacccaccaacaccaacacctacacctccttccggacaagtaggtggatcagagacaaatgatgaagagggtaaccgtggtttagttgatgggcctgatacttcgtccttcactgcgttcctctattccttattgtcttcctctgacactggagataatgcaaactcacgcgtgcagagtgatgataataaatctgctgcacctgatcacaaccctttaccagactcatcatcgctgaaggaaaatggtgggaggaagagtttgatttctagaagcaagcaatcaattggtaaggctattcgcagaattggtggatttcgccatcaggatcgcagggataatgttgaaatgaaattggatgatgggcatggttctaaggtttctggtggtgttgagatgaggagaattgaacctgtgactgtgcctttggttgatcttccagaaatttctgaaccttcagttctcctttcagatagtatacggaacgttctctatgtttctcttccgcctcttattcacggaaggaaatggctgttgttgtacagcacttggaggcatggtatatcactttccactctttaccggagaagcatgctttggcctggattgagtttgctggtagtacagcttaattatcctttagctggtattaattttaagcatgcatttatctatgtctga

SEQ ID NO: 2380 - DNA, 1125 bp, Glycine Max
atgggaaaaagacaatctttgcgcaacaaagccacccaccttgtttctgtccttctcaaccccatctccgattccgacacttccaatcccaaaacctccaaacaacacccaccaacaccaacacctacacctccttccggacaagtaggtggatcagagacaaatgatgaagagggtaaccgtggtttagttgatgggcctgatacttcgtccttcactgcgttcctctattccttattgtcttcctctgacactggagataatgcaaactcacgcgtgcagagtgatgataataaatctgctgcacctgatcacaaccctttaccagactcatcatcgctgaaggaaaatggtgggaggaagagtttgatttctagaagcaagcaatcaattggtaaggctattcgcagaattggtggatttcgccatcaggatcgcagggataatgttgaaatgaaattggatgatgggcatggttctaaggtttctggtggtgttgagatgaggagaattgaacctgtgactgtgcctttggttgatcttccagaaatttctgaaccttcagttctcctttcagatagtatacggaacgttctctatgtttctcttccgcctcttattcacggaaggaaatggctgttgttgtacagcacttggaggcatggtatatcactttccactctttaccggagaagcatgctttggcctggattgagtttgctggttgttggagataaaaaaggagcagtatttggcagcttagttgaagcacctctcagatcatccagcaagaaaaaataccagggaacaaacaagacatttgttttcacaaatatctctggtcagcctgttatatatcgtccaacaggagtaaaccgctttttcacactgtgcaacactgactacatagcaattggtggaggaggtcattttgcgctttatttggatggtgatctattgaatggttcaagttcagtctcggaaacgtatgggaatccttgccttgcaaattctcaagactttgaagtgaaggaagtagagttatggggctttgtacatgcttcaaaatatgaagaagtacttgcaatgagcaaaacagaagcacccggggtctgccgattctga

SEQ ID NO: 2381 - DNA, 1008 bp, Glycine Max
atgggaaaaagacaatctttgcgcaacaaagccacccaccttgtttctgtccttctcaaccccatctccgattccgacacttccaatcccaaaacctccaaacaacacccaccaacaccaacacctacacctccttccggacaagtaggtggatcagagacaaatgatgaagagggtaaccgtggtttagttgatgggcctgatacttcgtccttcactgcgttcctctattccttattgtcttcctctgacactggagataatgcaaactcacgcgtgcagagtgatgataataaatctgctgcacctgatcacaaccctttaccagactcatcatcgctgaaggaaaatggtgggaggaagagtttgatttctagaagcaagcaatcaattggtaaggctattcgcagaattggtggatttcgccatcaggatcgcagggataatgttgaaatgaaattggatgatgggcatggttctaaggtttctggtggtgttgagatgaggagaattgaacctgtgactgtgcctttggttgatcttccagaaatttctgaaccttcagttctcctttcagatagtatacggaacgttctctatgtttctcttccgcctcttattcacggaaggaaatggctgttgttgtacagcacttggaggcatggtatatcactttccactctttaccggagaagcatgctttggcctggattgagtttgctggttgttggagataaaaaaggagcagtatttggcagcttagttgaagcacctctcagatcatccagcaagaaaaaataccagggaacaaacaagacatttgttttcacaaatatctctggtcagcctgttatatatcgtccaacaggagtaaaccgctttttcacactgtgcaacactgactacatagcaattggtggaggaggtcattttgcgctttatttggatggtgatctgcttccttccatcaataatatgatcagcttgagttttgtttttgttttttaa

SEQ ID NO: 2382 - DNA, 1332 bp, Glycine Max; identical to SEQ ID NO: 105

SEQ ID NO: 2383 - DNA, 480 bp, Glycine Max; identical to SEQ ID NO: 106

SEQ ID NO: 2384 - DNA, 657 bp, Glycine Max
atgggaaatgctatggggagtaaaaaagcaaaggtgatgaaaatagacggtgaaacgttcaagctcaatactccagcaagagcaaacgacgtcgttaaggactaccctggacatgttctcttggactctcacgcggtgaaaaacttcgggcctcgggccaagccacttgagcctgactaccagctcaagcccaagaagatttattttttggtggagttacccaaggttaagcccgaaccattagtaacgaggagggtgcgatccagtggaatccgtggcatgaacgcccaggataggcttgatttcttgatgctgtcgaaacgctccgtttcggaccttaccatggtgaagcatgggcccaagccagaaaatggtgggcccacgagggtcaaaatgaggctgcccaaggcccacttggagaggcttatggaggagagccacgacgggagcgaggtggcggagaagatcataagtttgtatatggggaataatgccgccgtggacggcggcggcgcaacggtggaggcccaaaaggaggttcacaatcgcaagccacgaaggaaacgggtgagtttcagcccagtggaacaagcagaaattcatgaagaatcagcagcaccacaacagtcactagtttatagcagtccttccagatag

SEQ ID NO: 2385 - DNA, 531 bp, Glycine Max
atgggaagcagattgggaagaagagtggtgcagttcgcgaacctccccataaagcttctgatgccgaacagcttcaccaacatccacgaaatcgctctcaagaccattccttcggccacgaagatcgagatcaagcgcgtccttcaatccctctacggcttcgatgtcgataaggtccgaacgctcaacatggagggcaagaagaagaagcgtggtggcttgttgattgcaaaacccgactacaaaaaagcctacgtcaccctcaaaacccctctctccatttccccggatctctacccgatccgaatcatcgatgaggacaagaagaggatcaataagcaagccaagtccagcctcgttcaggaccacgaggcccacaccgaggcccaccaccactggctccatgaccgcaaggaggcccaaccacccttcaggcctcaaaagcatggccgtttgggccggcccgagggcgcttccaatgctaagtttccctggtctagcatgaggtctgctagtggctctactaggtag

SEQ ID NO: 2386 - DNA, 996 bp, Glycine Max
atgggaaggcaaccttgctgtgacaaagtggggttgaagaaggggccatggactgcagaggaggataagaaactcatcaatttcatcctcactaatggtcaatgttgctggagagctctccctaaactagcagggctgttaagatgtggaaaaagttgcaggctcaggtggacaaattacctgaggccagacctgaagagaggccttctatcagaatatgaagagaaaatggtcattgatcttcatgctcaacttggcaataggtggtctaagattgcttctcatctcccaggaagaaccgataatgagatcaagaatcactggaatacccacataaagaaaaagctcaagaaaatgggaattgatcctgttactcacaagccactttccaataaaactgaggaaactcaagcccaaccagatgaacaaacccatcaaccattgcaagaacaacaacaacaacaacatcaacatcaacaacaacctatcccagttgagaaagacctcaaatttgaacctgaaaaggagcaaaacagggagccagagacttcagttgaatcatcaaccatcactgaagaagttaaggaggaagaccaaatcatgacacccctatttgactcatgggaactaatgaatgagttctgcactgatgaagctcccataatagaaccaaatgagattctagttccttctgctccttcttccgcttcaccaaccactactactatatcatcttcaacatcaacatcctcttattcaaattcatccaacttccttgaagacctgctgctcccagatttggagtggtctgatgattacaatgatactaattttgacaacaatagcagcatggccttgtgggatgatgactttattggaagttggaattcgcttattaatggtgatggtgatagaaagcaagtgtttgacgctcctatcaatcagtacccaagtgtgatcatggattcagattcttgggactatggcttgttttga

SEQ ID NO: 2387 - DNA, 3093 bp, Glycine Max
atgggaatgaagggtgctcccgccactctctccgacgacgacgtcgttctcaagtccccaaacgaccgtcgtttgtaccgcctcatccacctccccaacggccttcgcgccctgctcgttcacgatcccgagatttaccctgaggggcctccgaagcatgtttcaaacgaggacgaagttgaagaagaagatgatgatgatgaagaagaagacgaggatgaagaagaagaagaagaagatgaggatgatgatgatgatgatgaggaagaagaagaaggaaatgaaatggatggggtgaagggtggtgctgctgctgctcagagcaaaaaggctgcagcagctatgtgtgtaggaatgggcagcttctctgacccgtatgaagcgcagggactagcgcattttttagaacacatgctcttcatggggagtgatgaatttccagatgaaaatgagtatgatagctatttgtccaagcatggtggctcatcaaatgcttacacagaaactgaatatacctgctaccattttgaagtgaagcgagagtttctgaagggtgccttgaaaagattttctcagttctttatttcacctcttgtaaagatggaggcaatggagcgagaagtacttgcagtagattcagagtttaaccaggttttacaaagtgatgcttgccgtcttcaacaacttcagtgccatactgcagctcataatcatcctttaaatagattcttttgggggaataaaaagagcttggttgatgcaatggagaagggtattaatttgcgggagcaaatattgaaattatacaaggaatattatcacggtggattgatgaagcttgttgttattggtggagagtctctggatgtgcttgagagttgggttgtggaactgtttggcgctgtcaagaaaggtcaagcaaacccagtgttcacagtggaaggtcctatctggaaatctggtaaagtttatcggctagaagctgtcaaagatgttcatatccttgacttatcatggacacttccctgtctacaccaagagtatttaaagaagccagaggattatttagctcatctccttgggcatgagggcagaggaagcttgctctcctttctcaagagcagaggatgggctacatctctatctgcaggtgttggggaagaaggaatttatcggtcatctatagcttatgtcttcgtcatgtccatacacctcactgactctggtgtagaaaagatctttgatatcattggctttgtctatcaataccttaagttgttgagccaagattctccacaagaatggatatttaaggaacttcagaatattggaaacatggatttccgatttgcggaagagcagcctcctgatgattatgctgctgagcttgcagaaaatatgcacttttatccaccagaacatgtaatttatggtgactacgtgttcaagacatgggataaacaattgttaaaacaagttcttggtttcttcattcctgaaaacatgagggtagatgttgtttcaaagtcgttccttaagtcagaagatttccaatatgaaccttggtttggttcacgttacgttgaggaagatattggtcaaagtttcatggagttatggagaaatcctccagaaattgatgtctcactgcatcttccttccaagaatgagtttattcctagtgacttttctatacgtgctagtgacacctgtgttgatgattttgcaaattcaacatctcctagatgtataattgatgaagcattaataaaattatggtacaaaccggatagcactttcaaagttcctcgtgccaatacatattttcgaattaccatgaagggtggctatgctgacgtgaagagttgtgtattatccgaattgtttattcatcttcttaaagatgagttgaatgaaatcacatatcaggctagtattgccaagttagaaacttctgtcacttatgttggtgacatgcttgagctgaaggtctatggtttcaatgaaaagcttcctgttttgttatctaaattcttttcagtatctaaatctttcgtgccaactgatgatcggtttaaggtaataaaagaagacatgaagagagctttaaagaacaccaacatgaagcctctaagccattcaacatatttgagattgcaagttttgtgtgagagtttttatgacgctgatgagaagctgtgttatctaaatgatttgtttcttgatgatctgaaggcatttatccctgggcttctctcccagatatacgtggagggtctatgccatggaaatctgtcaaaagaagaagcaattaacatatcaaaaatatttaagatgagttttccagttaatccgctccctattgagttgagacatgctgagcgtgttatttgcctcccatccagtgccaatttagttagagatgtcaatgtgaagaataagtcagaaaaaaactcagtggttgagctttattttcaaattgatcaagattttggtctgggttcaatcaaattgaaagctttaattgatctttttgatgaaattgtggaggagccatttttcaatcaactgaggacaaaagagcagcttggttatgttgttgaatgcagcccgcgagtaacataccgtgtctttgggttttgtttctgcgtccagtcatctgagtacaacccagtttacttgcagggtagaattgaaaacttcttaaatggcctggaagaattgctggatggacttgatggtgattcctttgagaattacaaaagtgggttagtggcaaagctgctggagaaagacccttcactcacatatgaaagcaatagattgtggaaccaaattgttgaaaaaaggtacatctttgacttgtcaaagaaagaagcagaagaattgaagaacataagtaagcatgatattgttgaatggtacaagacttacttgaaaccgtcgtctccaaagtgtcggcaactacttattcggctatggggttgcaacacagacttgaaagaagctgaagcactacccaaatctgtgctggccattacagatccagcagcttttaagatgcaatccaagttttatccaagtttttgttaa

SEQ ID NO: 2388 - DNA, 4310 bp, Glycine Max
atgggacatctaaagattcaaatgcaaactggtcttattcccacagaggacgaatatgtacaatgtgatgctggatatccaaacaagactaccatagcatgtatgatcaatgcagaaattagtgctgttttggctgtcatgcgaagaaatgttagatggggagttcattacatgtcagatgatgaccaatcagagcactttcttgttcagtctttaaagacattaaggaggcatgttttctcatggcataaccaatggcatgccatcaaccctgccttgtatctccagccctttttggatgtgatacgatcagatgaaactggtgcacctattactggtgttgctttgtcatctgtttacaaaatcttaactctagatgtgattgatcaacacactgtcaatgttggggataccatgcacttggtggttgatgctgtcacaagttgcagatttgaagttactgatcctggatcagaagaagtggtattaatgaagattttacaagttcttctagcatgtgtgaaaggtaaagcatctgtaatgctgagtaaccaacacatttgcaccatagtgaatactagtttccgtatagttcatcaagcaggaaccaaaggtgagctgttgcaacgaatagcacggtatacaatgcatgaactggttaggtctatattttctcaccttcagaatattgacaacacagagtctgcattcataaaagggacagctaccttaaaacaagagaccaatggactaaataatgaccatgctttggccagcagacaattggaaaatgggaggctgaattctgcacaggatgctcaaccattatctacaggcattgcttccagtactgcaacagacttgacagcagctgtaattgatgaaaacaaagctattgcttgcaatggcaatgagattgatccacatgaattacagctcatgactgaaccatatggggttccatgtatggtggaaatatttcacttcttgtgttctttgctgaatgttgctgagcatatgggagtgaatcctagatcaaacacaataacatttgatgaagatgttcctctttttgcgttaaatttgattaatgcagccatagagttgggagggccatcctttcgctgtcacccaagattactgagtttaattcaggatgaattattccgcaatcttatgcaatttggtgtatcaatgagccctcttgtactttcaatggtgtgtagcattgttctcaatttgtatcaccatcttcgtacggaactcaaattacagctagaagcatttttttcttgtgttattttgaggcttgctcaaagcaaatatggggcttcatatcagcaacaggaggttgtgatggaagcacttgttgatttttgcaggcaaaaaacattcatggtggagatgtatgctaactttgactgtgacataagttgcagtaatgtctttgaagatcttgctaatttgttgtccaaaagcgcatttcctgtgaacaatccattatcttccatacatgttcttgcgttggatggtcttattgctgtaatgcagggaatggccgaaaggataggtagtagatctttaagttcagaacaatctcctgtgaattttgaggagtatactccattctggatggaaaagtgtgacagttttggtgacccaaatgattgggttccttttgtccgccaaagaaagtacataaagagaagattaatgattggagctgatcacttcaatcgggatgttaagaaaggtcttgagtttctccaaggaacacatcttttgcctgacaaacttgatccccaaagtgttgcctgctttttgagatacactgctgggttggataagaatctcattggtgattaccttggaaatcatgatgaattctgtgttcaggttcttcatgaatttgctaggacatttgatttccaagatatgaccttagacacagccctgcgtgtatttttggagacttttaggctgcctggagaatctcagaagatacatagggtgcttgaagctttctctgagagatattatgaacaatcaccacacatccttgctaacaaggatgctgctcttgtgttgtcatactcaattatattgcttaatacagatcatcataatgtgcaggtcaaaaagaagatgacagaagaggattttatcaggaataataggcgtataaatgatggcaacgatcttcctcgagaattcctgtcagagatttaccattcaatttgtaaaaatgaaatccgtaccactcctgaaccaggctttggatttcctgaaatgaccccaagtcgatggatttctctgatgcacaagtcaaagaaaactgctccattcatcgtatctgattctagagcatacttggattatgatatgtttgtgttattgtcaggcccaacaattgctgccatttctgtggttttttatgatgctgaaaatgaagaggtataccaaacatgtatggatggatccttagctgttgcaaagatatcagcctactatcatcttgaaaatgtacttgatgatctggttgtgtgcctctgtaagttcattaccatttgggatccactatcagttgaggaatctgtcctggcctttggagatgacacaaaagcaagaatggcaactgagacagttttcactattgcaaataggtatggcgattacatccgcgcagggtggaggaatattcttgaatgcatcttaatatttcacaagttaggcctccttcctactcggttggccagtgatgcagctgacgagtcaaaggtaactatagaaaatggacatgggaggtctaattcaatttctttatcatcaactcatcttcaatatattactccaaagagatcctcgggattaattagcaggtttagtcaactcttgtctcttggtgctgaagaggcacaatcaataccaactgaagaacaactggtcgctcatcagcaagctacacaagcaattcataagtgtcacgttgacagcatattcactgagagcaaatttctgcaagctgaatctctattgcatcttgcgaaagcgctcattaatgctggagctcaacatctgaaagggagcagaatatctgaggatgaagacacttcagttttctgtctggagttactggtggcaatcactctcaataacagggatagagttggacatctctggagggatgtttatgagcacatatccaatattgttcagtcaactgtgatgccttgtgcactggtagaaagggctatttttggacttcttagaatttgccatcgcttacttccctacaaagagaacattactgatgaacttttgaggtccctgcaacttgtcttgaagcttgatgctcgggttgcagatgcatactatgagcagattacacgggaagtcagtcgccttgtgaaggcaaatgcttcacatattagatctcagtctggatggcggacaatttcatcactgctttccatcactgctagacacctggaagcatctgaggctggatttgatgcgctgatattcattatgtctgatggagctcacttgctccctgctaattatgttctatgtgtagatgttgcgagacattttgctgagtctcgtgtaggactggtagatcggtctatagttgcactagatctaatggcaggttctattaattgtttagaaaagtggtctaataatgctaagaaagcagtcaaagaagatgaagtggaaaagatgttgcaagatattggggaaatgtggtttaggctagttcagggactgaggaaagtatgtctggaccagagagaggaggttagaaatcatgcattgttatctttgcaacagtgcttgacaggagctgttggaactcacatcccacacgagttgtggttaacttgttttgatcaagtgatcttcactgtgctggatgacctgcttgaaattgcacaggcacactctcagaaggactacaggaacatagaaggaacacttgttattgccttgacactcttgtctaaggttttcctccagttactccaagaactatcgcaatttgaaaccttctgcaaactatgggaggatatgctaggctgtatggaaaaatgtgtgaagatgaaaattcagggaaagagaagtgagaagcttcaggagcttgtgcctgagcttctgaagaacattttgcttgttatgaaagctgggggcattctagtgcacagcagtggctcaggagataatagtttgttggaactggcatggcaacatatgaagaatattgctccgtcgttgcagtctgaggtgttccctgagcaagattcagaaca

SEQ ID NO: 2389 - DNA, 1770 bp, Glycine Max
atgggagaacttctttttgagacttatggagttccatctatagcctttggtgttgacgcggcattcagctataaatataatcaacagcaaggtgtttgtgataaagatggtcttgcaatgtgtcctggattcaatacaactcatgtgattccgtttgtagatggggagcctatttataaaggatgctgtcgcaccaatattggtggattccatgtgaccgattatttaaaacaacttctttcactcaaatatccttatcatatggctagatttacatgggaaaaggttgaagacctgaagatggaacattgttatattgccccagactatgcttctgaagctcggctgtttcagaaaggagctaaagaggccgaagaaaaaaccagatgttggcagctcccttgggttccacccccaactgaggagcctccttctgaggaagagattgcaagaaaggcagcaataaaagagagacaagggcaaagattacgagaaatggctgaggcaaagaggtcatctagaataaacgaattggaaaatgaattgcatggtttggaatttcttttaaaacagcttgaacaagttgaagacagtaatgttccgtctttcctagcagcaactggttatgtctctaggcaggagatagaatctgcccgcactaaagttacacaatccttacggaaagcaaaaggtgaaccaaagaacgagcaagctgaaactgataaggccagccctaatgctaatgaaaagtattctcttataaacatccctgatgacatgctcacaacagaccagctcattgaaaagaagaaacagttatcactgaaatccatgtctgaagggcggcagcgattaaaacagaagcgttatgaagaggaattggagcgagaaaggaaacaacagctagaggatgagaaacgcctagagaatccagagctttacttggaacaattgcatgctagatacaaagacctttcagagaaagttgaccaacgaaaacggctcaagacaaatggaggtcattctaatggaaataacttatccggtggcattggtcgtggtgagagactcaatgctgctcaaagggagagaatgcgcctcttgacaactgctgcctttgatcgcggcaagggtgaggatacatttggtgccaaagatgaagattggcaactttacaaattgatgggcaaagataatgatgatggtgatgaggaaccagatgaggatgatgcagagctagcccgcatctcttcaaggctactggacttggatccaacatttgtgcccaacaagtcagaaacaggtagctctcaacctgccgaggcaccacgtgcccgccctctcaccaaagaagattttcagattgtttttggtgttgaaaggttcaggtgccccgaaattttgttcaatccaaactggattgcggttgatcaggcagggttagatgagatggctggggtctcaataagaaggttatcatgtaaggatgaaagcctggaagagagactcactagctccatacttgtgactggtggaagttctcttttccccggcatcattgaacgccttgaagccggaattcggatgattcggccatgtggagcacccataaaagtagttagagcactggatcctgttatggatgcatggcgtggggctgcagcgttcgcatcagccccacaattccatacacaaactttcagtaggatggattatttcgaaaagggtgaagactggctccgcagttatcagattaaatactcattgtaa

SEQ ID NO: 2390 - DNA, 828 bp, Glycine Max; identical to SEQ ID NO: 107

SEQ ID NO: 2391 - DNA, 3342 bp, Glycine Max
atgggagatccagcggagagcttcggatcggaaggtttggattccgccgccgccgttaagaccgacgacctttgtatggaaatcgatccgccatttcaggaaaacgtcgccaccgccgaggactggcggaaagctctcaacagagtcgtccctgccgtcgtcgtcctccgcaccactgccactcgctccttcgacaccgagtccgccgccgccagctacgccaccggcttcatcgtcgacaagcgccgcggcatcattctcaccaatcgccacgtcgtcaagccaggtccggtggttgcagaagcgatgtttctgaaccgcgaagaggttccggttcatccgatttacagagatccggtacatgattttgggttctttcgttatgatcctggtgctatacaatttctgaactatgaggagataccacttgctcctgaagctgcctgtgtaggactagaaatcagagttgttggtaatgatagtggtgagaaggtttccattttggctggtactcttgctcgtttggatagggatgctcctcattataagaaggatgggtataatgacttcaacacattctatatgcaagcagcatctgggaccaaaggagggtcaagtggttccccagttatagattggcaaggcagggcagtggccctgaatgctgggagcaagtcatcaagtgcatcagcattctttctgcctctagaacgagttgtgagggcattgaggtttcttcaaaagggaagtgaaacttatgttgataaatggaaggcagtttctatacctcgtggtacacttcaggtgacatttctccataaagggtttgatgagactcgtcgacttggcctcagaagtgagacagagcaggtagtacgtcatgcttctccagctggtgaaactggaatgctcgttgtggactctgtggtgccaggtggtccgggttataaacacttggaaccgggtgatgttgttgttcgtgtcaatggagaagtcattactcaatttctgaaacttgagactctacttgatgacagtgtaaacaagaatattgaattacaaattgaaaggggtggcacatctaagagtttaacattgtcggtgcaagatttgcactcaataacgcctgattatttcttagaagtgagtggggcagtaatacatcctctttcttatcagcaggctagaaacttccgtttccattgtggtcttgtttatgtggctgaaccaggatatatgctcttcagagcaggagttcctcgccatgcaataattaagaaatttgctggtgaagaaatatcatgtcttgatgaactaatatcagttctttctaagctatccaggggtgctcgagtaccattggaatatataagctacactgatcgtcatcgaaggaagtctgttttagtgaccgttgataggcatgaatggtatgtaccaccccagatatacactcgtgatgacagtactggcctttggaatgctaaacctgcttttaagcttgattcccccttcctatcattgggtgctaaagatgttgacaatctgtctagacagccagtttcactaactggtgagcgtgcttgtgggggacatgtgtttggagataacaatcaggagtttgttgatggtgtcactagcatggaaaccaattgtgaagatccctcagagtgtgtatctcaccacaatgcatctgatggtgtggtgaaaaaacgaaaagtggaggaagatttatcagctgatggaaatcttgttgctgatttttccttaaatgataccagggaaactaagctagaaaaatcaagtattatacaggatgacatgttaatggactatcagggtgcaactgcagctacagcaaatgcgtcagttgctgaacgtgtgatcgagccgactcttgtgatgtttgaggttcatgttcccccatcttgtatgcttgatggtgttcattcacagcacttttttggaactggtgtcataatttatcactcccaagatatgggattagttgcagttgacaagaatacagttgcaatatctgcctctgatgtaatgctatctttcgccgccttccctgttgaaattccaggagaggtggtatttctccatcctgttcacaattatgccctcatatcatatgatccctcagcattgggacccgttgggggttcagttgttcgtgctgcagagttacttccagagccagcattacgccggggtgattctgtttatcttgtggggttgagtagaagcctacaagcaacttctagaaaatcagttgttaccaatccttgtgctgcattaaatataggatctgctgattcccctcgctatagggcaaccaatatggaagtaattgagcttgatacagattttggcagtacattttcgggtgtgctaacagacgaacaaggaagggtccaagctatatggggaagcttctcaactcagctgaaatttggttgcagcacctcagaagatcatcaatttgtgaggggtattccaatttatgcaataagtcaggtccttgacaagattatatcaggtgcaaatgggtcacctcttcttataaatggtgtcaaaaggcctatgccacttgtgagaattctagaggttgaactttatccaacattgctttcaaaggctcggagttttggattaagtgatgattggattcaggcacttgttaagaaagatccagtaagacgtcaggttttacgtgttaaaggttgtttggctggatcaaaggctgagaatcttttagaacaaggggacatggttttagcaatcaacaaagaaccagtgacatgcttccgtgacatcgaaaatgcttgccaagctttagacaaatccgacgccaatgatgggaagcttcacttgactattttccggcagggacaagaggttgaactttttgtgggaacagatgttagggatggaaatggtactgctcgtgcaattaattggtgtggttgtattgtccaagatccacatccagcagtgcgtgctcttggatttcttcccgaagaaggtcatggtgtatatgtggcaaggtggtgtcatgggagtcctgtacatagatatggtctatatgctcttcagtggatagttgaaattaatggaaaaccaactccaaatatagattctttcgttaatgtgacaaaggaactagaacatggcgagtttgttcgtgtaaagacaattcacctcaatgggaagccacgagtcctaacattgaagcaagatttgcattactggcctacgtgggaattgagatttgatcctaatagtgcgatgtggcatcgcaatataatcaagggattgaactgcagtacggtctga

SEQ ID NO: 2392 - DNA, 1458 bp, Glycine Max
atgggagctttgactcatgaaccttttataggggtgaatattggtagagatctctcagacatgcctcaccccactcaagtagtagcactacttaaagcccagcaaattcgacatgttaggctgtatgatgccgaccaagctatgctcattgctcttgcaaacacaagaattcaagttgctgtgtctgtccctaatcaagagatccttgcaattggtcaatcaaataccacagctgcgaaatgggtttcccataatgtgatagcacattaccctgccactaacataactactatttgtgttggttctgatgtcttaactaccctcccctatgcagcaaaagtgcttgtcagtgcccttaagttcattcactcagccctcgtggcatccaatcttgatcaccaaatcaaagtctcaacacccctttcctcttccatgatccttgattcatttccaccttcacaagccttcttcaaccgctcactgaatccagtcttggttccaatgcttgatttcttgcaaaccactggctcttatctcatgctcaacatctacccttactatgactacatgcagtcgaatggtgtgattccattggactatgcactcttcaaacccctccctccaaacaaagaagccattgattccaattcccttctccactactccaatgtgtttgatgctgcggttgatgctgcatacgttgccatggcttttctaaattacactaacattcgtgtggtggtgacagaaacaggctggccctcaaaaggtgactctaatgagcctgatgcaacagtggaaaatgcaaacacttacaacagcaatttgatcaagcatgtgcttaacataaccgggactccgaaacaccccggaattggtgttagtacttacatctatgagctctacaatgaggatgcaaaggcagggccattgtcagagaagaactggggtttgtttgatgcaaatggtaaacctgtttatgttttgcacttgacagaatcaggaggagtgttggcaaatgacaccaccaatcaaacttactgtgttgcaaaggatggtgctgatcctaagatgctgcaggctggaatagattgggcatgtggacctggcaaggtggattgctctcctttgctgcaaggacaaccatgttatgaaccagacaatgtggtggcacatgcaaattatgcttttgacacttactatcatcagatgggaaagtctcctcagtcttgtgatttcaatggcatggctacaatctccaccaccaatccaagtcatggatcctgtgtatttccaggaagtcttggcaacaatggcaccttccccaacgtcacgttatcatcaatgaattccacaaattcagattcttctgcctgcaatctccatagtggtgaattgggaattagaagccttctaatggtgatagtacttctactatggggagtggctttgctataa

SEQ ID NO: 2393 - DNA, 1623 bp, Glycine Max
atgggaggcaattcaccagagaggaaacctggttgtggcttgatgacagcagtatttgggcgaaataatccatggtcacgaaaatcagtctctgcaggttcttctcccgtagccaacaattttgaaaaaccaccaaacattcaagattcaaaacggagacatagaggctctaatgattttccaacccatgttgtaagccaaaggaagccacaaaatcgcaaaagggtaccaaaagaagctgttggaatctctggtgaacttgaaagcatgatcaatgaacacctaaagtccaaaggaagtagtacccttggcaatttaggtaaccttaggcaaggagcaggaccaaattacaatgcttacagtgaaatggattactgtgttagtaataatgttgctagtggaggatacacaaatcaaaccataggacgtgaatacgataaaattagttatggcaaagaagctaaaccaagcaaggaacaatcaggttcactgtgtagggctgtgtctactcgaatggatcccgaacaattgaagataatgggcaatgaggattacaagaatggaaggtttgcagaggcattggctttgtatgatgccgccatcgcaattgacccgaataaggcttcttataggagcaacagaagtgctgcattaactgctcttggtaggcttttggaggctgtttttgaatgtagagaagctattcgaattgagtctcattaccaaagagcccatcatcggttgggaaatttgcacttaagattaggagaaacagataaagctttgtatcattataaacaagcaggaccagatgctgatccagatgagattgctaaagcaaagactctccaagtatatttaaacaaatgcaccgaggctcgtaggttcggtgattggatcacacttataaccacaaccaacaatgctatatcatctggtgcagactctgctccacaaatatatgcattacaagccgaagccttgctaaaacttcgtagacatcaagatgcagacaaagtaatgtcaaggtgccctaaatttgatgttgatgagtgtaccaagttctttggacctattggtaatgcaaatttgttggtgacacaggctcaagttgatttagttgctggcagatttgaagatgctttggaggcagcacaaaaagcaactaggttggattctaatagtaaggaggcaaataaggtgatgagaaaggctcgagctgtcacaagtgctcgtgcaaagggaaatgagcttttcaaggcatcaaaatttcatgaggcttgcattgcctatggagaaggccttgattatgatccatacaactccgttttgctatgcaacagagctgcttgtagatcaaaactaggccaatttgataaagcaatagatgattgcaatactgcccttaacttacgcccatcttacagcaaggccaggttgagaagagccgattgtaatgctaaggttttggtgattaaatgcatcaaaacacattctttttatcaacaaatttggaaagatgggaagcttcaatacaggactatgaaatttactaaagagacaccagaagatgaggaagtaaagcgagcattgctgagcccagcacagcttcaaaacaggcac

SEQ ID NO: 2394 - DNA, 690 bp, Glycine Max
atgggagtgctttccaataagattgatagggaacaattgaaacccggtgatcacatttactcctggaggcaggcttacatctatgcccatcacggaatatatgttggagagggaatggttatccacttcaccagaagagcagggcaagaaactagatcaggaacgatcttggaccgtctccttataagttcaccaccacttcgtgctacttttgacactccatgtccaagatgtggtgatcaagctagatctgatggtgtcatttgttcctgcttagattgttttctctcaggtggtgatctatacttatttgaatatagtgtgtcacctgcattttttctagccaaagctagaggaggtacttgcaccaccgcattttctgatccaactgatgaagtccttcaccgcgctctgtttcttcttgagaatggattcggtggttaccatgtcttcaagaataactgtgaagactttgcaatttactgcaaaacaggtttacttgtagtcactaacatcagtgtagggaggagtggacaagcagcatcatgctttgctgctgctagtgctgtagtttcttcaccactgaggtttatgactgccagctttggtggtttggcattggttggatgtggtatgtattgtgttagcagatatgtttctgatattggagtacgcggtgatgtagctaaa

SEQ ID NO: 2395 - DNA, 624 bp, Glycine Max
atgggagtgttttccaataagattgatagggaacaattgaaacccggcgatgtcatttattcttggaggcaagcttacatcattgctcaccacggtttatatattaaaagaatcattcttattcagatttttataaactggaacaagaacaatgttggaccgttttcatgtaagttcaccccatcatgcttctcactgaaggtgtcactcaaacctgcttggattcttttctttatggtggttatctatacttatttgagtatggctagaggaggaacttgcaccactgcatcttctgatccaaccgaagccgtcctttgccgcgcttcctttcttctcaagaaaggatttggtggctaccatttgttcaagatcaactgtgaggactttgcaatgtactgcaaaacaggcttgcttgtagtcacagacatcagtgtagggcaaagtggacaagcaacatctctcttggctgctgttgctggtattgtgacaaataactgtggtggtgcattggttggatttggctcatattgttatggaagatatatctatgatattggagtacgcagtgttgtgacaaaagttccagtggaggagatacctaaaatggccaaggaaaactga

SEQ ID NO: 2396 - DNA, 620 bp, Glycine Max; identical to SEQ ID NO: 108

SEQ ID NO: 2397 - DNA, 426 bp, Glycine Max
atgggatttgctttgtcttttggttccttgcctgttttggtttcctcttatgactttgctaccccaaataaagaaattcaatggctggggtctgtcttcactggcatcatcttctgtgttgtggtttatagattgactgctattttgagttctctgttgttcaagggatatggcaaattgagtagtgcagagaaaattgaatggaataaccggggattctcaacatttcatgctctgtttgcatcatttacgtcattttacctcttggtgttatcagatattttcaacaaggattcacatgaagaacttgttattaatagatcatccactttctcaaattcggtactggggatttctataggttattttctagcagatctggcaatgattctttggcatttcccagctttagggggtctggaatag

SEQ ID NO: 2398 - DNA, 333 bp, Glycine Max; identical to SEQ ID NO: 109

SEQ ID NO: 2399 - DNA, 333 bp, Glycine Max; identical to SEQ ID NO: 109

SEQ ID NO: 2400 - DNA, 333 bp, Glycine Max; identical to SEQ ID NO: 111

SEQ ID NO: 2401 - DNA, 333 bp, Glycine Max; identical to SEQ ID NO: 111

SEQ ID NO: 2402 - DNA, 333 bp, Glycine Max; identical to SEQ ID NO: 111

SEQ ID NO: 2403 - DNA, 567 bp, Glycine Max
atgggcgatgcaattgatttgactggtgacggaggagtcattaaaaccattgtaagaaaaagcaaagctgatgctgtcggtccaacagaaaatttccctcttgttgatggtcattatgaaggcacacttgctgatactggtgaagtttttgacactacacatgaagataacaccatcttctctttcgagattggaaagggcagtgttatcaaggcttgggaaattgcagtgaaaaccatgaaggttggagaagttgcaaaaataacttgcaagccagaatatgcatatggtagtgcaggatctcctccagatattcctccagaggcaacacttgtttttgaagttgagctagttgcctgtcggccaaggaagggctccagtttgggaagtgtttcagaggagagggctaggcttgaggaactgaagaagcagagagagctagctgctgctgccaaagaggaggagaaaaagaagagagaagaagcaaaagcagcggctgccgcacgtgtgcaagccaagttagaagccaaaaaaggtcaaggaaagggtaaaggtaaagcaaagtag

SEQ ID NO: 2404 - DNA, 1269 bp, Glycine Max
atgggctcctccgcgatggtgttggacccgaaaccctcatcggagcctccgccgttcctcccgtcgacgaaatcggactaccttcaaggcagcttcggcggcgacgccaccgcctccgacgaggacgacctctacagccgcctgaaatccctccagcgccagctggagttcatcgacatccaggaggagtacgtgaaggatgagcagaagaatctcaagcgcgagctgctccgagcgcaggaggaggtgaagcggatacagtcggtgccgctcgtcattggccagttcatggagatggttgaccagaacaacggcatcgtcggatccaccaccggatccaactactacgtcaggatcctcagtaccatcaaccgcgagcttctcaagccctccgcctccgtcgcactccaccgccactccaacgcgctcgtcgacgttcttccgccggaggccgactccagcatctcgctcctcagccagtccgagaagcctgacgtcacttataaggacattggaggatgtgatatacagaaacaggaaatccgtgaggctgtggagctaccccttacacatcatgaactatacaaacaaattggtattgatcctccccgtggtgttttactgtatggaccccctggcactggcaaaacaatgcttgccaaagctgttgcgaatcataccactgctgctttcatcagggttgtgggatctgagtttgtgcagaagtatcttggtgagggtccacgaatggtccgtgatgtatttcgtcttgctaaagagaatgcccctgcaattatatttattgatgaggttgatgcaatagccactgctagatttgatgcccaaactggagctgatagagaagtacagcgtatccttatggaacttttgaatcagatggatggttttgaccaaacggtaaatgttaaagttataatggcaactaacagagcagacaccttggaccctgctctgttgcgtcctggaaggcttgatcgtaaaattgagttccctttgcctgatagacgccaaaagaggctcgtatttcaggtttgcacagccaaaatgaacttgagtgatgaggtagacctagaggattatgtttctcgtcctgacaaaatcagtgctgctgagatagcagccatttgtcaagaagctggaatgcatgctgttcgcaagaatagatatgtcatactgccgaaggacttcgagaagggttacaggacaaacgtgaagaagcctgatactgactttgaattttacaagtga

SEQ ID NO: 2405 - DNA, 357 bp, Glycine Max
atggggacggtgaccgcagaaatccgtgacccgaatcagagaaaacggctcaagggccccaacgccgtcactaacttccccctgtccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttcggcgagtttgacccggacgagttcttgacgtggccgagttaa

SEQ ID NO: 2406 - DNA, 369 bp, Glycine Max; identical to SEQ ID NO: 114

SEQ ID NO: 2407 - DNA, 420 bp, Glycine Max; identical to SEQ ID NO: 115

SEQ ID NO: 2408 - DNA, 474 bp, Glycine Max
atgggggttggagattactggtctgatttaatgggaagtgggaatggcaaccaccaacacaacaacaagaacaagaacaagaagcaattacagaccgtggagctgaaggtgatgatggattgtgacggctgtgtgctcaaggttaggaaaactctctcttcattagatggagtagaatcggtggagataaacaggaagcagcagaaagtaacagtaactggttatgtggaaccaaacaaggtcttaaagaaggccaagtcaacagggaaaaaggctgagatttggccttacgtgcctttcaacatggtggctaatccatatactgttcaagcttatgacaagaaggctcctccgggatatgtgaggagagtggacaactctgctgccaccataggaacagtgacaacagcatatgcagattcatacaccaccatgttcagtgatgaaaacccaaatgcatgttctatcatgtag

SEQ ID NO: 2409 - DNA, 2241 bp, Glycine Max
atggggttggctttgttagcttcgaaggccgtgagacccacatcaaggctcctcttcggttcccaaaaccctagcaccttcctcctccgaaccatcgtctccaagccccagcttcggaatcccgaagccaccgccgcgcatccggagcagccgccgcctgccgatctcccgccgcggactccgctcgccggcgcccgcgtccacttcccaaaccccgaggactccatcgaggttttcgtggacggctaccccgtgaaaatccccaagggaatgaccgttcttcaggcctgcgaggtcgccggcgtcgacatcccgaggttctgctatcacagcagactctccatcgccggcaattgccgcatgtgcctcgtcgaggtcgagaaatcgcccaaacccgtcgcctcttgcgccatgcccgctcttcctgggatgaaaattaagactgacacacctgtggcaaagaaggctagagaaggagtgatggagtttttattgatgaatcatccattagattgcccaatttgtgatcagggtggagaatgtgatcttcaggatcagtcaatggcatttggctctgatcgtggacggttcactgaagtgaagagatctgtggttgataaaaatcttggacctctggtgaagactgtgatgactcggtgcattcaatgtacaaggtgtgttagatttgcaacagaggttgctggggttcaggatcttggcatgttaggtcgtggaagtggagaggagattggaacatatgttgaaaaacttttgacaagtgagctttctggaaatgtcatagatatctgtcccgtgggagctctcacttcaaaaccttttgcatttaaagcccgaaattgggagttgaagggcacagagacaattgatgttactgatgcggttggatccaatattcgaattgatagcagaggacctgaagtgatgcgcattgttcctcgtttaaatgaggagataaatgaagaatggatttcggataaaacccgcttttgttatgatggtttgaaaaggcaaaggttaaatgatcccatgatacgtggttctgatggacgctttaagcctgttaactggcgtgatgcacttgctgtggtagcagagattgcccaccaagttaaaccggaagaaattgttggcatagctggcaaactttcggatgctgagtccatgattgcactaaaagatttcataaataggatggggtcaaatgatgtatggggtgaaggcattggtgtaaatactaatgctgatttcagatccggatatattatgaatactagcattgctggtcttgaaaaagcggatgccttcctgttggttggtacccaggcacgggtggaagctgccatggttaatgccagaatacgcaagactgtcagagcaaaccaagccaaagttgggtacattgggcctgctactgatttcaactatgaccacaaacatcttggtactggccctcaaacacttctcgaaattgctgagggtcgccacccatttttcaagacactctcgaatgccaaaaaccctgttatcattgttggtgctggggtttttgagaggaaggaccaggatgcaatttttgccgctgttgaaaccattgcgcaaaaagcaaatgttgtcagacctgactggaatggccttaatgttttacttctccatgctgcccaggctgctgcccttgaccttggacttgttccacaatctgagaaaagccttgagtctgcaaaatttgtatatttgatgggtgctgatgatgtaaacttagacaagatcccagatgatgcttttgttgtttatcaaggtcaccatggtgacaagagtgtttatcgagcaaattttattttgccagcagcagcattcagtgagaaggaaggaacctatgaaaataccgacggatgcacgcaacaaacattgcctgcagttccaacagttggtgactccagagatgattggaagataattcgagctctatctgaggtggcaggagtgcctttgccctatgatacaattggggccgttcgtgcccgaatcagtactgtagccccaaaccttgtgaacatggatgagagagaaccggccacattgccatcttcactcagaccaaccttctctgagaaggtggacaccaccccattcgggactgtagttgagaatttctatatgactgatgccattaccagggcatcaaagataatggcacaatgcagtgccatgctgttgaagtga

SEQ ID NO: 2410 - DNA, 1130 bp, Glycine Max
atgggtaataacaggttcagattgtcagatatgatgccaaatgcatggttctataagctcaaagatatgagcaaatcaaggaagagaaatggccctcatgttatgaagaacaaagtagcctcaccaacaacatcacaaaggtcacagccaagatactctcattatttctccattgaaccaaacatagctggtaagttatacaactctcctattttttacaccaaacactcagataacacattcactgattcaccaagaaggtcatccaagagaagggctgggagaaaaaccatttataagccttctccaacagttgtgtcttcacccgtcatcgaaagttttggttgtcattccacaaacaattggattaagccaaatcaacttcagtctccagactattatctctcctccatagagatttcttcttctgaatcaaacctcaatgatgaatatgtttcatctgagtctgagtgtgataagttcactattcctgacctgcttaatggggtagcctctgaatgcagttgtagagttagctcttccaccaatgacatcatcattgacatgaaaaatgaacccttcaatggaaattctgaaaaccttgatggctttgacacaatttcacaattgggccttgctccaatattaacaaagccagtgaagtttgatgataaggtcattgaaaccactgagttgagaagatcagctaaatttgatgagctgaagtctcatcagtctctatctgtcatagttagcaaagaggaatgtagtagaactaagagagaaagaaaaacaagtccagtagctagagtttcctctgctaattctccaggtataaaacttagagtcaattctccaaaactcgcaagcaagaaagttcaagcctatgcaaggaggagtgtgtcatccagagcatgcaaggcctcaatgaattcaggctttccagagggatttgcagttgttaagtcctcacttgatccacaaagagacttcagggagtcaatggtggagatgattgtggagaacaatatccacgcatcgaaagatttggagaacttgcttgcctgctatctctcactgaattcaagggaataccatgatcttattgtcaaagcatttgagcaaatttg

SEQ ID NO: 2411 - DNA, 945 bp, Glycine Max
atgggtagtagcagtaggaggtgtttgagcttcaccacttggcgtgaccggtacttgcggtattccttctcccgggccggactcaaatccacaaccaccgatctcggcgacggcaccatcatgcattgttgggcccccaaggcccataaccactccaccacttcccttcttctcatccacggcatcggagccaacgccacgtggcagtggaaccacttcatctcccccctcacgcgccacttcaacgtatacgtccccgacctgctcttcttcggagattcccacacgacacgacccgagaggtcggagtggttccaagcgaagtgcgtgatggctctgctggaggctctaggggtccgccaaacaagcgtggtggggctgagctacggcggctttgtggcgtatgctgtagcggcgatgttcccggagagggtggagaaggtggtggtgtgttgtgctggcgtgtgcttggaggacagggacatggaggatgagggaatgttttgggttaaaagtgttgacgaggttgttagtgttttgctgccgcagacaccgcagaaggttagggaactgctgcagcttaccttcgccaaccctatcaaactcttgccaacttgttttctcaaagatttcattcatgtgatgtgtacagagtaccggcaggagaggacagaactaattcaagcattgcataaggatagaaaactgtctaatcttcctaagataaccaagcctatgcaaattatctggggagagcaggaccaggtattcccactggagttagctcacagactgaagaggcacgtaggagagaaggcacaacttgtagtcattacgaatgcagggcatgcaatcaatgtagagaagcctaatgagctgtgcaagaatttaaaatccttcctcattgatccatccaagcaagaaaatcacagcaatggtctaaag

SEQ ID NO: 2412 - DNA, 1446 bp, Glycine Max
atgggtatagtgaggggggtgttattggatgaatcagtactcttggctgaaagtggtgatgataaaactgtttctttactccggccaggagctgagtctctcatccgaacactcttcctgtccagaacgcatagtggaatttcttatggtgttggccttccagatgacaaggcaagtgttcttcaaaaaattgctagtttgtactcacttgattgcttcatcttaaatgattctgtaagtgaggttatgcctggatggagtaatactgatgatggcagcattattatttatctgatttctgataagaaggagttcttacctaaattaagcagctataattggctggttgttgttctaaatgttggaggtgaaagcatatgtcacaatccaaatatacttcagattgaaaacttagaggagtttccattgaccatatgccacttaaataaaagatcaattggaaccaatgctgtgactgtgagttatacaatgaagccttctcgtgtcgaagattttgcaaagaggggtgcatttcctttgtgtcctactcaaaatgggttgatgtttgtgcctctcgcatccaagctgcctttatcatctcaattaaagggtgttgacatagttctccacaaagccactgatgaaatattatcaattgaagataataatattacttttacacagaacatccaagcattgcaaagatacttggatcagcaccaggatttctgtgttattgatccactgagtaatgtttatcctttattggataggctagaaattcaacaagttctacttggcttagtagaactgaacactgaaggcaaatatttgatcagaggggcccattttcttaaggctgataactttgatgaatttgattttgcaactggactagctgaagctagattgtctcttccatgtatagtgaaacctaaggttgcttgtggtgtcagtgatgcacataagatggcaattgttttcaaagttgatgattttaagaatttaagtgttcctcttccagctgttattcaggaatatgtggatcattcatccactttgtataaattttatgtcttgggtgaaaagattttctatgctgtcaagaagtcaataccaaatgctgatattttgaggaaatcatctaatggtgatgagctcaaacctctactgtttgatagcttaaaatctatgccgaccgctgacagtatcacaagtaatgagcctattgaccttaagctggttacagatgctgcaaattggcttaggagaaggcttcagcttaccatctttggttttgatgttgtaattcaggaaggtactcatgaccatgtaattgtggatgtaaactatctcccatcatttaaggaggtgcctgatgacatctctattcctgccttttgggatgccattagaaataagtttgactctagggtatctaaataa

SEQ ID NO: 2413 - DNA, 1875 bp, Glycine Max
atgggtgcatgtttgagtaagaagaaagggtcttcttctacagcaaccaagtcagcttcttccacagcacatgttgctgtgcctgagctgaagaacaatcctccttctgttagtggtgtcactgtttccaaacccaaagtggaaactgaaactgccccagaagtgaaactgaacaaggacaattctaagaaagtggaagagaagcatgagacagtgccagaacctgaagggcatgtgaaaaaggagatattcatcatcaagcacaggaagagccatgatgatagagagagaaactccaattccaaatccccatctttcactgaagaatcaatggctgataaaactgccccaacaccatccacaaacatgggtgttgtaggagtgaggacttcaagctgcaccaaagaagaggtggatgcaattctcatccagtgtgggagactcagcagaagctcttcagggaatgctgctgctgctgcttctggtgaacacagaagaaggtactcaggctcaaagagaagctatgattttgaccactgtgacaatgacaccgtttccaatgatgatgactcaaagaaggccaatgccaatgagagcaacagtgatctgtgtgaggaggagaggcaccagcaacggccacggcaacgccagtctccgagccgaaggccttcttcttctcaggaaaggagaagaagaacaccaagcagggaaagggaacagcagcaaaggtcaagcagcagggagaggagagtgagtagatctcctggaagaaggtcatcagagaacaccacaccttccaatgcaagaaacaacaattgcagcaacactagttctaggcctgggaagatggtttctgttcctgccactgtttcatcactggtgatggataagagtaacaataatggtggtggtggcggtggtggagaatctggagcaaccactggcatcaagaggatcacagtgaagagaaatgtgggtgctgcctctccgcggtcgcagtcgccagcaagagcaaatgggaatgctgcaagtggtaataaagctttcaatgagaatcagcagcagccatcccttagccgcagcaattcaaggaaagcagaacaatcaccttacaaaagaaatccattgagtgagattgaacctaactcccttgcttttccacattcaacagccaataatagcagcagcaaggtgcaaaacagacccaaaaaggaatttgaaacagaagctaatcagaaaacaaacggcagcagaactgcattggacaagggaatgaatgtaaattgcaagacaaaggtgcaacaagaggaagatgtgaaagtgcagtcttcaattactgataatgttgttgtgaaaacaatggtaccaccaggagttgacaacctaaaaccaccctatacattaacaagaagcagatcttcgaggcaatcgcgggacttagacctcaaccctgaagctctattgaatcctccacagtcctatgcttcactgctgcttgaagacatccagaatttccatcagaagaacacaccacctgtttctctcccagcatgtgtcaccaaagcttgctctatcctcgaagctgttgctgatctcaactctaacgccggcttaaatttctgcggtgcagaagacaggagaagtccactggcttttcagtgtagcaggaatgactacaatgtttcattgactacccacgattatggaaaaagggagccagatgccgaggacccggttgtagaatcaatgttattattcaatgatgatgatgtgatggaacaaagcttgcacaagtatgtgacagtgaataggggtggtttgcttggtggggtggacatggatgaccaagagtcttcgggaagcaacagcttcact

SEQ ID NO: 2414 - DNA, 1110 bp, Glycine Max
atgggtgctgcgggctccaagctcgagaaggctctcggcgaccaattccccgaaggagagcgttactttggcctcgagaattttggcaatacttgttactgcaacagcgttttgcaggcactatacttctgtgttccatttcgagaacaattgctagaatattatgcaaataacaaaagcataacagatgcagaggaaaatcttttgacttgcctagccgacttattttcacagataagttcccagaagaagaaaacaggtgtcattgctcccaaacgatttgtacaaaggttgaaaaaacagaacgaactcttccgtagctatatgcaccaggatgcccatgaattcttgaactttttgttaaatgaacttgttgacattctggagaaagaggcccaggctgcaaaaaatgatcaagagacttcaccaccttctgaaaaggctgcaaatggacctaagaatagtctagccaatggtgctaaaaaggagcctttagttacttgggtgcacaaaaattttcagggaatactcaccaacgagaccaggtgcttgcgatgtgaaactgtaacagctagggatgaaacattttttgacttaagccttgatattgaacaaaatagttcaattacaagttgcttgaaaaacttcagttcaacggagacattgaatgctgaagacaaatttttttgtgacaagtgctgcagtttgcaagaagctcagaagcgaatgaagataaagaaaccacctcatgtgttggtcatccaccttaagcggtttaaatacattgaacaactgggtcgctacaagaagctgtcttaccgggttgtcttccctcttgagctgaaattgagtgatactgctgaagatgcagatattgagtattctctatttgcagtagttgtccatgttgggagtgggcccaaccacgggcattatgtaagccttgtgaaaagccataaccactggttattttttgacgacgaaaatgttgagatgattgatgagtctgctgttcagacattctttgggtcttcgcaagaatattccagcaatacagaccatggttacattttattctatgagagcattggctctggtaacaggaactag

SEQ ID NO: 2415 - DNA, 576 bp, Glycine Max
atgggtggccaacaaaagaagattggtcaaactcaaagaagaagaaatgagattatgggtttcacagtttctcacaacaagccttcagggtttgacctgatgcagaactgtgatcttcctccaccttccaagttttttatgggtccagataagagtgtcatattgtccatgaataggctctataacagagaagaagagcaacatagcaaacagtctggtgcttacaggattgacagtggacatgatgaaaaggataaaatggagcttctgaaggcactgcgagcatctcagacacgggccagagaggcagaaaagaaggctgcagttctgaaaaatgaaaaggagggtctttctatggttttgttggaagaggccatgcacttgtttgcatatcgccaacaggtgcgtttgcttgagcttcaagttttccgcttgcaacaatcccttttgctgcgtcaacaaccagagggagatggccatgatgaagaaactactggtgttgcatgggttctggccttggttctttcgttgggaattggagttaccactgctcttgcttgcagatactatctgtga

SEQ ID NO: 2416 - DNA, 1029 bp, Glycine Max; identical to SEQ ID NO: 116

SEQ ID NO: 2417 - DNA, 1884 bp, Glycine Max
atgggttctgtgaactccaaaactgaaaagaatgaagccttgcttctttgtaaggaaagaaagaggttgatcaagatggccattgattccagatatgctcttgctgcttcacacttatcttacatccaatctcttcgaaacattggcgtcgctcttcgacgatacgccgaggcagagatgctaatagagtcgtccttatcggtttcagatcacacctcatctcaatctacttacccttctccatcaccttcacatattgatgatgatgcttcggagtcaccattgaacaatgagagtcatcatcatcatgtgagttatatgagaacaagtggcagtgcagctgtgactgttatgatcaatccccacattgaaaatcacttcgatgatgaagccattgggttgttcccaattcctccacctcctcctgagagtggtgcctcttgggatttctttgatcctactgataatgctaagaatttcaagtttgaggggcatgcaagttacttcaaggatgaaggagaaaccggttcgttcatggatgtgtcaaggggtcaatggtcacaagttgctaatgaaagggatgttgctagagcggtacaaggttgcaaacagaattatgttggtgttgttggacgatcaagttcaaagaacaataagaaggatctagctatgaacactgagagggatgatccttctgagttcatcactcacagggctaaagattttttttctagcattaaggttatagagaatcggtttgtacgagcttctgaatctggtagggaggtctcaaggctattggaggcaaacaaaatcaaggttggatattctgaggcaaaagggaaatcatctcccacgattttgctagcggcttttatgtttgcttgctacggtcaaaaggctacacctttttgccaagaacctgcacagaagattattaactggaagaggacattatcttctcaatcatcctcaatcaggaacccattagttacaacatcgaagaagtatatggatgataatggaagtgacttttgtgaagaaccctgcatgattgctggaagtcattcgtgcacccttgacagattgtatgcatgggagagaaaactttatgatgaagtaaaggctggtgagttcatcaagaaggattttgatcgaaaatgtgaccagctaaggcatcaatttgcaaaagatgaaggcaataaagtgattgacaaaacccgaacagtagtgaaggatctgcattcacggataatagtggctatttattctgttgatttaatatctaaacgaatcgagaggatgagagatgaagaattgttcccacaacttttggaattaactcaagggaactcaatgagaaccttggaaggagatacccgaagagagataatgactcagctactagaagaatttgagtgctttggtctaagcttttctaactgtatcgacagccacacctcatacattgaagctctcaatgtatggctacaaaattgtatactacaaccaagggaacgttccaagagcagaaaaccattctcccctcgccgtgctttggccccacctatatttgttctttgtcgagattggtgtgctggaattaaagctttgccttctgaggaactaagtcgtgcaataaagaactttgtgtctgatcttcgtcgcatgatagagcagcaagatcaagagcttcatgaaaaacagaattcaactgttgcaagcattggtggagaaaccgagagcaaaactaatgaagaaagtgaagacgattcttcacatttgtgttgcatacatgcaagtttaaccaaacttgttcaccaactcactaaatttgctgaggcatcattgaagttgtatggaagatatcagacaaaaaagtga

SEQ ID NO: 2418 - DNA, 1161 bp, Glycine Max
atgggttgcttctttagtgtaccttcaaagatcaaagctgagagccctccacgtaatggtttgaattcaaaggatggtagcaaagaagagaatgatttgagttgtttaagcagcaaggtgtcctcttcagctatgcttctaactcctcaaagtgaggatgagatattgcaggccagcaatttgaagaacttcacattcaatgagctaagaactgctacaaggaactttcgtccggatagtatggtgggcgaaggtgggtttggttgtgtgtttaaggggtggatcgatgagcatacacttgcccctactaaaccagggacaggaatggtcattgctgtgaagaggcttaaccaagaaagcaaccaggggcacattgaatggttggcagaaatcaactacctggggcagctcagtcatcctaatcttgtgaaactaattggttactccttagaagatgatcaccggattttggtgtatgaatttgtggccaagggtagtttggataatcacttgttcaggaggggttcttactttcaaccactctcttggaacatccgtatgaaggttgctcttgatgctgctaagggtcttgcatttcttcacagtgatgaagtagatgtaatatatagggacttcaaaacttccaatatcttacttgattctgattataatgcaaaactctctgattttgggttggcaaaaaatggacccgaaggtgataagagccatgtctctacaagggtaatgggcacctatggctatgcagctcctgagtatatagccacaggtcacctaaccaaaaagagtgacatatacagttttggagttgttcttctggaactcatgtcagggaaacgtgcactggatgacaacaggccaagcggggagcacagtttagttgaatgggccaaaccactcctcaccaacaaacacaagatctcccaagttatggatgctcgcatagaaggccaatactcaaagcgcgaagcaaagagaatagctcaccttgcaattcaatgcctatctacagaacagaaacttagaccaaacataaatgaggtggtgagattattggaacatcttcacgattccaaagacacaagctcaagcagcaatgctactcctaatccaagcttatctccttctcctcttcgttcatag

SEQ ID NO: 2419 - DNA, 297 bp, Glycine Max
atgggtttcgtctccgccagtggcttcttctccgtgatttgcttcatggtagtcatgcatgatatgaaaaggttgggattggaggctaagggatgttgtgttggttgtatagtgaagggacaatatggtggttttggttggaatagggatggacgtgggttgttcaaagatgttggtgtggtgaagagtggaaaaaggccttgtaagggttttggagattcatgtgttgtagggcaatctattgtggtggagagggtttgcttaagccgaaaagggtgtgaatcctatgaaaattga

SEQ ID NO: 2420 - DNA, 510 bp, Glycine Max; identical to SEQ ID NO: 117

SEQ ID NO: 2421 - DNA, 1098 bp, Glycine Max; identical to SEQ ID NO: 118

SEQ ID NO: 2422 - DNA, 198 bp, Glycine Max; identical to SEQ ID NO: 119

SEQ ID NO: 2423 - DNA, 813 bp, Glycine Max
atggtgctaactccgttaacctccaccttctccttcctatgctctttctctaaccttctcggcttatatgaccaatatgttttgaatgtttcagatgagagggaagacgatgccaagaagcttatgagattggtgaatgtggagtcactcaagatgaagcttggtatggaagggaaggaagttatttgctattctgagcttcttgaggcctgtgaaagtatggggattgcgaggagtcctgaggaggctgcagcatttgccagggttcttgatgaggctggggttgttctcctctttcgggacaaagtttatttgcatcctgataaggtagtggatctggttcgaagagccgttccactggcactgactgctgataacgatcctatgagggaggagttgaagaaactgcaggacaagaaagaggaaattgatgtgttagcacataagcaggtgcggcgcatcctctggtctggactgggatttggtgtaatcactgttggcttcttcttccggctaacattctgggaattttcatgggatgtaatggaacctattgcattttttaccacaaccactgggttggtcataggctatgcctatttcttattcacttcaagagaccctacttaccaagacttcatgaagaggctctttctttcaaggcagaggaagctttttaagaggcaaaattttgacattgagagattcaaggagctccagtgcaagtgcaagacacctttacatgctagtaccgttttaaaaaatcgcataggggtggaactggatcttgaagatgctttacatagagattaa

SEQ ID NO: 2424 - DNA, 189 bp, Glycine Max; identical to SEQ ID NO: 120

SEQ ID NO: 2425 - DNA, 258 bp, Glycine Max
atggtggaggttactttcacccaactcagccacaagtgcagagggccatacgcccacaactgcagtcgcaacgtcattttcaaaatgtcagtcaaggaacaagctccaacagttcatcttcaaaaggacatacattggtgcatagaggccaacagatatggaggccaaagagttaaaaggggatctctattactccgaaaatgccatggttttagctttgaacaggtttttactattgcctttcagtttacttgttaa

SEQ ID NO: 2426 - DNA, 600 bp, Glycine Max
atggtggctgtggtttcccaagaaaatgttgtggcattggtttctcgtaccggtagggagttgcaacgttatagaaaaggtcgtcgccaagttgtggggtgcataccgtacagatttaagattggggagaagacttgcttggatgtttctgatgaattggaagttctggttattagttctcagaaaggaaaagggatgctattcccaaagggaggctgggaattagacgaatcaaaaaaggaggcagctttgagagaaaccatggaggaagctggggtgcgaggcattgttgggggtaaattgggtaaatggagtttcaagagcaagactcatgacactttctatgaaggctacatgttccctttgcttgttcaagagcaattggagttctggccagagcaaaacgttcgtcaaagaatatgggtgagcgtcacagaagcaagggaagtttgtcaacactggtggatgaaggaagctctagacagacttgtaaatcgtctctcgggtcaaaaacaacttggtcatcatcgtgataataataagcaagttcttggttctataaactgcaaaggagatgccaaatctgacttgtgtaaatag

SEQ ID NO: 2427 - DNA, 141 bp, Glycine Max
atggtgggagtggtattgggttgtttccctggtaagcggttcttgtactgtgttcaaagttttcaacttcccaagcaaacagagctccatccacttgttggtgttgtgtcacctactcactcactcaccccagcttcctag

SEQ ID NO: 2428 - DNA, 642 bp, Glycine Max
atggtggtgaaggtctatggtcctgcaagtgcagcctgccctcaaagggtgttggtttgcctcttagagaaaggggtagagtttgaacttgtgcatgttgatcttgatcaaggagagcataagacacctgaatttcttctcagacagccctttggtcaagttccagctgtagaggatggtgatttcaggctctttgaatccagggctattataaggtattttgcatcaaaatatgctgaccgtggccctgacctattgggtaaaaccttagaggagagggcactggtggagcagtggcttgaagtagaggcaagcaacttcaacaatttgtgcttcaatatcatgtttcagttggtgatcctaccaaagatgggtaagcctggggacttggccttggctcacaaatgtgagcaagatatagaaaaggtgcttgatgtgtatgaaactaggctctctcaaagcacatatcttgctggagataatttcactttggctgatcttagccaccttccagggcttgaacatctcattgaggaagctaaattgggacacttggtcactgagaggaagaatgtgaatgcttggtgggagaaaatttcaagtagaccagcttggaagaagttaaaggatttgattcactaa

SEQ ID NO: 2429 - DNA, 243 bp, Glycine Max
atggtgtatgctggcactatccacccaaagcgccttaaaaagtctgagatttggaattcgtcaaagtgggtgtggtctttcagtgtgaaagccaccaaaggcacaccattgtctttggacacaattgaaaatcgccctgttttctcgagtccctctttcagcaccagcatgttgtccctgcagttttccatcacgtttctatatccctgcaatcacattttagttggtagtattgagcaatga

SEQ ID NO: 2430 - DNA, 426 bp, Glycine Max
atggtgtcgcagaagaacaagaacaagggaggctatgatgatcatcagaaaccgaggaataacaggtttttggtaaacatcaatatcatggggagtgcggggcctataaggttcgtggtgaatgagaaagaacttgtttctggggtcattgatactgctctcaaatcctatgctggcgaagggaggcttcctgttcttggatttgatgccaccaatttccttctttactgcgcaaatgctggctttgatgctctgagtccattggaaccgataggatctttggggtcgaggaattttgtgctgtgcaaaaagcaggtgcagtcatcaaaggcagcaccccaatctgagttggtgtctcaaaagagcaatggtggatggaaggcatggttaaataagtcatttagtttaaaaatcctatcccattga

SEQ ID NO: 2431 - DNA, 1980 bp, Glycine Max
atggtgttgaagaagagggtagattatggatttaatggctttcgagttcctgttatacctaaagctcctagatctgccagaaggagggttgctttcaacaaagcagttgaggatggtcaagtttgcgctattgaactactggcatctttagctggccaattgttgcaggagagtgaaagttctgcttccagcaatgcgtctgaaggaaatcatcagcctgccttcagccaaggtgtaattgagcaagatatacaagatgaagttaaaccattaaaaatggaggaaattcatcagggaaattgtgcagagagtacttttaagactgaggtagcctcacaaaaaagtagtcagaaacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgtatctcctgcactaattgactcgaaaagtaatattaaatctccatttcataggaaattttttcccagtgcttccttttccaggtatgggaatggcattaagttaggttttagagatgatgacgaaaaatttttaaggtgcaaaagggtttgcactaaaccaaaggcttttaggtctccacgacgcattgcacaccgaagaatcaggaatttgatgtcttccaaatactggaagacagctccaaagttgaaggactgtgaactttctgatctaggagtacctcgttatcataagaggaaaacttgttacggttttgaaagatctcagcacaatgccattgttaaaaagaggaaattcgttgaccgggtttcaggggtaacttctgatggaggattcagtagtgagagtgtgtccaattcacctcagaaagggatggatgcagacaagcctagctcatctgcaaaattgcatgtacttaaggctaaggattctcatgtaaagtttagcataaagtctataaggataccagagctttatattgaggttcctgaaacttcaactgttggttcactaaagaggacaatcatggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacgagcttctccaactatttgtgttggtgatccttcttctcaatgtgaaacatcccagcctacatggcccacagaaactcctgtcttagattcaggagttactgataccttgcatgactcacccttgctgacatatccgggcaacctaattgaaagtaaccatgagcccacttcttcactcgccgacactacagttaacaaaataacacctgattccagagcaatagttgctgttccagctaccacagaaacattagctgtggttcctgtgagtcagaaaaccaagcgctctgagtttgtacagcgtcgaaccaggagaccattctctgtgactgaggtagaagcacttgttcacgcagttgaggaacttggaactgggaggtggcgtgatgttaagttgcgagcttttgagaatgcagaccataggacttatgtagacttaaaggtacattatttctttccttccccctctagtcacaaagtaccctttaacatgtgggttattttacatggtttgacctctagaaggataatacataaaaaatggcattggagttacttttggttatggctaatttggtattgcccttatgattattttgattga

SEQ ID NO: 2432 - DNA, 1395 bp, Glycine Max
atggtgttgatcagagaagaagagatagtggaggagatgagtgaagcggagtgcaatatcgactacgagaagctgaagaaacgcatgtggaaggaccgagtccttctgcagaagctgaaggagaagcggcagaaacaggaaccagacgtggaagcgaaacaagaggcatcgaagaggaagaagatgtcacgagcacaagactcggttctcaagtacatggtgaagatcatggaggtctgcaacgcccaaggcttcgtctacggcatcatccccgagaagggaaaacccatgtccggttcctccggtagcctccgcaagtggtggaaggaccaaatccgctttgaccaaaacgcccccgtcgcagtctcaaagtacctcccactcctctcaaaagacattgaccttgacattgcttcctacatacacctcctccaagacttgcaagactcaaccctagggtctcttctttccgctctcatgcaacactgtgcccctccacagagaaggttccctttggagggagggctttcccctccttggtggcccaacggggaggaaatctggtggggcgaacagggccttctggcccaagaaaacggcccacctccttacagaaagccccatgacttgaaaaaggcttggaaagtttctgtcctcgccgcagttatcaaacacatatctccagattttgataaactcagaaggctggtgactcagtccaagaccttgcaagataagatgactgccagggacagtgccacgtggtcgaaagtcatgaaccatgaagaggctttgctagatctaaccgagaagtgcctcaaaatatctaatgatgatgacaaccttgaagaagaagaagaagaagaagaagaagaagaagaagaagggttttctggttctcatgaacctcaacttttgaagaggaagggcgcgtttggctttggtagtactgatgctttagtggataagctgtatgcttgtcaaaacgcagggtgtccacagagtgagccttctatggagtttgcggataagaacttgaggctggaccatgaggctctgcgtgctttccgaacagtggatagcgatgttcttccatttcaccgttatctctccaatgatgcaccaccaatcacaagtttggatgatttgatgaacgtggcttttcagaatgatgtgaaccttggtgaggctgctggtgggagtggcacattggaagatgacccttgttactggcttaacgccattgaaaatcttgagttgcaggctgcgttagagttgttggtgagagataacatggactttgctcaaaatgttccggtgcagattccgcagggacagggacaagaggatgcagcctcagtttggggcttgggaacccatccaacgcaaggatag

SEQ ID NO: 2433 - DNA, 1668 bp, Glycine Max; identical to SEQ ID NO: 121

SEQ ID NO: 2434 - DNA, 228 bp, Glycine Max
atggttatagaaggagggtttcccctattagagatgttcaggctttgggtgtattcaagagagagttctaagtttcggtatggcggtgatcacgcactaagtgcgacggcatctgggcttagcgagtatggtagcaagcacgcacttagcgcgagattcacactaaacgcgcctttgggcttcttcatgaatcttcttcacgctaagcttgatctgactactaagtga

SEQ ID NO: 2435 - DNA, 933 bp, Glycine Max
atggttccatttcaggcattgcaggccttcggtctcaccgttgacaccgtgtgtcccggaaggaaagccggtgatgtctgccgcaccgccatccatggaattcacggcgaccagacttactctgagatgattggtcacaaatttgtactcaatgcaacgtttgatgaagttgatgcttcaagctatgatgtgttgtgggtgccgggtggcaggtctcctgagtatctttctcgtgttcctggtgttctggaactggtgaccaagtttgtaagtttaggaaaactaattgctagcacttgtcatggacctttgattctggcagcttctggagtgcttaaaggtcgcaaatgcacgggttttccttctcttaaaccagtgttggttgatgctggagctgattgggttgatcctgacaccatgacaacaacagtggaggatggtggattcattacttcaactacttatgaagggcaaccggagattattagccttcttgtgaaggcattaggaggcaaaataagtggcaccaaaaagaaaattctctttatttgtggggatttcgtggaagatttccaggccaaggttccttttcagtcccttcagtctttaggatgccatgtcgatgcaatttgcccctcaaagtttgctggtgacttttgtccaactgctgttcatgattttgaaggagatcaaacttacagtgagaagcatgggcatcattttgatttaacagtagcctttgatgatgtggatccttcagactatgatgctcttgtcatccctggaggtcgatcacctgagtatttgtcattgatggatccaatccttgacttggtgaggcatttctttttaaacaataagccagtggggtctatcggtcatggccaacagattttagctgctgctggtgttctaaaggtatttatactgtaa

SEQ ID NO: 2436 - DNA, 131 bp, Glycine Max
atggttcctgattctcataatgcattgccacatcctccatgcatgcaccatcatcatgatcatcatcattaccattaccactaccattatcacaggcaccttcatcgttcttcttctccgttgccgcaacc

SEQ ID NO: 2437 - DNA, 2694 bp, Glycine Max
atggttcgtgcactcacgaatggagaaaggggtggcctctgcgatctggtggattcgcccaactatgctgcaagtgcggttttggggggcttggatgatgcaagggtagttttggggattaagattttgggacacgttcatattgattctgttttaaaatcagagatgtttttgggttttgattttgatgtaatcaatcttgtggggtttccaagtgtatttttaagatctgcttacgagaattcagttttctgcaataaattccactgccaacaaactggttggagggagtgtaacttttgcaacaagcctatccactgcggatgcatagtatctagatctttgttcgagtatcttgactttggtggcataggttgtgtgagctgtgtaaatactacccaacttagtatgatgaggaatatggaaaatccaaatgtgactgttttgtcgataaaaaataatgcgggtgatcggcattctgctcattttgatggcagactgcctgtgggtggtgttgatgaaggaaaacttatgcaattctgcaaaattatcgaagctagtgaatccagccgttggaatcatgctcaaagagatggcataattgcacatcgtgggcaaaaaaaccaagaagccaagaaaaataataggtcaacatgggagattaaaaacatgcatgaatcaaatacaaaaccatctttgagtatgtatctgggaaatgcatcagggaacaactctgtcccaccttctgctggagaggctgtagaaggaagacttgatggaaaaacatctcctccctttcaaggatcacgctctatatttcctaaaccattgaagaatgggcttaccatgaatatggaaacaaataaaggtacaatgtctcaatcacgtgttgctcggccacctgcagatggcaggggcaagaatcagttacttcctcgatactggccgaggattactgatgaagagctagagcgattggctggagatttgaaatccactgtagtgccattatttgagaaggtgttgagtgccagtgatgcaggtcgaattggccgtcttgttctcccaaaagcctgtgctgaggcatattttcctcctatttcacaatctgaaggtgttcctttgcgaatgcaagatgtgaaggggaatgaatggacatttcagttcagattttggcctaataacaacagcaggatgtatgtattggagggtgtgactccttgcatacaggccatgcaattatgtgctggtgatactgtaacatttagtcggatagatcccggaggcaaacttgttatgggtttcagaaaggcatctaattctacagatacacaggatgcctccacatctgcacaatctaattcagcaaagggaaccgtctcttctggtaccgagaatctgccatcaggaaggaatgttgaatgtcacttaaatggacatacagagcatctgcatttgggtactggaactgctggattgcttaaaactgaaaataatgagatgacaaacagtagttcaccacaacaacaaatttccgttttagagaagaagaggactcgcaatattgggcctaaaagtaagaggttgctaattgataatgaagatgccatggagttgaaacttacatgggaagaagcacaggatttgcttcgtcctcctcctagtgtcaagccaagcattgtcacaattgaggaccaagtaatcgaagaatatgatgtaagcacaactgtatcaaatcagtacatatttttattttgtagggggaaggaacaatgggctcaatgtgatgattgctctaaatggcgaaagctgcctgttgatgctcttcttcctcccaagtggacatgttgtgaaaatgtttgggattcaagcaggtgttcatgctctgcgccagaggagttaagttcaagggaaatagaaaatcttctgaaaaacaacaaagattttaagaagcggcgaatcgtagaaagcagcaagtcaatccaagaacatgagccttctggtcttgatgctcttgccagtgcagcagttcttggagaaaatctcattgacactgccgagtcatcagctggagtcaccaccaaacatcctagacaccgtcctggctgctcttgcatcgtgtgcattcagccaccaagtggaaaggggagacataagccgacatgtacatgcaacgtgtgcatgaccgtgaagcgccggttcaaaactctcatgctaaggaagaagaaacggcaatccgaacgtgaagcagatgctgcccaaaaagatcaaactcttccaaaagacgagctggataccaatggagcatcgagagacgatacaagtcagttggagaaagaggctggactaaaaagtcaacatgaggtgggtgggtccagtgctggacagatagatctgaattctcatcccaaccgcgaagacatgcaagtggaaaccactggacttaacatgtctagtcatcttgaacctgcaacaaaccatacagtaggggaatttatgaaccaaaatggcctaagaaactttaataatgaagtgcaaactggtcagaattcttctttgcacactcctaaatctaatggagaaggtcagagatacttctctgatggaagatgctttgcatccattatgtggaaccaggaaagaaaagatgaggtacacagtcaaaccaatcaaagtcaaaacaatctttcttaa

SEQ ID NO: 2438 - DNA, 1512 bp, Glycine Max
atggttctctccaaaaccgcctccgaatccgacgtctctgtccactcaaccttcgcttctcgctatgtcagaacttcgcttcccaggttcaagatggcggaggagtcgataccgaaggaggcagcataccagatcataaacgacgagttgatgttggatgggaacccaaggttgaatttggcatcatttgtgacgacttggatggagccagagtgtgataaactcatcatggctgccattaataagaactatgttgacatggacgagtaccctgtcaccactgagctacagaatcgatgtgttaacatgatagctcatcttttcaatgcaccactagaagagactgaggcagcagttggtgttggcacggttggctcatcagaggccattatgttggctggattggcattcaaaagaaagtggcaaaacagaaggaaacaagagggaaagccttatgacaaacccaacattgtcactggagccaacgttcaggtttgctgggagaaatttgcaaggtactttgaggtggagttaaaggaggtgaagctccgtgatgattattatgtaatggaccctgaaaaggccgtggaattggtggatgagaacactatttgtgttgctgctatccttggttccacactaaatggagagtttgaagatgtcaaacgcttaaatgatctcctaattgaaaagaacaaaataactgggtgggacactcctattcatgttgatgcagccagcggtgggttcatagccccatttatttacccagagcttgagtgggacttccggttacaactagtgaagagcatcaatgttagtgggcacaagtatggtttggtctatgctggaatcggttgggttatctggagaagcaagcaggacttgcctgaggaactcatctttcacatcaactatcttggggctgatcaacccaccttcacccttaacttctccaaaggttctagccaagtcattgctcaatactaccaactgattcgccttggttttgagggatatagaaacgtgatggaaaactgcagggacaacatgctggtgctgaaagagggactcgagaaaacagggcgattttcaattgtgtccaaagacaatggtgtgcctttggtggctttcacactgaaagaccacacccactttgacgaattccaaatctcagactttttaaggcgctttgggtggatagtgccagcatacaccatgcccccagatgctcaacatgtcacagtgcttcgtgttgtcatcagggaggacttctcaaggaccctcgcggagcgtctcgtgtccgatgtggagaaggtgctgcatgagcttgattcacttcctgcaagggtcatcagcagcaccactgtgacactcagtgcagaagaaaatggcaaggtagtggttgctaagaagaatcctatggagactcagagggaaatcactgccatttggaagaagtttgtgttggagaggaagaagaacaatgacaagatgaatggtgtttgttag

SEQ ID NO: 2439 - DNA, 1356 bp, Glycine Max; identical to SEQ ID NO: 122

SEQ ID NO: 2440 - DNA, 771 bp, Glycine Max; identical to SEQ ID NO: 123

SEQ ID NO: 2441 - DNA, 978 bp, Glycine Max; identical to SEQ ID NO: 124

SEQ ID NO: 2442 - DNA, 1479 bp, Glycine Max
atggttgtagatcactactgtgactacaacaagctcaaattccgaacctttctcagaaaaatgttctgggaattcggtcttgcttgtgtggccaacccttcccggcgtcggagaagctccgagagaagctctgcctatggaaaaaagacgaatttggagcacaacaaggcgtggctgcttgcggagtctggtgggtgtggagcagaattgaccaatgctgaccctcaatcggttcactcctctttcaggttcagcttctgttctcaggtggagttggagtccttgaacatgagttcttcaagtgctgcaacggttttgatggtgaatttggacaatgggatgagtgaatctcgcgccagggagatgaaatggaggagaatggagtcgttggagaagagcatatcccctgtggctcacagcttgatcaggtttagctatggtgaaattatgtctgctactaggaatttctccaaagggagggtgttggggagaggggcattgagctgtgtttttagggggagagttgggattttgaggactgcagtggcgatcaaacgattggacaaggaaagcaaggaatctgccaaggccttttgtagagaattgatgattgcaagttctcttcatagttcaaatgttgttccccttttggggttttgtattgatcctgaggagggtttgtttttggtgtacaagtatgtttcagggggcagtctggagcgccacttgcatggaaggaagaagggtagttcacctcttctgtggcctgtgaggtacaaagttgcgattgggattgctgaagctgtagcttatctgcatagtggaactgaaagatgtgttgtgcacagagacattaagccctcaaacattctgctttcttcaaggaagattcccaagctatgtgacttcggattagctacatggacttctgcaccttcacttcctttcctttgcaaaactgtcaaaggaacatttggatatttggctcctgagtatttccaacatgggaaagtatcagacaagactgatgtatatgcttttggagtggttttgttggaactcattactggccgtaagccaattgaggcaaggagatcttcaggagaagagaacttggtcttatgggctaaaccttttctacagaaggggaaaggagcaattgaagagttgcttgatcctcaactcaagtgcagtcttaaattctcaaatcaaatgggtagaatgatcgaagcagcagctgcatgtgtcacaaatgaagaatctcggcgacctggcatacatgagattattgcaatactgaaaggtgaagaagaacctcttctctccaaaagaaagaagtccagttttcttgggaatggatgcgtgattgattgttattctcagttacaacaaacaaataatgagatgaaaagtcacttggcattagcaatgtcaggagttgcagagtttgaggatgatgattatctctatggtcgataa

SEQ ID NO: 2443 - DNA, 107 bp, Glycine Max
atggtttatgtgtatgtgtgtatctttatgcacctacacataacacatgtatttgttatattggagcaggtcatgaaatggaatggatgggtaccctccaaaacata

SEQ ID NO: 2444 - DNA, 1611 bp, Glycine Max; identical to SEQ ID NO: 125

SEQ ID NO: 2445 - DNA, 474 bp, Glycine Max; identical to SEQ ID NO: 126

SEQ ID NO: 2446 - DNA, 1296 bp, Glycine Max
atggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagcaccaaggagaatgctaccgggttgttgaaactgttgaatggttacaggaacaaagcggagtgcactgactcatcattgaatttcgagcatcttaagaagccattttaa

SEQ ID NO: 2447 - DNA, 723 bp, Glycine Max; identical to SEQ ID NO: 127

SEQ ID NO: 2448 - DNA, 816 bp, Glycine Max; identical to SEQ ID NO: 128

SEQ ID NO: 2449 - DNA, 636 bp, Glycine Max; identical to SEQ ID NO: 129

SEQ ID NO: 2450 - DNA, 846 bp, Glycine Max
atgtcacaacaaacactaaccattcttctattcacactcctcagtcttacttcttcaccagccacttgcttatactcttctccatcaccccctaccgcgccattttccgaatctaccccccacaccgaccctgaaccacgcgccgaagaatggttacccgcccacgcaactcactacgccgccaccgacgcggtcggcggcgcgtgtggttacggcgacctccttaacggcggttatggcatggccaccgccgctctcagcgaagctctcttcgggcgcggccagatctgcggcgcctgcttcgaggtccggtgccgcgaggaggattccgacttcgaccggcggtggtgcatctccggcacgacggtcgccgtcaccgccaccaatttctgcgccccgaactacggttccgacgcggagagcgtcgccggacactgcaaccctccgaagcagcacttggttctccccattgaagcgttcgagaaaatcgcaatctggaaaactggcactggcaacatgcccgtggagtatcgcaggataaagtgtgcaagggaagggggaatccggtttacaattactggttctggaatattcatttcggtactgattagtaatgtggctggaattggagacattgctgctgtgaaggttaagggttcaagaactggttggcttccaatgggtaggaattggggtcagaattggcatattaatgcattgctacagaaccaacctctttcctttgaggttacaagtagtgatgggataactcttacatcttacaatgttgctcccaaggattggagctttggacaatcttttgaaggcaagcaatttgagtcttga

SEQ ID NO: 2451 - DNA, 2034 bp, Glycine Max
atgtcaccacttcaaacatccttcttcgtcttcttcctatgttttctcaatgcctcttcttctattttcgccaccacccaatttgactttgggactttaactatgagcactttgaagcttctcggcgatgcccatttgaacaacaacaccgtcagcctcaccggcgaccccgccgtccccaactccgccgccggaagagccctttactccgcccctgtcagattccggcaaccgggaaccccttctccggcgagcttctccaccttcttctccttctccgtcaccaacctcaacccctcctccgtcggcggcggcctcgccttcgttatctcgccggactcctccgccgtcggcgaccccggcggcttcctcggcctccaaaccgccggcggcggaaacttcctcgccgtggaattcgacaccctgatggacgtggagttcagcgacatcaatggaaaccacgtcggattagacctaaatagcgtcgtttcgacgcaagttagcgacttgggaggcatcggagtggatctcaaaagcggtgactcggtgaacgcgtggatcgagtacgacggaaacgccaaagggttgcgcgtttgggtctcgtactcgaacgttcggccaaaagatccgattttgaaggtggatctcgatgtgggtatgtacgttaacgatttcatgtatgtggggttttctgggtctacccaaggtagcaccgaggttcacagtgttgagtggtggagttttaactcctcctttgattccgcggcggctcctgccgcctcgtcagcaccctccgccacgtcagagcaaaaggagagtaggtcgtctaggaagagtactgtgggggcagttgctggggttgtcactgctggtgcttttgttcttgctctctttgctggtgcattgatttgggtgtattctaagaaggttaagtatgtgaagaagctcgatcattctattgagtcggagattattagaatgcctaaggagtttagctacaaggagcttaaattggccactaaggggttcagtgctaatagggtcattggtcatggtgcttttgggactgtgtacaagggtgtgttgcctgagagtggtgacattgttgcggtgaagaggtgtaaccatagtggccaggggaagaatgagtttctgtctgagttgtctataattggaagtcttaggcataggaatttggttcaccttcaaggttggtgccatgagaaaggtgagattttgttggtgtatgacttgatgccaaatgggagtctggataaggctttgcatgagtctagaatgccgttgtcttggcctcacaggctcaaaattttgttaggtgtgtcgtctgttttggcctacttgcatcatgagtgcgaaaaccaggtaattcatagggacattaagactagtaacattatgttagatgaagggttcattgctaggttaggcgattttggtttagcgaggcaaacggagcatgacaagtctcctgatgccactgtggctgccgggacaatggggtaccttgcacctgagtacgtgcttactggtagagccacggagaaaactgatgtgtttagctatggtgctgtggttcttgaggtggccagtgggaggaggcctattgagaaagatgctcctgctgctgggaatggtaaagttggaattagcagcaatttggtggaatgggtttggagtttgcatcaagaaggtaagttgctaacagcggctgatccgagacttgaaggtgagtttgaggaaggggagatgaggaaggtactcttggttggattagcttgctcacaccctgattcaatggcaagacctactatgaggggtgtggttcagatgctgctgggtgaggctgaagtgcctattgtccctagagccaagccatctactagttacagtacttctcaactcttaatgaacttgcaagatagtgaatctgagtgtaataatggtatgatcaccatctctacctcttcatcagagagcagcttcaatggcagagatagtctgatggaagtctag

SEQ ID NO: 2452 - DNA, 364 bp, Glycine Max
atgtcacccaagttctcctatctgaactctctagttgagagaaagaagcctcaagaaaccacagatgaattggccattgtgaaagcagctgcatgggcatggtaccaacatggttcaggctctgaaggaaaggctaagagtgagtttgatgtcacaagaactcaacgtatggccaggccttcacgttacaagttagaagctatgagaatggctaaggaagcaccctcaaattcaattcacaccaattataaacctcttcttgatacatatgaagttcaatgcatttcaaggcaattggacaggcttattgtagagtctggccacaacaaacttggcaacagcatcaatgcaaataataatgatg

SEQ ID NO: 2453 - DNA, 498 bp, Glycine Max
atgtcagaagatgctccatcttccaaaaatcacacgaaagaatgtgaaggcaccgaggacacaaatccaaagacaacaacacagtgttttgtagcagctgactcttctggtcatgtggaggagatatcatccttactgaagaagcctgacaaacaagaaagccaagtagataaaagaaggaacaattgtgatgctgaaactcctcttaaatgtaataagagtacaaaagaaggtatgcgattcatttggctttatccatctaattgctttgcttttgaaatcaaaattcagttcacatttccttatgctgtggatgtacatgccacactcatttcttttttcacagaagtgaaattttggtcacctgaaggaagaaccacgatgagtggtggaaaacataaaaatggtaaaattagcttgtcgggtcaggtgatgtttgaaagctacgtctttaagcttctgcgtgttcagaaggtattgaaggaggcatgtacatga

SEQ ID NO: 2454 - DNA, 516 bp, Glycine Max; identical to SEQ ID NO: 130

SEQ ID NO: 2455 - DNA, 690 bp, Glycine Max
atgtcatccactgctagcttgggttatggggctccaacctgcttcaacaacgttcatcacacaaagaagcagcaagcaatgaggaacagtttcttgagcaataagcacaacagtgtgagagtgatgaagggttggagaggaagacatggtaacactaacaacacatccaaaagggtaggaattgtgcagtgtagagggttaggggacttcataggtggagacttgataaagtttgatcttggacgttggctttcagatgttgaagagcacaaagcacttgcaatataccctcctcatgaaggaggctatgagggccgctacttgtcgcgtctcaaacgccaagggtactatttcctcgaccttacggctcgtggccttggtgatcctgaaaccaccctcaccaagattcaccctgtttgccctcctcatgttggcaagcagccaatagcaaggtggtatttcccaccagaagttgattacagattagaagcgttgccaccaaatgccaaaggattggtagtgtggataattgaagccaaggttctctctaaggcagaactgcagttcctagctttgctgccaacacttaggcctaatgtgagggtcattgctgaatgtggaaactggagaaagtttatgtggaagccacttaaagaaattgcgggactaacaaccagtgaggaagcttga

SEQ ID NO: 2456 - DNA, 1911 bp, Glycine Max; identical to SEQ ID NO: 131

SEQ ID NO: 2457 - DNA, 984 bp, Glycine Max
atgtccaattctatctccgacccgacccgaataattcactctcaggatccgaataccaccgcggaccctcaggttccgcttcggaacctttcccaggttcggaacagaatggattctctacaacacttcctatctcaatccatcaataccaacactcccctcaccgtcgatcaaatcgccatggtctccagccagatcctctcctccatccaccaagtcatcgtcaacggcgccgccctcgtctcttactctcagaattccatcgccgccggagcaccggatccaccgccgtatccgaagaagccgaagccggaaccttcagttgccgataaagcgaagcaaacactcgattccaaactcgagcctctcgaaggcgacgacagcgaaatcgtggagctcgacgccgtcgaaatcctcgcggagcacatgcacttttgcgagatctgcgggaaaggcttccggcgcgacgcgaacctccgcatgcacatgcgcgcgcacggagaacagttcaagacggcggaggcgctggcgaagccttcggagaaagcctcgtggctgcgtgcgacgcggttctcgtgtccgttcgtaggctgcaaccggaacaagctccaccggcggttccggccgctgaaatcggtgatttgcgtgaagaaccacttcaagcgaagccactgcccgaagatgtacacgtgcgagcggtgtcgcaagaagcacttctcggtgctctcggatttgaggagccacttgaagcattgcggaggagaggccaggtggaagtgcacgtgcgggaccacgttctcaaggaaagacaagttgtttggccacattgcgctgtttgagggccacgcgcctgcgctcgcgtgtgactcagaggatccaatgttgatgagtgaaagtggatttgaattggatgattgttttttggatcaagagtttcccgaaggcttctttgatgattttgggtccattgatgactactgttaa

SEQ ID NO: 2458 - DNA, 1515 bp, Glycine Max
atgtccattgtatttcttggttttgttggattgttgtgtcgtttatacacttccttggtggagaacccaaataggcttcgctctaagctaatgaagcaaggtatcagtggtccacctccaactatactgctaggaaatattgtggacataaagaaagctcggtctaccacttcaaattctccttcttttgaaatccctgtctctcacaactgtgcttctgttatccttccattgtttgataaatggaaggaacagtatggtcaagtgttcatgttttctcttggaaacagacaaatactgtgtgtgagtcaacctgacatagtgagagatatcaccacatgcacatccttggacttggggaagccttcatatcaacagaaacaactagggcctttgctgggtcaaggtgttttaacttcaaatggaactacatgggtgcatcaaagaaagatcctagctccagaactatacatggaaaaggttaagggaatgatgaatataattagtgagtctgctatatctctgctaaacttgtggaaaagtagaacagaagcagaaggtggagttgctgacataaaaattgatgagtacatgagaaatttctctggggatgttatttcaagagcatgttttggaagcaattattccaagggggaagaaattttcttgaaacttggagctctccaagagatcatgtcctggaaaaatgtttctattgggatccctggcatgagataccttccaacaaagaccaatagagaagcatggaaattagaaaaggaggtgaaaaaattgatactacagggggtgaaggaaagaaaagaaactagttttgagaagcacttgctgcaaatggttcttgaaggtgctaggaatagtaatacaagtcaagaggccattgaccgatttattgttgacaactgcaagaatatatacttggcaggctatgagacaactgcagttgcagctacatggtgcctgatgttgctggcctcaaatcaaaattggcatgaccgtgttcggactgaggtgctagaaatttgcaggggtagtatcccagattttaatatgctttgtaagatgaagcagctaacaatggttattcatgaatcattgcgcctttatccccctgtagctgtggtgtcaaggcaagccttcaaggacatgaaatttggtaacattgatgtccccaagggttttaacctttggataatggtagtaactttgcatacagatccagatatctggggagatgatgccaacaaattcaacccagaaagatttgccaatggaaccataggtgcttgtaagttgccacacatgtacatgccctttggggttggtccacgagtgtgtcttggacagaatttggctatggttgaacttaagatgctggtagctctcatcttgtccaaattcactttctccctctctccacgatacgttcattcgcctactcttaggttgctcatagagcctgagcatggagtccatctcttggtgaaaaaactatga

SEQ ID NO: 2459 - DNA, 1371 bp, Glycine Max
atgtccgcctcatgcggggtggtggagtgcgttttcgttctgggctgcgcgcggtggctgtggaagcgctgcacctacgtgggcagctacgacagcgccacttggcccgccgccaccgccgacgagttcgaccgggtgccgcgcgtctgccgcctcatcctcgccaactacgagcccgatctccgcaccccgcagtaccaaaaacccacctccgccaccggccaccgcctgaacccggactgcgtcatcaagcgcgtgacctacgaggacacgctgggccacgcgcctccgtacataatctacctcgaccacgagaacaaggagatcgtgctcgccgtgcgtgggctgaacctcgccaaagagagcgactacaaggttctcctcgataaccggttagggcaacaaatgtttgatggtgggtatgttcatcatgggttgttgaaatcggcagtgtggttgttgaaccgtgaatcggagacgctgaagcggttgtgggtggagaatggttcggagtatgagatggttttcgcggggcactcgttgggttctggggtggtgtcgctgttgaccattttggttgtgaatcatagggaccgtttgggtgggattcccaaggagaagattcggtgctatgcgcttgctccagctaggtgtatgtccctgaatttggctgtcaagtatgccaatgtcattcattctattgttttgcaggatgatttcttgccaagaacggccactccattggaagatatattcaaatcaatattctggttgccctgcttgttgttcttggtttgcctgagagacaccttcatacctgagggtagaaagcttagagatccaaggagactttatgcacctggaagaatgtaccatattgtggagagaaaattctgcaggtgtgggagatttcctcctgaagtgaggactgctattcctgttgatggaagatttgagcatattgtcttgtcctgtaatgcaacatcggatcatggaattatttggattgaaagggaggctgagaaagccttacaagtaatgaaggctcagagctctgaaactgtgacagaccctccaacagtacaaaagtttcagaggttgaagaccatagagaaagaacatagagatgctttggaaagagctgttagcctgaatgtacctcatgcagtggacactgctgagaaagaaacatctgagaacaatgaaggtgacgacgatgcatccgccagtgcaaacaataacgtctcaagtaaccaatcaaaatctagtggtggaaggtcgaactgggatgaggtagttgaaaaacttctaaagaagaagagtgaaacgggagaacaaaacctggaaagggatacgaatgtcacacaataa

SEQ ID NO: 2460 - DNA, 786 bp, Glycine Max
atgtccgctgtgagagttcaagtttcggcgtgtgcggtttccgccaccgtcaaccaccttcgcctccgccaaaacgccgtcgtttccttcaggaagaagaagcctctcactctcagagtggtctcaatgtcttccgttcctccttcccaacccttcgaaatcgccgttaaagcttccgtcaccacacccaacaggctcggcgacggccctttttgccaaagggtgctgctgacactggaggaaaaacatctaccttatgaccccaagttggtggatttgaccaacaagccagaatggttccttaaagtcaaccctgatggtaaagttcctgtcataaagtttgatgagaagtgggttcctgattcagatgttattactcaaacattggaagagaagtatcccagcccaccattggtgaccccacctgaaagggccacaggggggtcaaagatcttttctacatttattggatttctcaagagcaaggatcccaatgatggaacagagcaagcattactaagtgaactgagctctttcaatgattacatcaaggaaaagggtcctttcatcaacggtagtgagatatctgcagctgacctatcacttggaccaaagctataccatttggagattgctttggggcattataagaaatggacagtgcctgattcacttacctctttgaagtcttatatgaaggccattttctcgagggaatcgttcgttaaaacaagtgcacaaccacaggatgtcattgaaggttggcgtcctaaagtggaaggctaa

SEQ ID NO: 2461 - DNA, 582 bp, Glycine Max
atgtcctccattctcctccttcttcttcttcctccaaatccaaaccacttattctctctcctcttcctcccaaacccctctcatattcccacaccaccatcctccacacgtaagatctcattccaccacaacgtaaccttaaccgtttcactaaccgtaggcacgcccccacagagcgttaccatggtcctccatacaagcagcgaactctccgggctccactgcaaaatacaccaaaacattcactcaatcttcaccccacacctccacaccatgcatgtctgccatgccaccgtctcctacgctgacgccacctccctagagggcagcctcgccgccgaaacgttcgccatgtccgggtcgggtcaacccggaattatattcgtgtgcatggattccgggttcagctccaacgcaaacgaggactccaaaataaccgagttaatgggcatgaaccgcgggtcgctctcgttcgtgacccaaatggggtttccgaaattctcgtacagcatctccggcaaagacgcttccggcgtgttactcttcggcgacgccacgttcaagtacacgcctttggtttaa

SEQ ID NO: 2462 - DNA, 528 bp, Glycine Max; identical to SEQ ID NO: 132

SEQ ID NO: 2463 - DNA, 1071 bp, Glycine Max
atgtcgctgctctcagatctcatcaaccttaacctctcagacactactgagaaggtgatcgcagagtacatatggatcggtggatcaggaatggacctgaggagcaaagcaaggactctcccaggaccagttagcgacccttcaaagcttcccaagtggaactatgatggttccagcacaggccaagctcctggagaagacagtgaagtgattatatgcccacaagccattttcagggatccattcagaaggggcaacaatatcttggttatctgtgatacttacactccagctggagaacccattcccactaacaagaggcacgatgctgccaaggttttcagccatcctgatgttgttgctgaagagacatggtatggtattgagcaggaatacaccttgttgcagaaagatatccaatggcctcttgggtggcctgttggtggtttccctggaccacagggtccatactactgtggtgttggcgctgacaaggcttttggccgtgacattgttgacgcacattacaaagcctgtctttatgctggcatcaacatcagtggaattaatggagaagtgatgcccggtcagtgggaattccaagttggaccttcagttggaatctcagctggtgacgaggtgtgggcagctcgttacatcttggagaggatcactgagattgctggtgtggtggtttcctttgatcccaagccaattcagggtgattggaatggtgctggtgctcacacaaactacagcactaagtccatgagaaatgatggtggctatgaagtgatcaaaaccgccattgagaagttggggaagagacacaaggagcacattgctgcttatggagaaggcaacgagcgtcgtttgacagggcgccacgaaaccgctgacatcaacaccttcttatggggagttgcaaaccgtggagcttcagttagggttgggagggacacagagaaagcagggaagggatattttgaggacagaaggccagcttctaacatggacccatatgtggttacttccatgattgcagacacaaccattctgtggaagccatga

SEQ ID NO: 2464 - DNA, 1017 bp, Glycine Max; identical to SEQ ID NO: 133

SEQ ID NO: 2465 - DNA, 1092 bp, Glycine Max
atgtcggcaacgccatcttcctccttcttcatccgcgccgccggcggcaacggtccctccgccgctcccgtcgccggctccggcgagtcgcactcgcaccaccggagggcgcactcggaggtcagcttccggctgccggatgacatgattgacttgtcgccgtcggatccgttcaacggcggatcctcgacggcgagcttcgaggagatcggatccgaggacgacctgttctccacctacattgacgtcgagaagctcggggctggacgcggcggaaacggatcggatcagagcgtccgagcaccgccgctgcgcggccgagacaccggcacagtagctccgtcgacggttccacgtcgacgagcatgttcggagagatcatggatgcgaagaaagccatgcctcctgataagctcgcagagctttggaacattgatccaaagcgtgccaaaagaatccgaatgcgatggtttaaagttgatgtcacgtaaatttctctctactgtaatactggctaatcggcaatctgccgcacgttcaaaagaaagaaaggcacgctatatacaagaacttgagcgcaaagtccagacccttcagactgaagcaacaacactttctgcccaacttacactgtaccagagggatacaactggtctgagttctgaaaataccgagcttaagctccgtctacaagccatggagcaacaggcacagctgcgtgatgttcttaatgatgcattgatgaaggaggttgagaggcttaagattgctaccggagaggcattgaaccaatctgagtcttttaacctgggaatgcaccagatgccatatgcagggtcaaatttcttttcaatcccaccacattcaggtccttctgggcaccagaacatgcaattgccaccatttggccactcccattccactgtgccgactcatcagctgcaacaaacaaattctcaccaaatgtcagatatattgcaaaacgaccagcttggtcgtctgcaaggactcgacattagtagcaaaggaacacccgtggtgaagtctgaaggcccctcaatatctgcaaatgagagtagcaccacattttga

SEQ ID NO: 2466 - DNA, 1125 bp, Glycine Max
atgtcgtatgtgcctccgcacctcagaaacgccacctccacctccgtcgccaccgccagaaccccctccgtaacccttgacaacaacaacaacaaccaccaccaccaccacaagctcgcattcccctccaacaccaccaccaccaccaattgctctccctctctctccttccacaacaatgcctctcgccggagctccgccgcgcctccctcgccgcggattcttgccacccccgacgccgtcttcccccaatggcaaccctccgaacgcgtttctcgcatgactcccgagcaggttgaagaaatccgatccaggcttaatcttgatgttgctgtcgcatctgactctcctcctgcacctgcgcctgctccaatagaatcgtttactgatatgggtttgcatccgagtatcatgaaggacattgcttaccatgaatacaccaggccaacttcgatccaggcacaggccatgccaattgctctcagtggaagggatctattgggttgtgctgaaactggtagcggaaagactgcagctttcacaattcctatgatacagcattgcctggcccaacctccaattcggcgcaatgatggtcccctggcattagttttggctcctaccagagaacttgctcaacaaatagaaaaagaggttaaagcttttagcagatctctcgagtcattaaaaactgccatagttgtgggcggaactaacattgaaaagcagaggtttgaactaagagcgggagttgaaatagctgtggccacccctggaagattcattgatcacttacaacaaggcaacacttccctctctagaatttcttttgttgttctggacgaggcagatagaatgcttgatatgggttttgaaccacagataagggaggtaatgagaaatcttccagagaagcatcaaacactgctgtttagtgcgactatgcctgtggagattgaagaattatcaaaggagtacttggctaacccagtgcaagtgaaggtggggaaagtgagtagcccaacaactaatgtttcacaaactcttgtgaaaatttctgaaaatgagaagcttttctttcttttggcttcttttctgaaatcttatcatgttcttgtagattga

SEQ ID NO: 2467 - DNA, 2034 bp, Glycine Max
atgtcgtcaaaatatcagattcttgacaaccgccctattaatcagtggaaggttacagagctaaaagatgagctgaagaggaggaagttaagtatcaagggtttgaaggatgatttggtcaagcgtttggatgaagtccttcgtcttgaaagggaggctgacgaggcttctgagaaggatgaggccaatggtttcgatggtcatgtagatggggaaaaagattcagaggcggttactgtggatgctgaaatggttgattcaactgacagggacaatgccaaaacatttgagactgctgaaaagggcaagagcggtgtagttgatcctgttgaaatagaaaatgtggaaaagattccggaggttgtggatcacgacagcaataagaatgacaagcaggatggtgttaccaaccaagttgacattaataatagtgtgtcagccatagatcaagaggttgaacctaagggcttgccagctgaagtagtggccagtgctgaggattcttatcgtgcagaaaagaataatgaggattcagcagcaaagctggagaatgaggagtcaaaggcgcagctggatggtgaggactcaaagccccagctggattgtgacatcaagcccttgcatgaggatcctgtgcccgactcttctgttccagaaaaccaggtatctgaggtcaaccctagtttagggtctcaagtaaaatctgattctatttctactgattctctgtcaattaatcaaaagaatgaactaaaggatactataattactgataatgtcaaattagaacaagatattgttaagccagagatggtggaagaaccatcatccagaaatgatgtacctgtttcttatgatgaatcacattcaatggatgttggagggctgcatgagaaaaaggcatctgttgaagaaaatttcaataatgttttaagtccagacatgaacaagaccaatagcagcgatgatgtggggtatcccgaagagttgaacttggacagaagttctggtgatgattctatggaagaggatttgcctgagactaagcaaattgattctaagtttaatgttgatgaacttaaagacaaaatagagattgaagagcctattgtgaaggaggaaagtagtactatagctgttggagatggtctgtctgcaggagaaagtgatatccaccaagatattgacattagtccagttgctccaacagagaaacgaaaatttaatgaacaagcatcagttgggaacaatgagcctgcaaaaaggcaacgcaggtggaacactgaaacagttaaaggtccagatgcacaaagcactactcccaggcctgctactacacctagagatgagccaattgctttgaaacgcaacttctctaggtctgattcctctgcaactgatgatacacctaaagaacgcattgttccaccaccacaaaggtccccaactaattccctcaggattgatcgttttctccgtccatttaccctaaaagcagtgcaagaacttcttggtaagactgggaatgtcagcagcttctggatggaccaaataaagacccattgctatgtgacttactcgtctgtggatgaagccattgagacacggaatgctgtatataatttgcaatggccaccaaatggtgggcgtctcttagttgctgagtatgttgatcctgaagaagtgaaaatgaagttagaacctcctcctactcaggctgcatctgtcagcactgtcccagcagttcctcctgcacctccctcacagccagagccttcccctcgtctgcacagggagccgcatccagttccagctactctcccacctccaccaccattgtcaaaacccccaccagtagcaagagaacggcttccatctccaccaccccttcctgagaaagttgacccacccattgtcactctggatgatctctttcgcaaaaccacagccactcctcggatctactatctacctttgtctgaagagcaagttgcctcaaaacttacagcacagggtaaaagcgcgaggcagtag

SEQ ID NO: 2468 - DNA, 852 bp, Glycine Max
atgtctaatttgtacaatcagatttccttaccttcaccccaaagagccaattcaccaaacataaacatgagaggcaattttgatgttgatagtcagtacttaacagagctgctagcagaacgacagaagcttggacctttcatgcaagttctacccttatgtacgagactcattaatcaagagattttaagggttaccggaaagaatgaatcattgcagaaccaaggatttagtgactttgatagaatgcgattcataaatccgagtcatatgacttctccaaactcaacatcaaacttcactggctggaaaagcctgtcacatgagaggttagctggtgtacaaggactaagcatggattggcaaacttcaccggttgttccaagttctcccattgtgaagaagatattgcgcttggatattccgaaggatagctatccaaagtttaattttgttggccggcttcttggccctaggggtaattcactgaagcgagtggaagctactacaggttgccgtgtatttatcagagggaaaggttcaattaaagacttagacaaggaagaattgctacgaggaaggcctggctatgagcacctgaatgatccacttcacattctaattgaagctgaactacctgccagtgttgttgatgtaagattgatgcaagctcaagaaatcatacaagagctacttaaaccagtggatgagtcacaggacttttataaaaggcaacaactaagagaacttgctatgcttaattccaacttcagagaagagagccctcaactgagtggtagtgtctctccattcacttctaatgaaataaaacgggccaaaactgatcaatag

SEQ ID NO: 2469 - DNA, 385 bp, Glycine Max
atgtctccagaatgtgctatgatgggtgtcatctcaactaaaaccgatgtttatagctttggcatcctattgctagagattctaagtggaaagaagaataataattatcatccattcaatcttgttgcttatgcatggaaattaaggagtgaaggcgaagctttaaagctaatggacacaactttggatgggtcatactctcctaccaaagtgatacggtacattcttatcgatctcctatgcacacaagatcaagcaagggatagacctactatgcttgaggttgtttcgtttctttcaaatgaaagtgctcatttaccaccacctaaacaaccaggattttgtatcattagagttatggaagagatagagaagcacaacagtt

SEQ ID NO: 2470 - DNA, 1311 bp, Glycine Max; identical to SEQ ID NO: 134

SEQ ID NO: 2471 - DNA, 702 bp, Glycine Max
atgtctctgcgtgtggcggcagttaatttgctaaaaaaacttcgctttcctgcttcccatgtcttccctgcttccacagtaaccacaaatgcattttccggtaaactcaaactttcccgttggtatcaagctggtgaacatggttggaggatagatcttagggatccttgtctatggattgttatatctggacatgtagcaatgacattaggaattagtgccagcactgtatttgctgaagatgcaacaactgaagcatatcctgataatgacccagggggtgacttaattggattaagaaaaattgaggatggctctgtagtatcaaacatacatacagcaaagtggagagtctttacagataaagcgagagaattttttctacagggaaaactagatgaagctgaaaaactcttcctttctgctatagaagaagctaaagaaggtttcggcgagaaagatccgcatgttgcttctgcatgcaacaatctggcagaattgtacagggtcaaaaaggcatttgacaaagcagaaccattgtatttggaagctatcaacatattagaggaatcttttggtcctgatgatgtacgggttggggtcgctgttcacaaccttgggcagttttaccttggacagcggaagttggaagaagctcgtgttagctatgagaggataactttattcaacaattctaattaa

SEQ ID NO: 2472 - DNA, 225 bp, Glycine Max
atgtctgatattgctatgttggtagcagaagaatatgagaggaggacaatgaattttaagaaggctggcgctgtacaagagaggaacttgaacgtggtttcttgtgcttctttgttggttctgaaggagaagattgaggtgcagaagaaggagcttgtcaagtgggttttggaacccaaaacccaatttgcaattgctgcttctaacagtttcttttctgcttga

SEQ ID NO: 2473 - DNA, 915 bp, Glycine Max; identical to SEQ ID NO: 135

SEQ ID NO: 2474 - DNA, 207 bp, Glycine Max
atgtcttccattggggcacgttcagctgaaatttatgttatggagaagaggcagaaagagaagttgaagagaatggaagtggaaagagtacgaagaggtgaggtgagtactgaagagagaaaggtggctagttctagtgtgggaaagaacaaggtgcatccaggtagtgaacaaggagtcacatccgataatgcctttagggcataa

SEQ ID NO: 2475 - DNA, 3951 bp, Glycine Max
atgtcttcccttcaactgttgcaactaactcggcatggccagagttttctagcttcaaggaggaaaactttattacttgcatctggtatcttaattgctggtggaacagctgcatatgtgcaatcaaggtttagagttaataatcacgatttatttggccattgcaatgggcacagtaatgataaagaagttgcagaggaggttgtgaaggatgttagtactccaaaaaataaacaaaagaaagggttgaagtcactccaagttctagccgcaattctactatctggaatgggcaaatttggtgcaagtgatcttttaggtttagttgcgatagcggtgctgcgaactgctttgagcaacaggctagctaaagtgcaaggcttcctatttcgtgctgcttttcttcgacgtgtaccattgtttcttcggctaatttcagaaaatattcttttgtgcttccttttgtcaaccattcattctacgtcaaagtatataacagggactttgagtttacatttcagaaaaatattgacaaagcttatccattcccactattttgagaacatggtgtattacaaaatatcgcatgttgatggtcggataactaatccagagcaaagaattgccagtgatgtgccaaggttctgttcggagttgagtgaaattgtacaggatgatctaacagcagttactgatggacttttatacacttggcggttgtgttcatatgctagcccaaaatatgtcgtctggatattggcatatgtacttggagctggtgctgcaatcagaaacttctctccttcatttggaaaacttatgtctaaagagcagcaattggaaggagagtatcgacagcttcacgcacgattaaggactcactcagaaagcatagcattctatggtggagagaggaaagaagaagctcatattcaacagaagtttaaaaccttggttaggcacatgtataatgtgctacatgaccattggtggtttggcatgattcaggacttattattgaagtaccttggtgctactgttgctgttattttgatcattgaacctttcttttctggtcatctaaggcccgatagttcaactttagggcgtgcagagatgttaagcaatcttagatatcatactagtgtcataatttccttatttcagtctctaggaactctttctatcagtgcaagacggctcaatcgcctcagtgggtatgctgatcgcatttatgaattaatggccgtatcaagggagctaagcttggtgaatgagaaatcttccctgcaaagaaatgcaagtagaaattgcatacgtgaagctaactacattgaatttgatggtgtcaaggttgtaacacccactggtaatgtcttggtggatgatctgactcttagggttgaatcaggatctaatcttttaattacaggtccaaatggcagtggaaaaagctcccttttccgggttctaggtggtctttggccattgatatctggacatatagtgaaacctggaattggctctgatcttaataaggagattttctatgtgccgcaaaggccatacactgctgtaggaacacttcgagatcagttgatttatcctcttactgaagatcaagagattgaacttctcacagatcgtgggatggtggagctgttaaaaaatgttgaccttgaatacctgttggaccgttacccacctgaaaaggaggtaaactggggtgatgaactgtcattgggtgaacaacagagattgggcatggcaagacttttctatcataagcctaaatttgcaattctagatgagtgcacaagtgctgtcactaccgatatggaagaacggttttgtgctaaagttagggccatgggaacatcatgcattaccatatcacatcgtccagcattggttgcattccatgatgtggttttatccttagatggtgaaggaggatggagtgttcattataaaagggagggctcttctactgaaatggggattgatacgatgaaggcatcagaaaaaaaacgacagagtgatgcaaaggcagttcaacgtgcattttccatgagcaaaaaggattctgcattctcaagtccaaaggcacagtcatattttgcggaggtgatatcatcatctccatctatcaatcatacaatttcaccatctgctgttccccaactccatggtaatacaagggtattgccattgagagcagctgccatgtgtaaagtattggtacccactgtacttgataaacaaggtgcacaattgcttgctgtcgcttttcttgttgtttcaagaacatgggtctcagatcgtattgcatcactaaatggtaccactgtgaagtttgttttggagtcacacacaaataataaaaatgaaaaatactttaaatggaggcatttgaaagagatggatgattttaaaggaaatgttatcatttacgttttgccagagaaatacagagtacagttgctttggggttcttttagaggcaagagcatgcatgggacattgatgccattgctgggtgggggtggggtctttcacatggcaaacaaaaatattgacgcagatcagaggataactcacgacttggagaagttaacagcggacttgtctggattggtaaccggaatggtaaagccatctgtggatattttgtggttcacatggagaatgaagctattaacaggtcagaggggggttgccatactctatgcttacatgttacttggtctgggatttttaagaactgttactcctgattttggcgatttgataagccaagaacaacaacttgaaggaacctttaggttcatgcatgaaagactctgtactcatgctgaatctgttgctttctttggaggtggagctcgagaaaaagctatggttgaatcaagattcagagagcttctctcccactctaaataccttttaaaaaagaagtggctgtttggtatactggatgattttatcacaaagcaactccctcataatgtgacttggttgctgagcttattatatgctatggaacataagggagaccgtgcttcaataagtactcagggtgagctagcacatgcattgaggttcttagcatctgtcgtttctcaaagctttttagcttttggcgacattcttgaattgcacagaaagtttgtagagctttctggtggtattaatcggatctttgagcttgaagagcttctggatgcagcacagtctgtagtattacatctccaatatggggttatcatgaagatgttggccagggagttgacatgtgacattgagcttggtaaaagcctgcttgttactggtccaaatggaagtggaaaaagttccattttccgagttcttagaggactttggccaattgcaagtggaagactctctagaccatctgaggatgtggatcaagaggctggatcaggttgtggcatcttctatgttcctcagcggccttacacatgcttgggaacattgcgggatcaaattatatacccattgtctcgtgaagaggcacagtttcgagcactgaagatgcatggaaaaggtgaaaaacatcctgaccctagaaaaatgttggacacacacttgcaagttatcctagagaatgttcggttgaattatcttctagaaagagacaacaatggctgggatgcaaatctaaactgggaagacattctctctcttggagaacagcagagattaggcatggcacgcttgttcttccataagcctaaatttggtatcctggacgagtgtaccaatgccactagcgttgatgttgaagaacacctatatgggctagcgaacaaaatggggatcactgttgttacttcctcacaacgtcctgctttaataccatttcattccatggaattgcgtctgattgatggtgagggtaattgggaacttcgttcgatcaagcaatga

SEQ ID NO: 2476 - DNA, 543 bp, Glycine Max; identical to SEQ ID NO: 136

SEQ ID NO: 2477 - DNA, 597 bp, Glycine Max; identical to SEQ ID NO: 137

SEQ ID NO: 2478 - DNA, 2919 bp, Glycine Max
atgtgccacccccattgctcacagtctcactgctccacttcacttcccaaacaccctcccccaccccatttccaccaccacccttctccctccatcttcttcaccatgaagaaccacaagtcccacatcgctacttacctatcttatgacgcttcagcgatgctctctctcagagacagtctcaacccgcccgaatctctcgggtggtccgacccggacccgtgtaagtggaaacacgtcgcgtgctccgaagaggtcaaacggatcattcgtatccaaatcgggcacttgggtctccagggaacacttcccaacgccaccgtgatccaaaccctgacccaattggaacgcttggagctccaattcaacaacatttcgggtcccctcccgagcctaaacgggttgggctccctccaagtcctcattctcagcaacaaccaattctcttccatccccgacgacttcttcgccggcatgtcggagcttcagagcgtcgagatcgacgacaaccccttcaaaccttggaagatccccgacagcattgttaactgctcttccctccaaaatttttctgcgaattccgccaacattgtcggcacactcccggatttcttctcgagtcttcccacgttgacccacttgcacttggccttcaataacctccagggtgcattgcctttgagcttttccgggtctcagattgagactctctggttgaacgggcaaaagggtgttgaaagcaacaaccttggcggcaatgttgatgttttgcagaacatgacgtcgttgacgcaggtttggttgcattccaacgcttttactgggcctcttcctgatttttccggtttggtaagcttgcaagatttgaacttgagggataacgccttcacgggtcctgttcctgggtctttggtggagttgaaatcgcttaaagctgtgaacttgactaataacttgtttcagggggcagtgcctgagtttggttctggggttgaggtggacttggatttgggtgatgattctaacagtttctgtttgtcacgtggagggaagtgcgatccaagggtggagattctgctttctgttgtgagggttttagggtatcctaggaggtttgctgagaattggaaggggaatagtccttgtgctgattggattggggttacttgtagtggtggtggggacattactgttgttaattttaagaagatgggtcttgagggtactatagctcctgagtttggtttgcttaaatcactgcaaaggcttgtgcttgctgataataatctcactgggtcaattccagaagagctagcttccttacctggacttgttgaattgaatgttgcaaacaatcggctttatgggaagatcccgagttttaagagcaatgtggttcttaccacaaatgggaataaggacatagggaaggataagcccaacccggggcctagatcatcacctttaggtccactaaattcaagagctccaaacagaagtgaagaaaatggtggcaaaagatcttcacatgtaggggtgattgtgcttgctgtgataggtggtgtggtgttggttttggtgattagtttcttggtgtgttgtctgtttaggatgaagcagaaacggttgagcaaggtgcagagtccaaatgcattggttattcacccgcggcattctggatcggataatgaaaatgtgaagataacggttgcaggttcaagtctcagtgtttgtgatgttagtggaattggaatgcaaaccatggctggcagtgaggcaggggatattcaaatgggtgaagcagggaacatggttatttctattcaagttctgaggaatgtcactgacaacttcagtgagaagaatatactgggacaaggaggttttggaactgtttacaaaggtgaactgcatgatggcacgaagattgcagtgaaaaggatggaatctggggcaataagtgggaaaggtgcaacagaatttaagtctgaaattgctgttttgacgaaagttcgccaccggcatcttgtttcccttcttggttactgcttggatgggaatgagaagcttcttgtgtatgagtacatgcctcaggggacattaagtaagcacctttttaactggatggaagaaggactgaagccactggaatggaacagaagattgaccattgccttagatgtggcaagggctgttgagtatcttcatagcttggcccatcaaagctttattcatagagacttaaagccttcaaacattctccttggagatgatatgagagcaaaggtttcagattttggtcttgtgcgtcttgctccagaaggaaaagcttccgtagaaacaaggattgctggaacttttggatatttggcaccagaatatgcagtcactggtcgtgtgactactaaagttgatgtgttcagctttggggtaatattgatggagctgataactggaagaagagcacttgatgatacccaaccagaggatagcatgcaccttgtaacatggttccgtagaatgtatgtaaataaagactcattccagaaagccattgaccacacaattgatctcaatgaggaaacgcttccccgtattcacactgtagctgaattagctggccactgttgtgcaagggagccatatcaaaggcctgacgcaggtcatgctgttaatgtgctttcttctcttgtagaactttggaaaccatctgatcaaagttctgaagatgtatatggcattgacctagacatgtctttaccacaagcattgaagaagtggcaggcttatgaaggtagaagccaaatggaatcttcttcttcatcactcctacctcctagcttggataacactcatacaagcatacctacgcgtccgaatggatttgtggagtctttcacatcagcagatggtaggtga

SEQ ID NO: 2479 - DNA, 1710 bp, Glycine Max
atgtgcggaatcctcgcagtgttgggttgcgtcgacaactctcagaccaagcgcgctcgcatcatcgaattgtctcgcaggttgcggcatagaggtcctgattggagtggcatacattgctatgaggattgttaccttgctcatcaacgccttgctattgttgaccctacttcgggggatcaacctttgtacaacgaagacaaaactgttattgtcactgtaaatggggagatatacaatcacaagcaattgaggcagaaactgagttcccatcaatttcgaactggtagtgattgtgaagtgattgcccatctttatgaagaacatggagaagaatttgttaatatgctggatgggatgtttgcctttattcttcttgatactagggataaaagttttattgctgctcgtgatgctattggcattacccctctatacttgggctggggtcatgatggatcaacatggtttgcatctgaaatgaaagctctgagtgatgattgtgagagattcatatcttttcctccagggcatatctattccagcaaacagggaggattaagaaggtggtacaatccaccatggttttcagaggatattccatcaactccctatgatccaacccttttgcgtgagaccttcgagagggctgtagttaagagaatgatgactgatgtaccttttggagttcttttgtctggaggattggactcatcacttgttgctgcagtggtcaatcgttatttggctgaatctgaatctgctcgtcaatggggatcacagttacatactttctgcattggtttaaagggctctcctgacttgaaagctgcaaaagaggtagcagattaccttggtactcgtcaccatgaactttatttcacggttcaggaaggtatagatgcacttgaagaagtcatttaccatattgaaacatatgatgtaacgactatcagagcaagtactgcaatgtttcttatgtccagaaaaattaaagccttgggagtgaaaatggtactttctggagaaggttcagatgaaatatttggaggttacctgtattttcacaaggcacctaacaagaaagagtttcatgaagaaacatgtcgaaaaattaaagctcttcatctttatgactgcctgagagccaataaatcaactgcagcatggggtgtagaggcacgtgtaccattcttggataaagaatttatcaacgtagccatgagtatagatccggaatggaaaatgataaggcctgatcttggaaggatagagaagtgggtattacgcaatgcatttgatgacgataagaatccatatttaccaaagcacatattgtacaggcagaaggaacaattcagtgatggggttggttacagctggattgatggcttgaaggatcacgcaaacaaacaagtcacagatgcgacgatgatggctgccaattttatttaccctgaaaacactcctaccacaaaagaaggatacctctacaggacaatttttgagaagttctttccaaagaatgcagcaaaggcaacagtgccaggaggtcctagtgtggcatgcagtactgcaaaagctgtggaatgggatgcagcatggtcaaaaaatcttgatccttctggtcgtgccgcacttggtattcatgatgctgcatatgatgcagtggataccaaaattgacgagcccaaaaatggaaccctttaa

SEQ ID NO: 2480 - DNA, 585 bp, Glycine Max
atgtggagccacctattggtgaaatttctcaaaatccatagtcttttatgtatccatcgcccccaaccaacccaaacttgttataggccttctttatccaatgcaagaatcaaggaagcgtatagcaacgatgaaaagtgcagggagtttatggaaaaaggagtcactcaattgaaatctcgattgaaccaaatccacccgctagttcaaaagtttgatggttgctacaaacaagtagttaatcatagaagaagtgggagttcaaagaaagatcttatgactaatgcacatatgatttactcgcaggataccgataaaaaaatagaagttgaacatgcctggttgttgttgaaagaggaatgcaaattcgatgcggaatttatgggaaagtcttcaaagagaaccaatgtttttgcttcaggtggttactcattgtcttttaacctaaatgcacctaatgaagttgaagagtatgacacaacatcaccaatttgttttcattatggaaaactagttgttgcaaaattagtcattggaaaactagttgttacaagactaaccgttgaaaaattagccattacaaaa

SEQ ID NO: 2481 - DNA, 690 bp, Glycine Max; identical to SEQ ID NO: 138

SEQ ID NO: 2482 - DNA, 2154 bp, Glycine Max
atgtgggtgttttacctgatttcgctgcctctaacaacaggcatggtgcttttcacgcttaggtacttcgctggccccgatgtccctcgctacgtgctcttcaccgttggatatacctggttctgttctctctccatcatcatcctcgtccccgctgacatttgggcgacaatgtcttctaaccaagagaatggagctatttcattcttctggagctggtcctattggagtacatttttacttacttgggctgtggtgccccttattcagggttttgaagatgctggggatttcactgtatcagaaagattaaagactagtgtacatgttaacttgatcttctatctaattgttggatccattggcctttttggactcattcttctcattttgacgcacaataagtggaagggaagtcttttgggatttgccatggcctgctcaaatacttttggacttgttactggtgcatttcttcttggctttggtttaagtgaaattcctaaaagcatttggagaaatgctgactggactatccgccagaaagttcttacgcacaaaattgcccaaatggctgtcaaactggatgatgctcaccaagaactttcaaatgctattgttgtagctcaagcaacatccaagcaaatgtccaaacgtgattctttgagaccttatatgaatgtcattgatgatatgctaactcaaatgtttagggaagatccttccttcaaaccacaaggtggccgattaggggaaaatgatatggattatgatacagatgagaagtcaatggcaacactaaggcgtcatcttcggggagctcgtgaggagtattatagatataaaagtgaatatatgacttatgtattggaggcacttgaattggaagatacaataaagaattatgaacgccgcaactcaactggatgggaatataattcaagcattagacctgctcggactggcaagttggggtccttatgtgatactttagaatttttatggaaatgcattttaaggaaacaagttgagaaaggcttggctgttatacttggtatcatgtctgtagcaattcttttagctgaggcaactcttctgcctagcattgatctatcgcttttttccattcttataaaatcggttggaacacaggaggtccttgtgcaggtgtttgcttttgttcctctcatgtacatgtgcatctgcacatactattcattgttcaaaattggaatgttgatgttttactcactgacacccagacagactagctcagttaacttgcttatgatatgctcgatggttgctcgttatgctcctcctgtctcatacaactttctcaatctcattcgccttggcaagaataaaacaactatatttgaacagcgaatggggaacattgacaatgctgttcctttctttggggatgaatttaacaaaatctatccacttattatggttatatacaccattttagttgcaagcaacttctttgataaagtatttgattttctgggaagttggaagagatatattttcaaaactgaagctgaagatatggatggttttgatccatctggattaattattttacaaaaagagcggtcttggcttgagcaaggatgcaaagtaggggagcaagttgttccacttgcaagaaatttcaataacattgatattgaatccagcaacaattttatggagaggaatggtgctgaaatgaagccaacttccaatttaattactgatgaaataaatggccgtctgtccaaaacttcgaaggaagacacaagcagaagcagggaagccatcaccaagaagtatgctgtcgttagagagcagggtcggccagcatctaagttgaagtcagaagagaaaaacgcagcctcggctgattccttgtccgacgaagggaatactaattctagcaattcatctggaggatcatcttcaggtttgacttcgacgtggcaatcgatgaagactggctttcagagtttcaaggtgaacataggggccaaaaagtttttacctctacggcaaatacaggaaaataccggctctagtcattcctcgtctgagtcccttgatgacatatttcaaaaactcaaacggccaactttaaaccaatctatatacaatgacaacgattag

SEQ ID NO: 2483 - DNA, 1839 bp, Glycine Max
atgtgggtgttttacctgatttcgctgcctctaacaacaggcatggtgcttttcacgcttaggtacttcgctggccccgatgtccctcgctacgtgctcttcaccgttggatatacctggttctgttctctctccatcatcatcctcgtccccgctgacatttgggcgacaatgtcttctaaccaagagaatggagctatttcattcttctggagctggtcctattggagtacatttttacttacttgggctgtggtgccccttattcagggttttgaagatgctggggatttcactgtatcagaaagattaaagactagtgtacatgttaacttgatcttctatctaattgttggatccattggcctttttggactcattcttctcattttgacgcacaataagtggaagggaagtcttttgggatttgccatggcctgctcaaatacttttggacttgttactggtgcatttcttcttggctttggtttaagtgaaattcctaaaagcatttggagaaatgctgactggactatccgccagaaagttcttacgcacaaaattgcccaaatggctgtcaaactggatgatgctcaccaagaactttcaaatgctattgttgtagctcaagcaacatccaagcaaatgtccaaacgtgattctttgagaccttatatgaatgtcattgatgatatgctaactcaaatgtttagggaagatccttccttcaaaccacaaggtggccgattaggggaaaatgatatggattatgatacagatgagaagtcaatggcaacactaaggcgtcatcttcggggagctcgtgaggagtattatagatataaaagtgaatatatgacttatgtattggaggcacttgaattggaagatacaataaagaattatgaacgccgcaactcaactggatgggaatataattcaagcattagacctgctcggactggcaagttggggtccttatgtgatactttagaatttttatggaaatgcattttaaggaaacaagttgagaaaggcttggctgttatacttggtatcatgtctgtagcaattcttttagctgaggcaactcttctgcctagcattgatctatcgcttttttccattcttataaaatcggttggaacacaggaggtccttgtgcaggtgtttgcttttgttcctctcatgtacatgtgcatctgcacatactattcattgttcaaaattggaatgttgatgttttactcactgacacccagacagactagctcagttaacttgcttatgatatgctcgatggttgctcgttatgctcctcctgtctcatacaactttctcaatctcattcgccttggcaagaataaaacaactatatttgaacaggagaggaatggtgctgaaatgaagccaacttccaatttaattactgatgaaataaatggccgtctgtccaaaacttcgaaggaagacacaagcagaagcagggaagccatcaccaagaagtatgctgtcgttagagagcagggtcggccagcatctaagttgaagtcagaagagaaaaacgcagcctcggctgattccttgtccgacgaagggaatactaattctagcaattcatctggaggatcatcttcaggtttgacttcgacgtggcaatcgatgaagactggctttcagagtttcaaggtgaacataggggccaaaaagtttttacctctacggcaaatacaggaaaataccggctctagtcattcctcgtctgagtcccttgatgacatatttcaaaaactcaaacggccaactttaaaccaatctatatacaatgacaacgattag

SEQ ID NO: 2484 - DNA, 2007 bp, Glycine Max
atgtgttggagctctagtaactcagaggtggttgcttcaaacaaaaccacgttagaagaggttttggacattgagaacaacatggctcatcagtgggtgctcaatgctccagagccaccttccatgctgcgtcaggtggtggacaacgtcaaggaaaccctcttaccgcatccaaatccaaacacattctcttatctcaggaaccaacccttttccaaacgtgcctttgccttgttgcaaaatttgtttcccattcttgcttcactccaaaactacaatgcccaaaagctcaagtgcgatttaatggccggtctaacccttgcaatcttcgctattccccagtgtatgggaaatgcgactttggcgcggctaagtcctgaatatggcctatatacaggaattgtcccacctcttatttatgccatgctggcgagttcaagggagatagtgatcggacctggatccgtggattcactgctactttcctcaatgattcaaacattgaaagttcctattcatgattctagtacttacatccaacttgttttcactgtgactttttttgcgggcatttttcaagttgctttcgggctctttaggtttggttttctggtggaatatctttcacaagccacgatcgtggggttcttggcagcagctgccgtgggcattggactacaacaactgaaaggattatttgggatcgataattttaacaataaaactgatttgttttccgtggtgaaatctctttggacatcgttcaaaaaccaatcagcatggcatccctacaatttaattattggattctcatttctctgtttcatcctatttaccagattcctggggaaaaggaacaagaaactgatgtggttgtcacacgttgctcctctcctttctgttattggatcatctgctattgcatacaaaataaactttaatgagcttcaagtgaaggactacaaagttgcagtcttgggaccaattaaaggaggcagcttgaatccaagttcactccatcagttaacatttgatagccaagttgtgggtcatttgatcagaatagggttgacgattgctattatttcactcacgggatccattgctgttggccgatcatttgcatctctaaaaggacacagtattgatcccaatagagaagtggtatcattgggcataatgaacattgttggatccttaacttcttgctatattgcatcagggtctttgtcacgtactgctgtgaactataatgctggatctgaaaccatggtctccatcatagtgatggcacttacggtgctcatgtcacttaaatttttgacggggcttttatatttcactccgaaagcaatccttgcagcaataattctctcggccgtaccaggactgattgaccttaacaaagcacgtgaaatttggaaggttgataaaatggatttccttgcttgcactggagcctttttgggagtcttgtttgcatctgtggaaataggccttgcaattgggatcgcgatatcatttgcgaagataattataacctctattcaacctgctatagcggttattggaaggcttccaggaacggctgcattcggcgatgttgaacaatatccaatggctgtcaacattcctggggttttgatagtctctttaaaatcttcttggctttgttttgcaaatgcaaatcttgtagaggaaaggattgagagatgggtgaacaatgcaaaagctaaggatggcaaaggaggagaaaacaccttcatacacgtcattattgatgcctcaagtcttacaaatattgacactgtgggaattgcttctctggtggagctcaacaaaaatttgatttccagtggagtaaagttagctatcgctaaccctaggtggcatgtaattcacaagctaagattagctaacttcgtgagcaaaattggaggaagggttttcctttctgtaggagaagcagtagatgcatgtgttggcactaaaatggttgctgtataa

SEQ ID NO: 2485 - DNA, 1086 bp, Glycine Max; identical to SEQ ID NO: 139

SEQ ID NO: 2486 - DNA, 1440 bp, Glycine Max; identical to SEQ ID NO: 140

SEQ ID NO: 2487 - DNA, 1875 bp, Glycine Max
atgttattacagcaaactgaactgaagcaagttccatccatgtctcggcttcaaaagtcaacaggtcagcagcaaatgtttcattccctacaccaaattctgtccccatacatgtcaagtgttgttgtatctgtgttattgtggcatgtcattgctgtgcttttggtttcaaatttggcctttgcttcaagccttgaggaaacaaatggacacccaaaacacaaaggtgaggtgatctatgcccacaatggagctgttgccactgatgaccgtagatgctcaaggattgggaaggatgttcttagagaaggagggcatgcagtggatgcagcagtggcttcttccctttgtttgggggttgtgagtcctgcttcaagtggccttggtggtggagcctttttgcttctcaggttgaataatggggtggcaaaggcttttgatatgagagaaactgctcctgctcttgcctccaaggatatgtatgctggaaatactactttgaaggccaaaggtggcctatctgtagcagttcctggagaacttgctggccttcatgaggcgtggaaacaacatgggaagcttccatggaaaagacttgtaaagccagctgagattctagcacgtagagggtttaaagtatcaccatacctccacaagcagatggaagaaacagagtcagatatattggaagacaagggtcttcgtagcatatttgccccaaatggaaaactcttaaagataggtggcatttgctacaataagaaactagccaagactctcagaacaatatcagagtctggtccaaaagccttttatgaaggattgattggtcttaatttagttaaagatgtccagaatgctggagggatattgagcatgaaagacctcaaaagttacactgttaaacagaaggaacccatatctaatgatgttcttggtctaaagctccttggcatgcctcccccttcaggtgggcatccaatgatgctactgctgaacattctagatcaatataaactcccttctggcctttctggtgcccttggtttccatcgagaaattgaagctttgaagcatgtatttgccgtgagaatgaatcttggtgaccctgattttgtaaatataactggggttctttctgatatgctttctcataggtttgctaacgtgttgaaaaatgacataaatgataataaaacttttggccccagtcattacggcagcaggtggaatcagatccatgatcatggtacaagtcatttaagtataatagatcctgagagaaatgccatttccatgactagcactgtgaatgcatattttggttcaaagatcctttcaccaagtacaggaatagtactgaacaatgaaatggatgatttttccatgcctagaaatgttaccaaggatgttccaccaccagctcctgccaatttcatcatgccaggaaagcggccactatcatccatgtcacccactattgcccttaaggatgggaagctaaaagctgtagtaggtgcaagtggaggtgctttcatcattggtggaactgcagaagttcttttgaatcacttcgttaaaggaatggatcctttttcttctgtaacagctccaagggtctatcatcagctactacctaacgtggttaattatgagaattggaccactttaggtgaacactttgaacttcctgctgatatcagggaagcccttaaaagtaagggtcatgtcctaaagggccttgccggtgggactatttgccaatttattgttctagacaattctgtgccgtccagacaaaataaagggattggaaatggaaagcttgtggcagtgagtgacccaagaaagggtggttttcctgcaggcttttga

SEQ ID NO: 2488 - DNA, 633 bp, Glycine Max
atgttattgttatatttttttttcaatgatggtacacatctactcggcagctttttgtttatttcaaaaactgcagcacctaacaataattcagttagagggttcaacgtgatcgatgacattaaaaccaaggtggagaaagcatgtccccaggttgtgtcatgtgctgatattcttgctctggccgctcgagactctgttgtttatgaacatatacttcaattcactcgagtatgtttgatgacaggtggacatactattggccttgctagatgcgtaacattcagagatcacatctacaatgattccgacattgatgcctcctttgccaagtccctgcagagcaagtgccccagaagtggaaatgacgatttactcgaaccccttgaccttcaaactcctacccattttgataacctatacttccagaatttactggacaaaaagggtcttctccattccgatcagaagctgttcaatggtgattccaccaacaaactggtgaagaaatatgctaccaatacagctgcattctttaaagactttgccaagggcatggtcaaaatgagcaatatcaagcctctaacaggaagcgaggggcagatcagaatcaattgcagaaaagtcaattaa

SEQ ID NO: 2489 - DNA, 1137 bp, Glycine Max
atgttcatcgagaattttaaggtagagagtcctaatgtgaagtacaccgagactgagattcagtccgtgtacaactacgaaaccaccgaacttgttcacgagaacaggaatggcacctatcagtggattgtcaaacccaaatccgtcaactaccaatttaaaaccaacacccatgttccaaaattgggggtgatgcttgtgggttggggtggaaacaacggctctaccctcaccggtggtgttattgctaacagagagggcatttcatgggctacaaaggacaagattcaacaagccaattactttggctccctcacccaagcctcagctattcgagttggatccttccagggagaggaaatctatgccccattcaagagtctgcttccaatggttaatcctgacgacattgtgtttgggggatgggatatcagcaacatgaacctggctgatgccatggccagggcaaaggtgtttgacatcgatttgcagaagcagttgaggccttacatggaatccatggttccactccccggaatctacgacccggatttcattgctgccaaccaagaggagcgtgccaacaacgtgattaagggcacaaagcaagagcaagttcagcaaatcatcaaagacatcaaggcgtttaaggaagccaccaaagtggacaaggtggttgtcctgtggactgccaacacagagaggtatagcaatttggttgtaggccttaatgacaccatggagaatctcttggctgctgtggacagaaatgaggctgagatttctccttccaccttgtatgccattgcctgtgtgatggaaaatgttcctttcattaatggaagccctcagaacacttttgtaccagggctgattgatcttgccatcgcgaggaacactttgattggtggagatgacttcaagagtggtcagaccaaaatgaaatctgtgttggttgattttcttgtgggggctggtatcaagccaacatctatagttagttacaaccatctgggaaacaatgatggtatgaatctctcggctccacaaaccttccgctccaaggaaatctccaagagcaacgttgttgacgatatggtcaacagcaatgccatcctctatgagcctggtctttga

SEQ ID NO: 2490 - DNA, 1533 bp, Glycine Max
atgttcatcgagaattttaaggtagagagtcctaatgtgaagtacaccgagactgagattcagtccgtgtacaactacgaaaccaccgaacttgttcacgagaacaggaatggcacctatcagtggattgtcaaacccaaatccgtcaactaccaatttaaaaccaacacccatgttccaaaattgggggtgatgcttgtgggttggggtggaaacaacggctctaccctcaccggtggtgttattgctaacagagagggcatttcatgggctacaaaggacaagattcaacaagccaattactttggctccctcacccaagcctcagctattcgagttggatccttccagggagaggaaatctatgccccattcaagagtctgcttccaatggttaatcctgacgacattgtgtttgggggatgggatatcagcaacatgaacctggctgatgccatggccagggcaaaggtgtttgacatcgatttgcagaagcagttgaggccttacatggaatccatggttccactccccggaatctacgacccggatttcattgctgccaaccaagaggagcgtgccaacaacgtgattaagggcacaaagcaagagcaagttcagcaaatcatcaaagacatcaaggcgtttaaggaagccaccaaagtggacaaggtggttgtcctgtggactgccaacacagagaggtatagcaatttggttgtaggccttaatgacaccatggagaatctcttggctgctgtggacagaaatgaggctgagatttctccttccaccttgtatgccattgcctgtgtgatggaaaatgttcctttcattaatggaagccctcagaacacttttgtaccagggctgattgatcttgccatcgcgaggaacactttgattggtggagatgacttcaagagtggtcagaccaaaatgaaatctgtgttggttgattttcttgtgggggctggtatcaagccaacatctatagttagttacaaccatctgggaaacaatgatggtatgaatctctcggctccacaaaccttccgctccaaggaaatctccaagagcaacgttgttgacgatatggtcaacagcaatgccatcctctatgagcctggtgaacatcccgaccatgttgttgttattaagtatgtgccttacgtaggggatagcaagagagccatggatgagtacacttcagagatattcatgggtggaaagaacaccattgttttgcacaacacatgtgaggattcccttttagctgctcctattatcttggacttggtccttcttgctgagctgagcactagaatccagtttaaagctgaaaatgagggaaaattccactcattccacccagttgctaccattctcagctatctgaccaaggctcctctggttccaccgggtacaccagtggtgaatgcattgtcaaagcagcgtgcaatgctggaaaacataatgagggcttgtgttggattggccccagagaataacatgattctcgagtacaagtga

SEQ ID NO: 2491 - DNA, 1368 bp, Glycine Max
atgttcatcgagaattttaaggtagagagtcctaatgtgaagtacaccgagactgagattcagtccgtgtacaactacgaaaccaccgaacttgttcacgagaacaggaatggcacctatcagtggattgtcaaacccaaatccgtcaactaccaatttaaaaccaacacccatgttccaaaattgggggtgatgcttgtgggttggggtggaaacaacggctctaccctcaccggtggtgttattgctaacagagagggcatttcatgggctacaaaggacaagattcaacaagccaattactttggctccctcacccaagcctcagctattcgagttggatccttccagggagaggaaatctatgccccattcaagagtctgcttccaatggttaatcctgacgacattgtgtttgggggatgggatatcagcaacatgaacctggctgatgccatggccagggcaaaggtgtttgacatcgatttgcagaagcagttgaggccttacatggaatccatggttccactccccggaatctacgacccggatttcattgctgccaaccaagaggagcgtgccaacaacgtgattaagggcacaaagcaagagcaagttcagcaaatcatcaaagacatcaaggcgtttaaggaagccaccaaagtggacaaggtggttgtcctgtggactgccaacacagagaggtatagcaatttggttgtaggccttaatgacaccatggagaatctcttggctgctgtggacagaaatgaggctgagatttctccttccaccttgtatgccattgcctgtgtgatggaaaatgttcctttcattaatggaagccctcagaacacttttgtaccagggctgattgatcttgccatcgcgaggaacactttgattggtggagatgacttcaagagtggtcagaccaaaatgaaatctgtgttggttgattttcttgtgggggctggtatcaagccaacatctatagttagttacaaccatctgggaaacaatgatggtatgaatctctcggctccacaaaccttccgctccaaggaaatctccaagagcaacgttgttgacgatatggtcaacagcaatgccatcctctatgagcctggtgaacatcccgaccatgttgttgttattaagtatgtgccttacgtaggggatagcaagagagccatggatgagtacacttcagagatattcatgggtggaaagaacaccattgttttgcacaacacatgtgaggattcccttttagctgctcctattatcttggacttggtccttcttgctgagctgagcactagaatccagtttaaagctgaaaatgaggtctgcatgcattgctaa

SEQ ID NO: 2492 - DNA, 1158 bp, Glycine Max
atgttcatcgagaattttaaggtagagagtcctaatgtgaagtacaccgagactgagattcagtccgtgtacaactacgaaaccaccgaacttgttcacgagaacaggaatggcacctatcagtggattgtcaaacccaaatccgtcaactaccaatttaaaaccaacacccatgttccaaaattgggggtgatgcttgtgggttggggtggaaacaacggctctaccctcaccggtggtgttattgctaacagagagggcatttcatgggctacaaaggacaagattcaacaagccaattactttggctccctcacccaagcctcagctattcgagttggatccttccagggagaggaaatctatgccccattcaagagtctgcttccaatggttaatcctgacgacattgtgtttgggggatgggatatcagcaacatgaacctggctgatgccatggccagggcaaaggtgtttgacatcgatttgcagaagcagttgaggccttacatggaatccatggttccactccccggaatctacgacccggatttcattgctgccaaccaagaggagcgtgccaacaacgtgattaagggcacaaagcaagagcaagttcagcaaatcatcaaagacatcaaggcgtttaaggaagccaccaaagtggacaaggtggttgtcctgtggactgccaacacagagaggtatagcaatttggttgtaggccttaatgacaccatggagaatctcttggctgctgtggacagaaatgaggctgagatttctccttccaccttgtatgccattgcctgtgtgatggaaaatgttcctttcattaatggaagccctcagaacacttttgtaccagggctgattgatcttgccatcgcgaggaacactttgattggtggagatgacttcaagagtggtcagaccaaaatgaaatctgtgttggttgattttcttgtgggggctggtatcaaggtacattgttgttatactaatgtcatatcatgggtgttatttttactaggacaatctatcctttgcatgttttgtaaacaatttatgcatcgtgctagatttatatgtcaaaaatggagaaatgagttgattttttcaagtgttctgttgatgattgacagccaacatctatag

SEQ ID NO: 2493 - DNA, 618 bp, Glycine Max
atgttgggtggtgggatgggaagcacaatacaaagggatctaaccaggattgcagaaactgcagatacatcctctcgggatggtttgacctatctattgacagacacaatacagagtttggttcgacatcttggtaactgtattgcaggatattcatttgtggatctaaagcggagtaaagaggatggggagaaatactataaccaactatcaaatgaagaaagggccaaatttgatgaagagacattagttaatttgaacaacacagaaaagagaagtacaaaaatccagagtgattttgatggaaaggggattaaagaggaaagcaaaaaatttgaagaagagaaacttctcaacgagattggttccgagtacatagtgataacaatcttggtagctgctaaaggagcacataagcttcctaacatcaatggaactaaagatttgaaggaggctttgcaaaagcttagaacccttctctcaagcaaattattagctggcaaggtattatggaccccacaaaatgaggatgacactctttcaaaacgaaaactacttgaagactaccctcagttagcaagaagcatgacaaactttctggttaagaaacatgaatga

SEQ ID NO: 2494 - DNA, 213 bp, Glycine Max
atgtttggtgattcaaaaattgccttccaaggaatctcaccctttcccaccacatgtgacccccaaatcttgctttgccttagctccaccacaaggctttccttctttagaccttccaagaattcttggggacatgaacaatttaagttgaaggactcgttccaaaagggaacatatttggtattggaggaaacttttttggtgttgagttga

SEQ ID NO: 2495 - DNA, 468 bp, Glycine Max
caaggttgttccttcgaccataaaacagcaaaaggttcatgtccaataggtgattgtggaggccttttacaatgcaatggaattggtggaatccctccagctacactagtagaaattacccttggaacctctcaatcaccattgcatttctatgatgttagtttggttgatgggtttaaccttccagcgtcagtgaagcctgcgggtggtggtggtgcaggttgcggtattgcggcgtgtgaggttaacttgaacgtttattgcccttcttctttggttgtggagaggaatgggaaggttgtagggtgcaagagtgtttgcttggctgcaaagtctgataggtatttttgcactggtgagtttgctgggaggtgcaagccaactgtgtttgctcatcttttcaagatcatttgccctaattcttatagctatgcttatgtggtcaagacttgtgtggcacctcgctat

SEQ ID NO: 2496 - DNA, 288 bp, Glycine Max
cacaaccttgaattcgttaatgttttcacggatgatgggaaaataaactccaatggtggctctgattttttgggcataccgcgagaggcagtatcagaagcagtacagaagaagttattaagccttactttattggcaatgatccttagtttagtttgcttccgacagacgctttgcacaagaaactttgtggttttgtctggacaatggactgcaattgcttcatccctttatgtcctttgtcatggaagaattatggcagcgccttccttcacccagggaatgtaa

SEQ ID NO: 2497 - DNA, 720 bp, Glycine Max
cacgccgtcgtactcaaaatggtgcacttcgactcccccttcgttgccaatgccctcatctctctctatgccaagtatgcctctttcaaccaaataccacacagggacattgctttgaggaacacctttatctctactgcgcttcaggactccttatacgacaccgcgtttcacttgttttgtaacatgcaggccacatacgcgtttagagtcaatgacttcactttatccatacttctcatcgcgtctatgttgttgatggaagttagggttggaaatgttgatgatgtggagtggttgtttgaggggatgaaagtcaaggatgttataacttggactgagatggtcatggcgtatatggaatttgggttggtcaatttggccttgaaggtgttcgatgaaatgccagagaagaattttgtgtcttataacacgattctggctgggttatgtcaaaacgagcaaggttttgaggcgatgatgttgtttggagtaaaattcaaagatccaaaggcactaagtatgcatatgttactatactttattgtaattttgtattgttctgtatggcgttataggtttggaagttcttcaagtccaagtttcatatgtgtgtgtgtgtgctctgtttttgggacaagtgaagatagaagttgcacatttaatgtctttatcaacctacatgcaagaactaataaaatagcacttcttagtgttgct

SEQ ID NO: 2498 - DNA, 1219 bp, Glycine Max; identical to SEQ ID NO: 141

SEQ ID NO: 2499 - DNA, 678 bp, Glycine Max
cagctttggtcaatgcagaagattaaactaaaatgtaccattggatttatatatgccatacagaacatggatggaaaaaaaaaggaattggaggagagtaaaaacttgaatgatgtgctgcagaagaaacttaccgaggaaaaacgatcatcatggctggaatgggagaatcagcaacttaaagggaaagctatgaagctacaagaagagttacaggttcaaaatcaaaagctcaattcgaaagtagttcagctggaaaatcaaatacagtgtaatcaaaagctggaattggagaatcagcaacttaaagggaagttagctagaccaatggaaaaggatgggtcacttaaagatgcagaagatttcagccaatcattaatcattatagagcgtgagaggaatgacgagcttcagaaagctcgaaagaaattaattatgggcattgcggagatatcaagtgatcttggtaatattggtgtgaagagaatgggcgaaatagacactgaaccattccttatgaaacatatgtatattgaattttttatacgtgatagtgaaattattgatgatgaagatgaaacgtcgaagggattgaaagaagtaatgggtgttggagcgtataatgcagtggtgacagctttgaaagaaatgatgaagacaattataacttcattttga

SEQ ID NO: 2500 - DNA, 409 bp, Glycine Max
cagtttttggctacacataaaggtactttgatggttggattttactatgctacaaaaaaacttgcgtgggaaatatttgatatagatggtcggattaagtacaagattgaagtaccatggcaaaacattatgggcatgcaagccattgtagaagaaagcaagtctgaaattcttcaaattgagctggctaaggcaccaccattctttcgccacattgatccaaatccacgaagtcatcctcaatgggagccatcaaaagacttcactggaggtcatgctttgaaataccggtatgtatttacatttatttgtttatttatttattatcttagcaaaaattaccagaagctcatacaatctgataatcggttattagagttgagccgccaaataccttcttcaagattaa

SEQ ID NO: 2501 - DNA, 900 bp, Glycine Max; identical to SEQ ID NO: 142

SEQ ID NO: 2502 - DNA, 876 bp, Glycine Max
cgcgcctgccgcgaatggggcgccttccacgtcacgaaccacggcgtccccccttccctcctcgcctccctccgccgcgccggcctctccttcttctccgacacccccattcctgacaagctccgctactcctgctccgccgccgcctccgagggctacggcagcaaaatgctcgcaacaactacctccgatcaaaacgacgccgttcaggtcctcgattggagggactacttcgaccaccacacgctccccctctctcgccggaaccctaaccggtggccggagtttcccgccgactaccgggagctggtggcgacgtacagcgacgagatgaagattctggcgcaaaagttgctggctttgatttcggagagtctagggttgcgagcctcgtgcattgaagatgctgttggggagttttatcagaacattacgattagttattaccctccgtgtcccgaaccagacctcaccctagggttgcaatcgcattctgatatgggggcaattacgcttttgattcaggatgatgtggggggtcttcaggttctcaagggtggtaacaagtgggtcactgttcagcctctgtcagatgctatccttgttctattggctgaccaaactgagattataaccaatggaaagtacaggagctgtgagcatagggcaatcactaatcctgatagagcaaggctctctgtggcaacatttcatgaccctgctaagacagtcaagatttcccctgcttctgaactgataaacgactcatcactagctaaataccgtgatgttgtttatggagactatgtatcatcatggtataccaaaggccctggaggaaaacgaaatattgatgcacttttgctggatccttaa

SEQ ID NO: 2503 - DNA, 1749 bp, Glycine Max
cggtccccaaatgcagacaacttaagcttagtcactaacctcctttgttttctcctaggagcaaacaaccgaagattaagtgtaaaaatggaaaaaatgaaaggaaaattctttaatgttaaattaatctttgttatgtatgagagtgagaggttctaccaacagacgaatgaaattggtggtggggtaacatgtgggaacaagagttcaaatgccacaggttttagagcagttggacaacaagcactagtggaccttcaaacagcaacacctaaaattaaaggtttctatgcagctactaagacacaggtggagggtggtagtgcaatttatgccattgcacagtgtgttgaaactgcctccccacagaaatgtctggattgcatgcaagttggatacaacaacttacaaagttgccttccaagcacagatggtacagcatatgatgctggctgttttatgagatactccaccacacctttctttgctgataatcagaccattgatatcagaccctatttaaaagaaggaggttcaagcaagaagtgggctattataggtggtgtcgtaggaggtgttgttctcctccttctgttgtttgcttggagattgtttacaaaaccaaagagggttcccaaaggtaagagacttaattaccttatctctctgcctttccaagcagctgacatattgggagcaactgagttgaaaggtccagttaacttcaagtataaagatttgaaagctgcaacaaaaaatttcagtgctgacaataaacttggagaaggaggttttggtgctgtatacaagggtactctgaaaaatggaaaagttgttgctgtcaagaaactagtgttggggaaatcaaacaagatgaaggatgattttgaaagtgaagtgaagcttataagtaatgttcatcatcgaaatctcgttagacttcttggctgttgcagcatagaccaagagagaatcctagtttatgaatacatggcaaatagcagccttgacaaatttttatttggtgacaaaaaaggttccctcaattggaaacaacgctatgatataattttaggcacagcaaggggactagcatatctacatgaggagttccatgtgtccatcattcatagagatataaagaccggtaatatccttctagatgatgatctacagcccaaaattgctgattttgggttggcaaggcttttgccaaaggatcgttctcatcttagcacaaaatttgcaggaacactgggatacacagcacctgagtatgcaatgcaaggtcaattatcagagaaggctgatacctacagctatggtattgtggtcctagaaatcataagtggtcaaaagagtactgatgtgaagattagtgacgagggtcgtgagtaccttcttcaacgagcatggaaactgtatgagagaggcatgcagttggatcttgtggacaagcgcatagaacttaatgaatatgacgcagaagaagtgaagaaaatcatagaaattgcgttattatgcactcaagcatcagctgcaacaaggccaacaatgtctgaattagtagtgctgctcaaaagcaagggcttagtggaggacttgcgaccaactacgcctgtttgcttatcaatcgttcaagtagggcatatgttgcgacgtaggaactattgtgttcttgtgggggcaatttcccccacaccattacatgtgcatccgctagtgatcccaggtgctaaggaaggttga

SEQ ID NO: 2504 - DNA, 468 bp, Glycine Max; identical to SEQ ID NO: 143

SEQ ID NO: 2505 - DNA, 1284 bp, Glycine Max
cttccaccatttgattacaagccacgaccatacaaaggacctttggctgatgaagtttttgccaaacggaaaaagttccttggtccttccttgttccacttctatcaaaaacttcttaacattgtagagggcatgatgcaacatctatttgatgagaatggcaggcgttatcttgatgcttttgctggaatagttactatttcttgtggacattgccatcctgcagttttgaatgctataatggagcaaagtaaactcttgcagcatacaacaaccatatatctacaccatgcaatagctgattttgccgaggccttggcatccaaaatgcctggaaaccttaaggttgtttattttttaaattctggttcagaggcaaatgacttggcgatgctgatggcccgtttatacactggtaatatgggtatgatttccttaaggaatgcatatcatggagagagttctagtacaattggacgcacggctatgaacacttgtaacgatatcattggagaagttcatcatgtcatgaatcctgatccataccgcggagtttttggctcagatgccaataggtacgccagagaattgcaagatcatattgactatggcccttcaggaagagttgctggatttatggctgaaactattcaggcatgcataatccatccttcatggacaggaggagcagttgaactggcacccgggtaccttaaactagcctatgacattatacacaaagctggaggagtctgcatagctgatgaagtgcaatgtgggtttgcgcgcacaggaagccatttttggggatttgagacacagggtgtcattcctgatatagttaccatggcaaagggtattggcaatggtttgccattagcagctgtagttacaactccagaaatagcaagcgtgatggcccagaagcttcaatttaatacttttggagagaaccctgtatgttttgctgggggacttgctgtgctcagagttcttgacaaggagaggcgtcaatgtcattgtgctgatgttggttctcactcgattcagcgtttaagatctatgatgcaagtacatgacatcattggagatgtaagaggaagaggcttaatgaagccacctgcaaaagctgaaacaacagctttgcatgaaagattcagcgagctcggtattctagttgggaaaggagggctgcatggaaatgtttttaggatcaagccaccaatgtgtttcaccaaagatgatgcagattctttgttgaagttcactgactggcttcctgat

SEQ ID NO: 2506 - DNA, 1167 bp, Glycine Max
cttggtttcatcggtttgcatagaaggataaggagagatcagccaaaatttacattcaactcaatcagacctttgctactaaattttaaaaagatgaaaaatattttttccacatcatcttcacatttaaacttcatacactccaatatcttttcggatgatggaatccatcctattaacattcctagtcaaatacacccatttgtctatttattttatctgtttaagtccttgtttctcactaaagttgtggctctgaagctaaagaaagataataatgtttcagcattggataaagaactaaaggttgaaaatgaacgactcaatgccaaagtgattcagctggaaaaacaattagaaagcattcaagagctagaattggagaatcaacaacttaaagagaaattagatgtgatgaagcacatggaagatgaatttctgaatatggttggtgctttacatatgaatgtagtggaaaaggagcggtcacttagagactcagaagatttcaaccagtcactgatcattaaagagcgtgagatcaatgatgagcttcaaaaagctcgaaagacattgattaaggtaagaattttcttttatgacatatatcttcgtatttctggaaaagtttatctaatcagactctggctaaaagttgctttagttttctacttttctatattgttttcgagatctgctaataatatatcaagtcttgatggcaatattgatgtgaaacaaatgggacaaatagacacagagccttttgttaaggctttgacagggaggagaagatataataaagaggaagcagagcaaatagctttggagacatgttcattatggcaaaaggatctgggagacccccattggtatccattcaaaatagtcacaattggtgggaaatcaaaggaaattataaatgacgaagatggaaggctaaaaagattgaaaaaggaaatgggtgttggagcatataaagcggtcgtggcagctctgatagaaatgaatgaatacaatccaagtgggaggttcatggtaagagaattgtggaacaacgaagaagataggagagctacattggaagaaggaattgaattcgtgttaaatcaaacaaaaacaaaaagaaggaaaatacatcaaatggtggatgatgaatcaggttga

SEQ ID NO: 2507 - DNA, 1071 bp, Glycine Max; identical to SEQ ID NO: 144

SEQ ID NO: 2508 - DNA, 687 bp, Glycine Max
gaagaagatcatgattacaatgacctttacaatgacgtcaatttcaatgaagggtttattcaattgttgcgcaagaacgacaattcagggttccgaaatggcgacgtcaaagaaaataagcctttattgttgtcgtcggggtttcgactattgtttctattttttctgaaagaaatagattttgtctttgaaatgtttatgctgcagttatttggttcaagattcctaaatttcaagattttgggggttgcttttattgaggaagcatttgtgtattcacaagataaaatttatgattttgagatgaagctaatggatattgacagtgagcaccttgggattccagaggcgtatcatgccatatcattgttaagatgccatcctctgagtttgttaggatctgcaaggatctcagtagtatttgtgacgctagggtgtggagttgaaggaagacccaagtgtttgtgtgtgtccacaacaacattaccctctatcctatcccatgtttatgtttataataccaaaaatacaccaagcttagttgcgatgaggctccgcaacgtgaccgtcatggccacgaccatgaacgtggcagtgctgaacaacaaggtcgtcacgttgttcaacgacagaacaaaaaaacaaaaggaaggaaagagaacacaaaaccaaggaaaacaaagttaa

SEQ ID NO: 2509 - DNA, 1017 bp, Glycine Max
gaagcagccgtcataaactacatgggcagcattggttccgacagagctgttccggatttcggcagccgcagcggcgaagcaggtggcgcagtcagtgttggagtggtagttcctgcattggaacatggcatagacaggacatacgttcagcatatattgataaatcctctaactacaaagcatctccttttgtctcctttctttagagatgaagcaactaattggctcaatctctacatattaaaggagctggtagctttgttggcagctggcttgcagaacctaggtagtggatatctcatgaagcaacaaatgatgaattttcaacagcctttccactatcttcaacaatccggaaacaacagttctccttttaaacttcagcagcagcaagcaattcaacaatgtccgctacatactcatcaagatacacttttgattccaagtgaccccatcagagacaacactccagtgttcctccaccatcatattcaaatccagagttcttggattcaagattcgaacatgaagttccttgcttcagttttccccagacaaaacgtgcttagttcactttgtcaatgcctatggcagcactatgtcacatattctggaaatgattctgcaatggcactaccaaattgtaataatgtaattcagatgcccaaaatcctacacacattggtgtcattattgattcatttggccttatactccccaccactgtccctgactaaagcctttggcaaggtaggatttttaagtactctgcggctttttcacaggttgacaaatcagggtcagttgggtgctcacttgacatatcccggttcagcagctaatcatgaactcagagaggagttggatcatatgtttggaattgaggggaagttggaagaccctcttatttgtcattcgtcaataatgtttggtatatcaaaatactttcaccacctgaacttttccagctcaacttccaattcttcgttaaagttcagaaatcaattatttccataa

SEQ ID NO: 2510 - DNA, 348 bp, Glycine Max
gacaacaccacccaccgaaacgacattgccaagaaacccaagctcccgcacgacatgcacaccattttcgaggccgagatccgtgaggaattctcccaccaccaccgcggcgtcaccagaatcaacaacgacagctttggcaactgcccgcgctccgtccttaccgcgcagtccacctggcagctccgcttcctccagcagcccaacgacttctacttcaacgcgctccgccccggtatcctcgtctcacgcgctgccatccaagacctcattaatgctgaccacgtgggtgacgtctccatcgttgacaacgccaccaccgccgtcatcgtcctccagcagagaatg

SEQ ID NO: 2511 - DNA, 201 bp, Glycine Max; identical to SEQ ID NO: 145

SEQ ID NO: 2512 - DNA, 1005 bp, Glycine Max
gagaaagagtactatgaaagacaatttgctactctcaaatcgtttgatgaagtggactcggtggaatcatctgactgcattgaggaaagcgatgaggagcaagctcagcaagaaagagcaatgaagatctctaattatgcaaatgtagctctgttgatattaaagatttatgccactgtaaggagtgggtcaatagctattgcagcatcaactctagattctctacttgatctaatggctggtggtatactttggttcactcacctctcaatgaagaacataaatatttataaatacccaattggaaagctaagagtgcagccagttggaataattatttttgcagcaatcatggcaacacttggctttcaggtattaatcacagctgtacaacaactaatacaaaacagtcctgctgaaatgatgaccactgaacagttaatatggttatactctattatgatatttgcaacagtggtgaaacttatgctctggctttactgtagaagctcaggaaacaagattgtccgagcctatgcagatgatcaccactttgatgttgtaacaaacatggttggactagttgccgctgttcttggtgataaatattactggtggattgacccagttggagctattttgcttgcaatttacactattacaaactggtcccacactgtcatggaaaatgcagtttcactggttggacaatctgcacctcccgaagttttgcagaagctgacatacctcgttataaggcaccctcgaatcaagcgcgttgacactgtccgcgcatacacatttggggtcctatattttgtggaggttgacattgaactgccagaagatttacccttaaaagaagcacacgctattggagagagcctacagataaagcttgagaaacttccagaagttgagcgggcatttgttcatttagacttcgaatgtgatcataaaccagagcactcagttctcatcaaactgcccaacaatcagccttga

SEQ ID NO: 2513 - DNA, 114 bp, Glycine Max
gattacaaagagagaggcttgagtgggaaacctaattcgattgaaggtgccgccatctcctttggtttggtatctcattctctgaaattgaattcggtttttttcccacagtga

SEQ ID NO: 2514 - DNA, 936 bp, Glycine Max
gattttcttcaagttattcagaaactgtcacaagtattaaacctatcattggatggggaagcaagagtcgcaacagcaagtttgcaaactaatgaagtaaggaaagtatctctagtaaccaacaaatccaacaagttgacaccggcaaagtttgaagcttggaaaaagtggcatgaagatggttgttctattcatgagattgctaactttccaggtagatcggctcctataaaagaacaaagtgttgctgaatatctgctggaagctgctcaagaaggattaccttttgattgggctagatttagcgagatgataggactgacacaagggatcatatcagaaattcagggtgctatttcaaaagttggatctacagataagctgaaacctataaaaaatgaattgccagaagagataagttatcagcacatcaagacttatttgacaatgcgaaactgtggaatatccttagaagcaattcaatctggaagtaaccagactgggaaagatgacgaacctgcacacaatgcttcaaatttgtcagatcctactttagaaacatgccacgtggaaagatattgtgaagacggcatctctgccaaaagttctctggaaaaatgggacctagaaattgatgaggtgcctattctacctgtcaatggttcggaggtacagaagcttccattagtctgtgagggggaattcacaaacaaacgacaaaaagtcagtgaaacaaaggaagtaaattcaactaaattgaaggctacagagagttctgttgtagagtggttgaagaaccttgatgaaggggctacattgagcgatgttttggaacacttcaatggatccagtaaagattccgtggttgaactgctaaattgccttcagtctgacttttcaatatatagtaaaggtggcacgtataagattctgtaa

SEQ ID NO: 2515 - DNA, 2722 bp, Glycine Max
gcaattgtatctatcaagaagggtgcatatttacttaagtgtcgtcgtagaggaaagccgaagctctgtcctttcagactttctcaggatgagagaaatttgatttggtactcaggacagcaggaaaagcacttgcgattgagtgtagttaccaaaatcgttcaagggcaggaacataagcaaaatgagtccgaaaaggagtgtcattcattttcactaatctatgctaatggtgaacgttctcttgatctgatatgcaaggacaaagcccaagctgcttcttggtttgttggattgaaagctgtgatttctaggtgtcagcatcctagagcttttagtagtttaagaagttgcaaaggggtgcagagttgtgctagtagtccagctggaatcttaagaagaaagaaaaatcttggccttctggacgatacctctcagtttactcaggtacatagcgtatgtgcaagtcccactttgtcactttctgaaaggtgcttttctgatggcttgtcatgtacctctgataacttttattcatcgtcatctttcctttccaacactcatggcgtaacagataattcagtgccaagttctccatacattgatcctgataatcatagcaacattgagtatctgatgcattccacttccccacatgtaggaaaaaataatgtgttgaaagatgtaatgatatggggtggagggattggatgtcttgtagggattgtgaatgaaaggtttgttcagcctagaatttattctttagtgccaaagttactagaatccactgcaatgttagatgttcataacatagctttaggaggaaaacatgctgccttagctacaaaacaaggggaagtgttttgctggggtcacggtaagtggggaagactggggcaaaaaattgatatggacattagctcccccaaaatagttgattctcttaatggtcttcatgtaaaaaatgttgcttgtggtgagtatcatacctgtgctttgacagattctggcgaagtatatacttgggggaatgatgtttgttgtgcagatttattgattgaagggagaactagaagtcagtggataccacaaaaacttggtggatccttagatggtattagtatctcaagtgttgcctgtggggaatggcatactgcaattgtctctagttgtgggaggttatttacttatggagatggtacatttggggttcttggccatggcgatcttcggagctattcaagtccaaaagaagttgaatctcttagtggtctacgggtgaggtctgctgcttgtggatcatggcatacggctgctattgttgaagtcatgtttgaccgtttcaggtacaatagtgctagtggtaagttgtttacatggggtgatggagatgaagggaggcttggtcatgttgataatggaagcaagcttgtaccaacacgtgttacacaacttgttgactatgattttgttcaagtgtcatgtggaagaatgttgactgtagcactcactaacatgggcaaggtttttgcaatgggaagtgccaaatatggacaactaggaaatccacatgccagggataaagcagtcatggttgaaggacaactcaaacaagagtttgttaaggtgatatcaaccggttcataccatgttgctgttttgacttctggggggagtgtctacacatggggcagaggtgaaaatggccaactggggctaggtgatactgaagacagatacacaccttgttttgttgaggctctaagagacagacaggtaaatactatcacttgtggtccaagcttcacagctgcaatcagtttacacaaacctatttctattagtgaccagtcaacttgtactggttgtaggttgccatttgggttcacaaggaagaagcacaactgctatagctgtggtcttttgttctgtcgtgcttgtagtagtaaaaagattacaaatgctcctctagcccctagtaagagcaaggcttttcgagtttgtgatcagtgtttcgataaacggcaaggggataggggagagacaactgtgacacaaggtcctttgttatcacttggtcaatcatgctacaggaaaagcatgccaagtggacgtaaggattggaaaagcaatcaagaaagtcagcaggatgtagaagatagttctcctatgctaggtggaatgccacagtgggggcaagttccttgccctgccatatttaaaataaattctacagaaaatccagttgctcatgtttcttcatccaaaaataaattagccacagtttctccctttaatgtggaatctacaacatataacttctccaatgtagagacagatgcaacaaagtctgacaaggtgctccttgaagaagttcataggctgagagccgaggctaagagacttgaagagcagtgtgagctcaaaaaccataaaatacaagagtgtcaacaaaaaattgaggagagttggtttgtagcaagagaggaagctgctaagtgcaaggcagcaaaagaggtcataaaagctttagcactaaggcttcatacaatatcaggaaaagataacgttggacaagaaggaaaagctgggccgaatgaatttgtgcccaatgtggcacccatacatacagaaatgaagagtccacgtgatgttaatgtggatagtctatccaattcccctatagtattctctgacacattaaaatccaaatttgggagaa

SEQ ID NO: 2516 - DNA, 1938 bp, Glycine Max; identical to SEQ ID NO: 146

SEQ ID NO: 2517 - DNA, 2751 bp, Glycine Max
gcattgagagccattaagagtcgtttgattgatcctaatggaaatttgagcaattggaatgatggagacccatgtacgtcaaggtggaaaggagttttgtgcttcaatgaaacaaaagaggatggccatctgcatgttgaagaattgcaattactgagattgaacttgttgggaactttggcaccagatcttggcaaattaacttatatgaaaagattgaactttatgtggaacaacataagtgggagtattccaaatgaagttggcaatatcacatctttggaactcttgcttctgaatggaaataaattaacaggttcactaccagaggagattggctatcttccaaacttggacagaatacaaattgatcagaaccaaatatcaggacctatacctacgtcatttgcaaacctgaacaaaacaaagcactttcacatgaacaataattcacttagtggacaaatcccaccagagctttcccgattaccaaatcttgttcaccttcttctcgacaacaacaacttgtcaggatatcttccccgtgagctggctgatatgccaagcttacttatcattcaacttgataacaacaactttgagggaaatagcattcctgatacatatgccaacatgtcaaagttgttgaagatgagccttaggaattgcagcttgcaaggaccaattcctgatttaagcaggatacctcaccttctttaccttgacctcagtttgaaccagttgaatgaatcaattcctcccaataagctttctgaacatatcacaaccattgatttatcaagcaaccgccttactggaaatattccatcctactttgctgatcttccacgtcttcagaaactgtcacttgcaaacaattcattggatggcactgtttcttcctccatttggcagaataagacttcaaatggaacaaaaacatttctcttggagttggaaaataataatcttacaaccatatcaggcagtattgatcttcctccaaatgtcacagttgggcttaatggaaatcccctttgctcaaatgtaaccctgactcagttctgtggatctgaaggggctaatgtaacagatggttcatttacaacaaattccagttcctgtccccctcaagcatgccctcctccttatgaatactctgtgaattgtttctgtgggcttccattgattgttgactatcggctgaaaagtcctggattttcaaactttcttccatatttgaatgattttgaggtctacatggcttctggtgttaaaatatctaccaatcagctacaatatgatttttattggcaagtaggacctcggctgagaatgaacttgaagttttttcctgcatatgttgataacagtagtagtcatactttcaatagaagtgagctcctacggctcacaagcatgttcacaggatggctaattccagacagtgatttgtttgggccttatgaactgatgggttttaatcttttgggtccttaccaggatgagattggcaggagttcaaaatcagggataagtacgggtgcgctggttggcatagtcataggggcaattgcctttgcagtgacgttatctgcaattgttaccattcttatattgagaataagattgagagattatcatgccgtttccaggcgacgtcatgcatccaagatctctataaaaattgatggtgtaagggcctttagttatggagaattgtcctctgccacaaacaatttcagcacctctgctcaagttggacaagggggctatgggaaggtttataaaggggttctttctgatggcacaattgttgccataaaacgtgcacaagagggatccctgcaaggtgagaaggagttccttacagaaatatcattactatcaaggttacatcatcgcaatcttgtgtctctgattggatactgtgatgaagaaggtgaacagatgctggtttatgaatttatgtctaatggcacattgagggatcacctttctgttacagctaaagatcctctgacttttgccatgagattgaagatggcattaggggcagctaaaggtcttttgtatctacactcggaagctgatcctccaatatttcaccgagatgtaaaggccagcaacatattattggactctaagttttctgcaaaagtggctgattttggactttcacggcttgctccagttccagatatggaaggagttgtgcctggtcatgtatctacagtggtaaaggggaccccgggttaccttgatccagagtacttcctaactcgcaaattgactgacaagagtgatgtttatagtcttggtgtcgtatttctggaacttttgacagggatgcatcctatctcacacggcaaaaatattgttagagaggttaacgttgcgtaccaatctggcgtgatattttcaattatcgatggacgaatgggctcttatccatctgagcatgtggagaaatttttgactttggccatgaagtgttgcgaagatgagccagaggctcggcctagaatggcagaagtggtcagagagcttgaaaacatatggtctacaatgccagaatcagataccaagagagctgaatttatgtccagtgattctggcaaagcagacagtcacagtacaccatcttcatcttctgcctctgcttctattatgaagacaccttttgtatcaggagatgtgtcaggtagtgaccttgttagtggagtgataccaagcatcaagccaagatag

SEQ ID NO: 2518 - DNA, 438 bp, Glycine Max
gcctggcttattaaggtgtatgtagtatgtaccttggtccatctgagacacagtgcatgtaagaccatcactattgtgttaccccacaattctgtaatcatgtacaaaatcacaatacttttggtaaagagggagcactggaacggagttgctaatatagttttgttaaatattggattttttattgagatctcttcgttaatgaaaaaccaaaattatgtttcattttgcaaggtggatattaacattcataagaatattcctcatgtacatttacatgaaaaaaggagaacaaggaacactattgtggagctgaaattcaagtttaattccattttgcattacatttcacaaatgattgttaccacccctcgtgaagaaattgatttgacaaataagaatcaaacagaagtcaacaaagacaaaaagaacccgtaa

SEQ ID NO: 2519 - DNA, 2181 bp, Glycine Max; identical to SEQ ID NO: 147

SEQ ID NO: 2520 - DNA, 1386 bp, Glycine Max
ggcgtttctctgttccccccagcctctcccttttcttttcttttccccgctatatataacaacacaacctgcgatactcacattcacacaaacatcattatggctccatcttcactgttttcaaacatgcatctcttcttcttctttcttctttcctccatacacctctctctacaactcaaccacaccacctcattattctcactctctttccctctcacaccactctctctctccaccagcaccgcctccaagatgatgctactcaactctctccttgcaaacaacaacaacaacaacacacgacttaaatcaccaccttattcctctccctacaactacaagttgtctttcaaatactccatggctttaatcgtggaccttcccattgggaccccaccgcaagttcagcccatggttttggacaccggaagccagctctcgtggattcagtgtcacaaaaaagcacccgctaagcctcccccaacggcgtcgtttgacccttctctctcctccaccttctctatccttccgtgtactcaccctgtctgcaagccgcgaattcccgattttaccctccccacctcctgcgaccagaaccgcctctgccactactcctacttcttcgccgacggcacctacgccgagggcaatctcgtcagagaaaaattcaccttctcccgttccctttttacccctcctctgatcctcggctgcgccaccgagtccaccgaccccaggggcattttgggaatgaaccgtggacgcctctctttcgcttcgcagtccaaaattactaaattctcatactgtgtccccacccgcgagacccgacccggttacactccaaccgggtcgttctaccttggcaacaacccgaactctaacacatttaaatacatcgcaatgttgacttttggtcagagtcaacgcatgccgaatctcgaccctttggcctacactgtagccttacaggggataagaatcggaggaagaaaactcaacatctcgccggcggtttttcgtgctgatgctggcgggtcgggtcaaactatggttgactccggatccgagttcacttaccttgttaacgaggcttatgataaggtgcgggctgaggtggttagggctgtgggccccaggatgaagaagggttacgtgtacggtggtggtttcgggacatgtggttttgatgggaatgcagttgagatcggacgattgatagggggacatggtgagagggttctggctaccgtggagggtggggtccactgcgtagggattgcgaactctgataaattgggtgcggccagtaacattattgggaatttcatcagcagaatcttgggtttcggtacggctgattgtagcagattgtctaactag

SEQ ID NO: 2521 - DNA, 603 bp, Glycine Max
ggcttcatctttgattcagataaggagttagttccgagtacaatggagttaacatcattgattttgcaaccaaacttgacacacttgtttccaacattcacatgctgtgtcaaactcaaaccttctttccagcatttgcagaataataaggaattatcactgaaaatcagtcgaagggtaggggttttggcagccataacttccttgattttgggtgtaaatggaaattttgggacacaaagtgcaaatgcatttgagtttaaatttgtggcccctgatatgacagttgaagatgcattgagtggagtgaggggtcatgcacaagatttgttacatgttagagatttgttagagttagagtcatggagagcagcacaaaagacattgagacagagctcagcaattctgaagaaggatatttataccataatccaaagcaagccgggaattgagagggcacaactaaggaagctctattctactctcttcaacaatgtgactagacttgattatgcagcaagggataaagatggaccccaagtctggcagtgttacgagaacattgttgtggctgtcaacgacattctatccagaatagaatga

SEQ ID NO: 2522 - DNA, 2217 bp, Glycine Max; identical to SEQ ID NO: 148

SEQ ID NO: 2523 - DNA, 524 bp, Glycine Max
gtagtgccgttggatttctggccaagctcttatggaatgagagtgaaaatcgctttggcagagaagggtatctcatatgagtgcaaacaagaagacttggaagctaaaagttctctgattttagagatgaacccggttcacaaaatgataccagttttgattcataatggaaaatccatttgtgaatcacttaacattgttcagtacattgatgaggcatggaacctcaaaccttctctacttccatctgacctttacaaacgatcccaagccagaaggtatggacagggaaggaccatggaagatgaacttggagacaagccatattttggtggtgaggactttgggtatgtggatgtggctcttgttcccttcactagctgcttttacacggttgagacctgcgggaaactaagcatagaggaagagtgtcccaaacttctggcttggccaagaggtgcatggaaaaagagtgtggccaagtcactccctcacccacaccagatctatgcctttgccatgca

SEQ ID NO: 2524 - DNA, 780 bp, Glycine Max; identical to SEQ ID NO: 149

SEQ ID NO: 2525 - DNA, 630 bp, Glycine Max
gtcacatggagtgtgtcgctgtcatgtgtcttcgttagcatcctggtgtttattttgtttaagctccgcgcgtgttgttgttgttgttattcttcttcttcttcccaacgccataacacaaagctcgtggcagccacagaagctattgaaaagtgccccatctttgaatactcgacggcgaaggagcttaaagtggggaatggggcagaggagtgctcggtgtgcttggtcgagttcgaagactccgacaccataaagatgctcccaaaatgccaacacgttttccaccagaattgcatcgatacatggttaccctctcgcatgacctgtcccatttgtcgccagaaactcacgtctcaggataccgtaatcgacattaatgatgatgatgtcgtcccaatggaacaactagaacatgatattggtacagagattacagagtcagaggtggcagtaactgatgaaactgacactggcactgttgtggaacagcatcaccatgtatttattcatctaatgaagtgtgtaattttcttgcacattggggaaaaagaaaaagattttgcactgaagaattcaatggggatgggaacaaaaagaggaaggaattttgctagaagaaaacgatga

SEQ ID NO: 2526 - DNA, 606 bp, Glycine Max
gtctgtaaagtagacattaatgcagaagagcaaacggcaattgtcacaggcattgtcaacccatccactttggtccagaagttggccaaatttggcaagcatgcagagatatgggatgcaggatacaacggtgatcagaacaataaccaagctcaattaataaataatcacagtgactatgaaaatcagtatatgattcccccctttggcgaaaatcactggggaccccaatgggagaaccaagaatgggcacgtaacttccctggagagtcatcaactagcaaatatggtcatcaaccatctcctatggccaacatacatgaatatcatcatgaattccatccatcaaatatgatgcactcttttactacgaaaattagacaagatatatccatttttccaccttcacatctaagctcggcatattttaattcttatacaaaattttcaaacattatcactaaaactcaaaaatatataaaagaaaatatcaccacaaaaactcaattgacaactcaacctagtgaaaaacatgtagcaaaattagcaattcaatctcatgtttccatctattctttatttcaacctttaccaaacccaacataa

SEQ ID NO: 2527 - DNA, 2295 bp, Glycine Max; identical to SEQ ID NO: 150

SEQ ID NO: 2528 - DNA, 1593 bp, Glycine Max; identical to SEQ ID NO: 151

SEQ ID NO: 2529 - DNA, 1530 bp, Glycine Max; identical to SEQ ID NO: 152

SEQ ID NO: 2530 - DNA, 1137 bp, Glycine Max
gttgatatttctttgagccacagacttaatgctgtgaaaccttccaaaactctatccatatgtcatcatgccactgctcttttacaagctgattttgactcacctgatgttatagctgaggctgggatgaatgcaactcgtgaaggttacacgagatatacccccaatgctggaacattagaattgcgccatgcaatttgtcgtaagctaaaatttgacaatatggaattacatattcttctgatcagattgtggtcagtaatggagccaatcaaagtattgttcaagcagtgcttgcagtttgttccccaggagatgaggcatgaaacagttattattcctgctccattctatacgagtgatccagaaatcgcaagattggctgatgcaacacctgtgattcttccaagccacatatctaataattttcttttggatcccaaactgctcgaagccagccttactgaaagatcaagactacttattctttgttcaccatgtaacccagcaggatctgtctactctaagaaattacttgaagagatagcccaaattgttctctctgatgaaatatatgagcacataattatgcaccaacaacccatacaagcttcgcatctttacctggaatgtgggacagaactccaacttgcaaattctgcatttcttagaatgtttgtaaattatgacaatgttgaaagcacatttgcaatgactggttggcggcttgggtatattgcttgtccaaaacattttgttgcagcattcggaaagattcaaagccagttcacttcaggtgcaagtagtatatctcagaaagctggagttgctgcattaggaataggctatgctggtggggaagctgtttctaccatggtgaaagcctttagggaaagaaaatttcaatatagcattgatcatcatcatctagctactttgcataaaaagttcaaaaatagtgaaaaattaaatacattagcccaagtcataacttggtttgccttggtgctggggagtgcatttggagatgattcttgcatccgcatctcttatgatgaatcccttactaatttaaagacaaccatggagaggattaagaaagcacttatccctctaagctctgatgcacttgtttaa

SEQ ID NO: 2531 - DNA, 1608 bp, Glycine Max
tcaaagagatcaatttcagagccacgtataatagaacaacaaatgggtgctaatgacagaaacaatgaatcatcagagaaagatgctttgttggacaacataaggaacgagatggatagtcttcgatcatccgaggataatgcaatggcgttattgtctgactataaaaggagaattcaagaactggaggccgaactggacaagcgaaaagaatcagaagcaaatttgtttgacacattggtaatgcaaacaaaacagctggagcagaataagattttgcttgaagagtcaaagcttgagatcatttctcttgaagaaaaaataaaggcacttcaaaagcgacaaatgacggaggatggcttttccacaaaagaaagtgtagagaatatggaaattgaagctgagctagaaaaagtgctgttcagtggtgaggaatcaaccatggaggtcaaaaccatgcttgaagaattgcaaatgcttaaaaatgaattgaagtcagcaactgaggcagaagagaacagcaagaaggccatggatgatttggcatttgcattgaaagaagtggcaacagaagccaaccaggtgaaggcaaaactgaccttaagccaagtggaactagagcacaccaaaggggatgcagagcgttggagaacaatgttaggaaccacagaagagaggtacaaggagattctagaaacaacaaggaaagaagctgataggtacaaaaacacagctgagagattaagattggaagctgaagagtcccttttagcatggaatgacaaggaaaccgagtttgtgaattgcattagaagagccgaagaggaaagattacttgcacagcaagaaagcactagagtccttgagttgttcaaagaggcagagaacaagacaagggtttcaaaggaagagaatcaaaagctgcgcgatatactcaaacaagccttgaatgaatccaatgttgcaaaagaagctgctgagattgcaaaggctgaaaatgctagactacaagatagtctcaacctacttgtccacgagaatgagatgctgaaaatccacgaagctgcgtcgtttgagaatattagagagttgaaacgaatgctatcagaatcatcaatgaaggagttcaaaaatgaggatatggataagccatccacaaaagaaggtagcaaggaggataacaataataacaaggaatcaggtgggagaaaagcaaaggcacataataacaactcaatagattctaagagtctgcacaaaacatttagttttaatctgaaggaaatgataacgccacataaccataataagcagcaacacagcaaagaagaggccaataacaaagacactgatgatgacacgttaaggggttcgatatttgatgaagtggattcatcatcagattcagaatctcgtcctgatgtagacatgggaaatagccctgatgattatgaccatcttggtgaatcgcattttgatgatccccatagtgatagcaactcgaggaaacgaagagctttgctgagaagatttggagaccttataaggagaagaggttaccataatcaccgaaaggaaccatccaacgaggaacatttacaaacgtga

SEQ ID NO: 2532 - DNA, 294 bp, Glycine Max
tcaaatgcttttgaatgggcacttgctgaaatgataaaccaacctgagttgctccaccgagccgttgaacaattggacattgtggcggtagggaaagagagactggtccaagaatcagatatacctaagctcaactatgtgaaggattgggcaaaagaagcttttcgccttcatcacactgcaacctttattcctcccaatgcctctatgagtgacacaatggtgggaaattacttcattcctaagggtagtcatgtaatgctaagcagacaaggacttgggacaaaccctaaa

SEQ ID NO: 2533 - DNA, 150 bp, Glycine Max
tcctacgttgtagaatgcaacgatggtaacgtcattctgtcagctacgctagcgaagttcaccctaaacaacgccgacgaattgcatttcttcgacatggacctcattgatggttacaacctctcaatgatcatgaaaccacaggactga

SEQ ID NO: 2534 - DNA, 599 bp, Glycine Max
tcctccatcgaccaccttgacaagggacgttacctcccatgttgttgctttgcatgttgtgcatggtcatgccttatcatgttcctcttaatcatagccattctctttcttggcatcacctacttggcttttctcaagtcagggatgccaaaagtcaacgtgagagccttcaacataacaaagttgcaagttgatgatgggtcacaaaagatgaatgcggttataggcttaggattaatattctctaacaagaatgataagcttaagcttttatatgggcctcttgatgttgatgtcactagtgaggatgtgctgttggggaagaaaaaactaggtggcttttatcaaaatcccttgaatgacacccaattggacatgaccatgacattggaaaatgctgatgttgacaagtatgctgcggaggacttgatatcagacatcaaagcctatgagatggtgtttgatttgtatgtgggtggacacattggttttcaggttgggaaattgcagatgaataatgttccctttctagcatcttgtcatcaaatcaagagggaggatgtggattttggaagaaagcctgaatgtgatgttaagct

SEQ ID NO: 2535 - DNA, 279 bp, Glycine Max; identical to SEQ ID NO: 153

SEQ ID NO: 2536 - DNA, 1380 bp, Glycine Max; identical to SEQ ID NO: 154

SEQ ID NO: 2537 - DNA, 273 bp, Glycine Max
tctttgcttgctaatataattaacagtttttggtttccgctgttttgctctccaaaaatcaaattccgtctttcaaactttcttcttctacgttgctgcactgcactgcgccctgaagaagaagcgagtttggtgttgtcaatgagcttcatatgtgtgggaggaagttcaatccatgtggctaaaggcccaagtggagaaggacgaaggcccaagtggagaaggacgaaggcccaagtggagaaggatgaaggcccaagtggaaaaggatga

SEQ ID NO: 2538 - DNA, 1125 bp, Glycine Max
tggcttcaaactttgggaccttacgcttctcttcctcctctcgccaccatgtccgtggagaccatgtgctccgttctcaaggtaaaccctaatcattctcaacttcttgtttttttcctttttacaaatgatgaagatgattggttgaacaatgacctcgtttccttttatttgataaatactttgggttttcggattttcggccttatcagagagaattatcaggtacctcctttggttgctaaaaagactgggatagttgtgagccctctgatatctttgatgcaagaccaggtgatggctttgaaacaacggggcatcaaagctgaatatcttggaagtgctcagaaggatttcactgtgcactctaaagctgagcacggtcaatttgacattctgttcatgactcctgagaaggcatgcacagttcctagcagtttctggtccaacttactaaaggctggaattagtctttttgctgttgatgaagcccattgcatatcggaatggggacatgattttagggttgaatacaagcatttagacaagctacgtgaggttttgctagatgttccttttgttggtctaactgcaactgctactgaaaaggttcgatatgacatcatcagttccctgaagctgaataatccttatgttacaattggttcatttgatcgcacaaatcttttctatggtgtcaaactattgaaccgaggacaatctttcattgatgagcttgtgcgagaaatttcaaaagaagtcactaatggtggttcaactataatttattgcacaacaatcaaagatgtagagcagatattcaagtcatttgcagaagcgggcattgaggcagggatgtaccatggccaaatgaatggaaaagctcgagaggagtctcatagattatttgttagagatgaactgcaagtcatggtggccaccatcgcctttggcatgggcatagataaacctaacattagacaagtgattcactatggttgccctaagagtctagagtcctactaccaggaaagtggacgatgtggtagagatggtatagcttctgtttgttggctatactacacaagaagtgactttgccaagggtgacttttattgtggagat

SEQ ID NO: 2539 - DNA, 798 bp, Glycine Max
tgtcaagagtctcttaaccattgccttgagctgaaatgcactgtaatggaagcattatatcctctggccattgtggtgaagatcagtgtaggcaatgtggatggtcctaatttgtatgaggtctccttggagaccaaattcaatattttgttaatggtggttcctgttagcaactatagcagcacaagagtgaaggatgctaaaaatccaactggagattatggggaaggaattatttcttcaccactacatctcaatggtaatatgttgctttcatttcaagttttgagggacactactgagaactttaatgaagaaaacatattgggaaaatctttgacatcaaaatttgttttccctcttggggtgttgctcgaatggaagacaaaaaatgattgtctacaaagcaatataaaatcatctaccatttcgttgggagaagatatgcatgccaaagtatcaaactttggattggttcggcttttacgtgaagggaagaattcatgtcaaaccaaactaaaggctggaactattgtatattggcacctaaaagacaaccaccttgttacacgattcatcaagagcctagaaaagataagaggttcattacaaaccatcattgacgagacaattgtggttgatgagcaaacctttgatagcattacagtggttgcaaagatcatgagaaagtatgattggtgccggatgacgtccttaaaatccattgcacatctcttttcttctcattttgtgcctcgattctcttctcccctaatcactatccgtgctgaagagtag

SEQ ID NO: 2540 - DNA, 1383 bp, Glycine Max
tgtctatcaaaaagtcaaacaaaaaatgttccaaaagggtctctggggtaccctatcatcggagagacacttagttttctcaaagcacagagacaagataagggttctgtttggttggaagaacggatatctaagtatggccctatcttcaaaacctccttaatggggttccctacagtctttgtaattggacaagaaggaaacaagtttgtccttggttcaccagatgatttgctttcttctaagaaacccctcaccctgcgaaagatacttggaaggcaaagcttagttgaacttacaggaccaagatacaggttagtcaaaggggaaatgttgaaattcttgaaacctgaatgccttcagaactatgtcaaagagatggatgaattggtgaatgctacattactgagagaattcagagagaatgaaatcattagagctgtggtcttcatgaagaaactgtcctatgagatagcatgcaatctattgtttgacattaaggatgagcacactaaggaggctttgtttgtagattttactttggcatttaaagcaattcattctcttcccatcaatctccctggcaccacattttggagaggccaaagagccagggcaagaattgtagacaggatgattcctattttgaacaaaagaagggaggaactgtcaaaaggagttctaagctccacaaatgacatgctttcttgcctgcttgcactaagggatgaaaatcatcaacctctagatgatgatttaatcactgataattttatttttttatttgttgctagtcatgacacatctgccactcttatgagcttgatgatatggaagttatctagagatcaagaggtttacaacaaagttttagaagaacaaatggaaattataaagcagagggaaggaacagaagagaggctaacatgggcagagatacaaaagatgaaatacacatggagagttgctcaggaattgatgaggatgatccctcctttgtttggcagctttaggaaagcacttaaagacactaactacaaaggctatgacataccaaaagggtggcaggtgtattgggcagcatatggaacgcatatgaacgatgatatattcgagaatccacacaagtttgatccatctcgttttgagaatccaaccaagccaattccaccttattcttacctcccatttggtgcagggcttcattattgcataggaaacgagtttgccaggattgagaccttggctattattcacaactttgtaaagatgtatgaatggtctcaagtaaacccagaggaagcaatcactcgtcaaccaatgccatatccatccatgggtctcccaattaagatcaaacccagatcttgtagtatttcttaa

SEQ ID NO: 2541 - DNA, 1409 bp, Glycine Max
tgtgttccttttccagcacaaggccatataaaccctttaatacaattggccaaggcccttcactggcgtggtttccacataacttttgtctacactgaaccaatcatagacgcttattcgtccatacaaaccatatggatcaacttgatccatatgatcatacggatcaacatgatcctcatacggataaacatgatccgcatgacaactcgatcccatcacccaaggcccaacctagcttttagtatgagaccattccagatgggttaccatcatgggacagtgatggaaacccagatggcgtcgccctgtcttctgatcaaacttaacacatcttcaggggcacctccagttagtgccataatatctgatggtcttatgacttttgcaattcaagctactcaggatctgagcatacctgaagctcagttttggattgcctctgcatgtggattcatgggatacatgcaattcaatgaactagccaatagaggaattattccattcgaagatgatgaatccattaccgatagtgaactagaaatgcccatagattggattccagggatgaaaaacattcgactcaaagacatgccaagctttatcagaaccacagatcttaaagagaccttgttcgattttatggggtcactagcaaagaattgcttgacatcatccgcaataattgttaacacgatccaagagtttgaactagaagtccttgatgcaatcaaggccaagtttcccaacatatacaacattggcccagctcccttgttaacaaggcatgttcctgaggacaaggttttgtccattgggtcaagtttatgggttgaagactctaagtgtctcgaatcgctagataaatggcaacccaattcagttgtgtatgtgaattatggaagctggacagtgataacagaacatcaccttaaagaaattgctttgggctttgcaaatagcatgcacccatttttgtggattattaggcctgatgtgatgatgggtgaatcagcaattttaccaaaagagtttttttatgagattaaggagagagggtacatcactaattggtgccctcaagaaagagtgctagcacattcatcaattggactttttttaacacactgtggatggaattcactaacggaagctatatgtgaaggtaaacctatgatttgctggcctttctttgcggagcaacaaatgaattgtagatatgcatgcacaacttggggaattggaatggagctgaaccatagtgtaaagcgtggagagattgttgagcttgttaaggaaatgatcgagggagataaggcaaaggaaatgaagcaaaacgttttggagtggaggaaaaaagcactagaagccactgatattggtggctcatcctataatgacttcaatag

SEQ ID NO: 2542 - DNA, 270 bp, Glycine Max
ttagagtgcaatgctggtgcactcacaaattttgaggtccttgatttcttacgagctaaaggagcttcaaaggatccaacaagagttattgccaaagtagcacagtctgaatacaaggtttatgattatttggttgacactgctgcctctgttcaaacaagagagagcatcaatgagttcttaacaagtgttaaacagcatgacctggcaaaagctgaggttctgaacatattaaacattgggccagctgctgaagttgaactataccca

SEQ ID NO: 2543 - DNA, 133 bp, Glycine Max; identical to SEQ ID NO: 155

SEQ ID NO: 2544 - DNA, 123 bp, Glycine Max
ttatttccccagatgatcgaagctgaacatactgtgcgacttttctcttttgagaaaccaagccaaataaatctgatccacctatccaccttgcttgtatgcactttaggagggttcatatag

SEQ ID NO: 2545 - DNA, 229 bp, Glycine Max
ttcaactttcaaactattcttgaggcaactgctcatttttcttccaccaacaagataagggagggtggctttggacccgtctacaagggaaaactactaattggacaagaagtagctataaaaagactttccaaaaggtcaggacagggattgattgagtttaaaaatgaagcgatgctaattgtggaactccagcacactaacttagtgagtctctttatattcactc

SEQ ID NO: 2546 - DNA, 291 bp, Glycine Max
ttcaatacgaactcgaaccaaacagtggttcagacatacgacaagatgacctacctgaattgcatcgctgattattccgacaatggaaccttcgtgtacaacggcgaaagctgtggtttcggcgaagcattggtcgtcgttgttccgttgaccatagttggaccgaactacttcttcttcgacgccgacaacggtgtgcagtgccagcacaacttggccttcgagatcgacgtccagcacggcctcggcttgccgccaagtctcaaccagccgcctctgtcgtcgtactag

SEQ ID NO: 2547 - DNA, 3501 bp, Glycine Max; identical to SEQ ID NO: 156

SEQ ID NO: 2548 - DNA, 294 bp, Glycine Max
ttctactactttgttaagtcagaaaatgatcctcttatgctttggctaactggtggtcctgactgctctttattttcaagtcttgcctttcaaataggcgtgcttcagtttctttcaagacaaagcatagctttgacaagtacatctaactctaaactcacatggaagataaggaccctatcttctacttttgttatagtcttcaactattttttcggatcaacacattataaaagaatggtaatgatattgagaatcattcctttattctgcatgtttaccttatggaagtag

SEQ ID NO: 2549 - DNA, 138 bp, Glycine Max
ttgactatcatctctcctgatagagatgacattgttcttcccattcctgagaatgagaatccaaagggtttatggtttactactaaagaaggtagtcattaccggttgaaattcaccttcaatgtgagcaataatatt

SEQ ID NO: 2550 - DNA, 3192 bp, Glycine Max
ttgatattttcttggtctcttggggatatactcaacaatgatctttacaaagacaaggtgaggcaaattccaacagcattctggtcagtaagtcactatctgaaatcatttatttttccacttattgaggaaactcgtacagatttatgctcaagcatgaagatgttgtcagaagctccggcgtgtgaaataactgacattaatttgtctgaagattactcacctccacatgatttgttataccagatagaaatgaaaacaatagtagctagtgataaaaaaggggatgtttatgagcctgaggttggacatctcattgctttgactgataagaggccaacatgcattgatgatttgaacaagcatggaaattcctatcttattgctttaattaggaaggttagaaagaaaaatgacgatgaaaatgtttttgaggttcaaatactagcctcacagcccattaaattggaaatgtactggcaagaggatgacaaatatatatatggtatatatggttttgctgtttatctttttagtttaacaacaaatatgcgtatatggaatgctctgaactcagatccagatggtccagtcatccatgtcagcaagcaactgctccaacctgattctgctgttggggaaaattgtgctcaatgttactcatttcaaaggtacactgatgatggatcaatgattggtgctgccattcgcttattcgatttaaacaaagctcaagaagagggcgttttaagttgtttagctgcaagggaatgctctcacaaaaatactgtgaaattgatttggggtcctccagggacagggaaaacaaaaacagttgcctcattactatttgccctcctcaaaaagaaatgcagaacacttacttgtgctccaactaatgtggcagtactggaagtgacatctaggtttcttaggctagtgacagagtccattgattatcacacttatggtcttggagacatattattatttggaaacagaaagcggatgagtattgacgatcgtgatgatcttcttgatatatttcttgattaccgtgcaaatattcttgccaagtgctttgctcccttgtctggttggaaacatcatttagaacaggtgatattgttacttgaaaatcctgaagagcagtatcgtgaatatttaaagttcaacaaacaaagcaagagaagaagcatatgtccaaggattcaaaaatttaacaaaatacaaattttgacatttcatgagtttgtcaacaaaaaattgaattatatctggaggtggatgaggacatttgcagtggatatgtgtactcatttgccaacttcttttatttcattaagacaggtgaaatgtttatttgaatgtcttgatttgcttaaagtccttgcagagatgctatcaaacaattcgattactgatcaacaattgtataaggccaggaaagaatgccttacaaagctgaaatcacttcaaaagattattcttcctgatttttttgatgaatatacaatcaaaaacttttgtatcaaaagatcgcgcatgattttttgtactgcttcaagctccgctagattgcatgcagtagaacattatagactagaaatgttagttatagatgaagctgctcaactcaaagaatgtgagtcaaatatacctttacaacttcctggtcttcgtcatgttgtacttattggagatgagaaacagttgcctgccctagtcaaaagtgagatttctggcaaggcagggtttgggagaagtttgtttgaaaggctggttcttttgggtcatgaaaaacaccttctcaatgttcaatatagaatgcatccatccattagcttgtttccaaatatggaattctatgacaaacagattttggattctcctagtgttaaagaaagaagccatgagaagcattttctacatggagatatgtttaagttctactctttcataaatgttgcttatgggcaagatgaattcgatgaagggaatagccgaaaaaatatggtggaagtagctgtggtatctgagattgttctcaacctctataaagaatcagcttctagaaaacagactgttagtgttggtgttatatcaccatataaagctcaagttcttgccatacaagatgctcttggaaaaaggtttgttggtaatgttgataatgacttttccctgaaggtttccacggttgatggtttccaaggtggtgaagaggatgtgataataatatccactgtaagatataataacatgggatatgtgggattcctttctaattttcaaagaactaatgttgctttaacaagagcaaggtattgcctttggatagtaggtaatagtgaaactttgatgaatagtggctctgtttgggagagattaatccttgatgctagggctcgagggtgttatcataatgctgatgaggatgagaggttatctgatgctattgcaacttccgtgattgagcttggtcaagttagtgatttattgaaattggattctctgctctttaagaaagcaaagtggaaggtttgcctcaatcaaagttttctgatctctatggcaagaattaagagtgctgagatttgcaagaaaatatgttccctgctgatgcaactttcaagtggttggcgtcagcctcaccggaacataaatattagagttttggatgatacttcttcccaacagttagagctgtataaagtcaatgagtcactttatcttgcatggaccatagatgttctagaggagaactcaaattatgttcaagttttaaagatttgggatgttttgccattgtctgaggtatccaatttgataaagaaaatacctgtagcccttgatttgctaagttctcttgaaaactttctgagtaaagccaagttcaagcaaacttctgatggttgtgatgatggagaaagcattcttgactgccttggtaggttaggcataaaaaaggaagagtgccttgtcaaactgaaatcactttctcagacaacttcacttccaaacattactgacaaatatgaaatggcaaaattttacttgatgagtgcacgcctgattttctgtactgctgcgagttctactaaattgttcacggatggaatgacaccagtagaattcctagttattgatgtcaaaaagaacagacataagttgattaaaacctgggtttaa

SEQ ID NO: 2551 - DNA, 2080 bp, Glycine Max
ttgttcacactgagtttctttcagctcgatgagtctgaatatttctaccttggaattagactctcagttgttaattctagttataactgggttgccaatagagacgagccaatccgtgacccttcagtggctctcacaattgatcaatatggtaacttgaaaattatttccaacggtggaaattccactatcatgctctattcttcttctaaacctgaaagtaatagcaacagtactatcatcaccagtgccatcttgcaagataatggcaactttgtgcttcaggaaataaaccaagatggatctgtgaagaacatattgtggcaaagctttgattatcccacaaacatgcttttaccagggatgaagctagggtttgacagaaaaacaggccaaaattggtctataacatcatggagaagtggtaagtctcctttgtcagggtccttcagccttggccttgaccacaaaacgaaggaaatggtgatgtggtggagagagaagattgtttggagtagtggccaatggagcaatggaaattttgccaatttaaagtcctcactttacgagaaggacttcgtttttgagtactactcagatgaagatgaaacgtacgtgaagtatgtgcctgtttatggttatatcataatgggatctttgggtataatatatggtagcagtggtgccagttattcatgcagtgataacaagtactttctgtctggttgttcaatgccaagtgcacacaaatgcacggacgttgatagtttgtacttaggcagtagcgagagtagatatggggtaatggcagggaaagggttcatatttgatgcaaaggagaaactaagccattttgattgctggatgaagtgcttgaataattgctcttgcgaggcttactcttatgttaatgcggatgcaactggttgtgagatatggagcaagggcacagcaaacttttctgacactaacaatttgatcactggtagccgccaaatttacttcattcggagtggaaaagaaacaccgtctgagctcctaaaatatcgatcgggtgtgagcatagaggaacaacacttatggataaaactcaaagaaagagctgaaaagcgtaagaagcaaaaagaactactaactgatattggaagaagcactgccatttccattgcatacggtgaaagaaaagaacagaggaaagatggaaacacaagtgatgaaacatatatatttgactttcaaactattcttgaggcaactgctaatttttcttccacccataaaataggggagggaggctttggacctgtctacaaggggaagctgtcaaatgggcaagaaattgctataaagagactatccaaaagttcaggacaggggctgatagagttcaaaaatgaagcaatgctaatcgtcaaacttcagcacactagtctaggtcttacctccaaaatagattccaacaagagaaacatgttagaatggaagatacgatgtcaaattattgaaggagttgctcaaggactcgtatatttacatcaatattcaagattaaaagtgatacacagagacttgaaagctagcaacattttattggacaatgagttgaatccaaaaatatcagattttggaacagctagaatatttgaactagcagaatcagaagaacaaacaaacagaattgtcgggacatatggctatatgtctccagaatatgcaatgaggggtgttatctcgactaaaatagatgtgtatagttttggagtcttgctactagagatagtaagtggaaagaaaaatagtgatgattacccactcaatcttgttgtttatgcatggaaattatggaacgaaggtgaagctctaaatctaacggacacattgttggatgggtcatgccctcccatccaagtgttacgctacattcatattggtcttttatgcactcaagatcaagcaaaagagaggccaactatggtccaagttgtttcttttctatcaaatgaaattgctgaattgcctctacctaagcaaccaggattttgtagcagtgaatccatggaagagatagagcagcctaaaa

SEQ ID NO: 2552 - DNA, 1017 bp, Glycine Max; identical to SEQ ID NO: 157

SEQ ID NO: 2553 - DNA, 99 bp, Glycine Max
aaaaacatctgttgcctattgatattcagttcagcaatagctgatttaaaatacttgacgtgtcacgtgtatgtacgtcggtatattttaacttcttag

SEQ ID NO: 2554 - DNA, 1389 bp, Glycine Max
aaaaagctgtcagaattcaagaccaaacttcatcaaaagattcaaaagttagctactcctcctttatcagccttggcatcaccacctgcttcctcttcagaaacaaacaagagtgggagggtgttgtacgtgagtgaatatggtgcagacccaacagggtctgaagaaagcagtgatggcattttgaaagctgttgaagatgcttttgagttgcagaagggtgttgagttggttggaggagtgaatgaccttggaggagtagtgattgatttggaaggtggaaactacaaaatcagcaaacccattgcattcccttcatctggtggtggcaatgttgtggtgaaaggaggaacgttgagagcatctgatacatttcctggtgatcgacatctaattgagttatggtcatcaaactccgggaaacttgagtcaaaagaacctctgaatgctgatgtcttcaaaagcatcaaagctcaaaacaatgcaatttactatgaagacataacgttccgggacatcctcttcgattcatcctacagaggaggaggaattttcattgttgattccgccagaacccgaatcagcaattgcttcttccttcatttcaccacagaaggaattctagtccaacaaggacacgagacctttatatcaagttgctttcttgggcaacactcaaccgtcggtggagacaaagctgagaaggacttctcaggggtggccattgatcttgctagtaacgataatgcagtcacagatgttgcaattttctcagcagcaattggtgttgtgctaaggggtcaagccaacattctaactggggtgcattgttataacaaggcaacatattttggtggcataggcatattagtgaaattggcaggcaattcactaactagaattgataactgttatctggattatactggaatagtcatggaagatcctgtgcaagttcatgtcacaaatgggttgtttctaggggatgctaatattgtattgaagtctattaaaggtcaaattttaggcctgaatatagttgataatatgtttaatggtgaccccaataagaaggttcctattgtaaatctagatggggcatttagtagcattgatcaagtggtgattgatcacaacaatgtgaatggcatgagcttgagatcaacggttgggaagttaactgcgagcggaaatggcaccaagtgggtggctgatttttcatcagttttggtgtttcctaataggattagccattttcaatattcattttatgctcaagatgagcctaaatttgtagcactttctgtgaccaatgtgtcagataatgtcgttgttgtggagagtgagaaagaagctaaagggttcgtctccttcatagttgaacaataa

SEQ ID NO: 2555 - DNA, 762 bp, Glycine Max
aaaaatttcaaagccaaatattttccgtcggtggatttcttggatgcacaattggggcataattcaagctttgtatggcgtagtatccatacttcacggtcccaaccttggcttaaaaatgataacaattcctatgtctcgacttttccttcaaatgaaaattatggcttaagagtggatgatttaatagatcataataagtgtgcatggaagaaatatctcgtggaagcaatctttagccaccatgatgctgaaaaaattctagctcttcccctcttgaacgtgatggagaatgataagataatagccatcttagaagtgaaggggattggatgctcatttggaagcttcggcaactccaaaaataaagcacttcttacggagacttttaagcttgtgatcacgcttaacatgtatggatggaagcaggactatggaacatcattgaacaaaagtgggatagtggagatcgctttctctcttttatttttactctcttgcaggaatccattccacaaattagagtcaaaattggagcggtcctttggtgtatttggaagacacgcaacacaaagctttgggaacaaatatccactacacctcgggttgcctactccactgcaatgcaaaacatcactcaatgggaagaagtccaaaaaccaaactatccagcaatattctcaaacgagcagcaacatcacatcgtggtctcctctgcaacaaaattacttcaaatgcaatcttgatgctgctactttctag

SEQ ID NO: 2556 - DNA, 1023 bp, Glycine Max
aaaagtaatgtgaaatcagctgtttttctgtctcccaagattgaacttggaccgggatctgtttccaataaaatttattatggtgttgattttccaagaggtcatattgcagtgaagagttttaatgcagaagtagttgatgaagcagggaaccctgtgcctctccatgaaacttataccactgggttattggacgatactacctatctaaagatgaacagtggtacatgccagagagatattcttgcacaatactacggccttggatccgaaacacggcgaacagctacggatattccagacccttttgaaataattgttggtaatcctgcaaaaattccagaggggtacgaggagaaatggttggtcaatatccatgccattgatacacgcggtgtagtggataaaatggggtgcactgagtgtaagtgtgagctttataatgttacaaatgatgaatatggagagcttcttctaaggccagactataaaggaggtttgctatgttgctatgatcaaacccagtgcaggttgagggaaggctttgtgggccaaaagaggaacctctaccttagatgcacagtaaagtgggttaattgggacaagttcattgtgcctgttaagatttatatacttgatgtcactgatacttcaaaaatatcacatgattctaaaggaatgatcgctgagcatgattgccagattgaatatgaggttgaatcttgcagcactggcaatgaggatggtaatgactgtctccatgtgaagaggacaaacctctcaatgaaaaattgtggttatgtcatatatggtgttgctcatcagcattcaggtgggactggatcaatgctatatggacagctgatggttatatgttcttcaataccaagttatggaaagggaaaggatgagacaaactacattttaggaatgtccacatgttatcctcgaccaggttctaatctaattaactacggtagcagccgtgagcacaccgcagtaatggggcttttctacctattg

SEQ ID NO: 2557 - DNA, 507 bp, Glycine Max
aaacaacctgctacaacattttgttctctggatgctgcaaatgatccaaaagaaaacaccccaattgaattaatcttcaccttccattttcttacccacgtggttttcgtgtttccatttcttctagtggatagagtgattgaacacaatcctggagtttctgcagtggccataaagaatgtgacaataaatgacaacttttttcctgggcattttcctgaaagaccaatcatgcctggtgttctcctggttgaggcaatggcacaggttggtggcttggttatgttgcaacctgaaattggaggttctcgcaataatttcttctttgctggaatagacaaagtgcgatttaggaagccagtgattgcaggagacactttagttatgagaatgacacttatcaaactgcaaaagcgatttggaatagcaaagatggaagggaaggcatatgttggaggtgaagttgtgtgtgagggtgagtttctgatggcaactgggagcgaataa

SEQ ID NO: 2558 - DNA, 174 bp, Glycine Max
aaaccttcaacaagtgatgttgaactcaatgaaatcattgaatatagttgcagttccttgggtgattgcaaaatgatccaacaaggtggatcctgcttcaaccctaacactctgatcaactttgcctctgttgtcatgaatcaatactatgcaactaatggcagcaacatttga

SEQ ID NO: 2559 - DNA, 780 bp, Glycine Max
aacgtcatttccttcatggtgtacttggcacccctgccaacattttaccgaatatacaaaaagaaatccacagaaggtttccaatcactgccttacctggtggcactcttcagttccatgctttggctatactatgcctcactcaagccagctgatgctactctcctcattaccattaattcattgggatgtgtcattgagattgtttacattgtcatgttcacaatctatgccaccaaggatgccaggaacttaaccgtcaaattatttatggtgatgaacgtgggttccttcgccttgatcttcctcgtcacctactttgctatacatggctccctacgtgtccaagtcgttggatgggtttgtgtatctattgcagttggtgtttttgcggcacctctcagcattgtggctcaggttattcgaaccaagaatgtcgagtttatgccgtttaacttgtcacttttcctcaccctaagtgccgtaatgtggtttttctatggcctcttactcaaggacatatgcattgctatcccaaatattcttggcttcacattgggactgcttcagatgttgctctatgcaatttacagaaatggtaaaactaacaataaggaagttgctacaaaggaggagaaagcactagaggcaataatgaaaaacgttgttgtggtgaacccgttgggaacgtgtgaagtgtacccagttatcaataaagagaataacaatggacaaggaatagaagttacatctaactgtacaatggcaagatctttttaa

SEQ ID NO: 2560 - DNA, 63 bp, Glycine Max
aactcatgctttgtggctcttcaggctttctcattcttcttattaagtgggtttcttaaaccc

SEQ ID NO: 2561 - DNA, 858 bp, Glycine Max; identical to SEQ ID NO: 158

SEQ ID NO: 2562 - DNA, 1080 bp, Glycine Max
aactttcaagttcaacgaccaaccaattatccaaaaccccatttcaaaggcccacacattgtgaaacgcaccaaagctatctctacccacatgcgcaatggccactgcgacttggctctccgtgtcttcgaagccatcccgcttcgaaactctgtctcttacaacgccatgatatctgggtacttgaggaacacaaagctctcccttgcaagggacctgtttgacaaaatgccccacaacttactgggtatgtcaggaacggcagattccgtgatgcccgcgtgttgtttgattcaatgcctgaaaatgatgctgtttcctggaatgccatgttgtctgggtatgtctggagtgggcatgatgcctcacaagtcacaagaattccggccatctcctggaatgggttacttgcagcatatgttcagagtgggagactcaaggaggctcgtcgcttatttgagtccaaatcagactgggaattgtttgatgggtgggtatgtgaagacaaacatgttaggtgatgccaagcagctttttgaccagatgcctgtcagggatgtaatctcctggaacaccatgatttcaggttatgaacaggatcgagattttgagggatgttttcacgtgaacagcgatggtgtatgcatatgtgcaggatggaataaaagagagatgtcgtacaatgtaatgattcctggttatgcacaatacaagagaatggacatggcaagggagttgtttgaggcaatgccttttccgaatataggttcgtggaatatcatgataagtggctattgtcagaacggtgatgtagcacaagctaggaacttgtttgatatgatgcctcggcgtgattctgtatcttgggcagctatcattgctggttatgctcagaatggtctctatgaagaagctatgaacaggtttgtggagatgaaacgagatggagaaagtttaaatagatctaccttttgttgtgctttgagcgcatgtgctgatatatctgctttggagttagggaaacaagttcatggacaggtggtgaagacggggtatgagaaaggctgtttagtgggaaat

SEQ ID NO: 2563 - DNA, 173 bp, Glycine Max
aagaaaaaggccacacgtgttgttttaaaggaagctgtggatttggaaaacatgccacttgaggaggaggtatttcagactctgaagagtgattcaaatggactcacaacaaaagtttctaagaagttgggcatctttggtcacaacaaattccaagagaagaaggaaaacaa

SEQ ID NO: 2564 - DNA, 600 bp, Glycine Max
aagaaacatgatgaacttcgacggcttccagaaggcaatcgaggagcgcttagagggaattcccgttgcttccgaggagtttctcttggtctcgggctcttcctcttctgcttcagcaaggacgacgccgaggctctcctcagccaggttacgcttattgacccccacgcgcgccagggctctaaagttgtccccgttgctttgaacaaggtgtttcagctcaaggtgaacagcgttgcttttagattgatacctgagttctctcaagtcaaaaatgccctcaaagagagggaaaaatctggcttcgcttccagtggcttttctggtgttccagttttccagtccagaaatctgatattgaagagccaaagtaagagatttcgtccacttttctccagaaaggaggacttagaaaatacacttaaatcggcagcccgtgagcagaacaaattaaattccactatgagaaaaggggatatccaggttgccactctagaggatgtaataaaagaaatgaaggaaaattctacatcgaactgggatgatgttatttttatacctcctggttttgatgtttcagacgactcaaatgagcagtag

SEQ ID NO: 2565 - DNA, 1056 bp, Glycine Max
aagaacatcagagtggcactgtccaagctggtccggtcagccaagcccggagatgttctctttgtccactacagccgccacgccacgcgcctcccgccggagatggatgaggaggacaacaccggctatgatgagtgcattcttcctgctgactgctacataatttgcttcttatttcttatacgtacggtgccaaggctggacagacgaggagagttgtattgtgtaattcgccaatcaaatgatgatttcaggcaatttgtagacaaggttccaaggggttgtaaaatcacaatcgtttcagattgttgccatagtggtggtctaatagaagcagccaaggaacaaataggagatagcacaaacgaagaaggccaaaactcaccctctctatttcacttcaaaaacctcttccatcgaaacatggaacaagaagaagaagaagaaaccatcgtgaagaatcgttctttgcctctttcaacactcacagaaatactcaagcaaaaaagtggcaaggatgatgacatagaaattgggaaactaagacacacactctttggggaagatgcaagccccaaagtgaagaaatatatgaatttagtcataaacaaactacaacatggaacaagtggtggcgagagaggaggaggacacacaattctggggctggtgggtgatcttgcacaacaatttttcgaacaaaagctaaatgacgatgacaaccacgacgaggaatatgcaaaacgtgggtggagcaagagggaggaacatcatgctgcatcaatcaagcgcaacattttggattgtgggattctgttgagtggttgccagagtgaccaaacttctgcggatttcgcaagtccttatggaaattcggacgcggcttatggggccttcagcaatgtgattcagagcataattgaagagactgatggtgcagtcacaaacagggagcttgtgctgaaggctaggatggtgcttaagagccagggttttgatcagaagcctggactgtattgcagtgacaacaatgttaatgcttcttttctgtgttga

SEQ ID NO: 2566 - DNA, 222 bp, Glycine Max
aagacaatatttgcagccaaccaagcatcttcaaaagcagtggatgcaccaaagggctaccttgcagtttatgttggagagaaaatgaagcgattcatgatccctgttcgagctgaggaagagtttggatatgatcatcccatgggcggcctcacaattccatgcaacatgtgcaaaataacaatggacttatcatcaaggtttgcattttcccttgaataa

SEQ ID NO: 2567 - DNA, 182 bp, Glycine Max
aagagggtgtcgttcgagaggcacatactgcgtcatttcgatcacccgctttttccacggttccgtggggccttcaagacggagcagctcacggggtttgctattgattattgccacggtgggaatctgcattctcttaggaagaggcaaccggagaaaacgttctctgaaaaaagcataag

SEQ ID NO: 2568 - DNA, 675 bp, Glycine Max
aagaggttgctgatcttcgaccgctctgataataagacaaggttattttatggtcctgtccctcttgtccagagtccaactgttactgctacaaagtttgctcaaagttacggtgtaaaaggggagggacaggccaaaagtgaaaatcatgaagatacagaagaaataaatgcatttctttattctgatgatgaaagcagtgaagatgacgacgatgatacttgtgatgaggtaacaagtacagatcattctcctttggcaactaataagacttatgtgatacaagagcaatttaaagacactaaggaggaggttgctagctctgattggcctaacaaaaggctgaagttatttgatggtgactataatagatcatcgacacctgtggacaggtatagtttggtaagaccaaatgaaacctgtgattgtgtcagtgatgctgaatcgaagaattctagtggctgggcatattctgttgataaaactaaagtagataattcagtggctcaccatatcaaatttaaaaaggataagatccgtgaatcgttgaaagttctcgagaatttaattcctggtgcgaaaggaaaggagccactgttagtcattgatggcactattgagtacttgaaaattttgatgtcccaaactggtgctcttggggtgaaatatcactaa

SEQ ID NO: 2569 - DNA, 1152 bp, Glycine Max; identical to SEQ ID NO: 159

SEQ ID NO: 2570 - DNA, 1095 bp, Glycine Max
aaggattttgattttgttgtcgtcaatttctaccactttgtgttcatccaagacccacaagctgaagttgccaaacaccgttctttcttggaattggagggtcttgacatcaatggaagagtctatttgaatgaacaagggattaatgcgcagtatagtggaccatcaaaagatgctatggcatatgtcaactggttaagaaaggataacaggttttccaacatcttggttcagatatctccatcagaaaaaggacatacctttccaatattgaagttgcgttataagtcttcattagtacaggttacccaaggtggagattgggtattttgtcactcaggtgtggcaggtaatatcacaatgttctcctgtggtgacggaaggagttatgagtgggatattggacattttcatggggctcaacgacctagtgtggactgctttaggaacacttcatttggtctgtctcaggaagagatcactgcttcagatcctttatcaaatgtagatgaagaaaaagcaaacatattgatgtattgcactggagggattcgctgtgatgtttattctacaatactaagatgtaaccttgttattgcaaatggacattgttttgtactattgaatttcagacctaagtattatgatatatttcatttggacttatgtggatttcaaaatttgtataccctgaagggaggcgtttctcactatctaaagaatgaagtccctgcagaatgggtaggaaatttatttgtatttgactcccgtctatctctccctccttctatttactataccggggccacaactcaagcagagtcaaatccagtttctggagatgataattttgcaaaatgctacgtatgtagtttgaaagtcagtgaattgagacataggaactgtgcaaatcttgattgtaatttgctttttctatgctgcagacaatgtgtagaggatctaagaggttgttgttgtttgacgtgcactactgctcctcggcgtagacctgtcttaaatggaatgcagagatacaaaaaatggcactactatcgggatatggattttcaagggaaactgaaaatttcaacttga

SEQ ID NO: 2571 - DNA, 459 bp, Glycine Max
aaggttctgattgcagctggtgtctctgtggcgattggtcagctttctaagccattcacttctgtttttctgtatggcaaagggtttgatatcagagcagttgttcaagctggagggttcccttcatcacactcttctgcaacagtggctagtgcaacattatttggccttgagagaggcttctccgatcctatttttggtcttgcagttgtgtatgccggtctcattatgtatgatgctcaggaagccacttctttggaaccacaagaaacaaatagaggtctattggttaaatcaggaagcaaaataaggcaaacagatgcagatgaaatctcatcaaagttggccattgatggtataccccaactaaaagaatctattggtcatacagagattgaagtcatagctggtgctttactaggctttttggtggctttggctgtgtataatttcaagtaa

SEQ ID NO: 2572 - DNA, 1449 bp, Glycine Max; identical to SEQ ID NO: 160

SEQ ID NO: 2573 - DNA, 684 bp, Glycine Max
aatcttataacttcttccacaagtctctcaaccacaacaaacaaactcttgcatggcacctacgccctcgtccgccgcaagggcctctgtccggacaaaaccacctacgcgctcctcatcaatgcgtggtgctccaacgggaaacttcgcgaggccaagctattcctcagggaaatgaggagtgttcctgatgttggaaccttcaatgctgtggtggaaacggtttctaaagagaatgttcagttttgtgttgatctatatcatgaggtttgtgctttggggatggctcctgatgttaacacttataagattctcgttcccactgtttcgaaggatgggatgattgacgaggcgtttaggttgttgaataatttccttgtatgcgcctgttatttaaggctttgtgtagcagggggcaatttgatgatgcttttttgcttctttggggacatgaaggccaaggcgcatcctcctaaccgccctctttatactatgctgattaccatgtgtggtcgtgctgggaagtttgttgaggtggcgaattatatttttgaaatgacagagatggggttggttcccatttcgcggtgttttgacatggttactgatgggttgaagaactgtggcaaacatgatttggctgggaaagtgcaagaatgggaagtttctatacgtggtgtttga

SEQ ID NO: 2574 - DNA, 542 bp, Glycine Max
aatgatacgcagcgccttctcgtttgcagcggctccaccgtgcatgtccatcttcagcaccaccaccggctccctcgtttcctcgctagaaggccacaccgtcgccgtcactgccgtcctaccgctttcgtggatgaaaccatccgccactgggacttctccgttcccgaatgcgttaagattatcgacctttgcttacccatcttctctatggtggtgccttcgatattgtctccgcgggaagaaaacgagaagaagacgatgaatgttattccttacgtgtctgttcaagatataaacgcactggacaatcgcccaaagcctttttatggacagatcagaaagtttaacgggcattgtttgtataaagtttttataataataatagtgtacaaattttcaagttttcttagtttttatagtttaaactttacagaacttctaattggattttccattttcaattgggttctgattttgaaatttgaccaactagccaacaattatttttatcggttaaaaattcaatactcctatttttg

SEQ ID NO: 2575 - DNA, 2034 bp, Glycine Max
aatggtgatgtaaaatgggaaggtgatgcttctattctaaaaggagccatccaagtcacatccaacaccatggaccaaaataacaattacagtgttgggagagtcacaagttataagaaaatgctcctctgggatatgaacactggaaagcttgctgatttcactactaaattttcctttgttgttttttcagggaaaagttactatggagatggaatggcatttttccttgctgatcctaatctcccacttctgaagaatattagagaaggaggtggtcttggccttgtggatggcaaacaagtgctgaattcaactcaaccatttgtagcagtggagtttgacaccttccacaataaatgggaccctcaaggtggcactcatgtaggtctgaatttcaactctatgaggtctaacataactaagcaatggttgacagatattcaaatatggaatgtttataattgcagcattgagtacaactcaagcactcttaatttgagcgtttcgttcactacgtacaataatgttagtaaaccagttgaggaatacatatcttacaaggttgatttgagagattacttgccggggaaggttattcttggtttctcagccgcaactggaaaattgtatgaggtgcatacactgagatcatggtcatttaattcaagtctacagagtgatgagaacacaaatgagataaaaccagtagcagcaccaccaacttcaaatcctgattctgaaaatgaacacaagataggattgtgggtggggattggaattggtgtaggcttggttctgggtcttttagggctgatttgtgctttattgtggaaaaggagtagagagaaaaaaggagagttagtttttgatctcaatatggctgacgaattcccaaagggcactggacctaagagcttttgctataatgagctagtaagtgctacaaacaaatttgcagagaagctggggcaaggaggttttggtggtgtgtataaaggttacttgaaagacttaaagtcctatgttgctatcaagaggatatcaaaagagtctagacagggaatgaaggaatatgtgactgaagtgaaggtcataagccaattgagacatagaaatttagtacaactcattggttggtgtcataggaagaatgactttctcctcatatatgagttcatgccaaatggaagcttagattctcatctatacggtgtgaaaagcttcttaacatggacagtgaggtataacatagctttgggcttggcttcagcattgctttacctacaagaagagtgggagcagtgtgtgattcacagggatattaaatcaagcaacattatgttggattcatgtttcaatgctaaacttggtgattttggtttggctaggctggtggatcatgagaaagggtcgcaaaccacgcgtatagccgggacgaggggctatattgcgcctgaatatttcacttcaggaaaggctactaaggaatctgatatatacagctttggggttgtgttattggagatagccagtggaagaaaacctgttgaactagaagctgaggagggtcaaataactgtagttgagtgggtttggaagctctatggattgggaaggttccttgaagcagctgaccctaagttatgtggagaatttgatgaaaaccaaatggaacgtttagtgattgttggcctttggtgtgttcatccagattattcattcagaccatctataaggcaagtgattcaggtgcttaaatttgagtctgctttacctattctccctgaaatgatgcctgtgccaacctaccttcctccaacaataaaagcacttttttcttctgtttcatcttccttttggggtagaaatagacaggctttgaggcaacagggactaagcaactatggcaagtacattttctatatcttaatcagttcagagggaatgcttggtctcatttgcagtaagcaaatacttggttctcaacacggccctggcttacctgtgacaaaaaatatcatcaacctataa

SEQ ID NO: 2576 - DNA, 596 bp, Glycine Max; identical to SEQ ID NO: 161

SEQ ID NO: 2577 - DNA, 1550 bp, Glycine Max
aatttcacgcgcattgatcgtaaattatacgttgctgcgatgaaaggcgacttccaagaactctccaatgaacagaatttggagatttcagaagaatttgtgactaagattcttaaggaagaaacagtccttcacatcgctgcaaggtatggacactccaatatcgctaaattattgcttgaacatgtcaaagcttttccaccttcagatattgagaaaggtattggagcagaaaagaagtttatgagggccacaaataatgagaaggacactgcattgcatgaggctgtgcgctatcatcacattgaagtagtgaagaccttgttagaaatggatcctgattactcctatgatgcaaataatgccgatgagactccgctttatctggcatcacaacgacaaaatcagcaagtggtggctgagatattaaacaaaatgaaatcaccggcatatggtggccccaataatagaacagcattgcatgctgctgtgattaaccaagatatagtaatggcaagagatcttgtgaagaataaacatgtgagaaaggctgtgaaacatgcggacaaggaaggttggattcctcttcattatgctgtgaaaacagggaatttaggtttgacgaagttgctgcttgcacaagatgggaacacagcatacatgcaagataatgagggcatgacagctcttcacatcgctgcttatgatggtgattggcttattatgaacatgataatagaatactatccagattgttctgagatagtggataaaaaaggcttgaatgttcttcattatgctgtcaatggggggagtggaactacagtggatataatcatggagaacctatcgctaagcaacctttacagtgagaaagactttgatggaaacacacccattcatcacctcaccaattccaaccttatgtgtgagagttttgtatttcaccgcagagttgacaagctggccgtcaacaaggaagctcaaacagctcttgatgttgcctattgtaagattgaagattcagatcaatcagattttagtagcatatcgataacagaggaccaaataaggttattaaaatcggctagatcaaaacaaagtcagcgactagatcaaaaatcaaagaacgggcaagaaaagactcaaagggtagtgttaactaaggaagcaaaggagactcatcttttagtggccacactcattgcaaccgtaagttttgcagctgggattactgtaccaggaggtaccatacaagatggtgaaaataaaggtagcccagttttggtgcaaagtagttttttcaaagcattcatggtatcaaacaccatatcaatggttctggccgctactgcagtttctatatatcttttcacgccagtgactagaaataaaaggaaggaaaatgctttctctaaaacagccctcgtattcactttgatcgccttagcagcaatgatcattgcattcattacaggcacgtatgtcgtattggaatcatcccgagtaattgctgttgcaattttccttattgggttatcctcttttat

SEQ ID NO: 2578 - DNA, 444 bp, Glycine Max
aatttcataacattaattattaggatgtttctgcattgtttgactcaaatgtggattgcaatactagcccactttatcataaaagagaggttgcacatatttggtgtgcttggatgtgctctttgtatggtgggatctacaattattgtgttgcatgctccccatgaaagagttattcactctgttaaggaagtgtggcaacttgctacagaaccagttatagctctattttattattttaaggaactttttttttatgaaaaagcaaaatcacatttaattcacacatttgcgaatggattgcaagtcattatctgctttatttatctgaaacaggaatgggacacagaagatgcatctcaaattgctactgaggtttgtggctttgtcacaattttatccgggacctttcttcacaaaaccaaagatattgcaaatagaccc

SEQ ID NO: 2579 - DNA, 801 bp, Glycine Max; identical to SEQ ID NO: 162

SEQ ID NO: 2580 - DNA, 672 bp, Glycine Max
acaactttgtctctcgcacaacaccatccaaaactaaaagggtatttgttgggttatatagaagcagttcgggaaattgagcagcagattcagaggggacaggcaatgtcaagtttgatgatattgttgtcggttgtggcagaagctggtttttgtaacaactttctggcatcttctagtatgtctgttgtaatcaatgggggcacaattgctggtctgtcactaggatcgtcattgagtacattgaaagcaaaggtacatgcattctctgtttgtgatgacccagattacttccacaacttcactcaaggcttgcttgatggactcaaagctggcgttagctcgagagatattgtccacattcagaacgccaagggtcttggctatgcaatgaatacatccgaggagcttaattttgttaaagaagttgctacggcaactggtgttgttcatgacccagtataccgtggtaaggctgcttatgcaatggtgaaagatatgtctgaaaatccaaagaagtgggaagggagaaagatcctcttcatacatacgggtggcctcctaggattgtatgacaaggtcgatcaattggcttcttttgttgggaattggcaacgaatggatgtcaatgaatctgttcctaagcatgatggtattggaaagatgttctag

SEQ ID NO: 2581 - DNA, 470 bp, Glycine Max; identical to SEQ ID NO: 163

SEQ ID NO: 2582 - DNA, 336 bp, Glycine Max
accaaaacgaaacaaagaagaaaaaaaaaactcaaacaccttcaagaacttgtatctttctttgttagtatttgttactacaattttacattcttttcatctctacatatttcattagtcatggcacctcaagcagtttccttcaagtccttcgccgttgctcttattgtggcgcttttcttctccgcctccgctctggacttagtttcggggcagtcgccggtgccggcgccggcgccggcaccagatgccggagcagctggatccgtgtcgagctcggtcgccatgattggagcttccgttgtgatttcattgctcgccatcttcaagcactga

SEQ ID NO: 2583 - DNA, 659 bp, Glycine Max; identical to SEQ ID NO: 164

SEQ ID NO: 2584 - DNA, 1290 bp, Glycine Max
accctcactcagctcctccaacttcacgccctcttcctcaaaacctccctcgaccaccaccctttcttcatctcccagttcctcttacaatcctccaccatctccctccctttcgccgcctccttcttccactccctccccaccctcccacccctcttcgcctggaacaccctcatcagagccttcgccgccaccccaacacccttccactccctcaccctcttccgcctcctccaaacctctcccctcaaccccgacaacttcacctaccctttcgtcctcaaggcctgcgctcgctcttcctccctccccctcggtgggaccctccattctctcaccctcaagaccggtttccgttcccaccgccatgtgggtaatgcccttttgaacatgtatgcggaatgctacgctgttatgtccgcgcgcatggtgttcgatgaaatgactgatagagatgttgtctcctggagctccttgattgctgcctacgtcgctagcaactcccccttggatgctttttacgtctttcgtgaaatggggatggagaatgaacagccgaactcagtcacgttggtgagcttgctatctgcttgtactaaaacgctcaatctcagggtcggcgagtccattcattcgtacgttacaagcaatggcatagaaatggatgttgcgttgggaacagccttgtttgagatgtatgctaaatgtggggagattgataaggctcttttggttttcaattcaatgggtgacaagaatttgcagtcgtgcactatcatgatctcggctctcgcggatcacgggcgagaaaaggatgttatctctttgtttacccagatggaggacggtggattgcggctggatagtttgtcttttgccgtgattctctcggcctgcagccacatgggacttgttgatgaaggcaaaatgtattttgatcggatggtgagagtgtatggcataaaaccgagtgttgagcattatggatgcatggttgacttgctaggaagagctggcttcattcaagaagcttatgatatcatcaagggcatgcccatggagcccaatgatgttatattgaggagttttcttggggcttgcagaaatcacgggtgggttcctagtttggatgatgattttctgtctgaactggagtctgagttgggggccaactatgtgctcactgctaatgttttttccacctgtgcttcatggaaggatgccaatgacttgagggtagccatgaaactgaaagggttgaagaaagttcctggttgtagttgggtggag

SEQ ID NO: 2585 - DNA, 882 bp, Glycine Max
actattagtggtcctacttatggagtaatgatgatcaacataatggtcattgcaagcatagtgaaatggaaatacgctgggtacccgaaaaggaacatagcgagtttaaaaccagactcggagctgagagtagttgcttgccttcataaaacacaccatgcatctgctaagaccccaactgtggatgcaatgcatctaattgagctagtttcttattcagatgatatcattcttgcttttgacctctatgaacatgacaacatgggtgcagtaactgcacacgtttacacagccatatctccaccctccctgatgcatgaggatgtttgtcatttagcattggacaaagtggcatccattataattcttccattccatctaagatggtctggtgatggtgccatagaatctgattacaagaatgcgagggctttaaattgtaagcttttagaaatagctccatgctcagttggaatccttgttggtcgttctgccattcattgtgactcattcattcaggtagcaatgatttttctgggtggaaacgatgaccgagaggctttgtgcttagccaaacgagttacaaggaatccaagggtcaacttggttgtgtaccacctagttcctaaggaacaaacaccagacgtggagtatatacaagataaggaggcactaaaacatgttatgaaaccacacttgggaaatagacatttcttcttcggcaaaatagtaaatgaacatcactatttcattgttgggagaagacacgagttagactcacctcagacggttgggcttacaacttggagtgaattttcagagttcggtgtcattggtgatttgcttgcttcatcagattttcagagcagagcgtgtgttttg

SEQ ID NO: 2586 - DNA, 912 bp, Glycine Max; identical to SEQ ID NO: 165

SEQ ID NO: 2587 - DNA, 147 bp, Glycine Max
actctcaatataaaaaaaccccatcctcagtcaaaaatgagagtagtgatagtgtccctttggttccgagcaaggactgctgcgagcacaagggcaggctgcttgcagcttgaagaatgccagcaccaccaactgtccatcccataa

SEQ ID NO: 2588 - DNA, 2941 bp, Glycine Max; identical to SEQ ID NO: 166

SEQ ID NO: 2589 - DNA, 1000 bp, Glycine Max
actttttccattgattcaactcactctctcagctcaacaccaaaacacccccttttcctctctacccatcatcactcaaagtccaatgcacacttctcattttctgtttctgcccaacaacaacaacaacaacaagtagaagccgatgaagaagagaactttcaagtgctcacagctctcaaaactgattacaatgacatactcatagtggacaccccaaagtccagaatgctgctccttgattcatcttgtactcccttctctatagtgttcacagcattctttacaaggaacaaaaatggactggttcttactgggtgtgtattctactctgactttgtttttttttttttttttattactgtatggacgtgtgttttatgtgatgaatttgcaagcttgccagtcattgttccaaaaggtcccatcgcaatcttaggtttgggcggtggaactgcagctcacctgatgcttgacttatggccttcactgcaacttgatggctgggagattgatcaaattttgatcgataaagcaagagattattttggcctatctgatctggaaaagacaacggacaatggtggtgttttaaatgttcatattggtgatgtcttcattacctcagaagattttcaccaaagatatgctggcattatagttgacttgttctctgatggaaaagttttgcctcagttgcaagaggttagtacttggttggaattacatgagagattgatggccaatggccgcttcatggtgaattgtggtggtgttggtggggggccaagtgccgtggatggaagtactgatcaagaaacttcaagtgatgaatcatggttattaaatccagcattgcaagcactatccaaagcgtttcctggacaagtaagttggaagagaatgccaaaggaaaatggtgaaaattttatggcacttacaggacctttgcctgatctggactcttggtctgctagtgtcccttctccactgagcaaaa

SEQ ID NO: 2590 - DNA, 540 bp, Glycine Max
agatttgtattaagatttttaaaaaaatataactttactccttttacttttactaatatggtaatctacatcacaattattaacggtgtatgtaaagataagcttgtatccgaggcttgcgatttatactgtgtaatggctgtcaaggaaatttctgctgatgttgtcacttataattctctaatttatggcttatgcattgttggtaagctgaaagaagcaaccagtttcttaaatgaaatggtattgaaagccatcgttttcgtgcctataatatattggttgatgcattatgataaaagggtggatgaagctattctctttaaggaaatgcatcagaaaaatatggtacttgacacagtgacttataattctcttgttgatggtttgtgcaaatctgggagaatcccttatgtttggaatcttattgatgagatgcagaggtcaaccaacaaatcttgtcgtggcactttttattgtagactatcaagccttacctcgttattgcttgctgaaactctgagggatttacttcattga

SEQ ID NO: 2591 - DNA, 1311 bp, Glycine Max
agggagcaatacacaggagagggctcagttaactttagaggagagcctgttctaaagaaggatactggcaattggagggcttgtccttttatcctaggtactatatcacatgaaggaaacgtttcttccgcaagaaacattagcatctggcttggcacttcttatctcacacctctcattggagccgttctagcagatggttactggggtcgatactggacaattgctgttttctctgcggtttatttcattggaatgtgtaccttgacactttctgcatctttaccagcattgaagccttctgaatgtttgggttctgtatgcccttcagctactcctgcacaatattctgtgtcctactttggtctatacgtgattgcgcttgggatcggtggtataaagtcatgtgtgccatcttttggagcaggtaaatttgataatactgatccaaaggaaagggttaagaaggggtcgtttttcaattggtattacttttctatcaatctaggtgccattgtatcatgcagcatagttgtgtggattcaagacaatgcaggatggggtcttggatttggcattcctactttgtttatggtattatctgtggtaagcttctttagaggcacacctctctactggtttcaaaaaacagggggaagtcctgttacaagaatgtgtcaggttttgtgcacatttgtccaaaagtggaatttggttgttcctcatagtcttttgtatgagacgtcagataaaatatctacaattaaagggagtcacaaactggtgcgtagtgatgatctaagaattagttgtttatggggaaaatgttggatgagccctgctctaatgtttcagaagttttttgtggatagattgcaattaaacatatttcttttagcctgtctttgccgcattgagaaatttgtgctaaattttgaatcgataatctctagtatcctcactttcttaaaaatgctctttcctccatacataaactataaacaggatttcctgcaccaaatccctcagtacttcttactgggggcagcagaagtattcgcattcgtgggactgcttcagttcttctatgatcaatctccagatgctatgaagactttaggtactgcactgtcacctttgtattttgccttgggaaattacttgagctcttttattcttaatatggtaacttacttctccacacaaggtggaaagcttggctggattcctgataatttgaacaagggtcatctcgattattttttcttgcttttagctggacttagcttcttaaatatgttggcatacgtt

SEQ ID NO: 2592 - DNA, 156 bp, Glycine Max
agtagtcgttgcctcgttggttttagtcagcttccaatttatttagtgacaatagtacccatgaaatctcatgtaatatctatattggaaattatggcagcacagagccaacaaaaatgggcaaagttaaccaatgttctaagctctaataaatga

SEQ ID NO: 2593 - DNA, 586 bp, Glycine Max
agtgaattgggtttatcactaaggttgcaaccaagcacaagtcatcataaagaaagtgatgtgggaaataacaataaggaagacaaaaatgatcaacaattggcaagttttgcatcagtgcagaacaaactacagcggacacatgagttgcctggtattactacccatgctgctttccctcctaacagaaaggctagggtttcggttagagcaagatgtgaagctgccacaatgaatgatgggtgccaatggagaaaatatgggcagaaaattgcaaaaggaaatccatgtccacgagcctattatcgttgcactgtagccccaggctgccctgttaggaaacaggtgcaaagatgtatagatgacatgtccatactaatcacaacctatgaagggacacataaccatccactccctgtgggtgcaactgctatggcttccacagcttctgcagcagcttccttcatgttgctagactcaagcaaccccatttcagatggcacctcaagcttcactcaagcaccatttccttacaacaccttccaccctctaaacccagcttcaaatttcaggagcataagcccta

SEQ ID NO: 2594 - DNA, 226 bp, Glycine Max
ataacttggttaaagaagtatgcaggtggtcaggttgattggagaggaaaatatagtggggctctccctccaacacctccaagagaacagcttatggacaggtactggtcccatgtggtgaattgcaagagttgcaattctctttataagagcctcaatgttgttgaagtaatgctgcagatcacatctgttgcttcaattggggttgttgccatcatgaagcatg

SEQ ID NO: 2595 - DNA, 207 bp, Glycine Max; identical to SEQ ID NO: 167

SEQ ID NO: 2596 - DNA, 1909 bp, Glycine Max; identical to SEQ ID NO: 168

SEQ ID NO: 2597 - DNA, 679 bp, Glycine Max; identical to SEQ ID NO: 169

SEQ ID NO: 2598 - DNA, 1626 bp, Glycine Max
atgaaaaaatcaagtctttttccatctgggaatttccttttccttttccttcttcttcttctcaatgtctctgcttcgttggcagcaccaacaccagaatcggtgtacacctccttcctccagtgtctcacaaactacacaaaatcacctgaccaagtttccaacatagtatttgctcaaaccaacgcttccttttcttcagttctccaagcctacatacgcaatgcccgattcaacacaacttcaaccccaaaacccttgcttgttgtcactccctcggaagaaccccatgtccaaggtgcagtaatttgcgccaaaagcattgcgattcaactcaagatcagaagtggtggccatgactatgagggtatctcgtatgtctccgaccaaccctttatcatcctcgacatgttccacttcaggaacatcactgtggatattgaaaacgaggttgctgtggttcaagcaggtgccacacttggggaactttattataggatttgggaaaagagtaaagttcatggctttcctgcaggggtgtgtcccactgttggtgttggtggacacttgagtggaggagggtatggtaacatgttgagaaaacatgggttgtctgttgatcatgttgttgatgctaaaattgttgatgccaaaggtaggattcttgacaaggaatccatgggggaggatcttttctgggctattagaggaggtggaggagcaagttttggagtcattttatcatacaatgttaaacttgttcctgtacctgaagttgttagtgtttttcggattgcgaagagtttggatcagaatgagagtgccactgagcttgtgttgcaatggcagcaggtggcgccgcacaccgatgacaggctcttcatgaggctgctgttgcagccagtgagttccaaggttgtgaagggccagaggaccatcagagccactgtcatggctttgtttcttggaggggctgatgaggttgccacattgatggggaaggagtttcctgctcttggcctcagcaaggagaattgcactgaattgagttggattgattctgtgctttggtggggtaatttcgacaataccactaagcctgatgcactgcttgatagggatctcaattcagcaagtttcctcaagaggaaatctgattatgtgcagaaaccaattcccaaaaaggggttggaggggatatgggagaagatgattgaattggggaaaactggatttgttttcaatccttatggagggaagatgagtgaggtttcgtctgatgcgacgccatttcctcaccgtgcagggaatctgttcaagattcagtactccgtgaattgggatgatcctggagttgaattggaaaataattttactagtcaagctagaatgctgtatagttacatgaccccttttgtgtctagtagtcctagaagtgcattcttaaactacagggaccttgatattggtaccaacagttttgggaagaatagctatgcagaaggagctgtttatggagtcaagtacttcaatgacaattttgagaggttggtcaagatcaagactgaggttgatccagaaaacttcttcaggaatgaacagagtattccagttcatccaagttag

SEQ ID NO: 2599 - DNA, 1539 bp, Glycine Max; identical to SEQ ID NO: 170

SEQ ID NO: 2600 - DNA, 1374 bp, Glycine Max; identical to SEQ ID NO: 171

SEQ ID NO: 2601 - DNA, 103 bp, Glycine Max; identical to SEQ ID NO: 172

SEQ ID NO: 2602 - DNA, 244 bp, Glycine Max; identical to SEQ ID NO: 173

SEQ ID NO: 2603 - DNA, 867 bp, Glycine Max; identical to SEQ ID NO: 174

SEQ ID NO: 2604 - DNA, 1437 bp, Glycine Max
atgaaaatgcaacaaaaagttggggcaggtgttgataatgcatggggctctgggatgcatgcaaatccatttgttgagaaacatgattggacacaggaacctggacaagggatgcagtctcccaatgcatatagttcacctgggcctttagagtcacagggaaatcttagaggggacctaaatcaaaacattgatcattttcagcagccacaaaatatcagtggttggctctcatctatcaaaggtacacttgaggaattagataatttctgcattgagggtaacgtgaaggaagcagttgaagttttggaattgctggaaaaactagatattcctgtggatttgccccgatatttgcaattaatgcaccaatgtggggagaataagtctcttgaagaggcaaaaaatgtacacaggcatgctttacaacatctgtcacctctccaagtcagcacatataatagaattttggagatgtatttagaatgtggttctgtagatgatgctctcaacattttcaacaatatgccagagcgcaatttgactacttgggatactatgataacacagcttgctaagaatgggtttgccgaagattcaattgatctatttactcaattcaaaaacttgggactgaaacctgatgggcagatgttcattggagttctatttgcatgtggtatgctgggagatattgacgagggaatgcagcactttgaatccatgaacaaggattacggcattgtaccatctatgactcattttgtcagtgtagtagacatgattggcagcattgggcatctggatgaagcctttgagttcattgaaaagatgccaatgaagccaagtgctgatatatgggagactttgatgaatctctgtagagttcatgggaacactgggctgggggattgttgtgctgaactagttgagcagctagattcttcttgtttaaatgagcaatcaaaggctggtcttgtacctgtaaaagcctcagatttgacaaaagagaaagaaaaaaggactttgacaaacaaaaatcttcttgaagtaaggagtcgagtccgtgaatatcgagcaggagatacttttcatcctgaaagtgataagatatatgccctgcttagaggtttaaagtcacaaatgaaagaagctggctatgttccggagacaaaatttgtgttgcatgacatagatcaggaaggcaaagaagaagctcttcttgcccacagcgagagacttgctattgcttatggtctccttaacagccctgctcgcgctccgatgagggtaattaagaacctccgtgtttgtggtgattgccatacagcactgaagattatttctaagcttgtaggcagagaactcattattcgagatgcgaaaaggttccaccattttaacgatggactatgctcctgcagggattattggtga

SEQ ID NO: 2605 - DNA, 408 bp, Glycine Max
atgaaaattctaataatagcctccgctgtggccgcatcgttgtttctattattatcattcatcatcggatacttaatcttccgatacgtaagaagaggttccgctgcggaagatagcagcaaccctgaaccttcgagcacgcgctgccgcaacttttctttgacggagataagagccgccaccaacaacttcgacgagggtttaatcgtgggcaaaggaggcttcggggacgtgtacaaaggccacgtccgcacgtgtcacaaacccgtggccatcaagcgcctcaaaccgggttcggaccagggcgcgaacgagttccagacggagatcaagatgctctcgcgcttccgccacgcgcacttggtctcactcatcgggtactactcatatggtttttttcagaaataa

SEQ ID NO: 2606 - DNA, 1215 bp, Glycine Max
atgaaaattctaataatagcctccgctgtggccgcatcgttgtttctattattatcattcatcatcggatacttaatcttccgatacgtaagaagaggttccgctgcggaagatagcagcaaccctgaaccttcgagcacgcgctgccgcaacttttctttgacggagataagagccgccaccaacaacttcgacgagggtttaatcgtgggcaaaggaggcttcggggacgtgtacaaaggccacgtccgcacgtgtcacaaacccgtggccatcaagcgcctcaaaccgggttcggaccagggcgcgaacgagttccagacggagatcaagatgctctcgcgcttccgccacgcgcacttggtctcactcatcgggtactgcaacgatggcggagaaatgatcctcgtctacgatttcatggcgcgtgggaccctacgcgaccacttgtacggttcggagctgtcgtgggagaggaggctgaacatatgtcttgaggcggcgcgtgggcttcacttcctccacgcgggcgtggacaagcagagcgtgatacaccgcgacgtgaagagcacgaacatcctgctggacaaggattgggtggcaaaagtgtcggattttgggttgtcgaaggtggggcccaacgcgtcccacgtgacgacggacgtgaagggtagtttcgggtatttggacccggagtactacatgagtctttggttgactcagaaatccgacgtgtattcgttcggcgtcgttttgctggaggtattgtgtgggaggtcccccatcgagactaaggtggacaagcacaagcagttcttggtgacatggttcaggaattgctatcatgatgggaatgttgatcagacggtggatccggctctgaagggtaccatagacccaaagtgtttgaagaagtttctggagattgcgttgagttgtttgaatgatcaggggaagcaacggcccatgatgagcgatgttgtggaagggttggagtatgcattaaatttacaacaacgttataaaaaaaataaaggggaaatagggttgaccaaaattgaggatcaccatggtgactttaacgacaaatttgggaaagtgttatcgatgaacgcgtctagcagcaccagcatggctacgacaacatgcagtgaagaggaacaagcattggtgcatgggatgttccctgagcttcgaaatcaaagaccacgttaa

SEQ ID NO: 2607 - DNA, 1545 bp, Glycine Max
atgaaacccacggcaacattcttctttctcctatccacaacaacactccttgtttgtctttgcctcggaacaacaacgttccaaaccactctctttataaccttcttcactatttcccttaactactggcttgtccctggaggctttgcatggagaaactatcactcttatcacaccaacgaaaaaccaaacaaaaaacttactgggcctatgggctggcccatacttgggtctctgcctctcatgggctctttagcccaccaaaaactcgctgccttagccgcgacgttaaacgcgaagaggttaatggcactgagtctgggacccactcccgttgttataagcagccaccccgagaccgccagagaaatcttactcggttcctcgttttcggatcgtccgataaaagaatccgcacgcgctctcatgttcgagcgtgccattggcttcgctccatccggaacctactggcgacacctacgtaggatcgcggcgttccacatgttctctccgaggaggattcagggcctggagggtctccgacagcgcgtgggtgacgacatggtgaagagcgcgtggaaggagatggagatgaaaggcgtggtggaggttcgcggtgtgtttcaggaagggtctctttgtaatattctggaaagtgtttttgggagtaatgataagagtgaggagttgggggatatggttagggaagggtacgagctgattgcgatgttgaacttggaggattattttcctttgaagtttttggactttcatggggtgaagagaaggtgccacaagttggcggctaaggttggtagcgtggtggggcaaattgtggaggatcgaaaaagagaagggagttttgttgtcaagaatgattttcttagcactttgctatccttgcccaaagaagaaaggttggctgattcagatatggcggctattttgtgggaaatggtgtttcgaggaacagacacagttgcaatactccttgaatgggtcatggccaggatggttttacaccaagacgtacaaaagaaagcccgcgaagaaatcgacacgtgcatcggccaaaacagtcacgtgcgagactcggatattgcaaatctcccatacctccaggctatagtaaaagaagttctccggctgcacccacccggcccactcctatcatgggcccgtcttgcagtcaatgatgtccacgttgacaaagttcttgtgccagctggtacaacagcaatggttaacatgtgggccatatcacatgactcatccatctgggaagacccatgggctttcaagcccgagaggttcctcaaagaagatgtttctatcatgggatcggacttgaggcttgcacccttcggggctggacgtagggtgtgtccgggccgggccttgggtttggccacgacccatctctggctcgcgcaacttcttcgccacttcatatggcttcccgcgcaacccgtggatctttcggagtgtcttaggctttccatggaaatgaagacacctctgcgatgtctagttgttcgtagataa

SEQ ID NO: 2608 - DNA, 2142 bp, Glycine Max
atgaaactgagtccaagagaggtggagaaactaggcctgcacaatgctggctaccttgctcagaaacgtcttgctcgtggtttaagactcaattatactgaagctgtgtctttcattgtcacgcagattatggaatttgctcgtgatggtgaaaagactgtggcacaactaatgtgcattgggaaacatctattggggaggtattgtatttttgttgaagctacctttcctgatggaactaaattagtcacagttcatgatccaatttcatgtgagcatggagatttagaacaagcattatttgattcttttcttccagtaccttcacttgacaagattgctgagatcatggaagataatagaataccaggtgaaataaaatatggagatggaagtctagttcttaacccaggaaggaaagcagtgattctcaaagttgtcaacaatggagaccggccaattcaggagggaagccactatcattttattgaagtgaatccctacttgacttttgatcgaaggaaatcatatggcatgcgcctcaatatatctgcagggactgctgttcgctttgagccaggggatactaagagcgttaatcttgtaagcattggtgataacaaagtcatcagaggaggtaatggcattgctgatggtcaaggggatttggacataaggaagaggaaaatgcaaggtattactggtgactctgacagtccattcaccacaatcattcctcgtgaagaatatactaacaagtatggtccaactactgacaaaatccgtcttggcgacaccgatttgtttgctgaaattgagaaagattttctctatggtaatgagtgtgtttttggaggtggaaaagttttaagagatagaatgggccagtcatgtgggcatccacctgcaatctccttggatactgttataacaaatgctgtgataattgattatagtggaatcatcaaagcatatataggcatcaaagacggccttattgtctcaattggaaaagcaggaaatccagacatcatggatggcgtattttttaatatgatcatgggggctaacactgaagttattgctggagaagggttgattgtaacagctggggctatagattgtcatgtgtattatatatgccctcaattagtagatgaggccatatcaagtagcatcacaacattagtgggagggggaaccggaccgactgctggaacacgcgccacaacttgtacaccagcaccatctcagatgaaactaatgctgcaatcaactgatgacctgcctctaaactttggtttcactggcaaagggagtagttccaagcctgatgaactgcatgaaataatcaaggctggagcaatggggctgaagctgcatgaggactggggaagtataacattcttcattacattttcttttattaacatacatactgacaccttaaaagaagctggatttgtcgaacatagtattgttgcatttaaaggaagaactattcatacttaccactggagtgcaggtggtggtcatgctccagatataatcaaagtatgtggtatgaaaaatgtcctgccctcatcaacaaacccaacgcgcccttttactgtcaatactatagatgagtatcttgacatgctgatggtctgccatcatctgaatagggaaattccagaagacttagcttttgcatgttcaaggataagagagggaacaattgctgctgaagatattttgcatgatattggggcaattagcattatatcttctgattcacaggctatgggtcgagttggagaggtcctttattcaaactcagcccatctacataagatggtgcttcatacatttgtccaattaagagttgaaattaaatggggcagtgtgcatgtgacatttctcaaaatattcttttttttaacactcgggcttaggtatgttgcattatttcttcctcaggtggcagaacttaatgctttatacggactgaacaagagggtggaagcagtaggcaatgtgaggaagctcaccaaactagacatgaaacttaatgactctcttccacaaatcactgccgacccagaaaagtacactgttacagcagatggtgagaacctcaccagctttgcaaccacctaa

SEQ ID NO: 2609 - DNA, 2718 bp, Glycine Max
atgaaactttcttcacctggttttagtcctccaccccaggaaggagaaaagcgagttctagattcagaactttggcatgcttgtgctggtcctcttgtttctttaccagctgttggaagccgagtggtatactttccgcaaggtcacagtgaacaggttgctgtgtctaccaacagggaagtggatggccatatacctaactatccaagcttaccaccgcagcttatttgtcaacttcataatctgactatgcatgcagatactgagacagatgaagtatatgctcagatgaccttgcaacctcttaatcctcaagagcagaagggagcataccttccagctgagttgggcactccgagtaaacagccaacaaactacttctgcaaaattttgacagccagtgacactagcactcatgggggattctctgttcctcgcagggcagctgaaaaagtttttcctccattggacttttcacaacagcctccttgtcaagagttaattgctagggatttgcatggtaatgagtggaaatttagacatatcttccgtggccagcccaaaaggcatctacttacaacaggatggagtgtgtttgtgagtgctaaaagacttgttgccggtgattcagtgctgtttatctggaatgaaaagaatcaattgcttcttggaattcggcgtgctaatcgacctcaacctgtgatgccttcatcagtgttgtcaagtgatagcatgcacttggggcttcttgctgctgcagctcatgcagctgcaactaatagtcgtttcaccatcttttataacccacgtgctagcccatcagaatttgtcatacctttagcaaagtatgttaaagctgtatatcatactcgagtttcagttggtatgcgcttcaggatgctgtttgaaacagaggaatctagtgtgcgtcgatacatgggcacaataactggcattagtgacttggattctattcggtggccaaattcccattggcgctcagtcaaggttggctgggatgaatccacagcaggagagaggcaacctcgagtgtctttatgggaaattgagccattaacaacatttccaatgtatccatctccatttccccttaggcttaagagaccgtggcctccaggactgcctttgttccatgcaggcttgaaggatgatgattttggaataaattcttcactaatgtggcttcgagacacagacagaggtcttccatctcttaattttcagggtattggtgttagtccttggatgcagccaaggcttgatccctcaatggtgaattatcaatcagatatgtaccaagctatggctgccgctgcacttcaggatatgtggacttcaaatccttccaaacagcatcctacttcctcaattcagtttcagcaaccgcagaacttccccaaccagacttctcccttaatgcaaactcaattgttgcagcagtctccatctcagcaggcttttccaaatagtcaagaaaatccacatccgtctccatctcaatctcaggctcaaactcaaacacactttcagcagcatctacagcatcagcactcattcaataatcagaatcagcatcatcttctgccgcagcagcagcaacaaccacaacaaccgcagttgcaacagcaacaagtggtagatcatcaacagatttcaagtgttgtctctacaatgtctcagtttgtttcagcagctcagtctcaatcaccacccatgcaagctatctcttcacttggccatcagcaaagcttttctgattcaaatggaaaccccacgactactgctattgtttctcccctgcatagtatattggattcatttcctcaggatgacacatctcaccttctcagccttcctagatccacttcttgggttcctgttcaacattcgactgcatggccaccctccaagcgtgttgtggtggatcctctcctttcttctggagcatctcaatgtgttctgcctcaagtggagcagttagggcagccacatagtaccatggctcaaaatggcattgcattgccagcctttcctggtagggagtgtacaatagaaggaagcaatgatccacaaaatcatcttttgtttggtgtcaatatagagccctcgtcacttctaatgcataatgggatgtcaagtcttaagggagttagcagcaacagtgactcacccacaataccttttcaatcttctaattacctgaacaccacaggacctgattcctcattgaatcctggaatgacacacaatattggtgaaacgggcttcctgcaaactccagaaaatggggggcaaggaaacccatccaacaaaacctttgtgaaggtttacaagtcagggtcctttggaagatccttggacatcactaaattcaccagctaccctgagctacgcagcgagcttgctcgtatgtttggccttgaaggtgagttggaggaccctgtgagatcaggctggcagcttgtattcgttgaccaagagaatgacgttctgctccttggtgatggcccgtggccggaatttgtaaatagtgtagggtatatcaagatactttcccctcaggaagtgcagcagatgggcaacaatgaacttgagcttcttaactcggtccccattcagaggctctctaacggtgtctgtgaggacccaagaaatttaagcactgggataacaactgtggggtctttaaactactga

SEQ ID NO: 2610 - DNA, 2715 bp, Glycine Max
atgaaactttcttcacctggttttagtcctccaccccaggaaggagaaaagcgagttctagattcagaactttggcatgcttgtgctggtcctcttgtttctttaccagctgttggaagccgagtggtatactttccgcaaggtcacagtgaacaggttgctgtgtctaccaacagggaagtggatggccatatacctaactatccaagcttaccaccgcagcttatttgtcaacttcataatctgactatgcatgcagatactgagacagatgaagtatatgctcagatgaccttgcaacctcttaatcctcaagagcagaagggagcataccttccagctgagttgggcactccgagtaaacagccaacaaactacttctgcaaaattttgacagccagtgacactagcactcatgggggattctctgttcctcgcagggcagctgaaaaagtttttcctccattggacttttcacaacagcctccttgtcaagagttaattgctagggatttgcatggtaatgagtggaaatttagacatatcttccgtggccagcccaaaaggcatctacttacaacaggatggagtgtgtttgtgagtgctaaaagacttgttgccggtgattcagtgctgtttatctggaatgaaaagaatcaattgcttcttggaattcggcgtgctaatcgacctcaacctgtgatgccttcatcagtgttgtcaagtgatagcatgcacttggggcttcttgctgctgcagctcatgcagctgcaactaatagtcgtttcaccatcttttataacccacgtgctagcccatcagaatttgtcatacctttagcaaagtatgttaaagctgtatatcatactcgagtttcagttggtatgcgcttcaggatgctgtttgaaacagaggaatctagtgtgcgtcgatacatgggcacaataactggcattagtgacttggattctattcggtggccaaattcccattggcgctcagtcaaggttggctgggatgaatccacagcaggagagaggcaacctcgagtgtctttatgggaaattgagccattaacaacatttccaatgtatccatctccatttccccttaggcttaagagaccgtggcctccaggactgcctttgttccatggcttgaaggatgatgattttggaataaattcttcactaatgtggcttcgagacacagacagaggtcttccatctcttaattttcagggtattggtgttagtccttggatgcagccaaggcttgatccctcaatggtgaattatcaatcagatatgtaccaagctatggctgccgctgcacttcaggatatgtggacttcaaatccttccaaacagcatcctacttcctcaattcagtttcagcaaccgcagaacttccccaaccagacttctcccttaatgcaaactcaattgttgcagcagtctccatctcagcaggcttttccaaatagtcaagaaaatccacatccgtctccatctcaatctcaggctcaaactcaaacacactttcagcagcatctacagcatcagcactcattcaataatcagaatcagcatcatcttctgccgcagcagcagcaacaaccacaacaaccgcagttgcaacagcaacaagtggtagatcatcaacagatttcaagtgttgtctctacaatgtctcagtttgtttcagcagctcagtctcaatcaccacccatgcaagctatctcttcacttggccatcagcaaagcttttctgattcaaatggaaaccccacgactactgctattgtttctcccctgcatagtatattggattcatttcctcaggatgacacatctcaccttctcagccttcctagatccacttcttgggttcctgttcaacattcgactgcatggccaccctccaagcgtgttgtggtggatcctctcctttcttctggagcatctcaatgtgttctgcctcaagtggagcagttagggcagccacatagtaccatggctcaaaatggcattgcattgccagcctttcctggtagggagtgtacaatagaaggaagcaatgatccacaaaatcatcttttgtttggtgtcaatatagagccctcgtcacttctaatgcataatgggatgtcaagtcttaagggagttagcagcaacagtgactcacccacaataccttttcaatcttctaattacctgaacaccacaggacctgattcctcattgaatcctggaatgacacacaatattggtgaaacgggcttcctgcaaactccagaaaatggggggcaaggaaacccatccaacaaaacctttgtgaaggtttacaagtcagggtcctttggaagatccttggacatcactaaattcaccagctaccctgagctacgcagcgagcttgctcgtatgtttggccttgaaggtgagttggaggaccctgtgagatcaggctggcagcttgtattcgttgaccaagagaatgacgttctgctccttggtgatggcccgtggccggaatttgtaaatagtgtagggtatatcaagatactttcccctcaggaagtgcagcagatgggcaacaatgaacttgagcttcttaactcggtccccattcagaggctctctaacggtgtctgtgaggacccaagaaatttaagcactgggataacaactgtggggtctttaaactactga

SEQ ID NO: 2611 - DNA, 6639 bp, Glycine Max
atgaaacttttgatccagtattactacgaatgtgtgatctgtgatgttggtggcaacttattgtgctgtgacagttgtcctcgcacttatcatttacaatgtcttgatcctcctcttaagcgcatccctaatgggaagtggcaatgtccaagttgctttgaaggaaaagatcaattaatgcccaaaaaccacctggatccaatttcaaaacgagcaaggacaaagattgtcactacaaaatcaaaagatcaagttagctcacttaaccttgaaaaagtttttggaactaaacttgtttcaaagaaaaggtcctcaagcaagggaaaacctatttcaagcatgggagtccaattttttggaaagaaattattgtcttccccagctgatgaaacttgtagcgacaaacctattgacccatctcctgagagtcttatggaaggaacttcgccagtggacaggaagtcaacttcaccagccaaggaagatgaaccgctctctaaaattgctagtttagaagcaattgatgaacagctggagagcaagactgatttaacttgcagtaagatttcttcaaggaaaacacttgttcttgctattgctgctagtggagaggaagtgagaaaaaggaagaataaagttgttaatgataatactagtcaaaagaaacgaaaggctgaaaaggggaaaaaaattgtcaatccttcttctataaaatccaagtctgggaataataaagtacacaagaagcagaagtctataacccatagcatttctgcatctgtatcaaaagaggatgttggaaacaagaattctagtgcccagcagaaagatgaggtacttaaaaagatgaaaaatgagaagatctctcagctaatgaaagataccccaagtgaagttgataaagcatggagccgcatggacaaaactttgttgcatgaagacagtgctattgctgagtctttgcaggttgatcgggttctagggtgtcgaattcaaggtgagaatgcaaattcatcacgtaacttgtccttgaatgttgcgggtgactcaccttctggtgatctagtaatatcagaaaatcagtccagactactagatgataattctgcttgtgctaatgatttggatgttgaatcaactgaaaatcatattgaggattgtcaaaatgtcaagagttctgatgaagaaggaatactgaaaaacactgatagactggaaaggattcatgtatacagaagatcaataacaaaagagagcaagaaaggaaattctgtagattcgttgagtaaagccactggtgatttagatccctgtgactgggatggtaaagatcaggatgattctgctgtatctgctgaacagttggaaaaaccaactgacaaggtggagacagaggagatcattaatgttgctttaagaagtgaggacaacagtgagattccaaaaaactgtgaaatacaactctctcctgaagcaaaacaaaaagaaaggaatgcagagaagggaatgagtggcagtattgatgataaagctcaggatgctatcatagctgaatgcgcaggcccaaatggagagcaagttttctatgaatttttagttaaatgggtaggaaagtctcatattcataatagttggatttctgaatcccagttaaaagttcttgcaaagagaaaactagaaaattacaaggcaaagtatgggatgacgataattaatatttgtgaggagcgttggaagcagcctcagcgggtgcttgcccttcgaacttccaaacatggaacatctgaagcatttataaaatggactggactgccttatgatgaatgcacttgggaaagtttagatgaaccagtgcttcaaatttcttctcatttgattacacttttcaataagcttgaaactctcactcttgaaagggattcatcaaaggaaaattcaactaggaaaagcaatgaccatcaaaatgatatttttaatcttacagagcaacctgaggatctaaaaggtggttctttgtttccccatcagcttgaggcactgaactggttgcgtaaatgctggtataagtccaaaaatgtgatacttgctgatgagatggggcttggaaaaacagtatctgcttgtgcttttatttcatcattgtattttgaattcaaagtttcacttccttgcttggtcttggtaccactttctaccatgcctaattggcttgctgaatttgaactttgggctccgaatgtgaatgttgtagaatatcatggctgtgctaaagcaagagcaataattcgccagtatgaatggcatgcaaatgatccaagtgggttgaataagaaaacagaagcctataaatttaatgtgcttttaactacatatgaaatggttcttgctgattcttctcatttgcgtggagttccttgggaagttcttgttgttgacgagggtcatcgactgaagaattcagaaagtaagcttttcagcttgctaaatacattctcttttcaacatcgtgtactgttgacaggtactcctctccagaacaaccttggcgagatgtacaacttgcttaatttcttgcagccagcttcatttccttctctatctttatttgaggagaaatttaatgatcttacaactgcagagaaagttgatgaattgaaaaaacttgttgctcctcacatgcttcgtagacttaaaaaggatgccatgcaaaatatcccccctaagacagaaagaatggttcctgttgagttgtcatccatccaagctgaatattatcgtgcaatgcttacaaagaattatcaagtattgcggaatattgggaaaggagttgcccaacaatctatgttgaacatcgtgatgcaattgaggaaggtctgtaatcatccatacctcataccaggaactgagcctgaatctggttctgttgagttccttcacgaaatgagaatcaaggcttcagctaagttgactcttctgcattctatgctaaagattttacacagggaaggtcacagagttcttattttctcacaaatgaccaagcttcttgacatcttggaggactatttgaatatagaatttgggtctaaaacgtatgagagagtggatggatctgtttctgtagctgatcgccagacagctattgcacgctttaaccaagacaaaagtagatttgtttttttgttatccactcgctcttgtggacttgggataaatttggcaactgctgacactgtcatcatctatgattctgatttcaatccccatgcagatatccaagcaatgaatcgagcacacagaattggacaatcaaatagacttttggtataccggcttgtggttcgtgctagtgttgaagagcgcatcttgcagcttgctaagaagaaattgatgcttgatcagctttttgtaaataagtcaggatctcaaaaagaggtagaagatattttaaagtggggaactgaggaactcttcaacgattctcctggactgaatgggaaagacatgagtgaaaataacaatagtagcaaagatgaggcagtagcagatatagaacataagcatcggaagaggactggtggtctgggagatgtatacaaggataagtgtactgatagcagcagcaagattctgtgggatgaaaatgctattttaaaattgcttgatcgttcaaaccttcaagatggttcaactgataatgccgaaggggattctgagaatgatatgctgggctcagtgaaggcgcttgagtggaatgatgaaccaactgaagaacatgtagtgggtgaatctcctcctcatgggactgatgatgtgtctacacaaaattctgagaagaaagaggataatgcagtgaatggcaatgaagaaaatgaatgggacaaactactgcgtgtgaggtgggagaaatatcaaagtgaggaggaagcagctcttggtcgagggaagcgacagagaaaagctgtttcttatagggaagtatatgctccacatccaagtgaaacaatgagtgagagtggtggtgaagaggaaaaagagccagaaccagagcctgagcgtgaatatacaccagcaggacgggccctcaaggcaaaatatggtaaactccgtgctcggcaaaaggaacgacttgcccggataaaagcgattaaagaatcaaatcctgctgagggatttccaggtaatgagttactttcacattctccagccattgccaagggtggggatccagtggctggaccgatgcattcagatcaggaggggccttctatcaacctagaagacagacaactttctgaagcgaagaatagcaacactgactccttttcaaggatcaataagctttcaaaacataaaatgaccagtcattttgatgcttctgtcagtaatctaggtcgttctctccctgacatttttcttccaagtcaccctaaagtggggctgagcatgacaaactcaatgcccaccaacaatttgttgcctgtactgggactttgtgctcctaatgctaaccaaatagaatcatcggaaagtaatatttcgaagttaaattggagacatagacatggatccagacaagagtttccattcagtcttgccccttgctctgggacatccatggatgctgaggtcagaagtaaggaagtggcagcaaataccaagctggcagatgcatcaacagaaaatttacaaccaagtttcaaaaatagcatccctgataacagtctaacatttgttccttttccaccctgtgtgcaaggaaaggaatctgatgcatttgaaaattcaggtgctagattttctcattttcaggagaagatggccttgccgaatctgccatttgatgaaaggttgctggccagatttcctcttacaaccaagagcatgccaaattcacatctggacctcttgcccagtttgtctataggaggaagacttgaatctttgaatgggtctatgcaagaccttccaacaatgccagtgttgcctaatttcaaaataccccctgaagatttattcagatataatcaacaagacagggatgctccccctactttgggtttgggacaaaggccaaccacattctcatctttcccagaaaaccataggaaggtgcttgaaaacataatgatgagaactggatctggatcaagtaatttattgaaaaagaagtcaaaatcagatgggtggtctgaagatgaacttgattctctctggattggtgttcgtaggcatggaaggggcaattgggatgctatgctcagagatcccaagttaaagttttcaaagtataaaacatctgaggatttatcagtgaggtgggaagaggaacaggtaaaggtctttcaggggccaccttttcctgcacaaagatcatccaagactatgaaatctaccaaatcggcccattttccaatctctgatggaatgatggaaagggctttgcatgggagcaaatttcttttgccgccaaaatttcaaaaccatctgactgacatgaaattagggataggtgattctgcatctagtctgtcacattttagtacattggaccgacctagtttgcaaaatgatcacttcgtacctcttccatcttggagttatgataaaaacagatcaaaatttcctgaaggtgcttctgctgaaacatctgatagaccaggaacttccagtgtactgactgaaagaccatttctgcttaattcttttggaaccagtaccttgggttctttaggcttgaattgctcaggcagcattgatgcgcatcaaaaggaggatgaccaaggaagctccaagcgtggaaagttgcccgtactacttgatggatcatccaatgatgtgcgtcataatcccattaatgtaggaaatggtgagtctactagctctggattgttatctaaccccactagacctgatcttttgcactcaaaaggagaggaagtgggtggaagcagtactttgaaagacaagcttccccactggttacgagaagctgtgagctccccagccaaacttcctgatcctgaacttccacccacagtatcagccattgctcaatcagttcgcctgttatacggggaagataagcctacaattcccccgtttgtgattcctggaccacctccctccctaccaaaggaccccaggtctagtgtcaaaaagaaaaagaagagaagatcacacaagatcagtcggagtcttccagattttgcgggaaatcagcggggatttgcacagcagccaccattggcaagctcgtcacactcttcaaaaaaagcaagttcgggactgtctccatctcctgaagtgctccagttggttgcatcatgtgttgctcctggcccccatcttccatcgatcgccggtgcttcaaactttctcgacagcaagcttccattgccaaggcctgttggcagagccaaattcaaagactcagaaggtgccttcagaaataagaatcctagacagctctcacaaaaaaattggtgttcacctcaagaacaagaagtacatgaccttgatagtggagattccagcaagactcagtcagatccctctcgggttgaacggccctatgaagtggaagtgtcatctgagggaactgtctcagaccatgctgtgagagatcaggaaacataa

SEQ ID NO: 2612 - DNA, 930 bp, Glycine Max
atgaaagatgattcttgtgcttcagtaaatgatcatcacccaaaacttgcgaaatccatggatcaaacacctctgccaatttcaacttcaaatttacatctaactcctgtaaatgattcaaatggttgtgttcccgtggaacattttgcaggcaattcttgtcctcagcaacaatcagggttgcaggcttgtgatttaaacaatgatagttcaagcccaaaatctcaaattcctgaatttcagtcatctcatgattcatgcaaagtgattcaactgcaagatgaacaggttgtattaaatggactctgcaagccagaaagctccactgatccatcaatttctgttcatggaatagacttaccaatcacaaccttggcacctatgattaatgaagttaccaccagagaggctacacctgactcgtccaagtcattatcagttttctctgaactacctgaaacacacgaatgttctcagagcttgtctcaactgcaagttgtagaacaacttagagttcccgctgttggtttgaaaaaaggaattttaaaaagaaatccaagaggatgcagaggggtttgtgcatgtttgaactgtgcttcttttcggcttcatgcagaaagagcatttgagttttctaaaaatcaattgttagatgcggaagaggttgctcataatcttatgaaggaactatctcatctaagaaatatgttagaaagttctgctgatagtgtcaacaataatcccgtttttggtggaagccaggtgaaagaagcttgcaggaaagcatgtgcagctgaagaacttgcaaagaaccgtcttagtcagatgcacgatgatcttaatattcattgcagaataacgagcttgcagccaccaacggttacgtttgcggttcatgttgaaaaagaagtcattcaacctggcggataa

SEQ ID NO: 2613 - DNA, 1380 bp, Glycine Max; identical to SEQ ID NO: 175

SEQ ID NO: 2614 - DNA, 1200 bp, Glycine Max; identical to SEQ ID NO: 176

SEQ ID NO: 2615 - DNA, 336 bp, Glycine Max; identical to SEQ ID NO: 177

SEQ ID NO: 2616 - DNA, 1020 bp, Glycine Max; identical to SEQ ID NO: 178

SEQ ID NO: 2617 - DNA, 1404 bp, Glycine Max; identical to SEQ ID NO: 179

SEQ ID NO: 2618 - DNA, 1452 bp, Glycine Max; identical to SEQ ID NO: 180

SEQ ID NO: 2619 - DNA, 477 bp, Glycine Max
atgaacaaaggtgcagccggaggattagggggcggcgctggcgccggaagcgggcccactgcggctgcggcggcggcggcggcgcagaagcggaagactctggtgcaaagagtcgaaggcgatatcgccaacatcgtcgacaatttcagccaccttgtcaacgttgcaagggtaaatgatccactagttagaaattcacaggaagcttttatgatggagatgcgtgctgctaggatggtccaggcagctgattctctattgaagttggtgtcagagcttaagcaaactgcaatattttcaggatttgcctctcttaatgatcatgtagaacaaagaaggattgaatttaatcagctggcagaaaaaacagatcacacattatccagagtaggggaggaagctgctgctagcctaaaagaacttgaatctcattattcttcttctgcactgaagactatgcaaaacctgcagccatag

SEQ ID NO: 2620 - DNA, 234 bp, Glycine Max
atgaacaacacaatgacatgcttaaggtcaggctgtctattccctacaagcctaaatcctgagattcttgaaggtatccttggatcagttggtggagttatggcttttgtaactcttcatcagatgctgccactggcttttaagtacgcgggacaaaaacaatttgttaagatcatattttgtggaacgactttcatgtctgcaagtacaacgctacaaggtcttaacatttag

SEQ ID NO: 2621 - DNA, 201 bp, Glycine Max
atgaacaagataggtatgtatgtactatatatactaccactatccaacaagaagaaagagacactggatggagatgtaagagttgagagacagcttgccatgttttgcttcaattttaaaaggaatgggacaaagggtaccaagggagttccagagaaagtggtgaggatattttgggatattgaggaagaaagatattga

SEQ ID NO: 2622 - DNA, 681 bp, Glycine Max
atgaacacaagagcgggagctaactcagaatcccagccacagccatcaagacgacaacagcacctccactacgccagctccccaacgacgtcgtctcattcttcatgctgctgctgcctcttcctcctcttctccttcttcgctctcttagtcctcgccgcgcttctcgtaatcgtgctcgccatcaagcccaaaagcccgcacctggacctccgccaagtgggcctccagtacatggccctcgtgcccaacccaactcgcccaggcccatcgaccgcgaagctctacctcgtgatccggttggtgctggcggtggtgaacccgaacgaggtggggatcaggtgcggcgagtccagagtcacggtcgtgtaccgggacacacccttgggcaggacctccctgcccgcgttctgccagcgcgctcacaccgtgaaggaggtggtggccaccatggcagtggatgacgttaacttgtccaacgccgatggtgctgacttcgccagagacgcgttgctcaatgacagggtcgagctgagggtgttggcccatgtcgccaccaagattcgcctcttcaacctaccatctcctccacttcaggctaaggcattgctgactttgattcttatgctctcaacttgcttggactcctcgctgaatgccttggacatgccctcaacttga

SEQ ID NO: 2623 - DNA, 648 bp, Glycine Max; identical to SEQ ID NO: 181

SEQ ID NO: 2624 - DNA, 1314 bp, Glycine Max
atgaaccagttagttgaaagctcaatgaatactcaaagggtctctagagttcaagctccactggttgactctgtttcttgctactgtaaagtagattcaggcctgaaaacagttgttggggcaaggaaatttgttccaggatcgaagttatgtatccaacctgacataaacccaaatgcacataggagcaaaaactcacgtagagagaggaccagagttcagcctcctctcttgcctggtcttccggatgatcttgctattgcatgtttgattcgtgtacctcgggttgagcatggtaaactgcgtttggtttgcaagagatggtatcacctcctatctggaaatttcttctattcactcaggagaagtcttggaatggcagaagaatgggtttatgtcatcaaaagagaccgtgatggaagaatttcattgcatgcttttgatcccatctaccaactgtggcaatcccttcctcctgttcctggggaatattctgaagcattgggatttggctgtgcggttctcagtggttgccacctgtacttatttggtggaagagatccactgaagggatctatgagacgtgttattttctacaatgcccgtactaataagtggcatagagcaccagatatgctgcggaaacgtcatctgtttggttcttgtgtaataaataactgtctctatgttgctggtggggagtgtgaaggaattcaaagaactcttcgatctgctgaagtttatgaccccaaccggaacaggtggagttttatctcagagatgaccacagcaatggtgccctttattggtgttgttcataacggaacatggtttttgaaaggacttggatctaatcgaaatgtcatatgtgaatcctattcccaggaaactgatacctggaccccagtgagtaatggaatggtcaatggttggcgtaatcctagtatctcgctgaacggacaactctatgcacttgattgccaggatgggtgcaagctcaaagtatatgacagagcatcagattcatggaagaagttcattgatagcaaactccatttaggtagatcccgtgctcttgacgctgctgctcttgttccccttaatggaaagctttgcattatacgcaacaatatgagcatcagtctagttgatgtttcgagtccaaacagacgcgtggagagcaatcctcaactttgggaaaatattgctgggaaaggtcatgtcaggtctttagttagaaatttatggtcaactatagcgggacgtggtagtttgaagagtcatattgttcactgtcaggttcttcaagcctga

SEQ ID NO: 2625 - DNA, 597 bp, Glycine Max; identical to SEQ ID NO: 182

SEQ ID NO: 2626 - DNA, 1113 bp, Glycine Max; identical to SEQ ID NO: 183

SEQ ID NO: 2627 - DNA, 2253 bp, Glycine Max; identical to SEQ ID NO: 184

SEQ ID NO: 2628 - DNA, 852 bp, Glycine Max
atgaacgacctgcacgaaatgatgccttactctcagatctttcaaaacaaccgaaactacgccgtttggccgccgtacccgccggaaaacgcggcggtgttccctcaccctacggcgttcaatccgcatccgggtcgggtaactggaaacaaaaggaaagacttttaccgaaccggttcgggtccgccggtgatccgctccggcgcgaaaggttgccggattaaccacccgaagcgaattctcggccgcggcggtgccgccaatcggctcacgccgccgttcgctccgcgcaacacaacgtcgttcataatccggacgaagaattgtggcggcatggtgtcgccgccgactcctgaggcggcgacatcatccccggcgatcctgccggcggcgtctctgtctccggcgacgttcgacgagaaggctgcgaaggagcagtggggattcaacggctacggctccatgaagggccttattcggctccggccaggaaattgtgattccggcgccggcaggttcgaaatggtgtaccctaattccggtgaagaacataaaaacttggacaaaagggttgctgaacaagatacccatattgcacagcttgaagagcagaatttgacgctgaaggagagacttttgttcatggaaagacaattggatgacatgagaaggagggttcagttcttggagacctacggaacgaccagccgcggtggtgagggcggggcggagaatttccccgcagccggagatgtttgctcagtaaagagctatataaacaattctggtgttgacggtgataataataatgttgatgaaaataataattgggaagatattttgcagtggtag

SEQ ID NO: 2629 - DNA, 781 bp, Glycine Max
atgaacgggaaagcctccatctccaaggagctcaatgccaagcacgccaagatattagaaggacttcttaagctgcctgagaacagggaatgcgcagactgccggaacaaggcaccacgatgggcaagtgtgaacctagggattttcatttgcatgcaatgttcaggaattcaccgaagtcttggagttcatatatcaaaggtgcggtctacaactttagatacatggttgccagatcaagtttctttcatgcaattaatgggtaatgagaagtcaaataagcactgggaggaaaaaattccaccaaattttgatagaagtaaattgggaattgagaagtttatccgtgacaagtatgtggagaaaagatgggcttcaaaagaagaactgcaatcaacttcaaggacaggggctaggagtggtattctgaagaacaacaggagactttctcttgaagaaactactaaccctgggcacatgtgtagccactccaaaataacgacgatgataagcgatatcgagtataaatcacgagtaattgacagtattaacgttctatgtttaaagggagttaagattacttcttctcaaagaatagggggtttcttgaagggtttgaaagtcatacgagaaaaactcaagaattcacctccattaaaaaggccatcctcatcagttgattttgacaagtccacaggaaagagcaatggcactggtgacattttcaacttgctttgcatctatgatgataaccagaacttctcaaccatgcctccttcaa

SEQ ID NO: 2630 - DNA, 816 bp, Glycine Max
atgaacttgcagatgggaaaggttggagagaagcttgatatcgactttgtagtttccactggagacaacttctatgacaatggactaactagtgaccatgacaacgcgtttcaagagtcattcactcaaatttacacagcaaaaagcttgcaaaagcagtggtacagcgtgttaggcaaccacgactataggggtgatgcagaggcccaattgagcccggtccttagagaaattgatagcagatggctttgcttaaggtcctttattgtagattcagagctggttgagattttctttgtagacaccactccttttgttgaagagtacttcactgaaccacaggaacacaagtatgattggcggggcattggcccacaaaaaccttatattactaacttactcaaggacctagaattggcactgagggaatcaacagcaaaatggaagattgttgttggtcatcatgccattagaagtgttgggcatcatggtgatactcaagaacttataaatcagcttctccctatccttcaggcaaataacattgacttctacatgaacgggcatgatcattgtcttgagcacattagtgacacggagagccccattcagttcctgactagcggggcagggtcaaaggcttggagaggagacattaaaggaatgaaccgaagagacgtaaatttcttctatgatggacaaggcttcatgtctgtgaaattgactcagacggatgccaccattgagttctatgatgtttttggcaacgttttacacagattgacttcttcaaaacagctacattcttctatgtaa

SEQ ID NO: 2631 - DNA, 3096 bp, Glycine Max
atgaagaacattcttaagaagcttcatatcatgtccaatcaatcagaagatgcccaaggggctacttcatcaaagagcaacaagtccagtagtgatggttcatcttcatccactgccccaaagaagctttccaattggttgcattcagtttctaataggcagagtcccagtcctccatctcccaacctggctagaggagaaataatggacccgtctgattcagtgagcagtggtggtttggatgttgtgtctgattcagcgaggcgtgattcggagtctagcacgtcgagggatcctgaagtggaggaggagtatcagatacaactggctttggagctgagtgcaaaagaggatcccgaggctgtacagattgaagctgttaagcagatcagtttgggatcctgtgaccctgataatacgccagctgaagttgtggcctaccgttactggaattacaatgctcttggttatgatgacaaaatctcagatggtttctatgatctgtatgggatcttgaccgaggcaacctctgcaagaatgccttctcttgtagatctgcaaggaacaccgacctcagatgatgtcacatgggaagcagtcttggtcaatagggctgctgattcaaatttgttgaaacttgaacaagaagccatggagatggccgtcaattcaagaaaagattttgaagtagttttagatagtgatttggtacacaagcttgcaatagtagtggctgaatatatgggtggatcagttgaagatcacgaaagtatgttaagagcatggaggagtcttagttacagtctaaaagcaaccctcggtagcatggttttgccacttggttcactgaccattggattggctcggcatcgtgcattgttattcaaggttttagctgacactttgggcatcccgtgtcgattggtgaaaggactgcagtatatgggttccaacgatgtggcaatgaactttgtcaagattgaggatggaagggagtacattgttgacctaatggcagctcctggaacacttattccatctgatgctactggatcacacattgagtgtgacgattcttcctttgtagccagtccttcatcaagagagcttgattctcatgtagcatcgttcagcagtggggttggaagttcatctgaagaagcttctgactctggtactctggataaagataataaatcaaagtattttggctatgcaaggaaagaatccaatgtaagcggggctgctacgggcaaggaagaattgaagagaccatcaaatgaatccaataataccccctatgaggagaagatcatactgcaagaatcccctatcagatctaattatccatatatgcatggaagatctccttcttggactgaagggatcagttcccctgccgtgcgtagaatgaaagtcaaagatgtttcccaatatatgattgatgctgctaaggagaaccctaacttggctcaaaaacttcatgatattttgcttgaaagtggtgttgttgcacctccaaacttattttctgaaatttatcatgggcagttaagtaccccaaccgaggccaattttccaactgaacaaaaagatgaaaataaacaaggaagtgtgcagcaagaaactaagactgatgacaatctagttcctgctcgatttttgcctcctttgcctcaccaccgagttcaccgcaaagtaactcctagcagtagcagtcagctggagcattctaagcctgttgagggcttaggaattggccttcctcttgattcaggggaagctgctggacagcacatatcatcacaggtagaagcaactcaggtaaagtatgggaaaaatatgccagttgcggcagctgcagctgcagctgctgctgttgttgcatcttctatggtagttgctgtaacaaagtcgaacgctgactcgaatcttgagattcctgtagcagcagctgctactgctactgctgcagctgttgtagcaaccactgctgctgtaagtaagcagtatgagcagggaagttggagtggtggtgatacagagggtgctggttgtgagccgaagtgtagtggtgatggagagcataatgctttaggagaaaacacagaaggcgagagaaaatctgatcgatcagtaagtaatgacagcacaaagtctgattcagcgctagatgatgttgctgagtatgatattccgtgggatgaaattgcggtgggagagcgtattggacttgaaaaactcaattgcaactatgtagcttgtatttggcatgcaggatcatatggggaagtttaccgtggtgaatggcatggaactgaagttgctgtaaaaaagcttctatatcaagatatctctggtgaattacttgaagaattcaaaagtgaggtccaaataatgaaaagactgaggcatccaaatgttgttctcttcatgggagctgtaactcgacctccaaatctttcaattgtttctgaatttcttcctagagggagtttgtatagattaattcaccgacctaacaatcaattagatgagcgaaggaggttgcagatggcccttgatgctgctcgaggaatgaactatctgcacaactgcactccagtgatagtgcatcgtgatttgaagtccccaaatcttcttgttgacaaaaactgggtagtaaaggtatgtgattttggcttatcacgaatgaagcatagtacattcctttcttccagatcaacggcaggaacagctgagtggatggctccagaagtgttgagaaatgaactttcagatgaaaagtgtgacgtttttagctatggggtcatactatgggagctctctactttgcagcaaccctggggaggaatgaatccgatgcaagtagtgggtgctgttggtttccaacatcgccgccttgacattccagataatgtagaccctgccattgcagatattatcagacaatgctggcagactgatccaaagttgaggcccacgtttactgaaatcatggctgctttaaagccattgcagaagccaattactgcttctcaagtgcatagactaagtgttcagtcatcacgagttgctgaagaccccgcaggatag

SEQ ID NO: 2632 - DNA, 981 bp, Glycine Max
atgaagaatgttttagtaaggtcagctgcgcgagctctgcttggcggcggtgggcggagctactaccgccagctctcaacggcggcgatcgtggaacagagacaccagcacggtggcggcgcgtttggaagcttccacttgcggaggatgtccactcttccagaggtaaaggatcagcactcagaggagaaaaagaacgaggtcaacgacaccagtaacgccgtcgttacgagttactggggaatcacaaggcccaaggttcgtagggaggacgggacagagtggccgtggaactgcttcatgccatgggatagttaccactctgatgtgtcaatagacgtgaccaagcatcatacaccaaagtcattaacggacaaggttgcttttagggctgtcaagtttctaagggttctctctgatatctacttcaaggaacggtatgggtgccatgctatgatgctggaaacaatagcagcagttccaggaatggtgggagggatgctgctgcacttaaagtctctgaggaagttccagcacagtggtggatggatcaaggcactgctcgaggaagcggagaatgagaggatgcacctgatgaccatggtggagcttgtgaagcccagctggcacgagaggctgttgattttcaccgcgcagggtgttttcttcaacgccttcttcgtgttctacctcctctcgccaaaggcggcacatagatttgttggttacttggaggaagaagctgtgatttcatacactcagcatttgaatgccattgagagtggtaaagttgaaaatgtccctgcccctgccattgctattgactactggaggcttcccaaggatgcaactctcaaggatgttgtcactgtgattcgcgctgatgaggctcatcacagggatgttaaccactttgcttctgatattcatcatcaagggaaggaattaaaagaggctccagctcctattggttatcactga

SEQ ID NO: 2633 - DNA, 1056 bp, Glycine Max
atgaagaattgcgatgaatggaaacctttcctagtaatgatagcaatagatttttctttaaccatggtgaacattcttctcaagaaagtccttcaagaaggaatgaaccatttggtttttatcacatatcgtctctcagttgctactatatttctggcccccatcggctactttaaggaaagaaatggaagaccacagctcacatttcaaattttatgctgccttttcttcagtgccattattggggcatccgtcacacaatacttcttccttctggggatccaatacacctcagccacctttgcttgtgcctttgttaatatggtcccggtgatcacattcattatggcattaccatttggattagaaactgtgaacattaaatgcaaaggtgggaaagcgaagattcttggtacatttgtgtgcataggaggggcattgttgttgacactttacaaaggaaaacccttgtttgatgggtctcactatcaatctgcaatggaccaagcttcttctactactagatcaacacagaaatggaccatcggtgtaatagctttgattatgggaacccttttttggtctttttggtttattttacagtcaaagatagggaagagatatccttgccagtattcaagcacagccatcatgaccttctttggagccatgcaagcagctattcttggtttctccactggcagcagcaacttgtcctcgtgggttctcaaggataagatacaaataatcaccgttctttattctgggatagttgggtcaagtgtgtgctatgtgggcatgtcatggtgcgtaaagaagaggggtccggtctttactgctgcattcagccctcttgttcagataatgtcgggcatgattgatatccccttcttgcacgagcagcttcatcttggaagtgtggtgggatccatgttggtgatgatcgggttgtacattcttctgtggggcaaaagcaaggatatgatgcagaataatggcgccactaagttcgcccaagaagttgaagaaaccaaggaacaggagccgcaagtataa

SEQ ID NO: 2634 - DNA, 1209 bp, Glycine Max
atgaagacacccaagcattgctttccctgcacgacactttccagaagtagtgcaaatggacttggcctaaaagcaaccaggggcacagattattgccaaaccacaataaatttccccagtgacaccatccccaaatggaaagatcccaaaaccggtgaacttgaagctctgtcttttgattttaatctatgtgaagctgtggctacatgggaacaagtgcgaaacagtaccactatacttaccaaggaattcattgattctttaccaaatggatgggaggaatatgcatggcgtaggatcaataaaggaatacagctcaaccgctgtgagaacaagaccttgtgcatggagaaactttcactggttctccctgaaacaccaccatacttcccaagacagtttggacgctgtgctgttattggtaactcgggagatctcttgaaaacaaaatttggaaatgagatagatggttatgaagttgtcattagagaaaatggtgctccaacacagaactacactgattacgtgggtaggaaaagcacatttcgccttctaaaccgaggatccgccaaagcactggataaagttgtagagttagatgaacaaagaaaagaagtcttgataataaaaacaacaattcatgacatcatgaacaaaatgattcgggaggttcctataaaaaatcctgtgtacctcatgctaggtgcatcctttggctcagcagcaaaaggaactggacttaaagctcttgaatttgctctctctatgtgtgattcagtggatatgtatggtttcactgtagatcctggttataaagaatggacaagatatttctctgaatcccgtcaaggccataccccgttgcatggtagagcttattaccaaatgatggagtgcttggggcttatcaaaattcattctcccatgcgagctgatctaaatcgtgttgtaaaatgggttccaagccgccatattataagatctgctagaattgcatcagagaaattactgaggagagttggagcaggatctgaagatccactggctgcatgttccataattaagaagcaagtaaaaagaaatctaaatgcagtttcaaagctcagaaaggcagcacttgatcatttacggtatgtgaaaagaacaaccatgtatcctctagagcatagtcctggacatgggtcgctttgcactgtgccaactgattaa

SEQ ID NO: 2635 - DNA, 1113 bp, Glycine Max
atgaagacggagatgatgactaatgttacagagtatgaggcaattgcaaaggaaaaattgccaaagatggtttatgactattatgcatcaggggcagaggatcagtggactttgaaagaaaatcgaaatgcattctcaaggattctgtttcggccgcgtattcttgttgatgtgagcaagatagacttgactgcaactgtattgggcttcaaaatatcaatgcctatcatgattgctccaacagccatgcaaaagatggctcaccctgaaggagaattagctactgctagagcagcatcagcagctggcacaatcatgacactatcctcatgggctacttccagtgttgaggaggttgcttcaacaggtcctgacattcgtttttttcaactttatgtgtttaaagacagaaatgtggttgctcagcttgtgagaagagctgaaagagctggtttcaaggcaattgcccttactgtcgactctccaattcttggtcgtagggaggctgacatcaaaaacagatttacattgccaccaaacctggttttgaagaatttggaaggattggatcttggaaagctggacaagactagtgactccagtcttgcctcatatgttgctgaacaaattgatcagtcactcaactggaaggatatcaaatggcttcaatcaatcacttcattgccaattgtagttaagggtgtacttactgctgaagatactaggatagccatacaagctggagctgctggaatcattgtttccaatcacggagctcgtcaacttgactatgtccctgcaactattatggccttggaagaggtagttaaagctgcacaaggaaaaattccagtttttctggatggtggaattcgccgagggacagatgtttttaaagcactagctcttggagcagctggtgtatttattggtagacctgtggtgttctcattggctgctgatggtgagactggtgtgagaaaagtacttcaaatgcttcgtgatgaatttgaactaacaatggcactaagtggttgccgttcgctcaaggagataactcgtgaccatgttatcacagagtgggatcacccaagattttctcccaagttataa

SEQ ID NO: 2636 - DNA, 2055 bp, Glycine Max
atgaagagaacgaaaagtgatcctcccaactcgaggaggtttagattgtctcattttttgtttggcattggggtgttgtacttgttgtttgtgtcatgtaagtttccacagtttttgagaattgtatcaacgttaagtggggatgggagtgaagataggttggagggggcagctgttggggactctgaagattcagatttgagtaaatcttttgtgagttctgtttataaagatgcatttcacaggagattggaagataatagggaccaggagggtgcccccttgagaccaaacacggagccaaagaaggaggaagagcgtcttccggaatctccgaagcagattccactgcgatatggtaggataactgggaagataatgcgggaatataagaggaccaatgatttgtctgtgcttgagaggatggcggatgaggcgtggatattgggattgaaggcttggaaggaagtagataaggttgatgagaagggttcgatgaaaaactcggtccttgatggaaagcccgagtcatgcccttcttgggtgtcaatgaatggggatgagttgattaaaggagatagtttgatgtttcttccctgtgggcttgcagctggttcttcaatcactgtggtggggacaccccatcatgctcataaggagtatgttccccagcttgccaagatgaagagaggtggagggttggttttagtttcacaattcatggttgaattgcaagggctgaagtcagtggatggggaggatcctccgaagattcttcacttgaatcctcgaataaggggggattggagcagacagccagtaattgagcataatacctgttacagaatgcactggggaacctctcaaagatgtgatggtctaccgtctggggatgaagaagaaatgcttgttgatggatacagacggtgtgagaaatggttgcggaatgatattatagattctaaagagtccaagacgacatcctggtttaagcggtttatagggcgtgagcaaaagccagaaatgacctggccatttcctttagttgagggcagaatgtttgtccttacattgcgtgctggtgttgatggataccatattaatattgggggccgccatgtaacttcatttccatatcggactgggtttacacttgaggatgctacaggattggcaattaaaggggatgtggatgttcattcaatttatgctacttctcttcctacttcccatccaagtttctcacctcaaagagtactggaaatgtcagagacctggaaagcctcacctttacctaaacatcctattaaactttttattggagttctttcagcttcaaatcactttgcagaacgtatggcagttagaaagacatggatgcaatcagctgcaatcaagtcttcagatgtagtagcacggttctttgttgcactgaatccaagggcggaagtaaatgcagtgctgaagaaggaggctgcttactttggtgatattgtcattttgccctttatggaccgctatgagcttgttgtgcttaaaactgtgggcattagtgagtttgggattcagaatgtgactgctgcatatgttatgaaatgtgatgatgatacatttattagggttgatactgtcttggaagaaattgagaaggtaccccagggaaaatccctttatatgggcaatctcaatcttcggcatcggcctctgaggaatggcaaatgggcagtcacttatgaggaatggccagaagaagtatatcctccttatgcaaatgggcctgcatatgtaatttctagtgatattgttactttcatccgatctcaacacaaggataggaaactaaggctgtttaaaatggaggatgtaagcatgggaatgtgggttgagcgatataacaataccattgcagcagtccagtactcccacaattggaagttttgtcagtatggatgcatggagggctacttcactgcacattaccaatcaccaaggcagatgatctgtctttgggacaaattgtcaagaggtcgagctcgttgctgcaacttcagatga

SEQ ID NO: 2637 - DNA, 1569 bp, Glycine Max
atgaagagaacgaaaagtgatcctcccaactcgaggaggtttagattgtctcattttttgtttggcattggggtgttgtacttgttgtttgtgtcatgtaagtttccacagtttttgagaattgtatcaacgttaagtggggatgggagtgaagataggttggagggggcagctgttggggactctgaagattcagatttgagtaaatcttttgtgagttctgtttataaagatgcatttcacaggagattggaagataatagggaccaggagggtgcccccttgagaccaaacacggagccaaagaaggaggaagagcgtcttccggaatctccgaagcagattccactgcgatatggtaggataactgggaagataatgcgggaatataagaggaccaatgatttgtctgtgcttgagaggatggcggatgaggcgtggatattgggattgaaggcttggaaggaagtagataaggttgatgagaagggttcgatgaaaaactcggtccttgatggaaagcccgagtcatgcccttcttgggtgtcaatgaatggggatgagttgattaaaggagatagtttgatgtttcttccctgtgggcttgcagctggttcttcaatcactgtggtggggacaccccatcatgctcataaggagtatgttccccagcttgccaagatgaagagaggtggagggttggttttagtttcacaattcatggttgaattgcaagggctgaagtcagtggatggggaggatcctccgaagattcttcacttgaatcctcgaataaggggggattggagcagacagccagtaattgagcataatacctgttacagaatgcactggggaacctctcaaagatgtgatggtctaccgtctggggatgaagaagaaatgcttgttgatggatacagacggtgtgagaaatggttgcggaatgatattatagattctaaagagtccaagacgacatcctggtttaagcggtttatagggcgtgagcaaaagccagaaatgacctggccatttcctttagttgagggcagaatgtttgtccttacattgcgtgctggtgttgatggataccatattaatattgggggccgccatgtaacttcatttccatatcggactgggtttacacttgaggatgctacaggattggcaattaaaggggatgtggatgttcattcaatttatgctacttctcttcctacttcccatccaagtttctcacctcaaagagtactggaaatgtcagagacctggaaagcctcacctttacctaaacatcctattaaactttttattggagttctttcagcttcaaatcactttgcagaacgtatggcagttagaaagacatggatgcaatcagctgcaatcaagtcttcagatgtagtagcacggttctttgttgcactgaatccaagggcggaagtaaatgcagtgctgaagaaggaggctgcttactttggtgatattgtcattttgccctttatggaccgctatgagcttgttgtgcttaaaactgtgggcattagtgagtttgggggttga

SEQ ID NO: 2638 - DNA, 939 bp, Glycine Max; identical to SEQ ID NO: 185

SEQ ID NO: 2639 - DNA, 981 bp, Glycine Max
atgaagagagaggtgactcaccctcagaccctccctgacgaattgatccatgaaattctattgcgtttcaaaagtgtgcataaatcatggctttctctcatatctgaacccgggtttgctaaatcccactttgatctagccgcggcacccaccaccgacttcttctcaagtgcttcaatattgatcctgaagttgataattcttatgttgatatggtctctaacattccacttccattatctgctatgggaagcatgcatgaacacggacaacaatgatttctttgattttgtcataaccggtcagcgtatacaaagacaaactaatcatgtgtctgatgactacgtcgtggcgattctacaattgtcactagatcaagatttgccgtcatatcccaaggtcgattttttttcttcgagaaccaattcatggagtcgcatcgagggaacccttccttgttatttttcagggcaaaaaaatgtcaggcataagttcgtgcacaagttcatgcacatgttcttgaatggagctcttcattggatgattgaatcttataatgatcttggtctaattattgagtttgatgtgagggaaaggagattatcagatattccactgtcacgctatttaaccattgaatgggaatataaattacatcatttgactgtgatggaaggacttgtgtgtttgtgtctctctgactatatggatgatctcggcactactgaaatatggacgatgaaagaatacaaagtacaagaatcttggaccaagttatttgttcttcctaataatagttatcattgtttgcctttgtttgtcctaatacgtttcatcaaaactggagggtcttcagctttgtgcacgtggacaaacacatttttctctaactttgtgtccttgtataactgttttgtcatctattgcacacataatcaaaaaccaaacgtgattacaagaaattggaaggattcatattga

SEQ ID NO: 2640 - DNA, 285 bp, Glycine Max; identical to SEQ ID NO: 186

SEQ ID NO: 2641 - DNA, 546 bp, Glycine Max
atgaagaggagagtgatgatgatatcaggaggaggaggtggtggagggaaatcatcgtggagttcatcaacatcgtcatgggtacccacaacctcagtgtcggcatctggaaagaggattcagagggaaatggttgaactcaacaacgaccctcctcctgattgctctgctggccccaagggcgataacctctatcactggattgccaccattattggaaccccagaaacaccctaccaaggtggcatctttttccttgacatcaaatttccaattgattatcccttcaagcctcccgaggtagtattcaaaacacgcatttaccactgcaatgtagaccctgatggccgtgttagtatgggaatattgaaggatgattggagtccagcactaacaattactaaggtgctactagaagttagatcaattatgacaaatcctgatccttataatgctgttgtccctggcatcgctcatttgtattcgggagacagagcaaaacatgatgatattgctgcagagtggactgtccgatttgccaagtga

SEQ ID NO: 2642 - DNA, 501 bp, Glycine Max
atgaagaggagagtgatgatgatatcaggaggaggaggtggtggagggaaatcatcgtggagttcatcaacatcgtcatgggtacccacaacctcagtgtcggcatctggaaagaggattcagagggaaatggttgaactcaacaacgaccctcctcctgattgctctgctggccccaagggcgataacctctatcactggattgccaccattattggaaccccagaaacaccctaccaaggtggcatctttttccttgacatcaaatttccaattgattatcccttcaagcctcccgaggtagtattcaaaacacgcatttaccactgcaatgtagaccctgatggccgtgttagtatgggaatattgaaggatgattggagtccagcactaacaattactaaggtgctactagaagttagatcaattatgacaaatcctgatccttcagtagaggcaaaccttattatgtgcttgttttggaatagaagcatgttttaa

SEQ ID NO: 2643 - DNA, 1554 bp, Glycine Max
atgaagagggaacgcgagcagcttggttccatcgcagggacctcaagctgcggttattcaagcggaaaatcgaatctttgggaggaagaaggaggcatggacgagcttcttgcggtggtgggttacaaggttaggtcatcggacatggcggaagtggcgcagaagcttgagcgtctcgaagaagccatgggaaatgtccaagatgacctcccggagatttcaaacgacgtcgttcattacaacccttccgacatctccaactggctcgaaaccatgctttctaattttgaccctctcccctccgaagagccggaaaaggactccgcctcgtcggactacgatcttaaggctattccggggaaagcaatttatggagctagcgacgcgctaccaaaccctaagcgcgtgaaagccgacgagtcaaggcgcgcggtggtggtcgttgactcgcaggagaacgggatccgcctcgtgcacagcctcatggcgtgcgcggaggccgtggagaacaacaacctcgccgtggcggaggcgctggtgaagcagatcggcttcctcgctgtgtcgcaggttggagctatgaggaaagtcgcaatctacttcgccgaagcgctcgcgaggcgaatctacagagtcttccctctgcaacactctctctccgattctcttcagattcacttctacgaaacctgtccatacctcaagttcgcacacttcaccgcgaaccaggttatcctcgaagcgttccaaggaaagaaccgcgttcacgtgattgatttcggtatcaaccaggggatgcagtggccggcgctgatgcaagccctagcggttcgcaccggcggtcctccggttttccgactcaccggaatcgggccgccggcggcggacaactccgaccacctccaggaggtagggtggaagctcgcgcagctggcggaggagatcaacgtgcagttcgagtaccgtggcttcgtcgcgaacagcctcgccgatctcgacgcctccatgctcgatctccgggaaggcgaagccgtcgctgtgaactctgtcttcgagtttcacaagctcctcgcccgccccggcgcggtggagaaagtactctccgtcgtacggcagattcggccggagattgtcaccgtcgtcgagcaagaagcgaaccacaacagactgagttttgtcgaccggttcacggagtcactgcactattattcaaccctattcgactcgctggagggttcgcctgtgaaccctaacgataaggccatgtcggaggtttacttagggaagcaaatctgcaacgtggtggcgtgcgagggaatggaccgcgtggaaaggcacgagacgctgaaccagtggcggaaccggttcgtttcgaccggattttcttcggttcacttgggttcgaacgcgtacaagcaggccagcatgttgctcgcgctttttgcgggtggggatgggtatagggtggaagagaacaatggttgtctcatgttgggatggcacactaggcccttgattgccacctccgcgtggcaactcgctgcaactcgctga

SEQ ID NO: 2644 - DNA, 1113 bp, Glycine Max
atgaagatggagatgataactaatgttaccgagtatgaggcaattgcaaaggaaaaattgccaaagatggtttatgactactatgcatcaggggcagaggatcagtggactttgaaggagaaccgaaatgcattctcaaggattctgttccggccgcgtattcttgttgatgtgagcaagatagacttgactgcaactgtattgggcttcaaaatatcaatgcctatcatgattgctccaacagccatgcaaaagatggctcaccctgaaggagaattagctactgctagagcagcatcagcagctggcacaatcatgacactatcctcatgggctacttccagtgttgaggaggttgcttcaacaggtcctgacattcgtttttttcaactttatgtgtttaaagacagaaatgtggttgctcagcttgtgagaagagctgaaagagctggtttcaaggcaattgcccttactgtcgacactccaattcttggtcgtagggaggctgacatcaaaaacagatttacattgccaccaaacctggttttgaagaattttgaaggattggatcttggaaagctggacaagactagtgactccggtcttgcctcttatgttgctggacaaattgatcggtcactcaactggaaggatatcaaatggcttcaatcaatcacttcattgccaattttagttaagggtgtccttactgctgaagatacaaggttagccatacaagctggagctgctggaatcattgtttccaatcacggagctcgtcaacttgactatgtccctgcaactattatggctttggaagaggtagttaaagctgcacaaggaaaaattccagtttttctggatggtggaattcgccgagggacagatgtttttaaagcactagctcttggagcagctggtgtattcattggtaggcctgtggtgttctcattggctgctgatggtgagactggtgtgagaaaagtacttcaaatgcttcgtgatgaatttgaactaacaatggcactaagtggttgccgttcgctcaaggagataactcgtgaccatgttgtcacagagtgggatcacccaagattttctcccaagttataa

SEQ ID NO: 2645 - DNA, 1113 bp, Glycine Max; identical to SEQ ID NO: 2644

SEQ ID NO: 2646 - DNA, 279 bp, Glycine Max
atgaagatggatatgataactaatgttaccgagtatgaggcaattgcaaaggaaaatttgccaaagatggtttatgacttctatgcatcaggggcagaggatcagtggactttgaaagagaaccgaaatgcattctcaaggattctattccggctgcgtattcttgttgatttaagcaagatagacttgactacaactgtattgggcttcaaaatatcaatgcctatcatgattgctccaacagccaagcaaaagatggctcaccctgaaggtatgtga

SEQ ID NO: 2647 - DNA, 1338 bp, Glycine Max
atgaagattgtttggaaaaaagggtttgttcggttggttcttgtagcagggatcttgtggatgttattaattcttcttgcattattgttccatatatggtcttgtcaaacttccgtctcctttttatcagctatgtgtaacaaagatagcaaggttttcaacatgttagacaatatgggacttgtatcaaaacctcacagatgtccaattcctctttccaatgaccctgataaaatagttatcccaactggaagaactcccaacgaaactgtcaaaaatctgtcatatgttatggaagatgaggttccacatagtgaagctcagtcatctcctctatttggaggccatccaagttggaaacaaagggaggaaagttttaaactaaagtcaaatatgaaggtgcattgtggattcatccaaggtggtggtgctgaaatgaatcgtgtagacatcaaatatgtcaagaaatgcaaatttgttgttgcatctggaatttttgatggctatgatttacctcatcaaccatcaaatataagccttcgctcaaaggagcttttttgcttccttatggttgtggatgaggtatctctaaaattcatgagggaaaatggtacggtcaaagaagacagagctggtggaaaatgggtgggaatatggagacttgttcttcttaagcatcctccttatgatgaaccaagaaggaatgggaaggttcccaaaattttaacccacaggttgttccctcaagcacagtatagcatttggattgatggtaaaatggagctgatagtagatccattgctaatccttgagagatacctgtggcgaggcaagcatacgtttgccattgctcaacacaagcatcaccgtaagcgaaagcgatatgctcgaccccttattgatctccacatgaaaatctattattatgagggaatgaagccatggagctcaaataaaaagaccaatagtgatgtaccagagggagccgtcatcattcgggaacacactgccataaataacttatttagctgcttgtggttcaatgaggttcacctcttcactcccagagatcaactgagttttggctatgttgcatacagattgggggacgcgttcaaattcttcatgtttctcaactgtgaatacaattcactgtttgtgttgcaccctcacacaagagagcactcttctcccatagaatgggttaaacagttggatgaacttaagaaaggcaatttaaaagaaagtaggggaggactaggcttgtttaccccttatcctggggatcttgattctgttgttctgccaaatgtaacaagaacatcaaaagcaggctga

SEQ ID NO: 2648 - DNA, 846 bp, Glycine Max; identical to SEQ ID NO: 187

SEQ ID NO: 2649 - DNA, 1752 bp, Glycine Max
atgaagcaccgagacaccgttacatggaattccatgattactgggtacgtgcatcggagagagatcgccagggcgcgccaactgttcgacgaaatgccccgaagggatgttgtgtcttggaacctcattgtttcgggttacttttcgtgtcgcggaagcaggtttgtggaggaaggaagaaggctgtttgagctgatgccccagagagattgtgtctcttggaacacggtcatcagtgggtatgctaagaatggaaggatggaccaggctttgaagctctttaacgccatgccagagcgtaatgctgtgtcctccaacgctctgatcactgggttcttgctgaatggtgatgtggattcagctgttgattttttcaggacgatgcctgagcattattcaacctcactcagtgctcttatatcggggcttgttaggaatggtgaattggatatggctgctgggattctgtgtgaatgtgggaatggggatgatgatttggtgcatgcttataacaccctgattgcgggttatggccaaagagggcacgtggaagaggctcggcgcctttttgatgggattccagatgatcgcggtgatggtgatgaaggtcaaaggagattcaggcgaaatgtggtctcttggaattcgatgatgatgtgctatgtgaaagcgggagatatagtttcagccagggaactctttgataggatggtggagcaggatacgtgttcttggaacactatgatcagtggctatgttcaaatctccaacatggaagaggcttcaaagcttttcagggaaatgccaattcctgatgtactttcatggaatttgatagtatctgggtttgcacagaagggtgacttgaatcttgcaaaagatttctttgagaggatgccactcaaaaacctgatctcatggaactcgataatagctggctacgagaaaaatgaagactataagggggctattcagctattttctcgcatgcaatttgagggagagaggccagatagacacacattatcttcagttatgagtgtgtgtactgggttagtgaatctttaccttggtaagcagatacatcagcttgtcacaaagattgtcattccagattcaccaataaataattccctaattaccatgtactcgagatgtggggcaatagttgatgcatgcactgtatttaatgagataaagctttataaagatgtgatcacttggaatgcaatgattggaggctatgcatctcatggcttagctgcagaggccctagagcttttcaaactgatgaaaaggcttaaaattcatcctacctatataacctttatttcggttatgaatgcatgcgcccacgcaggattagttgaagaaggaaggaggcaattcaaatccatgattaatgactatggtattgagcgacgggttgagcactttgcctcccttgtggacatcttgggacggcaagggcagcttcaggaagctatggatttgataaataccatgccatttaaaccagataaggctgtgtggggtgcactactaagtgcttgtagagtgcataataatgtagaattggccctagtagcagctgatgctttgatccgacttgaaccagaaagttcagcaccatatgtgttgttatataatatctatgctaatttaggacaatgggatgatgccgagagtgtgagagtgttgatggaagaaaagaatgtcaagaagcaagcagggtatagttgggtagactga

SEQ ID NO: 2650 - DNA, 507 bp, Glycine Max; identical to SEQ ID NO: 188

SEQ ID NO: 2651 - DNA, 2013 bp, Glycine Max
atgaagcccttctgcagattcttgattcttgtatcgctattttctctggtggaatcttcatgcaacagcagtgaagagcatgacttggtgtccaaggctttcaaatcagtctctggcttcaacgctttctcctcctcgttcccaaccaacaactgttcacaaactcacatcatcaccagcatagtacttccatcccaaaacctcagcggcacaatttcatggaactaccttaggaacatatccaacttgcagattctcgatctctccgggaatttcctacagggccacgtgccaagctggttttggtcgagttcatccttattggcaataaacctctctagaaataggttcggagggagcatccttcaacccacatcagaaaacacctcgttttcatccattcaatccctcaacctctcatacaataggtttaccaactcaatccagctttctggtttcaaaaaccttaaaatcctcgacctttcccacaacaacctcgtaacactcccttccgggtttcaaaacctcagcaacctacaacacatcgacctctcaagctgcaatcttcaaagcaacgtaaaacccatttccgctcttcactcacttcactacttggacttatcaaacaacaccttcacgggtaatttcccttatgatttccctccactcaccaccctcaagttcctcaacatctcgttcaacaacttcacctcagcaattagcgtaaacaagttcagtagattcttcggtaaatcagctttcgtccacgctggcagcaacttcacctacaccaacgacagtaataaaaacacaaaacaagaagccatcatcgaaaagaaacaaaagaagcgaaagtccaaaacgctgattggtgcagcgtcgtctgcggcatcagcaattgtcctaattctcttgggcatatgggcagtccgcattgtgattcagaagaggaagcaacgtgccaagaagaacaagtgggcgatttcgatgccggtcccacaagggatgatgatgatgatgaaatcagggccgttcgagttcgagacagaatcggggtcaacgtgggtggctgacctgaaggaagcgtcttcggcggcggtggtgatgttcgagaagccgttgatgaatctgagcttcaaggacctcattgttgcaacgtcacacttcgggaaggagtcgcttctagcggagggaaggtgtgggccagtgtatagggcagtgctacccggggacctccacgtggcaatcaaggtcctggaagaggccagagacgttgatcctgatgactccgtggccaccttcgttgacctctcgagactcaagcatcccaacctgctgcccctctccggttactgcattgcaggtaaggagaaactggtgctgtacgagtacatggcaaacggcgacctaggaaggtggctacacgagcttccgactggagacaccaacgtggaggactggacaggcgacacgtgggagattcaaaacggcgtcgtcgacgacggatccccagaaaagatgggatggctcacacgacaccgtatcgcggtgggcatagcgcgtggcctcgcgtaccttcaccacgcgcgttccaagcccgtggtgcacggccacctcgtcacctccaacatcctcctcgccgacgacttcgagccccgcatcgccgatttcgggttgcgacccgacccggatccgaatttcggcacggagaccgacgtctactgcttcggggcggctctggtggagctcctgacggggaaggggagcacggcggaggcggtggcagcggcacggaaggcgatgagggaggggcacggcgttagggttttggacgagaggctccgactcgggggtgactcggtggtactgagtcagatggtggagactctccgagtcgcgtttttgtgtactgctgaatgcccttcgaagaggcccacaatgcaacaggttttgggtttgctcaaagacattcgtcctcatcaccaacaccaacaccaactcgtcctgagttga

SEQ ID NO: 2652 - DNA, 1002 bp, Glycine Max
atgaagctcactgcactgaattctacggttcgccgcgctctgctcaatggccggaaccaaaacggtaaccgcctcggttcagcggcgctgatgccgtatgcggcggcggaaacgaggctcctctgcgccggaggcgcgaacggatggttcttctactggaagaggacgatggtttcgccggcggaggcgaagctgccggagaaggagaaggagaaggagaaggccaaggccgagaagagcgtggtggagtccagttattgggggatttcgaggccgaaggttgtgagagaggacggaacggagtggccttggaactgcttcatgccgtgggagagttatcgttcaaacgtgtccatagatcttactaagcatcatgtgccaaagaatgttctggataaagttgcttacaggacagtgaagctcctgagaattccaacagatttgttttttaagagacggtatggttgccgtgcaatgatgctggaaacagttgcagctgtccctggcatggtaggagggatgctgttgcacctcaggtcactccgtaagtttcagcaaagtggtggttggatcaaagcattgctggaggaagcagagaatgagagaatgcacctaatgactatggtggaacttgtgaagcctaaatggtacgaaagactgctggttcttgctgtacagggagttttcttcaatgcgtttttcgtgctttacatactctccccgaaggtagctcatagaatagttgggtatcttgaggaggaggctatacattcttacactgagtacttgaaggatcttgaaagtggtgcaattgaaaatgttcctgcccctgccattgcaatagactattggaggcttcccaaggatgccagattgaaagatgttataacagtcattcgtgctgatgaggctcaccatcgagatgtgaaccattttgcttctgatatccactttcaaggtaaagaactacgggaagcaccggctcctattggttatcactag

SEQ ID NO: 2653 - DNA, 1491 bp, Glycine Max
atgaagcttaaaacatggcttgcgagtgttctgttgctcactgttgccatgcttaccgctacattaggtgcattcgtgggggtaaacattggcactgatgtttctgatctgccatctgcttcaaatatagttgacattctacaagctaatcaaattactcatgtgcgtctttatgatgctaacgcgcacttactacaagccctttcaaacactagtattgaagtaattgttggtgtcaccaatgaggaggtactgaggattggagaatctccatcagcagctgcaacctggattaataaaaatgttgttgcttatgttccctccaccaatatcacaggaatagcagttggtagtgaggttctttccactatcccaaatgtcgcccctgttctggttcctgccatgaattctcttcacaaagccctggttgctgcaaaccttaacttccgggtcaaagtttcaactccccagtctatggacattatccctaagccttttcctccttccactgccacctttaactcttcatggaactctactatctatcaactccttcagtttctgaagaatacaaattcctcctacatgttaaatgcctacccttattatggatatactaaaggagatggtattttccctattgaatatgctcttttccgacctcttccttccgtgaagcaaattgttgacccgaacactctatttcattataacagtatgtttgatgctatggtggatgctacctactactctatagaagccttaaatttcaataatatacccattgttgtcacagagactggctggccatcatttggtggagctaatgaaccagatgctactgaagaaaatgccgagctttacattaataatatgattcagcgggtcatgaatgattcaggtcctcctagtcagccaaacatagccattaatacatacatatatgaattgtttaatgaagacaagaggaatgggcctgtatcagaaaaaaattggggcatcttttataccaatggaagtactgtttatccattgagttttggtgcttctgaccagattactggaaattcttcaggagtattttgtgtggctaaagatggagcagacactgataagctgcaatctggcctgagctgggcatgtggacaaggaggagcaaattgtgctgcaattcaaccggggcagccatgctatctccccaataatgtgaaaagccatgcatcttatgcttataatgattattatcagagaaagcatagtagtggtggaacttgcgactttgatggtaccgctacaattactaccaaggatcctagttcttcatcctgtatatttgccggaagttctaactcgagcactggtggattgagtttacctccaacggctcttggaccttcaggcccctttggtgcgagtatgaacctgcaagtgtctagccttaagtatttgatatctgctgttggtgtatttttggctctggcggtgttatga

SEQ ID NO: 2654 - DNA, 1728 bp, Glycine Max
atgaaggactcaaactccagcagtagcagcaacagaaccgaacccattgcccaaaacatcatcaaactcattagcaacctctgcttctccctcttcgtcttctctgtcttaatcttcaccgtcatagccataacctaccagcccccagacccatggctccagtccaccccagccctaaccaacctcttcacccaatcagaaaacgccactttccgaatcgactcctccgtcctcagaaccggcgaagacctctccccctccccgcaagaccctcccctcccgccaccgcccccctccgaacccctcatcgatataacccaacagcaaatcgccaattccaccgttaattccaccgccgactctaccgcttactccaccgacgcgcagcctccctctctccctgcctgcgatgaaaccctaaactgctctaaccctcgcgttcttattgccgttcagagattcaacctccgcgcgttcaagtccattgccttcttcgactaccagccgccgatgaacggctccgtccccggcgagtgcgacgtcgcatggcgcttccggaacaagcgcgagcgctcctggcgcaagtaccgcgactttcgccgcttcaagatcgccgtcaccgacgactgcaggtacaaggtggtccacgctggcggttggcactccggcgccaatgctcgccggaatgtgacgcgaaccggcgccggcaggggtggtaagtccctgccgccgcgggcttcggcccgcgacgatgagatcaatgacacgattccgactttgggatcggatactaactttaggaatgggaagtatttgtactactcgagaggtggggattactgcaagggaatgaatcattatttgtggagtttcttgtgtggattgggggaagctatgtttttgaacaggacttttgttatggatttgagtgtttgtttggcttcaacttataaccctagtaacaaggatgaggaagggaaggatttcaggtactactttgatttcgagcatttgaaggagacggcttctattgtggaggagggtgagttcttgagggattggaagaagtgggataaaacgcatttgaagaagaagaaggttcctgttaggaaggttgtcaatcacaaggtgactcctatgcagcttaagaaggataagagtacgattatatggaggcagtttgatgcgccagagcctgagaattattggtatagggtttgtgaaggtgaggctgctcagtatgttcagaggccttggcatgctgtgtggaaatccaagaggttgatgaatattgttactgagattagtggaaggttggactgggattttgatgcggtccatgtggttcggggagagaaagctcagaacaaggagctgtggcctcatttggattatgatacgtcaccagatgttcttgttgagaagctcaaatggatggttcagccttggaggcatttgtatattgccaccaatgagccttattataattactttgataagttgaggtcaaattacaaggtgcatttgcttgatgattataaggagctgtggggaaatacaagcgagtggtataacgagaccacgcttctcaacagtggaaagcctgttgagtttgatgggtacatgagagttgcagtggatacagaggtcttttaccgtggaaagacacgcgtggaaacgttctataatttgactaaagattgcaaggatggagttaatacatgctga

SEQ ID NO: 2655 - DNA, 1143 bp, Glycine Max
atgaaggagttatctcagacccagagtgttgttgtccatgggattgctggtgctggttcagtggctttagccactgccttcacttatcctctcgacagcatcaaagtcctcattcaggttggttccagcaccggtaaagaattggaccctgcccaggctttgacgagactactctctgtgtccggcaatgcaggtttgtttaatggttttggctggttgttggctggaaggatttttggtctgggagcacgatttggggtttacgaaatcctgactgccttttataaagatggtcgggaaaataattatttgtttgcttctgaggctcttttggctggcgtggtagctggtgccgttgaggcagtcataagctctccattcgaactcatcaagcttcgtatgcaagttactgctgcttcatatgttccaagctccaactttgctttggaaaagggggctcgttcacctttaattgcaagattacttcatggccgttatccagacaagagggcattggacctatatgttggtctcatctccatcctaaaaaccaaaaatacaaacgtgaccagtgccttgctagagtatccatggacaatgacaggatctgggaggccaccatcagtttccaatgtcaggagaccatctgacattatatctttggaaggatggaggacattttggagaggactccgtcctggaattgtccgagattctgtgtttagcggcatatttttttcgacctggcaatttctgcaccaagcaatgctagattggaaggctgtagggatggatcctccacccaggttaaatgaagaagtcggtccattgtctcctttgattgttagtcttactgctggattctcagcttcagttgctgctactgcttcacatagttttgatactacaagaagtagatcacaatgtactgtgctgccgaagtacatctccatggagagaaagattctgaagtggaaacgaccaggaaccaagtttgaaagaattactggcatccatccttctgacagaggtgtcttgttccgtggtattggttggcgaatggctcgctctgggctggcatcattcattattgtaggaagttatttatttgttgctgatcagcttggttctagtttgacttaa

SEQ ID NO: 2656 - DNA, 312 bp, Glycine Max; identical to SEQ ID NO: 189

SEQ ID NO: 2657 - DNA, 1776 bp, Glycine Max
atgaagggtggcacggttcagattagctggcacgacggcaaacccgtcttaaccctcgatttccaccctcactccgccactctcgccaccgccggcgccgatttcgacatcaagttttggcaaataaaaccagcggggtcaccgaagaagcttcccgtggtttcctatcttagtaacctctcttaccatagctctgcagttaatgttattcgcttctcttcttccggggaattgctagcctctggtgctgatggaggggacttgataatttggaagctgcattctactgatgctggccagacatggaaggttctcaagatgttacgatctcaccacaaggacattttggacctgcagtggtctactgatgccacgtatatcatttctggatcagttgataattgttgcattatatgggatgttaacaaaggaactaaccttcagacgttggatacccatgcacactatgttcagggggttgcatgggaccctctagggaaatatgttacttctcttagttctgataggacttgccgaatttacatgaataagcctcataaatcaaagggcattgagaaaatcaattatgtttgtcagcaagtcatttccaaggcagatcagccattatttaagaattctaaggagacaaaatttcatctcttccatgatgagacgttgccatctttcttcaggagattagcatggtctcctgatggttcatttctacttgtgcccgcaggctcttacaaaattagtactgcatctgaatctgtgaatgcggcttacatattttctagaaaagatctttctaggcctgctatacaacttccctgtgcaagcaaagctgttgtagctgtccgattctgccccatattttttaaacttcggggaacaaattcagctgggttatttaaattcccatatcgcatcatatttgctgttgccactttgaattcattgtacatttatgacactgagagcacctctccgatagctgtattagctggccttcactatgccgcaataacagatattacctggtcatctgatgctcattatttggcattgtcctcacaagatggtttctgctctttggtggaatttgaaaatgacgaacttggatcaccttactctttatcagaaggaaaagtctcaaacaaggatggtaggagcactgtacagacaaccaatgacactgtaactgtaccaactgggaatgttagtgcagttctagcagagagcaagaaaatggaatcagaagacacggctgatgacgtggtcattgaagcctctggcaatattggtgctgttgtaacagaaagtgggaaaactgtaacacaagagaaggctggcatgatccagtcaactgggaatttagcagattttaggaaaaatgaagcagcagggaaagctgtttacatggtcattgaggcaacaggggatgttggaggggttatagcagatagtaggaaaaatgaagcagaagagaaaactgatgacatggtcattgaaacaactggaagtattgatgcagctgaattagatagaagaaaagctgagccagaagataaggcagagaaacagccagctaatctagattcagatggtaaacaagcggaagcaaaggagaagacaaagactctgcaatcaagtttagacggtataaaatcaggggcagaagaaaaggcagggccacaattgttcaatccgaagagtacacccatatcaaataagccagccaagaagcgtattactcctactgccattgatccatga

SEQ ID NO: 2658 - DNA, 1833 bp, Glycine Max
atgaagtatgtgttggtgactggtggtgttgtgagtggacttgggaaaggagtcactgccagtagtattgggttaatcctcaaggcctgtggtcttagagttacctctatcaagattgacccctatttgaacactgatgcgggaacaatgtctccttttgagcatggagaggttttcgtcttggatgatggtggtgaggttgaccttgatcttggaaactatgagcgtttcttggatatcaaattaactcgtgacaataatattacgactggaaaaatatatcagtctgttattgagaaggagagaagaggagattatcttggaaagactgtacaggttgttccacacataacagatgctatccaagagtggatagaacgtgtagcaaagataccagttgatgggaaagaagggccagctgatgtttgtgtcattgaattgggtggaactataggggatattgagtccatgccttttattgaagcacttggccaattttcataccgtgtaggccctggcaacttctgtttggttcatgtcagcctggttcctattctccatgttgttggtgaaccgaaaacaaagccaactcagcacagtgttcgtcaacttagaggattaggtttgacccctaatcttcttgcttgtcgcagttctaaggaacttgatgacaatgtcaaggcaaagcttggtcaattttgtcatgtgccgctgtcaaacatacttactctccatgacgttccaaatatttggcacattcctttgctattgaaagaccagaaggcacatgaggcgatcctgaaagcattaaacttgctaggtgttgctgcagagcctaatttgaaggagtggactgcaagaacaaaagtttatgacagatgtcatgaaattgttagaattgcaatggtgggaaaatacactggcctttcagatgcatatctttctgttctgaaggcacttttacatgcttctgttgctcgaaaccgtaaacttattgtggactgggttccagctggggatcttgaagaagctacttataatgaggatcctgaggcgcataaagctgcttggagtcttttaaagggtgctaatggggttctagttccaggaggttttggtgatagaggagtgcaagggaaaattcttgctgctaagtatgctcgagaacataatgttccatttcttggcatttgcctggggatgcaaattgctgttattgagtttgcacgatctgttctcggtctgcatgatgctactagcacagaattcaatcctgaaaccaagaccccttgtgtcatatttatgccagaaggctccaagactcatatgggaggaactatgcgtcttggttcaagaagaacttactttgaagttgctgactgcaaatctgcaaaattgtatggcaatgctagctttgttgatgagcgacatcggcatagatatgaggttaatcctgacatgatatcacagctagagaatgctggtctatctttcgttgggaaagatgaaactgggaggcgcatggaaatagttgaattgcctagccatcctttttttattggcgttcagtttcaccctgagttcaagtctagaccagggaaaccttctccactcttctcaggattaatagcagcagcaagtgaacaaaggagtacaatcatggtgccaagtagtaatggtcatgccaagttaactaacggaaatggaatgtacaatggacactcgccgaaacttaaagcacaccaaaagggaaatggcttcaaggcatccaatggttccttaaatggtatatataccaatggaaatggggtgtatgtggatggtagttgttag

SEQ ID NO: 2659 - DNA, 1311 bp, Glycine Max
atgaagtcatacaaattgtcagagctgagtgatgctgagcttcgcagcctcatcgctcgccctcgcattgatttctcttcggttttcgctctggtcaaccctatcgttgaccacgttcgcgaaagaggcgatgctgctgtcaaagaatacacattgagattcgacaaagctgaattggataacatcgttgaacttgtctccgaccttcctgatccacaactcgatgcgcatgttaaggaagcttttgatgtcgcctacaacaatatatatgcctttcatgctgctcagaagacacccgagagaaatgttgaaaatatgaaaggagtccaatgcaagcgagttgcaagaagtattaattctgttggtctttatgttccagggggaactgctgtattaccctcaacagctctgatgctttcagttcctgcacagattgctggatgtaaaactattgtccttgcaactcctccagctcaggatggtactatatgcaaggaggtagtgtattgtgcaaagaagggtggggtgactcacatccttagagctggaggagctcaggccatatctgccatggcttggggaacagaaacttgtcccaaggttgagaaaatttttggcccaggaaaccaatatgtcacagctgcaaaaatgatactacaaaacagtgaagccatggtttcaattgacatgccagctggtccatctgaagttttagtcattgccgacaagcatgcgattcctcgtcatgtagctgctgatttgctttcccaggctgagcatggtcctgatagtcaggttgtgcttgtgatttctggtgaaggtgtggatctgaatgttatagaagaggaactcaacaagcagtgccagagtctcccaagaggagagtttgctgctaaggccctaagccacagttttattgtttatgcacatgatatgcttgagtcaatcaagttctcaaacttatatgcacccgaacatctaattgtcaacacgaatgatgcagagaagtgggagggttttattgagaatgcaggttctgtatttttagggccgtggacaccagagagcgttggtgattatgcaagtgggacaaatcatgttcttcccacttatggttatgcaaggatgtatggtggtgtttcattggattctttcttgaagttcataactgtgcaatctctcacagaagaaggcctaagaaaactcgggccatatgtcgttaccatggcagaagttgaaggtcttgatgcccacaagctagcagttaccctaaggcttgaggacatagaagtcaggcaggtatcaacatga

SEQ ID NO: 2660 - DNA, 1593 bp, Glycine Max
atgaagtctctgaggtccatcttagcaacttttgtggttctattatcaatttcactcactatctcacttccaattgaagaagctttcaaccattgtctaacacaacactctcagactccaaaccaatttccctcatcaatctacacttacaccaatggttccttcacttcaatccttgagtccacagctcaaaatctaaggtacttgttgccctcagtgccaaaacctgatttcatattcaccccactggatgactctcaagtccaagcagcagtggtttgtgcaaaaaagcttggtattcacatgagagtgcgaagtggagggcatgactatgaagggctctcttatgtttccctcattgagaagcctttcatgatcctagacttggccaaacttcgtgcagtgaatgttgatattgcgcgaaacacggcttggatccaagccggtgctactattggtgaagtttactacagaatttcagagaagagtgcagttcatggcttccctgcaggcctttgcacaaccttggggattggagggcacatcacaggaggtgcatatggttccatgatgagaaagtatggtcttggtgctgacaatgttctagatgctagaattgttgatgctaatgggaaggttcttgatagaaaagccatgggggaggatctattttgggctataagaggaggtggaggtggaagctttggcgttattctttggtggaagatcaagctagttcctgtgccacaaaccgtgactgttttcacagtgaccaagaccttagaacaaggagggagcaagcttcttcatagatggcagcaagtggctccacatattgatgagaatctcttcattagagttatcattcaaccagggaatggcactgttcctggtaagagaacagtaacaacttcttacaatgctctctttcttggtggtgctaataggcttctccaagtgatgaagcatggttttcctgagttaggtttgacaagaaaggattgtgtggagactagttggatcgaatctgtgctttatattgctggctaccctgatggaacagccccagaagttttgctccaagggaagtccacaacaaaggcttatttcaaagccaaatcagattttgtgagggaagtaattacagaaaagtccctcaatgcactatggaaaatttttctgcaggatgatggccctctaatgatttggaatccctatggtggaaaaatgagtaggattgcagaatctgccacccctttccctcacagaaagggagttctctacaagattcagcatgtgactggatggcttgatggagagaagagtatggcaaagcacatgaactggatgaggaaattttatttctacatggctccctatgtttctaagtatccaagggaaacttatgtgaattatagagacttggatatagggatgaaccagaagaataacacaagtttattgaaggcttcgtcatggggctataggtatttcaagggtaacttcaataggttagtgaaggtgaaaactaaagttgatccatctaatttctttaggcatgagcagatagaaggcaagaagagaagaagctag

SEQ ID NO: 2661 - DNA, 1725 bp, Glycine Max
atgaagtggagtcacggtactgacactgatgtattctgtttaagttccattaaggaatccttggaagacccgcatgattacttttccagttggaagttcaacgacgtaaacatatgtgtatttgttggtgttgaatgctggcaacatggggagaataaagtgctaaatctcaacctcacaaacatgggtctgaagggtgagtttccacgaggccttaggggttgctcttcgttggtaggcttagacctttcacacaacgagctcacaggacccatcccatctgatatatccacattactcccttatgctacttccattgacctctcaaataacaagtttaatggggaaattccaccaagtttggctaactgcagttacctgaattctcttagacttgataacaacatgttaagcggtcatatcccacaagaacttgggcagcttcaaaggattagaaacatttcttttgccaacaataatttatcagggccgttgcctttgttccgggatggcgtgactagtgctgaagcttatgcgaataatacccaactttgtggagggcctttgccaccctgctcaagcgatgatttccctcaatcattcaaggatggccttgttgttggctatgctttttcgctgacttcttcaattttcctttatataaacaacaaccactggaataaggttaaagaaatcggcaaatatatttgttccatctcagggaggaagacaccttctgaagctgaccccacacaccaatttcaagctctgcagttgcaggataaagctatgaaagagatctctctagtaatggaaagaatgaagtccacgatgagtttgaccgaaatcaaagatgcaacagactgcttttcattagaaaatgccattgggatggggaaaattggaataatgtatgagggaaggctaactgatggttcgaaccttgccattaagaggctttttggttctaaacaatttaagaaggaatttcttttggaaataagaattctgggtaagtacaaacacaaaaatatagttcccctgcttggattctgtgtagaaagaaatgagaggattctggtataccaacacatgccaaatggaaggctttcaaaatggttgcatcctttagaaagtgaagttacaagattgaattggcctcagaggatcaaaatagctcttggggtagcaagaggcttatcctggctccattatacctgcaatttgcatgttgtgcatcgtaatataagttcggagtgtgtcttgctagacaagaattttgaacccaaaatatccaattttggaaaggccaagtttatgaatcccaacattgaggatggtgcaagcacgatattttatgcaagtgatgggaagaaggatgtctatgattttggtagtttgatttttgagctaatcacagggaaaacatttaacgagttgtcgcgttcatcatacaatgctactaacctgtctggcaacccatcgaatttttatgatgcaattgaggaatctctcattggggaaggttttgaaaatgaggtctacactctcatcaaagttgcatgtaagtgtgttaagcctttcccagatgaaagaccaacgatgcttgaagtttataactatatgatcgatatatggggagagcgacatagaataagtgatggttctgacacactcaacgtatctagttcttctactagtgtagatgaaattgttgagctataa

SEQ ID NO: 2662 - DNA, 1053 bp, Glycine Max; identical to SEQ ID NO: 190

SEQ ID NO: 2663 - DNA, 420 bp, Glycine Max; identical to SEQ ID NO: 191

SEQ ID NO: 2664 - DNA, 156 bp, Glycine Max
atgaagttatgcccaagatttttacattttgagctgtattctaatgatatggacatgttattattgacagtaaattttggtttatattcattttggattaaccttgagagttcccagttcaacagtcttgcttttttaattaaggtggagttgtga

SEQ ID NO: 2665 - DNA, 351 bp, Glycine Max; identical to SEQ ID NO: 192

SEQ ID NO: 2666 - DNA, 417 bp, Glycine Max
atgaagtttctgcccccacacactcttagaccaacccaaatcattcacatccaaaagcattcaaaatccagaagcatattttcaaggacttttctcaaaccattatcttcgcaagtctctaagacagccattacagcaatgggtttccgtttacctggtatcagaaagggaatatttgcagccaaccaagcatcatcaaaaacggtggatgcaccaaagggctaccttgcagtttatgttggagagaaaatgaagcgatttgtgatccctgtgtcatacttgaaccaaccttcatttcaagacttgttgagtcgagctgaggaagagtttggatatgatcatcccatgggcggcctcacaattccttgcagcgaagatgtcttccaacatataacttcttgtttgaatggacaataa

SEQ ID NO: 2667 - DNA, 2400 bp, Glycine Max
atgaagtttttttcagcaatagagtttctaagttcatttcttgtgctgatgttcttctaccctttttgccactcactcgacaacaccataaccataaaccaccccattagagacggcgacgttttggtctccaacggtttaggaaactttgcgctcggtttcttcagcccgcgaaactccacaaaccgttacgttgggatttggtacaacaaaatctcggaacaaacggttgtgtgggttgccaacagagacactcctcttaacgacacttccggtgttctcaaaataagcaacaacggaaaccttgtactccacgacaacagcacccgaagcctcaacccggtttggtcctccaacgtttccattgaatccacaaataacatttcagccaagcttttggatacaggaaacctagttttgatccaaaccaacaacaacaacattctatggcagagttttgattatcccgggaacactatgcttccgttcatgaaactcgggttgaaccggaaaaccggcctggaccggttcctagtatcttggaaatctccaaacgacccgggaactgggaacatgacttataagatcgacccaaccgggtttccgcaattgtttctctacaaagacaaaatccctttatggagggtcgggtcgtggacgggtcagagatggagcggggtgcccgagatgacaccgaatttcatcttcaccgttaactacgtcaacaacgagagcgaggtctccataatgtatggagtgaaagaccccagcgttttctcgagaatggtgctggacgagagcggccatgtggcaaggtccacgtggcaggctcatgaacataggtggtttcaaatatgggatgcgccgaaggaggagtgcgacaacttccgacggtgcgggtcgaacgcgaactgcgatccataccacgcggacaagttcgagtgtgagtgtttgcccggcttcgaaccgaaattcgaaagggaatggttccttagagacgggtcgggtgggtgcgtgaggaagagtaatgtgtccacgtgtcggagcggggaggggtttgtggaggtgacacgtgtgaaggtacccgacacgtcgaaggcgcgcgtggcagcaacgattgggatgagagagtgcaaagagagatgcttgagggattgttcgtgtgtggcttacacgagtgccaacgagagctctggaagtgggtgtgttacttggcatggaaatatggaagacactaggacttacatgcaagtgggacaaagtttgttcgtgcgagtcgacaagcttgagcaagaaggggatggtagcagaataagaagggatcgcaagtattcctttcgtcttaccttcgacgactcaaccgatctacaagaatttgacactacaaaaaattcagatttaccattctttgaacttagctccatagctgctgcaacagacaatttctctgatgctaacaagcttggccaaggaggttttggttctgtttataagggtctattgattaatggaatggagatagcagtgaagagactgtcaaagtactctggacaaggcatagaagagtttaaaaatgaggttgttttgatctcaaagctccaacacagaaatcttgtgaggatcctaggttgctgcattcaaggagaggagaagatgctaatctatgagtatttgccaaacaaaagtttggactccttaatttttgatgaatcgaaaaggtcgcaactagactggaaaaaacgatttgatatcatctgtggggttgctagagggatgttatacctccatcaagattcgcgattgagaatcattcatcgagacctaaaagccagcaatgtcttgatggactcttcattgaaccccaaaattgcagattttggtatggctagaatatttggtggggaccaaattgcagcaaacacaaaccgcgttgttggaacctatggctatatgtcaccagaatatgccatggaaggacaattttctgtaaagtctgatgtatacagcttcggagttttacttctagagatcgttacaggcagaaagaatagtggtctatatgaagacattaccgccacaaatttagttggacatatatgggatctatggagagaagggaaaaccatggagattgttgatcaatcattaggagagtcatgctctgaccatgaagtccaaagatgcatccaaattggtcttttatgtgtgcaagattatgctgctgacagaccatctatgtcagcagttgttttcatgttgggtaatgactcaactcttcctgatccaaaacaaccagcatttgtttttaagaaaactaattatgagagttcaaatccttcaaccagtgaaggaatttattcagtaaatgatgtaagtataactatgattgaagctcgttga

SEQ ID NO: 2668 - DNA, 142 bp, Glycine Max
atgaataccataagtagtccttttttattccaccgatattgctccatcaatcattgtgacaagcatattaaaacaacgatttcttctcacatgtatctggcaaattccacaaggctatgcactgattcttcacaatctccaa

SEQ ID NO: 2669 - DNA, 1458 bp, Glycine Max; identical to SEQ ID NO: 193

SEQ ID NO: 2670 - DNA, 1458 bp, Glycine Max; identical to SEQ ID NO: 193

SEQ ID NO: 2671 - DNA, 188 bp, Glycine Max
atgaatataacttttgttcaatatgacaatcagtatctgtatagacattacaggtctacatcaacatgccaatacatatttatagaagattggtacatactgtttaatttatacatatgtgtagactctgctaaaaaattattaggaaaaaaaaaggattattgtggaaagagtcatgcatacacctg

SEQ ID NO: 2672 - DNA, 213 bp, Glycine Max; identical to SEQ ID NO: 195

SEQ ID NO: 2673 - DNA, 144 bp, Glycine Max
atgaatgaactatctctaacaactttttcactctccaagactttccaattgaaaaagattctgtgcttctttccaatcttacatgtgtcacagacgccattagaaacattcacaaggcaaaccagaaacgaattatcttcttga

SEQ ID NO: 2674 - DNA, 905 bp, Glycine Max
atgaatgacctattctcaaactcattcaagaaatacagcaacctgaagcagcaggcacacctcgatgacgtagaggccgggaaagaaaccgtgaacctcgacaaattcttcgaggacgtggagaacgtgaaagaagaaatgagaacggtcgagaagctacacagaaaactgcaggaggcgaacgaagagagtaaagtggtgcacaatgcaaaaacaatgaaggagctccgggcgaggatggacaaggacgtggagcaggtccttaagcgcgtgaaagtaatcaaggggaaattagaggccttggagcgttccaacgccgccaacagaaacatccctggctgcggtccgggttcctcggcggacagaaccagaacctcggttgttagtggattggggaagaagctgaaggacatgatggacgatttccaaggtctgagaacaaggatgcagatggagtacaaggagaccgtggagcgaagatattttacgataaccggagagaagcccgataaggagactatagagaacttgatatggagtggggagagtgagagttttctgcagagggcgattcaggagcaggggaagggacaaataatggacacaatttcggagattcaggagcggcacgacgcggtgaaggagattgaaaagaatttgattgagttgcaccaagtgttcttggacatggcggctctggtggagtcgcaggggcagcagctaaataatatagagagccacgtggcgcatgcgagttccttcgtgagacgcggcacggatcagcttcaggatgctagagagtatcagaagagttcgaggaagtggacgtgctatgcaatcattcttggccttgtgcttcttcttgtgctcttgtttccaatcttgattaaccttttgcctcattt

SEQ ID NO: 2675 - DNA, 165 bp, Glycine Max
atgaatgacttcactggcagtgggcaccaacaagaggagcagcattgcagcaatgaaagttcagataggaataagttattgatgaacaaacaaatagttttgatcttttggagaataagaaaaaaatacttcaacaaaatttctgatgcattcatcaatcaataa

SEQ ID NO: 2676 - DNA, 831 bp, Glycine Max; identical to SEQ ID NO: 196

SEQ ID NO: 2677 - DNA, 1782 bp, Glycine Max
atgaatggaagcattggtagagccacttattaccaacctatgcacctgtgggacaaagccactggaactctcacagatttcagtaccaatttctcttttgtcataaactcacgaggtcaaagtgtatatggagatggaattgcattcttccttgcccctgctggttcaatggttcctaattccacattaggaggtactatgggtctgacacttgataaccaaatattgaactccacagacaatccatttgttgctgtggagtttgatatctttgggaatgactgggatccacccggtgaacatgttggaatcgacatcaactctttgagatctgttgctaatgccacatggttggctgatatcaagggagggaaagtcaaccaggctttgatcagttacaactccacttcattaaatttaagcgttgcgttcacaggttttaaaaatggtaccgctctgctacatcatctatctgtcatagttgatctgaaactttatttaccagaatttgttactgttggcttctcagctgccacgggaaatttaactgctatacatactctcaattcatgggattttaactcaacctccattatagctcccagtcagaagaaaaaggacaagaaagccttggcagtgggattgggagttggtggatttgttttgattgctgggttggggttgatttcaattcgcttgtggaagaaaacaagtgaagaggaggatcatgattttgaagagtatatagatgaggattttgaaaggggggcaggaccccagaagtattcatatgctgaattagcacaagcagctaacggtttcaaagatgagcacaagctaggacagggaggatttggaggtgtttataagggttaccttaaagacctaaagtctcatgtagccattaagaaggtatcagaaggctctgatcaagggataaaggagtttgcatcagaagtaagaattattagccggttaaggcatcgaaatcttgtgaacttgattggttggtgtcatgcagggaaaaagctcttgcttgtgtatgagtacatgtcaaatggaagcttggatattcatcttttcaagaagcaaagcattttgcaatgggcggtgaggtataacatagctcgaggattggcctcagcattgctatatttgcacgaagaatgggaacaatgtgtagtgcatagagacataaagccaagcaacattatgctggattcagagtttaacgccaaacttggggattttggtttagcaaggtttgtggaccatgcaaaaagtgcacaaactacagctttagctgggactatgggctacatggctcctgaatgtactttgggctacaggccggctagtaaggaatcagatgtctacagttttggagttgttgctttagagatagcttgtggaagaaaacccataaaccatagggctcaagaaaatgaaataagtattgtgcagtgggtgtggggactctatggagaagggagaattcttgaagcagcagatcaaagactagaagggaaatttgaggaggagcaaataaaatgcttgatgattgttggtctttggtgtgctcaccctgaccatagtaatagaccttcaataaggcaagcaattcaagtgcttaactttgaagctcccttgcctaatcttccatcaagtttgcctgttccaacatatcttgagcacccactgcactcatccatattaccattcagcataaatgcctcagaggaagccagattttgtcatctgtatattttttttttcatgtaa

SEQ ID NO: 2678 - DNA, 1122 bp, Glycine Max
atgaatggcattgggaaactcaaatcgtcgagttctgaattggaccttcacattgaagattacctaccttctggatccagtgttcaacaagaacggcatggcaagctccgactgtgtgatttgctagacatttctcctagtctatctgaggcagcacgtgccattgtagatgatacattcacaaggtgcttcaagtcaaatcctccagaaccttggaactggaatgtttatttgtttcctttgtggtgctgtggagttgtggttcgatatttgattttgttccctattaggattctagtgttggcattaggatggattatatttctttcagccttcattccagtgcactccctcctgaaaggaaatgatgatttgaggaaaaagattgagaggtgtttggtggagatgatgtgcagtttctttgttgcatcatggactggggttgtcaagtaccatgggccaagacctagtatccgaccaaaacaggtttttgtggccaatcatacttccatgattgatttcattatcttagaacagatgactgcatttgctgttattatgcagaagcatcctggatgggttggattattgcagagcaccattttggagagtgtggggtgtatctggttcaatcgtacagaggcaaaggatcgagaaattgtggcaaggaaattgagggatcatgtcctgggagctaacaataaccctcttctcatatttcctgaaggaacttgtgtaaataatcactactctgtcatgttcaagaagggtgcatttgaacttggctgcacaatttgcccagttgcaatcaagtacaataaaattttcgtcgatgctttttggaatagtcgaaagcaatcattcaccactcatctcttgcaattaatgacatcttgggctgtagtttgtgatgtttggtacttggagccacaaaatttgaagccaggagagacacccattgaatttgcagagagagttagagacataatctcacatcgtgctgggcttaaaaaggttccttgggatggatatctgaagtattctcgccctagtcccaagcacagagaaggaaagcaacaaatattcgctgagtctgtgttgcggcgctttgaggaaaaataa

SEQ ID NO: 2679 - DNA, 1122 bp, Glycine Max; identical to SEQ ID NO: 2678

SEQ ID NO: 2680 - DNA, 978 bp, Glycine Max
atgaatggcattgggaaactcaaatcgtcgagttctgaattggaccttcacattgaagattacctaccttctggatccagtgttcaacaagaacggcatggcaagctccgactgtgtgatttgctagacatttctcctagtctatctgaggcagcacgtgccattgtagatgatacattcacaaggtgcttcaagtcaaatcctccagaaccttggaactggaatgtttatttgtttcctttgtggtgctgtggagttgtggttcgatatttgattttgttccctattaggattctagtgttggcattaggatggattatatttctttcagccttcattccagtgcactccctcctgaaaggaaatgatgatttgaggaaaaagattgagaggtgtttggtggagatgatgtgcagtttctttgttgcatcatggactggggttgtcaagtaccatgggccaagacctagtatccgaccaaaacaggtttttgtggccaatcatacttccatgattgatttcattatcttagaacagatgactgcatttgctgttattatgcagaagcatcctggatgggttggattattgcagagcaccattttggagagtgtggggtgtatctggttcaatcgtacagaggcaaaggatcgagaaattgtggcaaggaaattgagggatcatgtcctgggagctaacaataaccctcttctcatatttcctgaaggaacttgtgtaaataatcactactctgtcatgttcaagaagggtgcatttgaacttggctgcacaatttgcccagttgcaatcaagtacaataaaattttcgtcgatgctttttggaatagtcgaaagcaatcattcaccactcatctcttgcaattaatgacatcttgggctgtagtttgtgatgtttggtacttggagccacaaaatttgaagccaggagagacacccattgaatttgcagagaggtaa

SEQ ID NO: 2681 - DNA, 276 bp, Glycine Max
atgaatgttgaagaagaggttcagcgtctcagccaagaaatcaagaggcttggtaaggtccaagcagatggttcttacaaggtaacatttggaacactatttaacgatgatgaatgcgcaaatatatttgaagcacttgttggaacactaagagcagcgaaaaagcgtaaagtactgacatacgagggtgagctactgctgcaaggagtccatgataatgtggaaatcactcttaatcctgcccctgctgaagcagccgcagcagctgccaactga

SEQ ID NO: 2682 - DNA, 1071 bp, Glycine Max; identical to SEQ ID NO: 197

SEQ ID NO: 2683 - DNA, 159 bp, Glycine Max
atgaattggattcagcgcaagatctacctttacaatgtgacttttgggctgtatatgttggactggtgggagcgttgtaccttcaatattgtggtgattatattaatgtgtttcgttctacgatacgttactcagttcttcaagaggtatgtttggtaa

SEQ ID NO: 2684 - DNA, 1590 bp, Glycine Max; identical to SEQ ID NO: 198

SEQ ID NO: 2685 - DNA, 921 bp, Glycine Max
atgaatttgatcctaattgagcatccatcaaggactcaagctgaggagaacaatgagcactctcagaaaatcacccttgggttggtgttggatggtgactttccattgctgaaaccaccttcttcacatgatggattaatagtccctgatatcaattcaaatggtcgttccttcagaaattattatggtgaaagcgagaggcataaatctgtgaaggaattctaccgacaacaacacatagggcaaacttatgaatttgctaagaagatgacggaggagtatgggaaattgaatagagtggaaatgagtatacgggaatgttgtgagatccttgataaaattgtggatgccactgaagctgctagaaaggactaccctaatgaagattggttacatttgactgctctcattcatgatcttggaaaggttcttctccttccaagctttggtggacttcctcaatggactgttgagattcgttttctcttggttgtgcttttcaggaagcaaatactcactttaagtacttcgagggcaacccagatggcaaaaatccagcttataatacagaaaaaaaaagggctatatgccacaggattaggactggacaatgtaataatgtcgtggggacatgatgagtacatgtatttggtgaggaaacaccaccactttaccttccgaggcattgttccttatccgataacactcttttcatcgtgcctttataccagacaggagcatacaaaggccatagaggatgttaagaacttcaagtggcaagaaatatttcacaagtatgttctctacagcaagagcaatgtgcgaattgatgttgaaaaagttaagccatattatatgtcgctcattgagaagtattttccccaaagctcaaatggtaaagacaacagaaagtggagatga

SEQ ID NO: 2686 - DNA, 1647 bp, Glycine Max
atgacaaaaaggagaaaaacgaatctatggaaaatcattcagaaaaaccaagctctccccattaattccatattcaagcttcctgcacctataaggactaaaaaacttatttacactgtaatctatggaacaattgatcttggtgggctgcaagtgtgtgaagcatcaacattcaacaaagtttggggcacctatggtggtggacctgatgatcaaggtttctccatttttgagccatcaggagtacctaaaggcttctccatgttgggtagctacagccagcccaacaacaagcctctttctggatatgttcttgtggcaaaagatgtgtccacaaacaccagcaaccctagtctaaagcaaccacttgattacacacttgtgtggaacagtgcatctctggagattgaccaagatggtcccatctatgtttggcttccaatagcaccgaatgggtataaagctgtaggccatgttgtcaccacaacaccaactaagccttcacttgaaaaaatcatgtgtgtcaggttagacctcactgaccagtgtgagacaaattcattcatttgggattcagacaacttcaattttcttgatgtcagaccaagcaatagggggattcaagcacctggtgttagagtaggcacctttgttgcacaaaatgcaagtcttaactctccatctattgcttgtttgagaaacaccaatgccataccaaaatacatgcctaatctaccacaaatcaaggcaattcttcaagtttactctccactctctctcttccactctctagatgaattctttccatcttctgtggagtggtttttctccaatggtgcacttctatataagaaagggcaagagtcaagtcctgtcccaatatcaccaaatggggctaaccttcctcaggatcctaatgatgatggtgcctattgggtggaccttcctgctgattcaaccaacaaagatagggtcaagaaaggagacttgaaaagtgccataagttatgtgcatgtgaagccaatgcttggaggaaccttcactgacatttcaatgtgggtcttctacccattcaatggagcagcaagagccatagttgatttcttaactattgacttggggaagataggtgaacatgttggtgattgggagcatgtgacactaagggtgagcaacttcaatggtgaattaaagcatgtctatttcttacaacacagaaaaggtgcatggtttgattcatctcaattagagttccaaagtgggaacaaaccattgtactattcttccttgcatgcccatgcatcataccctcatgctgcccgtaacatcacggataagataggcataaggaatgacactgctatgagtgacagtgtcatggatttgggggcatttcaattggtttctgctgagtatttggtttccgatgttgtggagcctcctccatggcttaactatttcagggaatggggtcctaagatttattacaatgttgatgaggaattgaagaagcttgagaagtttttgcctgggaagctgaaatctactttggagaatattgtgaagaatttgccaagtgaagtgttgcgacaggaaggaccaacaggtcctaaggtgaaggatagttggagtggagatgaaaggtga

SEQ ID NO: 2687 - DNA, 1737 bp, Glycine Max
atgacaaaactagaaccaacactctttttactactacttttcatgttgtcatgcctaataacagtgaacaatgcacactcaacaacaatcatcaacgtgtggccaaaaccaagaaacctcacgtgggccccaccataccaagccaccctcattgcctccacattcaccatcatcaccaccacaactccccaccacaacaaacacctctccgccgccatcatccgctaccaaaacctcgtaaaatccgagcaccaccacccacttgtccccccaggggtgaacatctccacaaacctcccaccactgaattccctcaccctcactgtccttgatcccggtgcaggactcgtccacgacgtggacgagtcctacaccctctccatccccccttcttcctcctcagccaccctcactgcaaagaccacgtggggagccatgcgaggcctggagacgttctcccagctcgcatggggcaaccccacgtgcgttgcagtgggggtccacttgtgggattccccgctctacgcccaccgtggcatcatgcttgacacttcaaggaactattttccagtgaaggacttgttgaggacagtggaagccatgagcatgaacaagctcaacgtgttccactggcacgtcacggactcgcagtctttcccattggtccttccttcggagcctgctttggctgaaaagggtgcttatgcctctcacatggtgtactcaccagaggatgtgaaaagggttgtggagtttggtcttgatcatggggttcgtgttatgcctgagattgactcacctgggcacactggatcttgggctttagcctaccctgaaattgtagcttgtgccaacatgttctggtggccagcagaaggtgacattcttgctgcagaaccaggaacaggtcatttgaaccctctaaaccccaagacttaccaagtcctaaagaacgtaattcgtgacatgacaacgttgtttccagaaccattttaccactcaggtgctgatgagattgtaccaggttgctggaaaactgatcccacaattcagaagtatctgtcaaatggtggaactctcagccaagttcttgagaagttcatcaacaacactctccctttcatagtgtccctcaaccgaaccgtcgtctattgggaagatgttttgctaagtgaaacagtccatgtgccatccacaattcttcccaaggagcatgtggttttgcagacatggaacaatggacacaacaacaccaaaaggattgtttcctcggggtatcgcaccattgtgtcgtcatcagacttctactatctggattgtggccatggtgactttgtagggaataatagtatctatgatcagcaaaatggggataacaaagacaacggtggctcttggtgtggacctttcaagacatggcaaaccatatacaattatgacatagcatatgggttgagtgaggaagaagcaaagttggttttgggtggggaagtggcactttggacagaacaagctgattctactgttttggatggaagaatttggccaagaacttctgcgttggctgagtcattatggtcaggaaatagggatgaaaagggtatgaagagatatgcagaggccacagatagattgaatgaatggagaagcagaatggtaagtagaggaataggtgctgagcctattcagccactttggtgtgttagaaaccctggcatgtgcaacacagttcaataa

SEQ ID NO: 2688 - DNA, 739 bp, Glycine Max; identical to SEQ ID NO: 199

SEQ ID NO: 2689 - DNA, 426 bp, Glycine Max
atgacaaagctaggaattaacaaagattcacatttggtctcaaaaaccaagccaaagatcaggataattcatgtgtatactccagaaatcatcaaaactgatgctgcaaatttcagagagttggttcaaaggctcacaggaaagccaaaagaagaaggaacaggtggaagcaagtccgaaactgcactaaccaaagaaccaatggattcacaccccaagaaggccatgatcatgcaagatgaagaggagtttctgagtctacaaaatgggacaaggctaaagaatgaacataaagaggaggaagttcaagatgatgtgtggaggtcaaagtcaaacgagaagttcagtggtttccttgatgggttctcagaattggatggttttatggaagagttaagtactttgcctgcagggaatcaaaattaa

SEQ ID NO: 2690 - DNA, 1995 bp, Glycine Max; identical to SEQ ID NO: 200

SEQ ID NO: 2691 - DNA, 2925 bp, Glycine Max
atgacacctgttgaagtgaaccacatcactcgtgactttgtatgtctgtgttacgagtatgatattaatgatctgcatcaagaggctcaagccagatggttgaagcctgcagaagtgatgtacattttacagaatcatgaaaagttccagttcacccaagaggtcccacaacagccaaccagtggatccctgtttctgtttaacaaaagaatcctgcgatacttccgtagagatggtcataactggcataagaaaagtggtggaagaactgtgggagaagcacacgaaaggctgaaggttctaaatgttgaagccttaaattgttactatgcacgcggagagcagaaccctgctttccagaggcggagctattggatgttggatccggcatatgagcatattgttcttgtgcattataggaacacaagtgagggaaagctaagttctggagctggggcacaattgtcaccaagttcttctgtctatactcagagtcctagcccatattctactcagaatccagggtcaacatccatacttggtgattcatatgaacctaatcagagtttctccagtcctgggtctacaaaagttacatctgagatattcgttctgaacaataaaatgggaacctcatctgaactcgaggttactcaagctttgcgccgattggaggtacagttaagtttgaatgaggacaactttgaagatattgtttccttcggcagtaagcatgaaactgttcatgattcaaatcccaagcacgatcaaagggtgatcagcaatcaagagcaatctgcagctttctctagacccgatgatcaagggctattttatgatggatgtaatggaaggcaaggatctatgggtcatacgtatcatggttaccctgatgcaaatgaaaaggctttatggacagagcagctggaatcacataagtcctcatctgcagtcaagttacctcagaaaaatgtatacatgccagctgaaaatgaaaattcagtatcttctgcaagaagggtaccagtttccaaccaggaaaacagtcactggctcaacttcaactgtaataattctgaaaactctgttttctcacaacctcaaggtgttgatgaagtcaaatttcctgcctattcttctatgttggaaacacaagtaattaattctgactactatgaaacattgtttgaccaaagccaaattggagcaccaccagatgcaaattcaagcttgactgttgcacaaaaacagaaatttactattaagactatctccccagaatggggttatgccaccgagactaccaaggtcattgttgttgggtcttttctctgtcatccctcggattctgcatgggcttgtatgtttggtgatgttgaagttcctattgagataattcaggatggtgtaatctcttgtgaagctccatctcaccttcctggaaaggttactctgtgcattacttctggaaactgggagtcctgcagtgaagtcagagagtttgaatatcatgataagaccaatagttgcactcgatgtactcaatccgaaacagaagccactagaagtccagaagagctgttattacttgttagattagggcagatgcttctttctgcatcaacaataaagaatgacaacatagaatctggaattcctctaataaaaccgaaagctgatgatgattcatggagccatattatagatgctcttctagttggcagtggaacgtcgagtggtactgttgattggcttcttgaagagcttctaaaggataagtttcaacagtggctttctttcagatcacgggaaaaagatgaagagacaggctgctctttgtccaagaaagagcaagggattattcacatggttgctgggttaggttttgagtgggccttgaaccctattctcacgtgtggagttaatataaatttccgtgacatcaatggatggactgcccttcattgggctgcacgttttggaagggaaaaaatggttgcttcacttatagcttctggagcatctgctggagctgtgacagatccaaatgcacaagatccaactggtaaaactgctgcatctattgcagccagcagtgggcacaagggactggcagggtatctttcagagatagctgtaacaagccatttgtcatcgcttacactggaagagagtgaatcatctaaaagttctgcttatcttcaggcggataggactgttaacagtgtctccaaggaaaatcttactgccaatgaggatcaggcgtcactcaaagataccttggctgctatcagaaatgtaactcaggcagctgcgcggatacaatctgcttttcgctcacattcttttagaaaacggagagcaagagaagcaactgctagtacaggtggcattggtaccatttcagagatttctgctatgtcaaaacttgcgtttcggaactcacacgaatataattcagctgctttatccattcagaagaaatatcgaggttggaaaggtcgtagagatttcttagcattgcgccaaaaagtagtgaagatacaggctcatgtgaggggttaccaggttaggaagcattacaaggtaatatgggcagttggaatcttggacaaggttgtcctacgatggaggagaaaaggagctggtttacgaggtttccgacaagagatggacatcaatgaaaatgaagatgaagatattctcaaggtgttccgaaaacagaaattagatgtagaaattgaagaggctgtttcaagggtgctgtccatggttgactcaccggatgctcgtgagcaatatcatcgcatgcttgagaaatatcgtcaagctaaggctgaacttgcgggtacgagtgacgaagcatcattatcaacttctgtaggagatgacttatttatggatgatttttatccatttccctaa

SEQ ID NO: 2692 - DNA, 984 bp, Glycine Max
atgacactgacactactgcctcctccaaaatcaccattcttgaagacccttttgttcctgtgcagcactagtctcctcctccctgatgctgatgcggttcagccaatcatcccaaacccctcctcatcttcaacaacaggaacaatccctgctttcccagaacaagctgaagctgcaggctgccctctcaacctctcagatgaccactatgaagccataaagagtgcatgtggctccaacaaacctgatgatgatgacctccaccgtagcagatgctgtcctgtgctcgcagcgtggctctattctgcatactcagccactgctcttagtgcctcacagggccataccacatcctatgacatgcccttgttgcctgatgactcagaaacatgtgtgagtgacttggggaaggccttgaaagttagaggaatccagctttttcagcccaatgagacttgtgatgtggtctattgctactgtggcattaggcttcaccctttgacatgtcctgagtcattctcagttactccaagtggaagtcttgttgtcaatcaaagtgtcaaaagattggcgagggattgctcgagtagcagcaccaatgtcaacaagtttcccggcctgggtggatgctccaagtgcttgcatagtctctattcgcttagaaagaagtcttcaaattcaagcaagtcagaagaagataggaccagcaagatccataacaaagactgtgaactcatgggcttaacatggcttctggctaagaatagaacagcttacattcacacagtttcgggggttcttcgagctttgatgttgagcagggaaggctctgacccacaatcatgcactctaaacagtgatggaatgcctcttgccgttgattcctctgaaatgtcagatgaatcttcagccaccaacctacaagcaccaattttcctctctctgttatttctacattattatttcaatgtattatccacctaa

SEQ ID NO: 2693 - DNA, 1041 bp, Glycine Max
atgacagatcctaagtccaatttatacactgaaaccttcaacttcatgcccctctattctcacctctcttcttttagtacttctcaatcaaacttattctcttcttactcaaacaacaacactttcgccattcaatctgaaacctcttcctcttatgctcctccttctcctcctctcagagaagcccttcctctcataaacaacataagcctcagaaaacaaaaggaaaaaaatgaaccatcaaagagtggtggtggtatggttgaagaggaaggaggaaagaaaagggacatggatgagacgacccttttgatgactagtactactactgaagagggtgatgctgaaactgtgacagtagcactgcaaatagggcttcctagcgtggctgcttctgatgatcttaatgggtcaaggaagatccctgcagcttgtgcacaaatgaatgaaaaggaggatgcgaggagtgtgatttctggacacccttttgatagattgaacaaggttcagtattggattcccaccccttctcagattctcattggtcctactcagtttttgtgtcatgtgtgctctaagagtttcaacagatataataatcttcagatgcatatgtggggacatggatctcaatatagaaagggccctgattctctaaaaggaacacaaccatcagcaatgctacggcttccatgcttttgttgtgcaccaggttgcaagcacaacatagaccacccaagagcaaggcctctgaaggacttcagaacccttcaaacacactacaagagaaaacacggcattaaaccctacatgtgcagaaaatgtgacaaaacgtttgcggtgaaaggtgattggaggacacacgagaagaactgtggcaaaatatggtactgtttatgtgggtctgatttcaaacacaaaagatctctaaaggatcacataaaggcctttggccatggccacggtgctgttgacattgattgcatgcaagaagatgaagcggcctccgaaattgaacatgatggggatatctcaatgtga

SEQ ID NO: 2694 - DNA, 1140 bp, Glycine Max
atgacattgcttttggggctcacgaagatctgctccctcttcctcctcttcctcgccaccctcacctccccggagggaacccccatcctccccttctaccgctccatcaccgccgcctcctactccgtcttcgtcgaatccaagctccgccccctccccgtcgtctcctccctcccccctccgccgagcctcgcctacctcgtctccggctcaaagggtgacggcgccgccgtcacccgcgtcctcttggccctctaccaccccaacaaccgctacgtggtccacctggacctcgaatcctcgccggaggaacgctccgatctggtgaggttcgtggagggccacgcgctgttcaagcggttcgggaatgtgagggttataaagaaggcgaatctcgtcacgtacaggggacccaccatggtcgcaaacacgcttcacgccgccacgattctgttgagggagcttggggattgggactggttcatcaatctcagcgcctccgattacccacttgtcacacaagatgatctgctgcatacgttttcgtacctaccgcgggatctgaatttcattgatcatacaagtgacattggatggaaagatcatcagcgtgcgaggccgatcatcgttgatccgggtttgtatatgaataagaagcaagatgtgttttggatttgcagaggaggagtaggccaacggctttcaagcttttcacagggctcatcatgtttctatcaaaataagggagttagatggagggtatatcctgcacgattaatgatattttgcttagcatcaaatattgaactgatattgacacttttttgttttgctgtaacaaatataactgttgtagtacaacaatactcccaatgttcggcttggatgacactgtcaaaatctttcattgattactgcatatggggatgggacaacctacctcgaaccgtactcatgtactatccaaagcattcttccttgcagttgcaacttttcattttccattctattttaccattgaagtgcttagtcaagttagactttcgttttataaataagaataagatgggaggcaataacctcaaacaagaagtaagagctggggaccatgaccaaaattccaaggcagccatgatgtga

SEQ ID NO: 2695 - DNA, 1074 bp, Glycine Max
atgaccaaagcaattgaggggggattttacaagggattcttggtgggcacaaagaaggtggaggttagtctacttcagtatgcagatgacacgatatttttgggagaagcaactttagcgaacgtaagaacaatcaaagcaatacttcgagcattcgagatggcatcggggttaaagataaatttcgccaagagtagttgtggggcctttggggtgtctgagcagtggacttatgatgcatccagttatctcaactgtgggctgatgtcttttcctttcacataccttggtatacccattggtgctaatcctagaagatgtcagacttgggaacccttaatcacgaaggtcccgaggcaggtggttagcaagctaaccagattacaaaggaatttcttatggggtggtgcagcagatcaaaataaaattccgtggatcaagtgggaaaaggtttgtatgcctaaggagctaggtgggttgggagtcaaggatattatctcgttcaacacatcattattaggaaagtggaaatgggagatgtttcagaatcaggaggagacttggtctagagtccttgaatcgaagtacggaggatggaggagtcttgatggagcttcgagggtcagcactgaatcattatggtggagggatctaaagatagtcaatcaaagtctgaatcaaggtcaccagctgaacaggttgatattgtggagggtaggatgtgctgtgaaagaaggtgggtgggagtggcattttaagtggaggagacttttgtttgatagcgagataggtatggcggtagctttcctccaacagctggaagggttcacaatcaggtcggaaataaatgatcattggaagtgggcggcaaagcctagtggttgttattcgactaagagtgcatacaaggcaattcatcatgtcacagtggaagatggacaggatggaaagttcaaggagctatggaagcttagggtcccattgaaagtggctatcttcgcgtggaggctgattcaagacaaattgccaactaaagttaatctgaaaaagaagcgggttgagttacaagagtag

SEQ ID NO: 2696 - DNA, 1278 bp, Glycine Max
atgaccaatctgcaaatacaaacagaggaaccccctctgagtcaaacaccgcttttaatttcaattcagcaacaactacagaaccagaatgagggaaatagtaataataacaataacaataatgtgaataagaagaacgaagacgttcaagttgacgctgacggagagattgaggaggatcagagtaaagtggaggcgagcctggtgcggttggaccggtttcttacggtgttagggttcaaccaggactcgccgttgagcttcgtggtttcgtggagcgtcttcgcggcggtgggagtggtggcgccgctgctggcgctgtccatgtgcgactgtccggagtgcgacaggtacgagattcagagcttcgagatggcgatcgtcgcgtttcaggccagcctcgccgccgtctccttgctctgcctctcccacaacctccgcaagtacggtctccgacggttcctcttcgttgaccgctactccgggaagatgcattgctttcaccgcgactacgtcgctcggatttcgggatctatgcgcatgctttttctgtgggtgttgccgtgtttcattctgaagacagtgcgagaaatcattcgcattttctatgtacaacatgggtcctggtggctctcgcttgctattttatcagctttgattatttcttggacttatatgagtacaatctctctgtcagcctgcattttgtttcacttggtctgtagtttgcaagtgatccactttgatgattatgggaagctcttgcaaagggaaagtgatgtgttagtttttatggaggagcacattcggttgcgctatcatctctccaaaataagtcataggttcagaatctatcttcttctagagttcttggtcgtcacagcaagccaggttgtgacgcttttgcaggtcactggatatggtcaaatgcttaccttcattaacggtggagattttgctgtatccacacttgttcaggtggtgggcatcattatttgtctgcatgctgcgacaagaatttctcacagagctcaaaatattgtttccgttgcaagcaggtggcatgcaatgctaacatgcacatcgtctgatgcaccctctcaattgagaagctcagctagtgcagggagcttggaggctgcaaaccatttaaatgcaatacaagtagactattctgaaagtgatctagagtcaatggattatgctggaatgtttacaaatacccaatggacttcctatgtgtcttcacatcacaagagacaagcttttggtgtgtaa

SEQ ID NO: 2697 - DNA, 2556 bp, Glycine Max
atgaccaccaaacgccaacatgcaattcttctgctcctcttattcttctgttctcacactttgttctctcatgcagccgattccatcacagaggacacagtaatcagagacaacgatggtggtgacaatttggtgtccaaagacctcacctttgaaatgggtttcttcggtttggataataataactcttcaagatacgttgggatttggtaccacgagattccggtcaaaacattcatatgggttgcaaacagagaaaaacccatcaaaggaagagaaggttcgatcctaatacaaaaaagcaacggcaacttgattgttctcgatggagagaacaacgaggtgtggtcaacaaacatgtcagttccaaggaacaacacaaaggctgttcttcgtgacgatggaaacctcgttctctcagaacacgacaaggatgtttggcaaagctttgaggacccagttgatacatttgtgccgggtatggcacttccagtgagtgctggaacgaacatattcaggtcatggaaatcagaaacggatccttcaccgggaaactactcaatgaaggttgactctgaggggtcaacgaaacagattttgattttggagggagagaagagaagaaagtggagaagtggttattgggatggtagagttttcactggtgtctccgatgtgacaggaagctctctatttggctttacagtcatcacagacactaaaggagaggaatattttacatacaaatggaatagccctgaaaaagtgaggtttcagataacttgggatgggtttgagaagaagttcgtgttggatgcagatgggaaacaatggaataggacacagtttgagccttttgatgactgtgagaagtataacttttgtggtagttttgcagtgtgtgatacgggtaattctcctttttgtagttgcatggaagggtttgagccaatgcattgggaggagtggaataataggaattggacaagggggtgtgggaggaggactccactgaaggctgaggctgagagaagtgctaataatagttcttctggagctgatcgtgaggtgagtgttggagaagatggtttcttggagcaaaggtgtaccaagtttccggatttcgcacggttggagaattttgttggtgatgcggattgtcagaggtattgtctgcagaatacttcttgtactgcttattcatatactattggaatcgggtgcatgatttggtatggagagttagttgatgttcaacactctcaaaataatcttggaagtttactccacatccgtcttgccgatgctgatttaggcgatggggggaaaaagaccaaaatttggataatattagctgttgtggtagggctgatctgcattggaatcgttgtattgctggtatggaggtttaagagaaaacctaaagcagtttcctcagcttctggtttcaacaacaatagcgaaataccagcctttgatctaacgaggagtacagacttatcagaaatttcaggtgagttaggcttggaagggaatcaactaagtggagcagaacttccattgttccattttagctgcattctagcagcaacaaacaatttctcggacgaaaataagcttggacaagggggatttggtcctgtctacaaggggaaaattccagggggagaggaagtagctgtcaagaggctttcaagaaagtctagccaaggtttagaggagttcaagaatgaaatggtgctcatagccaaactgcaacatagaaatctggttagactattggggtgttgcattcaaggggaagaaaagatactggtatatgagtacttgccaaacaaaagcttggactgctttttatttgatccggtgaagcaaacacaactagattgggcaaaacgctttgaaataatcgagggcattgcaagagggctactttatctgcaccgggattctagacttagaataattcatcgtgatttaaaagcaagcaacattttgttggatgaaagcatgaatccaaaaatttcagactttggcttggccagaatatttgggggaaaccaaaatgaagccaacacaaacagagtggttggtacatatggttatatgtccccagaatatgcaatggaaggtctgttttcaatcaaatctgatgtctatagttttggtgtattgctacttgagattatgagtggccgcaagaacacaagctttcgtgacacagatgactcaagtctcattggatatgcctggcacctttggagtgagcagagagtaatggagcttgttgatccttcccttggtgattcaattcctaagactaaagcgttgaggttcatacaaatagggatgttatgcgtgcaagattcagcatctcgtagaccaaacatgtcatctgtgttgttgatgctgggaagtgaatcaacagctctacctttgcctaagcaacctttgctcactacttccatgaggatacttgatgatggagaatcttatagcgaaggccttgatgtgtcaaatgatttgacagtttcaatggtgacaacagggagatag

SEQ ID NO: 2698 - DNA, 1191 bp, Glycine Max
atgaccccttcggaattcaaggaccgtctcatctttggtccttctccttcctctgcttccccaagagacccttcacctctggctgatgccttaacactctcttacaattccccaaaatgcccctcctcttcaaactcacaggactatgcatcaccgccactatttgattcccaacaacagcaaccgctcaactcttggctccttgaccccaattacgagtcatggcggaaaacgaaccttcaccgatcgaaaaccgcgccggccatggccgtgatcagcgatttcaacccccacaccgccgtgcaaagaccccagtttgccagccagagtattgtccgccagggtgttattcttcttgctctttatttggcattaggggttgtcatttattggttcaatcgtcataattttacagccaccgagactcatcctgtagttgatgcattgtatttttgtatagtgacaatgtgcacaatagggtatggtgacatcactcccaatagtacagccactaagcttttctctatattgtttgtgttggtggggtttggatttatagacatattgttgagtgggatggttagctatgtgcttgatttgcaggagaatcatatgttgacggcggtgaaggggaggaggggtgagaaggatggaaagtcttatataattgatgtgaagaaagggaggatgaggattcggttgaaggtggcgctggctttgggggttgtggtgatttgtactggggtaggtgtgggggttatgcattttgtggagaagcttggatggttggattcgttttatctttcggttatgtcggttaccacggttgggtatggagaccacgcgttcaagaccatgcacggtcggatctttgctgcgatttggttgcttgtgtcgacgcttgctgtggcccgggcgtttctctatctggctgaggccagagtggataagcgtcataggaggatggcaaagtggattcttggtcaggatatgactgtttctgagtttctagcagcagacattgacaataatggctttgtgagtaaatcagaatatgttatatacaagctcaaggagatgggaaaagtatctgagaaggacatcatgcaggttagtgagaagtttgatagactagatgctggcaactgcggaaaaataacgcttgctgatcttatggagaatcataattga

SEQ ID NO: 2699 - DNA, 825 bp, Glycine Max; identical to SEQ ID NO: 201

SEQ ID NO: 2700 - DNA, 3258 bp, Glycine Max
atgaccggaagcggaagaagtagcgttcggagcagggcgagatccctctccgactccgacgccgacgccgattctcttcgacaaaagaggcctccgctgaatcgccatagagagagaagcaaatacggaagctacattccgatatacagcaatgccaatctcaaagtgctgctcggtatctgcttcgtcgcattcttcatcatctggtttatgattcaccacctctccaattccgtaacggagccgaagcttcctcgcgccgttacgccatttcccgcgccaaagataatggaccttcctcagtttgaaggtgagcacaaggagagtttgtattggggaacttatcgtcctcacgtgtatctcggaattcgcgccaggactccaaaatctttgatggctggattaatgtggattggtgtgaaggatggaaaatatcacttgcggcatgtttgcagacacgaggatgacctaagtacttatggttggacaaggcacaatggacgtgattttggacatcaagtgctggttgatcatggcatgaccttgactactgaatttttaaaatcaaaagaggaaggcagtggctatggtggggattgggcagttcgaattaatatgcaaattgataagtccaagtggaatgagggatttgggagaggtgcccagctctttttctatttggctgatgaagctggtaatgctctagatgtaagtagagaaaacttgaacattcatgaagattctttgcttgcatctggctctcgagcagatattggagattggcagctacatttgaaatcaacggatgatttgcagctgcattatgctggatttcgcatacctcacttgcacaatttatctgatcccgtagaggaaaatcttgcatcacaaatacaaaagcatgctcgactgcagctatctgactcattagatgattctccaaatgtgttagtttttcagattattggtggatttcctttcacaacagatattgtactaatctctggaactgatttggaaacttctagagaagaagagcgtgtcagtatgcttacaggtacctcactgtccaataaactgaaatataaagaacaagaatttgatgagaagtttgagaagatttttaatttgaccgagaaggtggattccgaagccttatctgttggtaaggctgctgttggaaacttattaggtggcatcggctacttctatggccactctttgtacaaattcacaattcgccaatattatcaaagcttataccacttaactgctggacatgtgactcacaataggagagagattttaatcatgtgtgtgaacctgcaacttatcatttatagtaatgggcaaaaccctaaattggtcctccaaagacttagagaacatgtcaattatatgtcgtattggtctgctgagctttacacagctgtaccaagtcgatctttctttccaagaggatttttatgggatgaaggttttcatcaacttataatctggcgttgggatattcatatttcgttggatatcattggacattggttagatttgattaatgttgatggatggataccacgtgaacagattttaggggctgaagcactaagtcgggtcccagaggaatttgttcctcagcatccaacaaatggaaatcctccaactctgtttttagcattaaatgatataattgatggcttgaagaataatgagtttactgcaatggatagaagtgagatctctctattcctggaacgtgcctttgttcgattggaagcatggttccattggttcaaacttgaaatgaagataaacacattttccaggagatgtatgacaataaaatacagagtgatcagcttcacttcgtttcagtccaaacatgtgaacaacatgactaaatttaccaaaccaagcacgaggagattgcttcaacccatagagagatcgatgaagcttacacacaaggccatactccccctgagcaacaaacccaggtggttgctccatataaatatcctcctcaagatcaccgtggagaaagacattcttaatatcaagctgatggaggggccagtgacgaatagcagccatagcaagaaacagacgaacagtggtgagtttggcgacaggagagaaagtatcacagtaatcaatgccatatacctgtgtgtagcctttagctaccaaacgagccttaagccgatcaacctcaccagtgggcccaactttaacagtgtagacccacctacaacccacaggggtcttaccagggggaagaggaacaagctcccaagtaccattattttcaagggcctgcatttcatcaatcatagcctgtctccagccaggatgatcaagtgcctcacggacaggaaacagatggccagctactattggcatggacgggacactaggacaatgcgtgaaataaatcccaagacactgtcatctggactggatgattatccacgagcttcacacccaagtgaagatgaacaccacttggatcttagatgttggatgttacttgcagcagactgtatgcattccattcaagagttgttggatatggaaagcaagcctggcatggattatggttctactgctaagttgctattggattttgagttactgaaccagatgcattttgatgatggatacggagcttactttgattttggaaatcatacagagaaggttcaacttaaatggaaagaactgcaggctggacaaaattatgctactcaccaacttctccgggatgttatggatatgcctgtattgagattggttcctcacattggttacgttagtttattcccattcatggggaggatcattccatctggatcatggattctggaaaagcagcttgaactcatttcaaatcgcagcctcttatggaccaactatggattacgttcacttggcaaaacaagttccttgtacatgaagcacaacacagagcatgaccctccatactggagaggtcctgtttggataaacatgaattacagaattccttccgcactccaccattactccaaagagaatgggccatatcaggagaaagctaaagccatctacaaagaattgagaagcaatttaattagaaatatagtgcgcaattatcgacagacgggatttttgtgggaacagtacgaacagactaagggtaagggaaaaggggcacatccatttactggctggacatcgcttgtagtattaatcatggcagaagcatatggaactatttag

SEQ ID NO: 2701 - DNA, 3258 bp, Glycine Max; identical to SEQ ID NO: 2700

SEQ ID NO: 2702 - DNA, 5511 bp, Glycine Max
atgacctccaaacttgcagatatgcagaggcagtttggtgaaagttctaaatctctactgtggaatgaggatagagaattaatttctgctaaagatgttgctgcagcgaacgaagaacaattatctgctgaactttccactgttaataagcttaatgagctatataaagagagttccgaggaatggtcaaaaaaagcagcagacctagagggtgtgataaaagcaatagagtcacgcctaaagcaagttgaagatgattataaagagaaacttgagaaggaattatctgccagaaaacaagttgaaaaggaggccactgatttaaaagaaaagcttgagaagtgtgaagctgaaattgagacaaggaagaagactgatggagtgaataatcttcctcttagcagttttgctactgaaccgtggatggaaccaattgaagctgataccatggttgaggaaaatagcttgctactagtcccaagaattcctgttggagtttctggaactgcattggctgcttcacttctgcgagatgggtggagtttggccaaaatgtatgcaaaatatcaagaggcaattgatgcattgaggcacgaacaattgggaaggaaggagtcagaagcagtactgcaacgggttctatacgagttagaggagaaagcggaagcaattatagatgaaagagtggaacatgaaaaaatggctgactcatactccttgatgaaccaaaaattgcgaaaatccctgaatgaaaattccaacttagagaaaaccatccaggaactgaaggctgatctgaaaaggcatgaacgggattataatcttgtccagaaagaaactgatgaccttcgaaaacaggtgacagtacttctgaaggaatgccgagacatacaacttcgttgtggctcaatgggatatgatattgttgatgatgcttcaaatattgtttcaaggacaagtacagagactgaagctgaacatgtcatatccgagcacctcttgaccttcaaggacatcaacggactagttgagcagaatgttcaacttagaagccttgtacgtagcatttctggccatattgaaaatcaggaggtggaattcaagttcaagatctgcgacttgggggaggggacctgggttttgtttgagataggaggaaattaccttaaggtccctgtgggattaaaacaccagacccatagaatggttgcgatgtataagaggttatatgaggaggagcataatcttcatttatctcatacccattcctcagaagctcttgcagctgttgcggaagttggaagaaacaaccttaagacttcaattgaaagttcacaggaggctgctaagaagtcccttgaaaaagctgctgagcgtgtgagatgccttgaggatgatttagcgaagtctaggagtgagattattgtattacgatcagaacgtgacaagagtgcacttgaagcaaattttgctagagagaaacttaatgacattatgaaagaatttgaacatcagaaaactgaagccaaaggcattttagaaagaaatgttgagttttctcagctggttgttgactaccaacgaaaattgcgtgaaagctctgagtcattgattgctgctgaggagctttcgcggaaacttactttggagctgtcagttttaaagcaagaaaaggaagtcatatcaaattctgaaaaaagagcatccaatgaagttcgcagtttgtctgaaagggtgcagcgtttgcagttacacttgctattgcaggctagtttgagtaccatacagagtactgaggaagttcgaggggaagcaagagctgcagagagggttaagcaagaagaatatataaagaaattggagagggaatgggctgaggccaagcaagagttaaatgaagagcgggaaaatgtgcggagattcacatcagatcgggaccagaccctaaaaaattctctgagacaggttgaggatatgagcaaagagttagctaatgcattgcgtgcagttgcatctgctgaatcaagggctgctgtggctgagtcttcacaaatggtaaatattaacttcaagctctatacacaggtaaaactctctggtcttcaaagaaagatgggttccacggatgacaaggttgttgctgaattgcaaaaggcaaaggacgaaattgaaaagtggaaagaggaagctcatgccaacaaagcccacatgctgcagtataagagcattgctgaggtgaatgaagatgcactgaaagagatagaaaaggcgcatgagaagtttaaaatagaggctgacaatggaaagaaagatctggaatctgaacttaagtcactaagagacaagatgttagagcttgaaaataaatcttctttgaaatatgaagaagttgcttctgaaactgtgggaaaggaagaggctcttacatctgctatggctgaaatcacaaatcttaaagaagaaattttaaccaaatcttctcaaatttctgcaatggaaattcagatctcgggtttaaaagaaaaactggacagggaacatcagaaatggcgggcagctcaaaccaattatgaaagacaggttgttctccagtccgaaactattcaggagttgacaaaaacatctgaagcactagccttgctgcaggaggaggcatctgagttacggaaactagccaatactcagaaaattgaaaataatgaactaaaggctaagtgggaagatgagaaggtacaactagagaagtctaggaatgatgctgagaagaaatacaatgaaatcaatgaacagaataaaatactacatagtcaacttgaggcttttcatattcaatgggccgagaaggagcgtaacgctgctggtatttcatctggaagtagtagtgcagatgcctttggtgatgctggtcttcaaaacgtgattaattatctcagacgttccaaagaaattgcagaaacagaagtttcattgttaaaacaagagaagctgcgactacagtcacagcatgagagtgctttgaaggcagcagagtctgcacatgcatcactagaaactgagcgtgcaaaatcaagatcatttttgtttaccgaagaggagttcaaagcattgcagcttcaggtcagagaattgaacttacttcgtgagagtaacatgcagctcagggaagaaaataaacacaattttgaggaatgtcagaaattgcgtgaactagcacaaaaggttagagctgagacagagaacctagagaatctcctgagggaaagagaaattgagcttcagcgccataagaaagaaattggaacattaaaaatggaaaaagataatctcaataagaaggtttctgagttgcttgaaaggagtaaaaatgttgatgttgaggattatgatcgagtgaagaaacttgctagagaaatccaggataaactaagagagagagatgctcggattgaggaacttggtaaaagtctatcagaaaagcaggattctgtttcatgcctagagaaagatctttcaaactgccgattggagctagcagagagagagaagagaattaatgacattctgcataatgagaagaggattgatgttttgtcaagggaaaaggaagacctagggaaagagaaccaacaactttctaggcaattagatgaaattaaacaagggaaaaggtcaacatgtgatacaacaggtgaacaagcgatgaaggaggaaaaggacacaagaatacagattctggagaaacatctggagagacagagagatgaattaaagaaggagaaggaagagagtcgtttagagagaagtagacgactgaagactgaaaaggccataaaggactcttacaacaatgttgaacaggagaaaataaaattgattattgaaattgagaggtataaggagtctctgaaaaggttatctgatgaagttgaaaagcttaagattgttattggcaatcttcctgagggttcaaatgtggttcaacttctttctggatccaatgtcgatgactttgctgctccttacatatctgctgtggaaagttttgaaaaggaagctcagtcagtatttcgggagcttggaggtcgcggtaatcttggagatgcagcaacaattacggatggttcagccgctgctacaggttctcttgtacatcctcaatcccaaggcattgcatctttagcggcccctggagttagcggtttaccacctaaagccactggagaaagtgagaaaagacttgcattacccaaagctagtgttgaaactcgtcgaacaggtaggagattggtcaggcctaaactactagagaaaagtgagaaaagacctgaggagcttcaaggtggtgacacagaaatgtctgatgctgaaggacctgggggcaagcctgggcagtctagtgacacagatactagtaatgttgttcaatcatctcaacaattggctcgtaagcgtgttgctcctacctccacttctgaattacgtgaagaatcagttgcacctggtgagaagagctctgatgtcttgaagaagtcaaaaggatctgagtccctagaagagaatacagaagaacaacctgctgcaattctagaatttactggcagccaccctgtcactgaagaattatttgatagcagtgacatgccccaatgccaaaatgaggaggttggtgaagctcaaaatgaagatggtgaaattgctgtcgggaatgatgaggaatccaaagatccacggcacttggatggtactggtcaagaggaattacaagctgacaaaactggaactttagaagagaatcaagatcaatctgctgaaacaaaagtgctgtctgatgagatgcagaggaatcagacagacccagacaatcagcagtcaacattggcgcccagtggtgagagagaagagggagaattgatgccagatactggagatctagagggtgctagtgatttgtctaacattgcggaaaaccaagaatctcgggaaggtcaatctgagtctgctgcaactcctgaacgttccccagctagggttgatgatgatgctctagaggctggtgagattaattctcctgagctttcaagtgatgataagaatgatgagggtgacttggtagaggaggctgctgatggttctgacaagttgattgatgtcaacgaaccaatatcagctgagagcgatcaagtggctgagcctgttgcgagtgagactgctacttcgacaagcactgttgcagagagtagctcctctaaagtgaacttacctgttccaaggcaagggacccctagtgcccccgctgaaacagaagagacaaagcaggcatcacctgttggtagtacttcaacaaccataaatttatcagagcgagcacgggaaagggctcaaatgagacaggctgggttggtttcttctacccttagaggtcgtggaagaggcggtgctccccgtggtcgagttggtcgaggtaggggagtagtacgccgaccacctccaccacctggcagtgatcaatga

SEQ ID NO: 2703 - DNA, 1284 bp, Glycine Max
atgacctctcctttttcgtacacattccctatcagtgatgctggtactagcaattttagtactactaccactggcactagttacagcacttccactccatggatgaacagcagaatatggagcaagctccctcagaggcttcttgaccgtgtcttagcctttcttcctccaccggcattctttcgtgcacgttgtgtttgcaagagatggtatgcacttctcttctccaacaccttcctcgaattgtacctccaagtctcaccacaccaacactggttcttgttcttcaagcaccacaagacccgcaagagctacatctacaaaaacaacaacaacaacaacgggagtagcgatggttgtggacatattggtgcgtttgaagggtacctctttgatccctatgagatgtcatggtaccgcattttctttgctttggtcccttccggcttctctccagcttcatcttctgctggtttactttgctgggtttctgatgaagctggtccaaagaccatgcttctgagcaaccctttaatcggttctctcactcagctacctccaacgttaagacctagactcttcccttccattggcttaaccattaggcccacctgcatagatgtcactgttgctggtgatgacatgatatcaccttatgcagttaagaacctgacatctgaaagctttcacatcgatggaggagggttttactccctgtggggcaccaccgcttctcttccaaggctctgcagtctcgaatctggaagaatggtttatgctgaagggaaactctactgcatgaattgtagccctttcagtattttggcttatgacatcacatcaaacacttggttcaaaatacaagccccaatgaggaggtttctgaggtctccaaacctagttgagtgcaaggggaaacttctccttgttgctgctgttgagaagagcaagctgaacgtgcccaagagtttgagggtttggagtttgcaggcttgtgggacaatgtgggtggagtcagagagaatgcctcagcagctttatgttcagtttgctgaactggaagatggaaatggatttgaatgtgtagggcatggtgagtttattgtgatcatgattcgtggaacggacaaggcgttgctgtttgatatatgcaggaagaggtggcagtggattccaccttgtccttacattgcacatgatggatttgagttgcatggttttgcgtatgagcctaggcttgccacacctgtcactggccttcttgatcaattggcacttcccttc

SEQ ID NO: 2704 - DNA, 621 bp, Glycine Max; identical to SEQ ID NO: 202

SEQ ID NO: 2705 - DNA, 621 bp, Glycine Max; identical to SEQ ID NO: 202

SEQ ID NO: 2706 - DNA, 915 bp, Glycine Max
atgaccttaaattacaacattgccctcgccttctctgcggtgctcacgctgctcctctttcccctactgaccgtaggggagctcgtggaggagcagccactagtcctcaagtaccacaacggccagctcctgaagggccgcatcaccgtcaatctcatctggtacggcaccttcaccccgatccaacggtccataatcgtggacttcataaactcgttaagcagcgcgccaaacgcgcctctcccctcgaccgccacgtggtggaaaaccacggagaagtacaaggtgggaggaggatcccctgcgctcgtcgtagggatgcagttcctacacccggcttacacgctagggaaaaatctcaaaggaagagatctcctcgcactcgcgtcaaagttcaacgagattaactcgataacggtggttttaacggcgaaggacgttgccgttgagggcttctgcatgagccgctgtggcacccacggctctacccggaacgttaaaagtaatgcccgaaccgcatatatctgggttggaaactccgaaacacagtgccccgggcaatgcgcgtggccattccaccaaccgatttacgggccccagacgccgccgttagtttctcctaacggcgacgccggggttgacggaatggttattaacttggccacgcttctcgctggcacagttaccaaccctttcaacaacggttacttccagggtcccccaacggcgccgttagaggccgtttcggcttgcactggtgttttcggaagtgggtcgtacccgggttatccgggtcgggttctcgtggataaggcaaccggggcgagttacaatgcgcatggtgcgaatggaaggaggtatctcgtgccagcgatgtgggacccgcagacttcgacatgcaagaccctcgtctga

SEQ ID NO: 2707 - DNA, 3819 bp, Glycine Max
atgacgaagttttcaacttttgcaattgcgttccttttgtgtttttcttctatgctactagtccttggtcaggtcaactcagacagtgagagcattttgagattgttgttggaagtgaagaaatcttttgtgcaagaccaacaaaatgttctgagtgattggtcagaggataacacagactattgcagttggagaggtgtgtcatgtgaattgaactcaaactcaaactctatatcaaacactttagatagtgactcggtgcaagtagtagtgggtctcaacctttctgactcgtcactcaccgggtcaatatcaccttcactcggtctcttacaaaacctgctccaccttgatctctcctccaacagcctcatgggtcccattccacctaacctctctaacctcacttcattgcaatctttgcttctcttctccaaccaactcacgggtcacattcccactgagttgggctcgctcacgagtctccgagtcatgcgactcggtgacaatacactaacgggaaagattcccgcgtctcttgggaacctggtgaacttagtcaacctcggcttggcttcctgtggactcactgggtcgattccgaggcgattaggtaaactcagtctcttggagaatctgattctgcaggacaacgagttgatgggtccgattcctacagagttggggaactgctcaagcctcaccatcttcactgcagctaacaacaaactcaacggctcaatcccgagtgaactgggtcaactcagtaatctgcaaattctcaactttgccaacaacagcttatcaggggagattccgagccaactcggtgacgtgagccaactcgtttacatgaacttcatggggaaccagctcgagggtgctattccaccgtctctagctcaactgggtaatcttcaaaatctggacttgtcaacgaacaagctcagtggaggaatcccagaggagttaggcaacatgggtgagttagcttatttggttctgtctggtaacaaccttaattgtgtcataccaaagaccatatgttccaatgcaacaagtttggagcacttgatgttgtcagaaagtggacttcatggtgatattccagctgagttgagtcagtgccagcaactaaagcaacttgatttgtccaacaatgcactcaatgggtccataaatcttgagctttatgggttgctggggctaactgatcttttgttgaacaataacagcttggttggttccatctctcccttcatagggaacctcagtggtttgcagacacttgctttgtttcacaacaatttgcaaggtgctcttccaagagagattggaatgcttgggaagttggaaattttgtatctttatgataatcaattgtcagaggctatacctatggagattggtaattgttctagtttgcaaatggttgatttctttgggaaccatttcagtggaaaaattcccatcactattggaaggctgaaagagttgaactttcttcaccttagacagaatgagcttgtgggtgagattccagccaccttgggtaattgtcacaaactgaacattcttgatttggctgacaatcagctctcgggtgcaatccccgcaacgtttggattcctcgaggcgttgcaacagctcatgctctacaacaattctcttgaaggtaacctccctcaccaattgataaatgtagcaaacttgaccagagtgaatctttcaaagaacagattgaatggtagtattgctgcattgtgtagctctcaatcatttctttctttcgatgttaccgaaaacgagtttgacggtgaaattccttcccaaatggggaactcaccctcccttcagaggctgagattgggtaacaataaattctctggtgaaattccaaggacattggcaaaaatccgtgagctgtcattgttggacctctcaggaaattcactcactggaccaataccagctgagctttctttgtgcaacaaattggcatatattgatttaaacagcaatcttctttttggacaaataccatcatggcttgaaaaattgcccgagttgggagagcttaagctctcctccaataatttttctgggcctcttcccttaggcctattcaaatgttccaaattgctagttctctctctaaatgataactctctgaatggaagtctcccatctgatattggtgatcttgcataccttaatgtcctcagacttgaccacaacaagttttctggacctatccctccggagataggtaagttgagcaagatttatgagctctggctctctagaaataacttcaatgctgagatgccacctgagattggaaaacttcaaaatctccaaatcattttagacctcagttacaataatctctcaggccaaatcccatcttctgttgggactctgttaaagttagaagcacttgatctttcccacaatcaactcactggagaagtcccaccacatattggggaaatgagcagcttgggaaagcttgatctctcttacaacaaccttcaaggaaaattggataagcagttctcccgctggccagacgaggcatttgaaggaaacctacagctttgtggaagccctcttgagcgttgccgccgtgatgatgcttctaggagtgcaggcctaaatgagtcattggtagcaattatatcttccatttcaactttagctgcaattgctcttttgatacttgcggtgagaatcttctccaaaaacaagcaagaattttgctggaaaggcagtgaagtgaattatgtttactcttcctcttcatcacaagcacagagaagaccattgttccaactaaatgctgcaggaaagagggatttcagatgggaagacatcatggatgccacgaacaacctaagtgatgacttcatgattggttcaggaggttcaggcaaaatctacaaagctgaattggccactggcgagacggtggctgtcaagaagatttcatcgaaagatgaatttctgttaaacaaaagcttcataagagaagtcaagacactagggaggattaggcatagacatcttgtgaagctaataggatattgtaccaataaaaacaaagaagcaggttggaatttgctgatatatgagtacatggagaatgggagtgtatggaattggcttcatgggaaaccagccaaggcaaacaaagtaaaaaggagcattgattgggagacaaggttcaaaattgctgtgggattggctcaaggagtggagtacctccatcacgattgtgtcccaaggatcattcacagggacatcaaatccagcaacgtgttgctagataccaaaatggaggcacacttgggagattttggactggcaaaagcactaactgagaattgtgactccaatactgagtctaattcttggtttgctggctcttatggctacatagctccagagtatgcatacttgctacatgcaacagaaaaaagtgatgtttacagcatgggaatagtgcttatggaacttgttagtggtaaaatgccaacaaatgatttttttggagctgagatggacatggtgagatgggtggaaatgcacatggatatacatggctctgcacgtgaggaattgatagatcctgagctgaaacctcttttacctggcgaagagtttgctgcattccaagtgcttgagatagccttacagtgcacaaaaactacaccacaagagaggccatcttcaaggaaagcatgtgatcgtctcctccatgtattcaacaacaggacggtgaactttgagaagatgaatttggatcattacaaatga

SEQ ID NO: 2708 - DNA, 291 bp, Glycine Max
atgacgacatcaaggcgccttgcggacaggaaggtggagaagtttgagaagaacatcacaaaaagaggatttgtgccagacactaccactaagaagggaaaagactaccctgttggcccagtgctgctcggtttcttcgtctttgttgtcattggatcatataatcaggacagcaacgagtggaggcatggcttaaatggagctttgttttggattttgtgtcatcttctctttcttagcctcctcgtagaaaatgctaatacttctctacatgtactgtacttgtactag

SEQ ID NO: 2709 - DNA, 174 bp, Glycine Max
atgacgactgatgtgcagtggataactatggccactcatgcggcaacaattggctatacttgtgcaaagataaatgatttcaaatccttaagttcactctccctttttttgttttatggttttttctttcatttttctctatggtggcaaaggcagcggtgcatgagtacatga

SEQ ID NO: 2710 - DNA, 1776 bp, Glycine Max
atgacgagtcaatcggcgaagaacctattggttttgttggggctgggtttagctggaatagttctaatcaccagaaagctcaagaagtctgtcagaaaggatttgggggctttcattgagaagcttcagctgcttcctcctccccagcctgctcctcccaaggctccccatcccctcaccgcactcaccttcgcactttccgacctatttgacatcgaaggacacgtgtcgactttcgggcatccggagtgggctcggactcacgaacccgcttcttccactgctcctgctgtttccgctctcgtcgaaggaggtgctacctgcgttgcaactaccgttctcgatgacttagctctaggtattggcggtgaaaataagcattatggaacgcccaccaaccctgctgttcctgctcgagtacctggtggctcctctagtggtgctgctgtcgccgttgctgccgatttcgttgactttgcactgggtattgatacagttggcggggttagagtacctgctggattttgtggcattctaggatttcgaccttcacatggtgctgtttctcatttgggaatcatacctatttcaacaagtctggacactgttggttggtttgcaaaggatcccaatatattgcgtcgagttggccatatacttttacaagcaccatttgcaatgcaacgcagtcctcggcaaatagttatagctgatgattgttttcagcatataaatgttcctcttgacaggagttctcaagtggtggtcaaaaccactgagaagctttttggaaggcaagtattgaagcatataaatcttggggactatttaagttctagagttccaagcttgaaggggtgctctggacagaaaacaaatggtgaagtgaaagcttccgcattaaaattacttgccaacattatgcaatccctacaaaggcatgaattcagacttaaacatgatgagtggatgaacacagtaaaacctgaacttcatcctggtgtttcggcacaattgcatgaaaaattcgaggtatctgatgcagagattgaaaactctaaatctgttagaagtgagatgtgtgctgctgtaaattcacttttgaaggacgaaggaattttggttatccccactgtagctgatcctcctccaaaattaggtgggaaggagatcctatcagaggattatcagagtcgtgcatttagtctgttaagtattgctagcatatcaggttgttgtcaggtctcaataccattaggattttatgacaagtatcctgtttcggtgtccttgatagctaggcatggtggtgatcgatttttacttgacacactacagactgtgtatacaactctccaagaacaggctgatattgcttccaaaagcaaatcatctggaaatgctgtcagtaaggagcaatctgctgaaattgccaaagagaagggaaaccaagcctataaagataagcagtggcaaaaagccattggattttatacagaagctatcaaactctgtggtgacaatgcaacatattatagtaacagggctcaagcgtatctaggacttggaagttatcttcaagctgtggaggattgtacaaaagcaattagtcttgacaaaaagaatgtgaaggcctattttcgtagaggtacagctagagagatgctaggttactacaaggaagcaattgatgattttaaacatgcccttgtacttgagccaaccaacaaaagggcagcttcagctgctgaaaggttgaggaagctattccagtag

SEQ ID NO: 2711 - DNA, 1776 bp, Glycine Max; identical to SEQ ID NO: 2710

SEQ ID NO: 2712 - DNA, 702 bp, Glycine Max
atgacgagtccctcagtaaacaagaacatcctccagagtccagcatttcttaagtacatccttgaaacgagtagctatccaaatgagcacgaacaactaaagcaactcagagagaccaccgaacaaaagtaccaggaaaatatgggttatttgttgagtattccagcggaggaagcgcagttcatatctattttgcataaaatcctgaatgcgaagaaaacactcgaaattggagtattcagtgactactttcttcttgccacagctcttgctctgcctcttgatgacaagataacggcaattgatatggatagagaagcatatgagattggattaccctttattcagaatgcagaagtggagcacaaaatttactttcccgtggtgatgcattatcagccctcaatgatcttattgatacaaacagaatcatttggttatgtgcttgtggatacgaacaaagaagaatatataaagtattacgagttggtgtcaaaattggtgaaaaaaggtagactaattgcatatgataatacctcatggcatggttcagtggcaatttctgaagatgtaaaggaagatattataaggaagaacagaaaacccttgattgagttcaacaacttaatagcaaacgattctcgcttggaatcagctatcatttctattggggatggcttaaccctctgtagacgtctctaa

SEQ ID NO: 2713 - DNA, 915 bp, Glycine Max
atgacgattggtatcttgaactggcctccagatgaatcccatgttcatgccctcaacaactggcctcagaccagtcatggcagccccaatgcccatgcccgtgaaggagttctcagcaataggggtgtccaaaactctaaggtccccaaactttgtggcaagacctttaaaatatggatagcaaaaggattatggactgatattgatggcttgattctgtccatggaatcctttaaggatctggtattcgaacttatgatatcattaccagagaaattttgttcttttgtaataaccatgacaagtgtctggaagagtagaaatgaatacatttggaataataaagaggagaccaagatagggattatccagagggctgatactgtcttgtcagaatggaaagcggtgcagttcgtccagtggttgaagcccccaaacaggttctggaagtgcaacgtggacacggcatttatggatgaggaaggaaagtcgggttttggagcttgtctaagggatgatacaggagagtttatgatggcaaagacgggctggatgaatgcagtattgcgagtcaaggagggagaagcacatgcaatattacaaagtttattatggcttacaaatcagaacattcctaatattaagagcaaagaggaagatatcactggttgtgggtttattctaaaccaaattagagatattttgagatcttatccttcatactctattgaatatgtgagaaggcaagcaaatttggtggctgactctttagctaggaattccttcctttttgagcaacaccgaatcttccttaatactccacatttttttaaccatcatcaccttaactcttttttgttactgcaatattctttcagacctaaagaagttgtcatccctaaattttgtccgtaa

SEQ ID NO: 2714 - DNA, 1758 bp, Glycine Max
atgacgcaacaagaatcaaccatgtcactaatattcttacaactacttttactcttgtcatgcctaacactgaacaatagtattgcagaatcaaccaccatcatcaatgtgtggcccaaaccaaggaaccttacatggtccccaccataccaaaccaccctcctctcctccacattcaccatcaccaccaccaccaaccaccacaacaagcatctctccatcgccatccgccgctaccagaacctcatcaaatccgagcaccaccacccacttgtcccacaagcagtcaacatctccaacaaatacctcccaccactgcagactctcaaggtcacagtggtggacactgctgcagaactcgtccacgccgtggacgagtcctacactctctccatcctcccttcctcatgtgctaccctcactgcaaagactgtatggggtgccatgcgaggcttggaaacattctcccagctcgcatggggccaccccacgcaggttccagtgggcgtgcacgtgtgtgactccccactctatgcccaccgcggtgtcatggtggacaccgcgaggaactattatcccgtgaaggacttgatgaggacagtgaaagccttgagcatgaacaagctcaacgtgcttcacttgcacctcacggatgcagaatctttccctttggtgcttccttcggaacctgccttggctgaaaagggggcttatgcccctcacatggtctactcacccaaggatgtcaaaaaacttgtagaatttggtcttgatcatggggttcggataatacctgagattgacacacctggacacacagcatcttgggcattagcccaccctgacattgtaacatgtgccaacatgttctggtggccagccggaagggattggccacataggtttgcttcacaaccaggaacaggacatttgaaccccttaaaccccaagacttaccaagtcctaaagaatgtcatacacgacataaccacattgttcccagaaccatttttccactctggtactgatgaaatagtaccaggctgctggaaaactgaccctgcaattcagaaatacctatcaaatggtggaaccctcaaccaacttctcgagaagtatatcaacaacaccctccctttcattgtgtccctcaaccacaccgttgtcttctgggaagatgttttactggacaacatagtccatgtgccatctgcaatccttcccaaggagcatgtgattctgcagacatggcacaatggacataaccacactaagaagatagtttctgccggataccgaaccatcgtgtcatcggcggaattctattatctggattgtggacatggctcctatgttggcaacaacagtgcatatgacaatcaagatggtgacatgggcaatggcggctcttggtgtgcacctttcaagacatggcagaccatatacaactatgacatagcatatgggttgagtgagggggaagcaaagttggttttgggaggagaggtggcactttggtcagaacaatctgatccaactgttttggatgcaagaatttggccaagagcttctgcactggctgagtcaatgtggtcaggaaatagagatgaaaagggtgtgaagagatatgcagaggccacagatagattgaatgaatggagaagcagaatggtaagcagaggaataggtgccgagcccattcagccattttattgtgttaagaatcctggcatgtgtaacacagtgcatccagtctag

SEQ ID NO: 2715 - DNA, 1101 bp, Glycine Max; identical to SEQ ID NO: 204

SEQ ID NO: 2716 - DNA, 1101 bp, Glycine Max; identical to SEQ ID NO: 204

SEQ ID NO: 2717 - DNA, 219 bp, Glycine Max
atgacggaggagcagtggatcgcggtggtggcagacagtggtggtgcacggaggtgtcggatatggatagaagaaaaaaggaaaggagaaaaaactccgacggcggccaactggttgtttgcggtggagacgatgagagatgaaggaaagaaaaggggcaaaaaaggaaaaaaagaaaaaaaaatgagccatcggatggaaactagaaaaaaaaactaa

SEQ ID NO: 2718 - DNA, 1266 bp, Glycine Max
atgacgtcacactcccactacccacccgacttagacgccgactccgtcacctcctccccacgctccgatcacttccacgacgcgccgccccgcatccgcttcatgtgcagcttcggcggcaagatcctcccccgcccccacgacaaccagctccgctacgtcggcggcgacacccgcatcgtcgccgtcaaccgctccatcactttctccgccctcattctcaaactctccaaactctcaggcatgagcaacataacagccaagtaccagctcccgaacgaggatctggacgcgttgatctcggtcaccacggacgaggacgtggagaacatgatggacgagtacgaccgcgtcgcacacaatcagaacccgcgatcggcgcggctccggctcttcctcttccccgaaggagaagactcccgcgccagcagcatcagctcgctcctaaacggctcagccaagcgcgaaaactggttcctcgacgctttaaacggcggcgtttcgggcctcgaacgaggccgctccgaagcctcttctatggtctctgaagtacccgattacctcttcgggttagacaactccgaagaaataacaaatcaccaacgcgacccgagacccaaacccggacccattattcaagataacgtttccgtttcagatccgggttcgcccgccccggttgtctcgtccccttattgttccacgtcatcagcgccgcccgtgccctctctcccgaaccttccctatgttaaaaccaaacctttaaacttaaatccggttcctgatactgactccaaggaaaatcaaaccgaacctgaaacggaacctcacccgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatgacggtttgaaacagcacgtgtatcatgccgtgccaaattcgggtccggttccggttcacccagttattccgatgacgggtttggatgaaccgcagagaggtggagcgtaa

SEQ ID NO: 2719 - DNA, 399 bp, Glycine Max; identical to SEQ ID NO: 206

SEQ ID NO: 2720 - DNA, 315 bp, Glycine Max
atgactaactggcgcagaccaaagggtatcgattctcgtgttaggagaaagttcaagggatgcactttgatgccaaacattggttatggttcagacaagaagacccgccactatctccctaatggtttcaagaaatttgttgttcacaatgtgaaggatttggaactgctcatgatgcacaacaggacttactgtgctgagattgcccacaatatatccacaagaaagagaaaagatatagtcgagagagccgcgcagcttgatgttgttgtgacaaacaaaacggccagattacgcagccaggaggatgaatag

SEQ ID NO: 2721 - DNA, 639 bp, Glycine Max
atgactaccatggagattaagctatggaatgacaagcgcgaaagagaaatgtatgacaactttggggagctttatgccattatcaaagccactgagaggcttgagaaggcctatgttagagatataatttcaccgcaggaatatgagttggagtgccagaagctcatagctcatttcaaaaccttagcttccacccttaaagacactgtgcctagcattgagcgatttgcagatacttacaagatggagtgccctgcagcgattaaccgtctcgtggtttctggtgtgcctgccaccgtggagcatcgtgcaactgcggctgcctctgcttccacctctgccgctactgtggccgagtgtgttcagaattttattacttcaatggattccttgaaacttaacatggtggctgtggatcaggtgcacccattgctctcggacctttatgcttcgcttaataagttgacaatcctgccgcctgattttgaggggaaaaccaaaatgaaggaatggattgcaaggttatctaagatgggtgcagctgatgagttgacggaacaacaggcgaggcagcttcactttgatcttgagtcttcttacaattcctttatggcagccctgcccaatgctggtacatga

SEQ ID NO: 2722 - DNA, 615 bp, Glycine Max
atgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtaccgagccttatccatgtacataggcaatcatcggaatccattcttagcaattcatctaaccttcctgaagatggtggtagcgacacatctctcaagttggggttaccttaa

SEQ ID NO: 2723 - DNA, 615 bp, Glycine Max; identical to SEQ ID NO: 2722

SEQ ID NO: 2724 - DNA, 618 bp, Glycine Max
atgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaa

SEQ ID NO: 2725 - DNA, 3270 bp, Glycine Max; identical to SEQ ID NO: 207

SEQ ID NO: 2726 - DNA, 288 bp, Glycine Max; identical to SEQ ID NO: 208

SEQ ID NO: 2727 - DNA, 414 bp, Glycine Max
atgactccaaagccccaaaacaaacctttctgtaaccctaacactgcgaatcgaggaaaacacccttcggtggaatcatcactgcgtcttcttcaaccaaccaccgcgaccagagctcttctccgccgcgtccggagctcttctccaccacgttcaagttgtttaaggataatgggtcggaaagctggtacgctttttatcaaccccaagagattcggtaatcttcaaaaaccttgcatgaaggaaatggcattgtttctcagttgtatggctgcaaaccatagtgacaccgaagcctgtgctcgtcagaaggagctattgaatgtctgtattgatgctcagagtaaaaagaacagaaagtcttgggggagtatcaattatcaactgcagaggcttaaccgaggaaggaagtaa

SEQ ID NO: 2728 - DNA, 1377 bp, Glycine Max
atgactcgcggcataaaacaccgtcagaaagccaagagcaagaagaagggctcgaagaaagagggtggttcttcttcatctttggcgccagaaattccagcgaaggtgtggcaaccgggcgtggataagttagaggaaggtgaagagcttcagtgtgatccttctgcttacaattctcttcatgcctttcacattggatggccatgtttgagctttgatattttacgcgactctttgggcttggttcgaacagaatttccccacacagtatatttcatggcagggactcaggcagagaaaccttcttggaattctattggaatttttaaagtatcaaatattactggaaagagacgtgagccagtgcctaaacttggaactgatgacactgaaatggatggtgaggatagtgacagtgatgatgatagtgaggaagaagacgaaggtggtgctcagggtcccagtttgcaggaaacttcctcttcatttgatactaacattttgattcttttcgcatctacagtctgggacctaaactctcacctcaatgttctagctgagactgaaacagaaggtgtccaaggagttgctgcagtttttaatcaggacccattgtataaatttaaacacaaagatgaaggttatgctatagactggagtcctcttgttcctggaaagcttgcatctggggattgcaataattgtatttatctgtgggagcctacatctgctggaacgtggaatgttgataatgctccatttattggacatactgctagtgttgaagatctgcaatggagccctacagaatctcatgtttttgcttcttgttctgtggatggaaacattgcaatatgggatacccgtttggggaagtcaccagctgcatcttttaaggcacataatgctgatgtgaatgtaatgtcatggaacaggttggctagttgtatgttggcctcggggagtgatgatgggactatttctattcgtgatctcagactgctcaaggaaggagattctgttgtagcacatttcgaatatcacaagcacccaatcacatccattgagtggagtccacatgaagcctcttcattggcagtttcttcatctgataatcagcttacaatatgggacctttctttagaaaaggacgaggaagaggaggctgaatttaaagctaaaactaaagaacaagttaatgctcctgaagatctgcctccccaactattatttattcatcagggacagaaagacctgaaggaactacattggcacacacagattcctggaatgattgtatctaccgctgaagatggattcaacgtccttatgccttcaaatattcagagcacactgccatcgaatggtgctttgtag

SEQ ID NO: 2729 - DNA, 1479 bp, Glycine Max; identical to SEQ ID NO: 209

SEQ ID NO: 2730 - DNA, 1056 bp, Glycine Max
atgactgcaactggagtggccgtgtcgttggggttggggacattctctaactgttactgttacccagtgcctgtaaaggaattgcttttttctacaacgcgcattcgcaatcggagtaggaagaagcgttttggttttggtcaaaaaaggttttgcgttggagctgcaaatgcaaatcatgagtttgatccagagctgcgatctgtgcttgaacttgccaccgattctgagttgtacgagattgaaacaatccttttcgggccaagctacttgagtcctttgctcaaatccatcccattggcattcacaaacacaaacacaaatgatgacctcgaccgttccatgattggagtcgaccttggactacgccaacaatttatagcagctctcgagtcccgattcttcttccttgctgctgatgcccgctctaccttaaggggttggaggccttcttatagaaatgtcttgcttcaaataaggaaaaaattaaatattccttgctcaacccaattgtctactcacgaccttgaacttgaaattttcctccaccttttgcactgcaactcaactgaagaagaatcctctcaaggtcaggccactctacaacatggacttagtcaatggaaagtgcagtcaaaagttggggcccaagacattccatcaattcttttaaagggaggtggtgtatttacactgtccaagatataccaattgttagcaaggaaattatctgggaaagttcttgtagaagctgccaattaccaggttaagaaagagttagtgaagaagggtgggcagttagctatgattaatctagaatccagagcagccatgcttgcagcaaaacagggttttcttggtgctgcatcaagatatctgggctttagaagcgtggtcacattacttggacctgtgctttggggaacgtttttggctgatcttgtcattcaaatgcttggaacagattatgctagaatcttgcgaacaatttatgctttggctcagattcgagtcatccgcacatatcggctgtcttcggaagtcactgatgaatag

SEQ ID NO: 2731 - DNA, 666 bp, Glycine Max
atgactgccacagctgatcaatgcatgcatgagttttatcaacaacctctcatggatggcatggctatggatccatccatagaaggactcatggatgcatccatgtcatcatcatcagagggcatgatcatgttgagcccaagcaattcacacaacaacacaacaattggccaccacaatttaactccaaagggttgtgcattcaaacaaatccgaaggagatctagagcttctaagagcactccaattacccttctcaaggccaacacctccaatttcagggcattggtacaacaattcactgggtgtcccaccacaacagccatgtcacttgcaatccataagggtcccgttaccttaaatttccaacaaggtggtagcaaacaacatattcatcatcatcaccacacaaaaataacaactagaggagcaatgccaccgtttattggcaccataagttctaaccaaaaccaagtttctgtgccacttccaaagcaacacttgatgcaagagcagcaaagtggacactttcttccaacttcgtcgggtaactcttataggccaattaattgcatggatgatggattgatctttgataatgattttagtttacatgagctaaccgtgaatgccatctccaatgatatcgatgatttatttatgtga

SEQ ID NO: 2732 - DNA, 690 bp, Glycine Max; identical to SEQ ID NO: 210

SEQ ID NO: 2733 - DNA, 816 bp, Glycine Max
atgacttacacacctttctctctctgcccctccgattccgacctcgccgaatccctaatcctccgcggctgccaccccctcccccgccgccgctgcttctccaaaacaccacagaaacaaattcccccaaattccctccctaaaaaccccttcccttcctccctccctgacaacgctgtaatttgggatcattaccaatgcaaatcgttcgattgcttgaataaacaaaaccctaacctcggcttccaaccttctcgtgatatttcgaggttcaattcgtataagactgatttggatctcccgatccagcagctgtttcagatcgcggcggccgcgaagtcggtgctgcgcctcggcctcgacgtcggcggcggcaccggctccttcgccgcagcgatgaggctccgcaacgtgaccgtggtaaccacgaccatgaacgtggtggcgccgaacagcgaggccgtcgcgctgcgggggctcgtgccgctgcacatgccactgcagcagcggcttccgctgttcgacggcgtcctggatctagtgcggtgcgggcgcgccgtgaaccggtggattccgttgacggtgatggagtttctgctgctggatgttgatagggtgctgaggggaggagggtacctttgggtggatcattttttcagcaaaggggtggaccttgagaaggtgtatgcgcctttgatcgggaaattggggtacaagaaggtgaagtgggcgacggggaataagaccgatgccggtggggtaaaaaatggggaagtttacttgactgcgttgctgcagaagcctgtgtccagatga

SEQ ID NO: 2734 - DNA, 711 bp, Glycine Max; identical to SEQ ID NO: 211

SEQ ID NO: 2735 - DNA, 213 bp, Glycine Max
atgagaaaaatttgctgtgatctatggctaaaagctgtttttcctcttcacagtttactttattcttcgtttttctttccctttctaatattccttccatcaggggcacggaaagcagagtttcaccaccaaggaaaggccacaaccatggctttggattatggttgtgttaaagggaaccaatatattgctcaagagcctccctacttttaa

SEQ ID NO: 2736 - DNA, 768 bp, Glycine Max; identical to SEQ ID NO: 212

SEQ ID NO: 2737 - DNA, 528 bp, Glycine Max; identical to SEQ ID NO: 213

SEQ ID NO: 2738 - DNA, 1224 bp, Glycine Max; identical to SEQ ID NO: 214

SEQ ID NO: 2739 - DNA, 1176 bp, Glycine Max
atgagaacaaggagaggtgcgtgttatcctggtgtagtctcaaggatgtgctccaatgtgagggttacgaagaaaaaaagcaaggatctgcacatgcatatgcatgttcctgccggagactccattatttatagccggaaaaagcagaagaaaacgccggaaaaactcgccgccggtcgttacgattttttcgagtccttgccggatgacctcgtaatctccatcttctgcaagcttagttccaccgccactaaaccttccgatttcgtcaatgttttaatcacgtctaaaagattaaacagattagcacttcattcgcttgtattatccaaagcctcgccgagaactttcactattaaagcaaaatattggtgcgattcggcacacaaattcctcaaacactgtgccgatgccggaaacattgaagcttgctatactttaggcatgattcggttctactgtttgcaaaaccgagggagcggcgcgtcgttgatggcgaaggcggcgattaactctcacgcgcgggctctctacgcgctggccgtgattcagttcaacggaagcgggggcacgaagagcgacaaggacctacgcgccggcgtggcgctatgcgcaagagcggcgtttctcggacacgtcgacgcgctgcgcgagctcggccactgcctacaggacggttacggcgtacggcagaacatcgccgagggacggcggttcctcgtgcaggccaacgcgcgtgagctcgccgccgtgctgtccaccggcgccgccgcgcgtaccttgctgagttggaatcttcagccgcagcagctccggcaggggtccgggtgtccgcttctcagcgatttcggatgcaacgtgccggcgccggatgtgcatccggcgagcctgttcatgactgagtggttcgccgctcacggcggttctccgggaccggggctgagactctgttctaacgcggggtgcgggaggcccgagacgaggaagcacgagtttcgaaggtgttctgtgtgcggcgaggtgaattattgctcacgcgcgtgccaagcgcttgattggaagttccggcacaaagcggagtgcgcccccgtggagcgatggctcgacgaggacggcgaagatgtcggtaacgacgacggtgacggagaggtcgaggttgttatggtagatagttag

SEQ ID NO: 2740 - DNA, 999 bp, Glycine Max
atgagaacattcagctgcagagctacttcacaaggcaagtaccagcaaagatcaacttgcagtgttgaaaatatcttccatagggactatggaggaaggtttttacaagttgaaggatggcatcaacatcagtatttgttatgtgcaagaggagttgagttgtccccttctgccaatgaagaagttggagaggagactgaggaggatatctcaaaggaaacgttgatttggagagccatcaagttgccaatttactctgttgcatttgttcctctcactgtaggcagtgcagcagtttattttcagacagggatcttctcagctagatgttattttgttctcctggcttcttcagttcttgctattacctggctcaatttaagcaatgatgtttatgattttgacactggagttgacaagaacaaaaaggaatcagttgtaaacctggcaggtagccgtaaaggaaccttcattgctgcctacttgtgccttgctattggcttccttgggctgacttggactgctgttgtggaaagaaacatacgttcaatattgtttcttgtttgtgcaattatttgtggctatatatatcagtgtccaccatttcggttaagctaccaggggctgggagagcccttgtgctttgcagcatttgggccttttgccacttgtgccttttatttattacatggcagttcaagtgtgatgaaccatttccccttaagtggaacggttctttcagcatcaattcttgttggcttcacaacatctcttatcttgttttgcagtcatttccatcaggtggaaggagacaaggaggttgggaaaatgtcacctttggttagacttggcactaaaaaaggtgcagaggtagtgaaaggggcagtctttatgctctatgctcttttggttgcttttggtctaatcaaggcacttcctctcacttgtatagtatttcctttgtgcattgaccttgccgatgggaaacctggtagttag

SEQ ID NO: 2741 - DNA, 309 bp, Glycine Max; identical to SEQ ID NO: 215

SEQ ID NO: 2742 - DNA, 987 bp, Glycine Max
atgagaaggaactcttcctctcttgtgttgcttgatgttatattcatcaaaccttcaaagcccactcccaccacaattctttcactgtctaccattgagagtgtttctgagaacaatttcttctcgcaagccgcaattcccttaacactaccaaacttgaccctgcaaaaacatgctgatggaaaattcagaatcaactgcacctccgaaggaattccaaggctctcttttactattatcctcttgcaggacagaattccattcacagaggctatttgtcactgcaacctctcttctcttcattacctagacgtcaaaatcgcaaaacactttgcgatggattttccttctcaagatgaatttggaaaccaatatcctttggttttgaaggtgactaaattcctctgtagagttttcatatttatagtggggtggtctcacgatgtttgtgatgggactggtgtatctcagttcttacgagccgtggcagaacttaagcctgtgtgggaaagagaaagactagtgggaacatttactagtggagagagagagcatagcaagactcaagatgagtttgatgaaagaaagtggcaatggagaaagtacggagaaaaaaggaccacgcttacaggatcctttgtcccgtggatatacgggaatgccatcgtgcaggcatttgttacgttaacagtgaaggagctcaacgaaagaccactcttggaggttgtgaaactcatcaaagacagcataaaggaaacgaaaccaatgaaatttaattacgaaagtggtgcaataactgttttgacagattggagacatttggctatgttggaaaagtcccttgcgggtttgtgcaggatcctgcctcctagtaatttggatccatcaatgagtggaggaactagggtttatgtatgcctacctagggctgccatgtccaagttcaaggaagagatgaaagctcataacagtatcaaaaatgcgtag

SEQ ID NO: 2743 - DNA, 1620 bp, Glycine Max
atgagaagtgtatcaaagcacttacaattgttgcgcccaacaacaagctcgcgttgttgttcatacagtgctaactcgtctcactctcatggaacgaaaacgcgttcaccgccacatattctcaaatgggcatcacccaaaaacatttttgaccaactctctcatcaacatgtcaaattcaacctcttggaagaagcgcaggtactgttcgataaaatgtctgaacgaaatgtcgtgtcatggactactttgatatctgcttactctaatgccaagctcaatgacagggccatgagtttcttggttttcatctttagggttggtgtcgtgcctaacatgtttactttctcttcggttctgagggcgtgtgagagtttgtctgatctcaaacagctgcattctttgataatgaaagtggggttggagtctgataaaatgggggagttgttggaagctctaaaggtttttcgtgagatggtgacaggagattctgctgtttggaactccattattgctgcttttgctcagcacagtgatggtgatgaggctttacatctttacaagagcatgaggagagtgggttttccggctgatcactcgacgctcacgagtgttttgagatcgtgtactagtttgtcgttgttggagttagggaggcaggcccatgtccatatgctgaaatttgacaaagatcttatcctcaacaatgcccttttagatatgaattgtaggtgtggtactttggaggatgcaaagttcattttcaattggatggccaagaaggacgtaatctcttggagcaccatgattgctgggttagcccaaaatggttttagtatggaagcactcaatttatttgggtccatgaaagtgcaggatccaaaaccaaaccatattacaattcttggggttctgtttgcgtgtagtcatgcagggctagtaaatgaaggttggaactattttcgatctatgaagaacctatatgggatagatcctggaagagaacactatggttgcatgcttgatcttcttggaagagctggaaagcttgatgacatggttaagttaattcatgaaatgaattgtgagccagatgttgtgatgtggaggactttacttgatgcatgcagggttaatcagaatgtggatttagccacgacatatgtgttgttatctaatatttatgcaatttcaaaaaggtggaatgatgttgcagaagttcggagtgctatgaaaaaaaggggcataaggaaagaacctggatgtagctggattgaagtcaataagcagatacatgcttttattttgggagataaatctcatcctcaaatagatgagatcaatagacagttgaaccaatttatttgtagactagcgggtgctggttatagagaagactctcttcgataccacagtgagaaactggcaattgtttttggtattatgggctttccaaatgagaaaactattagaatctggaagaaccttaagatctgcggagattgtcataaatttgaaaaactcatagcaaagttagagcaacggcatattgtaattagagaccctattctataccatcattttcaagatggggtttgctcctgtggtgactattggtag

SEQ ID NO: 2744 - DNA, 225 bp, Glycine Max; identical to SEQ ID NO: 216

SEQ ID NO: 2745 - DNA, 1059 bp, Glycine Max
atgagagaaatcatcagcattcacataggtcaggccgggatccaggttggcaactcctgctgggaactctactgcctggaacatggcatccagcccgatggcatgatgccaagtgactcctccttcggtgtagcccacgacgccttcaacaccttcttcagcgaaaccggatccggcaagcacgtccctcgcgccgtcttcgtcgatctcgagcccaccgtcatcgacgaagtccgttgtggcacttaccgtcaactcttccaccccgaacaactcatctccggcaaggaagatgccgccaacaactttgccagaggccactacaccgttggcaaagagatcgtagatctgtgcttggatcgcgtccgaaagctcgcagacaactgcactggtctccagggcttcctcgtcttcaacgctgtcggcggtggcaccggttccggtctcggatctctcttgttagagcgtctctccgtcgattacggcaaaaagtccaaattagggttcaccatttacccttcccctcaggtttcaaccgcagtcgtggagccctacaacagcgtcctctccacccactcccttctggaacacaccgacgtggctgttctcttggacaacgaagccatctacgacatctgtaggagatctctcgacatcgagaggcccacctacaccaacctcaacaggctcatttcccagatcatttcgtcgctaaccacttccttgaggtttgatggcgctatcaatgtggatatcactgagtttcagaccaaccttgtgccataccccaggatccacttcatgctttcttcttatgctccggttatctctgccgccaaggcctaccacgagcagttgtcggtgccagagatcacgaatgccgtgtttgagcccgcgagcatgatggccaagtgtgatcccaggcatggcaagtacatggcttgctgcttgatgtaccgtggtgatgttgttcctaaggacgtgaatgctgctgttgccaccatcaagactaagaggactgttcagtttgttgattggtataattttctctcattctaa

SEQ ID NO: 2746 - DNA, 1353 bp, Glycine Max
atgagagaaatcatcagcattcacataggtcaggccgggatccaggttggcaactcctgctgggaactctactgcctggaacatggcatccagcccgatggcatgatgccaagtgactcctccttcggtgtagcccacgacgccttcaacaccttcttcagcgaaaccggatccggcaagcacgtccctcgcgccgtcttcgtcgatctcgagcccaccgtcatcgacgaagtccgttgtggcacttaccgtcaactcttccaccccgaacaactcatctccggcaaggaagatgccgccaacaactttgccagaggccactacaccgttggcaaagagatcgtagatctgtgcttggatcgcgtccgaaagctcgcagacaactgcactggtctccagggcttcctcgtcttcaacgctgtcggcggtggcaccggttccggtctcggatctctcttgttagagcgtctctccgtcgattacggcaaaaagtccaaattagggttcaccatttacccttcccctcaggtttcaaccgcagtcgtggagccctacaacagcgtcctctccacccactcccttctggaacacaccgacgtggctgttctcttggacaacgaagccatctacgacatctgtaggagatctctcgacatcgagaggcccacctacaccaacctcaacaggctcatttcccagatcatttcgtcgctaaccacttccttgaggtttgatggcgctatcaatgtggatatcactgagtttcagaccaaccttgtgccataccccaggatccacttcatgctttcttcttatgctccggttatctctgccgccaaggcctaccacgagcagttgtcggtgccagagatcacgaatgccgtgtttgagcccgcgagcatgatggccaagtgtgatcccaggcatggcaagtacatggcttgctgcttgatgtaccgtggtgatgttgttcctaaggacgtgaatgctgctgttgccaccatcaagactaagaggactgttcagtttgttgattggtgtccaactggattcaagtgtggtatcaactaccagcctccttctgttgttcctggtggtgaccttgccaaggtgcagcgggctgtatgcatgatcagcaacaacactgcagttgctgaggtgttctctcgcattgaccacaaatttgatctgatgtatgccaagagggcctttgttcactggtatgttggtgagggtatggaagaaggagagttctctgaagctcgtgaggatcttgctgctcttgagaaggactatgaggaggttggggctgaaggagcggaagatgatgaggaaggagaggactattcataa

SEQ ID NO: 2747 - DNA, 1044 bp, Glycine Max
atgagagaaatcatcagcattcacataggtcaggccgggatccaggttggcaactcctgctgggaactctactgcctggaacatggcatccagcccgatggcatgatgccaagtgactcctccttcggtgtagcccacgacgccttcaacaccttcttcagcgaaaccggatccggcaagcacgtccctcgcgccgtcttcgtcgatctcgagcccaccgtcatcgacgaagtccgttgtggcacttaccgtcaactcttccaccccgaacaactcatctccggcaaggaagatgccgccaacaactttgccagaggccactacaccgttggcaaagagatcgtagatctgtgcttggatcgcgtccgaaagctcgcagacaactgcactggtctccagggcttcctcgtcttcaacgctgtcggcggtggcaccggttccggtctcggatctctcttgttagagcgtctctccgtcgattacggcaaaaagtccaaattagggttcaccatttacccttcccctcaggtttcaaccgcagtcgtggagccctacaacagcgtcctctccacccactcccttctggaacacaccgacgtggctgttctcttggacaacgaagccatctacgacatctgtaggagatctctcgacatcgagaggcccacctacaccaacctcaacaggctcatttcccagatcatttcgtcgctaaccacttccttgaggtttgatggcgctatcaatgtggatatcactgagtttcagaccaaccttgtgccataccccaggatccacttcatgctttcttcttatgctccggttatctctgccgccaaggcctaccacgagcagttgtcggtgccagagatcacgaatgccgtgtttgagcccgcgagcatgatggccaagtgtgatcccaggcatggcaagtacatggcttgctgcttgatgtaccgtggtgatgttgttcctaaggacgtgaatgctgctgttgccaccatcaagactaagaggactgttcagtttgttgattgttggtga

SEQ ID NO: 2748 - DNA, 1332 bp, Glycine Max
atgagagaaatcctccacattcagggcggccagtgcggcaaccagatcggagccaagttctgggaggtgatctgcgatgagcacggcatcgaccacaccggaaagtacagcggcgactccgaactccaattggaacgcatcaatgtctactacaacgaggccagcggtggaaggtacgttccacgcgccgttctcatggatctggagcccggcacaatggactcggtcagatccgggccgttcgggcagattttccgccccgataacttcgtcttcgggcagtccggcgccggcaacaactgggccaagggtcactacacggagggcgccgagctcatcgactccgtcttggatgttgtgaggaaggaggccgagaattgcgattgcatgcaagggtttcaggtgtgccactctttggggggtggaactggctcgggcatgggaacacttctcatctcgaagataagggaagagtaccctgatcgtatgatgttgactttttccgtttttccttcccctaaggtgtcggacacagttgtggagccgtacaatgccaccctttctgtgcaccagctcgttgaaaatgccgatgaatgcatggtcttggacaatgaggctctctatgatatctgttttcgtaccttgaagctcgctacaccaacttttggggaccttaaccacctcatttctgctaccatgagcggagttacttgttgtctacgtttccctgggcagctgaactctgatcttaggaagcttgccgtgaatctgatcccattccctcgtctccatttcttcatggttggatttgcacccttgacatcaagaggatcccagcagtaccgcaacttgactgtgccagaactgactcagcagatgtgggattctaagaacatgatgtgtgctgcagatccacgccacggtcgttatttgaccgcatccgcaatgttccgtggtaagatgagcaccaaggaggtggatgagcagatgatcaatgtacagaacaagaactcttcctactttgtcgagtggattcccaacaatgtcaagtctagcgtgtgtgatatcccaccaaagggccttaagatgtcatccactttcattgggaattcaacatcaatccaggagatgttccggagagttagcgagcagttcacggcgatgttcaggcgcaaggctttcttgcattggtacaccggtgagggaatggacgaaatggagttcaccgaggccgagagtaacatgaatgatctggtggcagagtaccagcaataccaggatgctactgttgacgaggaagagtatgaggatgaagaggaggaggaggcttaa

SEQ ID NO: 2749 - DNA, 2862 bp, Glycine Max
atgagagaagaggttatcagctccggaggcaccgttgatccaacacctgctgccagcctagcattcactaccacagtatgtagctggttgtatagcagtatgataaattgtgatatttttataagacactcaattttctgctggggcatcatccccagctgttccaatgaatgttggcagcatagatgggtcaacacaagtgctggtggttctgcttttggttcttcaagatcttcatgtagaccttgggaaagaggagatttattaagacgtttggctacatttattccttcaaattggcttgggaagcctcagatcatcagttcattggcttgtgctcagaaaggctggatgaataatggtgtagacaaaattgcttgcgagtcatgtggttcttgcctgagttttacagcattgccatcttggacattagctgaagctcaaaatgccaacgaatcctttgccaggcagctggattcgggtcataaagttaattgcctttggaaaggaaacagctgtcctgaaagcttagtgcagttccctccaactcctccatctgcattaattgggggctacaaggatagatgtgatggactcgtacaatttcacagccttcctgtggtagccatctctgcaattgagttgatgtctgtttctcgtggcccgcaaattgaacgctttctatcacagtctcagaattttatgtcaggagaagtagatatcaaaccagacattgtatctgaccttgaaaatgctcaagatgaggcatactgtttatactctcgcgcacagaagcttataagcctttgtgggtgggaatcaagctggcgtttaaatgttcaagattgtgaagaacactctgcccaatctgaaagaaatggatattcttttggcccaagcaagactcaacttcatcttactcaagatcccgggtcaaaggcagtttctgcttctactaaattggatgccagaaaggccaaggcgcctcttaaggagcctagacttgactctaggtcacctttgcttgattgtagcttatgtggcgctacagttagaatttcagattttctgacagttcctcgtcctgctcgttttgcatctaacagtatagatattcctgatactagtaaaaaaataggattgactcgtggagcgagtgctgctagtggaatcagtggttggattgcagctgatgatacagagaaagatcagactgaagaccgtgacgaagttgcaacaacgaatgaggggaaattgttggcgaacacagatttagatttaaatctttccatggcagggggttttccttttactcctttgggcaggacagcaacatctgaatatactcatgaggatatgggaagggatttaatgattggccagccttcagggagcgagattggtgatcgtgcagcttcatatgaatcacgtgggccaagctctcgtaagagaaatcttgaaaaaggtggaagctcagataaccggcctgttcttaggctgcagcagcaggctgatagtgttgaaggaactgtcattgatcgtgatggtgatgaagttacagatggtggacaatattcagctggtccttcaaaacgtgcacgtgactctgatattttcgacacatattgttcacctcaacaaagagactcatctggtgccggtccgagtcattcaatgggtttagaggcttacattactggaaatcgagtttcttcataccgtcaaggtagtgacctcccaatgggtatccaatcagctagagactcaacccgtgcatcatctgtcattgcaatggacacaatatgtcatagtgtgaatggtgattctatggaaagtgttgaaaactaccctggagaccttgatgatgttcatttcccctcctctagcatgtatggcaatgtggacatgaatgaaacatctgaactgaataacagcaatcaagctcagcaaagcacttgcttacaaacagctactgaagttgcccgtggtgatgtgggtgtcagtagtacaaactatggggaagaacttttcaatgcagaaactgtgactgctcaggctcgtgatggaatcagtttgggcatcagtggagggagtgttggaatgtgtgctagtcatgaagctgaaatccacggggctgatatatatgtgcacagagctgatagtgttgttggtgaaatggaacagagagtagaagatgctgaaaaccagggacagacaggtgagtctgttccagatccaggtctgatggatgagattatccctgatatgaacagggaagatcctattggtgatagccaggagatgatgtctcactctgcaggaagaacagacagtgggtcaaaaattggctgctctacagaatctgttgaaagtggtgaaaagattagtcaaaactgcaatcttctacctgctaatagtagtcacccttctcgttcttgtaatgctaatatttactctggttgtgaaaatactaaggaagagatcatgaagcgtgataaatcatcatttgccaacaatagtgctctccctgaatcagattttgccattgcaaatgggataggccctccaaaaggagagagtaattatgaagctgcagagtttgatcctattgtgcatcacaatcaatgttgcccttgggttaatggcaatgttgctgctgctggctgtgctagttctgttccaagcacaagtagtgatgcaattgccctttgtggttggcagctgacgttagatgctttggatgctttgtcgctggggcacaatgcaattccaacagtaccatctgaatctgctgcatccctgtacaagaatgaccagcaagcacctggtcaaaaactctttcgcaaccactctatgagctga

SEQ ID NO: 2750 - DNA, 1803 bp, Glycine Max
atgagagagtctctgcagaatgcattctgcttatcttgtgggggtctacccgtgggatcagtagagcgaaaacttcaattgcaatcattaaaggcaaaaaatattcaattagctaaagaggcaactcttgctagtgatccttggcttggtcaagatattcctcatcttcccactcttgccacattggatcaagatattccacctcttggtcaagatacttctacccttcctcaggatcatatgcccaaggatcttgatcaagaattggatgcattgcgcggaattttgaacaatgatttgatattccaatctatcattaaccaaaggatagacctggacaatgcaatgatgtcacaaattgcaaataatgcaatcgaagagttaattaagcttttggatatgaaccaacccttctggtctatacatgactggaagttagttcttaaacgtgataattaccaaagcatacttggtaggagacattgcttacctggacctcatgcacggatagaatcctcaaaagattcacgaatagtggacatgaatgcggaacaacttgttcaaatgtttatgaatttggaaaaatgggttgatctgttcccaacaattgttacaaaagcccaaacaattcaagtactcgaaaacggtttggtaggaaatcgaagtggagctttgttgttgattaatgcagaaatgcacattctttcacatttggttccaactcgacaattctacttccttcgttattgtaaacaaattaaagaaggtgtgtgggtgataggggatgtgtcaattgattccttagaatacaaaaccattgttcctcgcatttggaggcgtccatctggatgcctcattcaagaaatgaatcacggattgtgcaaggtttcttgggtggagcacgtggaagtggatgataagatgcaaactcaccagcttttcactgatgttatttgttgcaataatgcatatggagcagaaagatggctttcgacacttaaaagaatgtgtgagagatttgcatgcgcttcagctgaaactatacccagttgtgacgagtctggagaagccattttatcacttgaaggaaagaagagtgtgatgcacttggctcatcgaatggttaagactttttgccgcactttagacgtgtcagattgtgagaacttcccatatttaacgaggatgatgaataatggtgaggttacaataattgttcgcaagaataactcagaacaagatgtgccacaaggcttgattctcagtgctgctacctcttttctacttccgcactctccagaaaatgtttttgacttcttgatagacaacaagaaacgagctaagtgggaacctttttggtatggaaagccagggcacgagattcaacgcatctcaactggaaataatccaggaaatttcatttcaattacgaaggctcttggccccagtgataacaatatgatagttcttcaagaaagttatgcagatggtttgggatctatgatggtatactcagcttttgatacggagacaatgaattttgccatgaggggagaagacacgtcacagttgttggttcttccctctggctttaccatatctggggatggtcattcaaatgcttttgaaggacaatctagacaagtggtgtcaaaaggttcattggttactctaatgttacaagttctagcttctagtactcctagcatggacatgatagacatggaatttgtaggttctgtcactacacttgtgtcctcaacagtggagaaaattaaagctgctttgaattgttccaattaa

SEQ ID NO: 2751 - DNA, 1104 bp, Glycine Max
atgagatacgtggaagacaaagggtgctataacaacaatggaccaacacaagagaccccaaatagcagtgccatgtactcagagtttcacaaaggaaaagatgctactagtgtctccaaccaccaccatcgagcaaccatgggaaaaccaacaccttctaagtgggacgatgcacaaaaatggcttgtggggttgtcaaaaggtggtggagagaaaagccactccaaaagcaagccaagaaactcaaacgcagatgatttgagactcatagcacctgtgccacagaaggagaatgattactcaagtagcgagaaggaagaggaggaaaatgatgcatgccatgatttcatcatgactaataatattattagtgctaatgctactgctgctcaatatgaagctgaagccaaaagggtggaatgtgatgagtcaaattggagaagcaataataacaataataaaaggtcttcagaaaattacacaatccaagtgcaaccaatatgtttcagagacatggggactgagatgacaccaattgctagccaagagccttcaagaactgggacaccaattagagccacaactcctgctactagaagcccaattcattcaggggcttcaactccaatgaggggtcaaaatgggtcacaacatgttgctgagactactaggaaatgtggaaatggagaaggatcaacaagcccttgcaagaggactcatgaagatcatcaagctagaaagttgagtcctctagaaagccgagcaatggcttgggatgaggccgaacgtgccaaatatatggccaggttcaagcgtgaagaggtgaagattcaagcctgggaaaatcatcagataagaaaagctgaaatggaaatgaagaaaatggaggtgaaggctgagagaatgaaagcattggcacaagaaaggtttacaaataaactagcttcgactaagaggatagctgaagagaaacgagctaatgcacaagtgaagctgaatgacaaagctttgagggctactgaaagggttgagtatataagaaggacaggacatgtgccttcttctttctctttaagctttaagttgccttccatttgctggtag

SEQ ID NO: 2752 - DNA, 333 bp, Glycine Max; identical to SEQ ID NO: 217

SEQ ID NO: 2753 - DNA, 996 bp, Glycine Max; identical to SEQ ID NO: 218

SEQ ID NO: 2754 - DNA, 837 bp, Glycine Max; identical to SEQ ID NO: 219

SEQ ID NO: 2755 - DNA, 1593 bp, Glycine Max
atgagcactatcaaaccattatggtttgtcctctcaacactaatctttctactttctgcaacttcggattcatcaccccttgaaaactttctccattgtctttcaaagcactcaagcccttcaataacaaaagccatttacaccccacaaaatccttcatttttatctatcttgcacatgcacacatacaaccacagattttctgcaccaacagcaccgaaacctttggctattgtgactgctcttgatgagtcacatgtgcaaggcactgttgtgtgtgccaagagcaatggaattcagattaggatccgaagtggtggccatgactgtgaaggcctttcgtatgtttcggacgtgccttttgttgttcttgacatgtttcattttggatcagttgatgtagacattgaaagtggaacagcatgggctgaatctggtgcaacacttggtgatgtttactatcacatttcagagaaaagtggtgttcatggtttccctgctggggtttgccccactgtgggtgctggtggccacttctctggtggtggctatggaaatctcatgagaaaatatggtctttctgttgataatatcattgatgcaaaattggttgatgtcaatggtaacattcttgacagaaagtcaatgggggaagatctgttttgggctataagaggaggaggtggtggtagttttggtgtcattctttcatggaagatcaagttggtttatgtgactccaaaagtgactgttttcaaagtgatgagaaacttggaagatggtgcaaagggtcttgtttacaagtggcaattgattgcaacaaaattgcatgacgatcttttcataagagtgatgcatgatgttgttgatggtactcaaaaggccaagaacaagaccataaaggttacttttattggtttgttcttgggaaaaagtgatcaaatgttgagtttggtaaatgagagttttcctgaattgggtttgaagcaaagtgactgcattgaaatgccatggatcaattccaccctttattggttcaattaccctattgggacccctattaaggctttgcttgatgtgcccaaagagcccctttcatatagcttcaaaaccatgtcagattatgtgaagaggcccattagaaaaagtgctcttaaatccatgtggaagcttatgattaaaagtgagagtgtgaggatggaatggaatccttatggtgggaagatgcatgagatttcaccatcagaaactccatttcctcatagagcagggaacttgttcttgattgaatacttaaccacttggggacaagatggggttgatgctgctaatcgttacctgaacatttcaaggtcattctatgaatttatgaccccatatgtttcacactcgccaagggaggcatttctcaactatagggaccttgatataggttccaattttccaagtaatgcaacaaacatgaacattgctcaaagttatgggagcaagtatttcaaaggtaactttaaaagattggtgagagtgaaatctaaggttgatcccgagaacttcttcagacatgagcagagtataccacctctttcccattag

SEQ ID NO: 2756 - DNA, 2421 bp, Glycine Max
atgagcactttcattatgttggagtctttagcttggtgccaaagctttaagggatatgaccttaccaaacagaagagtccgggttactcccatgccatttcacgagtttatagaaattctattttcatgctttactcagttaaaaagcaagtgccactactaccacatggtgctagtcatgggatatttcataggacgtgtgtgtcagaaaaattctttaaaaggtctcctctcaatgttccatcatggagaggattgtgtaagtcgcgttgggaacggctacaaacaaatgtagcatatgatgttgctggtgctgttgaagtcatccatgatttaggattggatactcttactttcttggctgtgaccgtcttaattgtgcctacattcaagtcaattaaagccagtcctatacttggtttcttctgtgctggtgtggtactgaatcagtttggtttaattagaaaccttacagatgtcaaagctttatcagaatgggggatccttttcttgctgtttgagatgggtttagagctttcacttgctcgtctgaaagctcttgcaaaatatgcttttgggatgggattgactcaggttgtactgtctactttagcatttactgcttttgaacttcctccaaatggagctgttggaacaaaaattttggaattccttttccactctaggcctgatctggtgaacatcagaagtgtcgatgaagctgtagtgattggtgctgctctctctctgtcatcttctgcatttgttttacagcttcttgcagagagaggtgagcttcctacaagatttggctcagcaactcttggaatacttcttttgcaggatttggccgttgtccctcttttagtcatacttccaatactagagagccagaatataactgagggaagtatttggcccatgcttgctcaagaaagtttaaaggcattaggtggattgggtctgctttcacttggggcaaagtacattctcagaagagtttttgaggttgttgcagatacaaggagctctgaggcttttgttgctctttgcttgctgactgttgctgggacttcactagtcacacagaatttgggatttagtgacacgcttggggcttttttagctggagcaattttagcagagacaaacttcaggacccagattgaagctgacataagaccatttagaggattgcttcttgggttgttttttctaactacgggaacttcaatcgacatgcagctccttttgcgtgagtggccaaatgtactttcactcttgggaggtttaattgttataaagacattgatcataactgcaattggtcctcgagttgggcttactttaaaagaaagtgtaagaataggattgcttctatcccaaggaggcgagtttggatttgttgttttctctttagctaataggcttggggtgcttccccttgagctcaacaagctgctcataattgttgttgtattgtcaatggcattaaccccatttctgaatgaagctggaagaagggctgctagctttattgaagaaaattttgaccctgagaataaacagaatgtttctgagacggttaacttcaacattagtgaacccgttgttatccttggatttggacaaatgggccaggtccttgccaatttcctgtccaatccattagcttcaggaggagatagtgatgaagtaggatggccttacgtggcatttgatcttgacccctcagtagtaaaggcagctagaaaaattggctttcctgtactctatggggacggatcacgtccagatgttcttcactctgccggtgtctcttctccaaaagctttcatgattatgtatactgggaagaagaagacaattgaagctgttcagaggctaaaattgaattttcctgcaatcccaatctacgccagagctcgtgatctcaagcatcttttagatctgaagaaagcaggtgcaacggatgccattttggaaaatgcagagactagcttgcacctgggttctaagttgctgaaaggccttggtgtgatgtctgatgatgtggcatttttgagtcagcttattagagattccatggagctccaagctcaagaaggaatcggccaatctgatgatcgtggattagatattatgaaaccgttgcaggtgagagttgctgtctcgagggaagcacgtgtactggcggcaacaacttcaccagaagctgaattatcagaaatgaatcagaatgatcaagcttcatcagttagaaatcaaagagaagtagatccagaagaacaagattatgaactaaatgaagctgtgaatttagaaggaaatggtgttttagttatcaaacatagtgaagaaagctcaatgattgtagaccaatcaaacccttcttcccatactgccactgaggaaccctga

SEQ ID NO: 2757 - DNA, 2043 bp, Glycine Max
atgagcactttcattatgttggagtctttagcttggtgccaaagctttaagggatatgaccttaccaaacagaagagtccgggttactcccatgccatttcacgagtttatagaaattctattttcatgctttactcagttaaaaagcaagtgccactactaccacatggtgctagtcatgggatatttcataggacgtgtgtgtcagaaaaattctttaaaaggtctcctctcaatgttccatcatggagaggattgtgtaagtcgcgttgggaacggctacaaacaaatgtagcatatgatgttgctggtgctgttgaagtcatccatgatttaggattggatactcttactttcttggctgtgaccgtcttaattgtgcctacattcaagtcaattaaagccagtcctatacttggtttcttctgtgctggtgtggtactgaatcagtttggtttaattagaaaccttacagatgtcaaagctttatcagaatgggggatccttttcttgctgtttgagatgggtttagagctttcacttgctcgtctgaaagctcttgcaaaatatgcttttgggatgggattgactcaggttgtactgtctactttagcatttactgcttttgaacttcctccaaatggagctgttggaacaaaaattttggaattccttttccactctaggcctgatctggtgaacatcagaagtgtcgatgaagctgtagtgattggtgctgctctctctctgtcatcttctgcatttgttttacagcttcttgcagagagaggtgagcttcctacaagatttggctcagcaactcttggaatacttcttttgcaggatttggccgttgtccctcttttagtcatacttccaatactagagagccagaatataactgagggaagtatttggcccatgcttgctcaagaaagtttaaaggcattaggtggattgggtctgctttcacttggggcaaagtacattctcagaagagtttttgaggttgttgcagatacaaggagctctgaggcttttgttgctctttgcttgctgactgttgctgggacttcactagtcacacagaatttgggatttagtgacacgcttggggcttttttagctggagcaattttagcagagacaaacttcaggacccagattgaagctgacataagaccatttagaggattgcttcttgggttgttttttctaactacgggaacttcaatcgacatgcagctccttttgcgtgagtggccaaatgtactttcactcttgggaggtttaattgttataaagacattgatcataactgcaattggtcctcgagttgggcttactttaaaagaaagtgtaagaataggattgcttctatcccaaggaggcgagtttggatttgttgttttctctttagctaataggcttggggtgcttccccttgagctcaacaagctgctcataattgttgttgtattgtcaatggcattaaccccatttctgaatgaagctggaagaagggctgctagctttattgaagaaaattttgaccctgagaataaacagaatgtttctgagacggttaacttcaacattagtgaacccgttgttatccttggatttggacaaatgggccaggtccttgccaatttcctgtccaatccattagcttcaggaggagatagtgatgaagtaggatggccttacgtggcatttgatcttgacccctcagtagtaaaggcagctagaaaaattggctttcctgtactctatggggacggatcacgtccagatgttcttcactctgccggtgtctcttctccaaaagctttcatgattatgtatactgggaagaagaagacaattgaagctgttcagaggctaaaattgaattttcctgcagtaataatctttttcccacccctaccctcagtgcaagccccttatctcaattggttgtgtgtgagagaatgtatgtgcacaataggggagaaattacgggtttctataattgaaagcaaccatggtagtatgatgtga

SEQ ID NO: 2758 - DNA, 2043 bp, Glycine Max; identical to SEQ ID NO: 2757

SEQ ID NO: 2759 - DNA, 396 bp, Glycine Max; identical to SEQ ID NO: 220

SEQ ID NO: 2760 - DNA, 915 bp, Glycine Max; identical to SEQ ID NO: 221

SEQ ID NO: 2761 - DNA, 582 bp, Glycine Max; identical to SEQ ID NO: 222

SEQ ID NO: 2762 - DNA, 591 bp, Glycine Max; identical to SEQ ID NO: 223

SEQ ID NO: 2763 - DNA, 1014 bp, Glycine Max
atgagcgagttgcggagcctcgcgtgtcaaggtattcctgatgctgctgggatacgttctactgtgtggaagcttttgcttggatatcttccaccagatcgagggctttggtcagctgaattagcaaagaagcggtttcagtacaaacaattcaaagaggagattttcatgaatccttcagaaatcacaaggaagatgtacaactcggcaaattgtgatactgatgatgccagctgtgcgagggcgttgctctctagatcagaaatcactcatggggagcatcctttgagtctggggaagaccagcgtatggaatcagttcttccaggatacagagatcatagatcaaattgaccgagatgtaaagcgcactcatcctgatatgcactttttctctggtgattcccaatttgcaaaatctaatcaggaggctttgaagaatatattaattatttttgcaaagttaaacccgggtgtaagatatgtgcaaggaatgaatgagatattggctcctctattctacgtgttcaaaaatgacccagatgaggaaaatgcagcctttgctgaagcagatgcattcttttgttttgttgagctattgagtgggtttcgagataactttgttcagcaactcgacaatagtgttgtgggaatccgtgcaactattacgagattgtcccagcttttgagagaacatgatgaagagctgtggcgacatcttgaggtcacttctaaggtcaatcctcaattctatgcatttaggtggattactctcctgctgactcaggaattcaattttgctgacagccttcacatttgggacactcttttaagcgatccagatggtcctcaggagactcttcttcgggtatgctgtgcaatgctggttctcgttcgtaagcgcctccttgcgggtgatttcacttctaatctcaagttgctgcaaaattatcccaccacaaacattagtcatttgctctatgttgccaacaagtttcgtgtacagtcagtctaa

SEQ ID NO: 2764 - DNA, 2514 bp, Glycine Max; identical to SEQ ID NO: 224

SEQ ID NO: 2765 - DNA, 2511 bp, Glycine Max; identical to SEQ ID NO: 225

SEQ ID NO: 2766 - DNA, 900 bp, Glycine Max; identical to SEQ ID NO: 226

SEQ ID NO: 2767 - DNA, 651 bp, Glycine Max
atgagcttacttttaagaataagacattatttacccaagggtttatgtagacaacctcttcatccaacagtagtgcggcttaacgctagtaacttaaatgtattttcaagacattttggtcaacctgcgaggaaagaggaggaggatgatgtagaggaagtggaaattgatcaaaaatgtctcccagctgattttgatcctgctacatttgatcccaatgatcatcgaggccctccatcagagagagttttcaggcttattgatgagattgcttctcttacggtagctgaagctggagaattgggtctcattctcatgaagaaaatgggagtgaaggagatgcctaatgtgggatttatgaaagcaggagctggaaatttggctggaatggcagcaaaagcaccaacagcagccaaggaggagcaaaagctagaaaaaactgtgtttgaattgaaactggagtcctatgaagcggcttccaaaattaaaatcatcaaggaggtccggggctttactgatttaggtttgaaggaagcaaaggatttagtggaaaaaacaccttctgttataaagaaaggtatttcaaaggaagaaggggagcagataatagagaaattgaaagctcttggtgcaaaggttgttatggaatga

SEQ ID NO: 2768 - DNA, 309 bp, Glycine Max
atgagcttcacattcaacctccatgttcccaaagctctgcctcctcttccctcttcatcacgtggaacaacttctctcttcttttcttcaaagcagaaatcataccacaacaacactagtccttgccaatcactacttataacatgcagaagccacaaaccaaattatgatgataccagcctaaagtatacaagtttggcactgcaagtaggagcactcttggccttgggttcttctttgggcaccatttttaaacttcaggaaattccctcgggacacttccttgcagtacccttggtctgtacctga

SEQ ID NO: 2769 - DNA, 249 bp, Glycine Max
atgagcttcacattcaacctccatgttcccaaagctctgcctcctcttccctcttcatcacgtggaacaacttctctcttcttttcttcaaagcagaaatcataccacaacaacactagtccttgccaatcactacttataacatgcagaagccacaaaccaaattatgatgataccagcctaaagtatacaagtttggcactgcaagtaggagcactcttggccttggtgagattcttgtgtacatag

SEQ ID NO: 2770 - DNA, 3093 bp, Glycine Max
atgagcttgctccatgtagttgggtttggtcttaaagtggggcatctacttttggtgctatgttgctgggttgtgtctgtggtttatcttaactggtttctcagcagtggaattattatggacaccaagatgggtggtggaggtggtggtggtagcaagatgtggcacaaaaaatggtgggagaagatctcagggcagggttgcaaaatccaccaacagtactaccagtatattggctccaagaaagttaagagagcgttgtggaggaagcttttgctgacatgggtagtgggttggttcatagtatctttgcggatcttctgctacatgagctcgcaaggtactgagaagaggaaagaaactcttgcaagcatgtgtgatgaaagggctaggatgctgcaggatcagtttaatgtcagtatgaaccatatccaagccatgtccattctaatctccactttccaccatgctaagagcccctcagccatcgatcagaaaacttttgcaaagtacacagaaagaacagcttttgagagacctcttacaagtggtgttgcgtatgctgtaagggtgctccattctgaaagggaacaatttgaaaagcagcaaggttggactatcaagaggatggatactctagagcagaacccggttcataaggacgattatgccccagaggcactggagccatcccctgttcaggaagaatatgctcctgtcatctttgcacaggatacaattgcacacgtgatttctgttaatgtgctttctggaaaggaagaccgtgaaaatgtgctgcgtgcaagagaatcaggcaaaggggttttaactgcgccctttaggctgctcaaaacaaatcgactaggggttatcctgacctttgctgtttacaagagagatctcccatcaaatacaaccccaaatgaaaggattcaagcaactgacgggtatcttgggggagtctttgatgttgagtcattagtggagaaattacttcagcaacttgctagcaagcaaactgtaattgttcatgtatatgatactacaaatcgtactcatccaattgccatgtatggctcaaatgaatcaggggattttttctatcacgtcagcactcttaactttggagacccttttaggaagcatgagatgcactgcaggttcaagcagaagccaccatggccatgggtggcaataactacttctattggtatccttgttattgcactccttgttggatatattttccatgccactgtgaatcgaattgccaaagtagaagatgattaccgtgagatgatggaacttaaaaaacgagctgaggcggctgatgttgcaaaatcccagtttcttgctactgtttcccatgagatcagaacaccaatgaatggtgttttggggatgttgcatatgcttatggacacagatctagatgtaacccaacaggaatatgtcaggacagcacaggaaagtggaaaagctctggtgtcacttataaatgaggttttggatcaggctaagattgagtttggtaagctagagcttgaggctgtgctcttcgacatacgggcaattttggatgatgtattgtctctattttctgagaagtctcaaggaaaaagagtagagttggcagtttatgtgtcagatcatgttcctgaattacttataggtgatccaggaagatttcgacaaataattaccaatctcatgggtaactcaattaagttcacggacaaaggacatatttttgtcacaatccatcttgttgaggaggttgtccgttcaatagaggttgacaaagaatccaactcagaaaataccttgagtggttcgcccgttgctgatagtcgccggagctgggaaggattcaaggctttcagtcaagagggacctcttggttccttctcatccccctccaatgatcttgtcaatttgattgtatctgttgaagatacaggtgaaggtattcctcttgaatctcagccactcatcttcaccccattcatgcaggtaggttcatccatctcccgaaagcatggaggaacaggcattggcctaagcattagcaaatgtttggttggcctcatgaatggggaaattggatttgtgagcatacccaagattgggtccacattcacttttactgctgtattcaccaatggacaccgtagttcaagtgagtgtaaaattcagcaaatcaacaaccaacctcagtctgcatcttcagaatttgaggggatgactgcattaattattgacccaagatctgttagagcagaagtgtctggatatcacatccaacggcttggcattcatgttgaaatggtttcagatttaaaacaaggtttgtcaaccataagcaatgggaatgtagttgttaatatggtcctgattgagcaggaggtttgggatagagatttaggcttgtcatctcactttgtcaataacacgaggagaattgatcatggggttcctccaaagctgttcattcttgttaattctagtagttcttttaaagctagcgtaaacttgggtgttcataatcctactgtgatcaccaaacctctgagagcaagtatgcttgctgcctcactacaacgagccatgggtgtccaaaacaagggagctcctcatagagagctccaaagtttgtctcttcgccatcttcttcgtggcaggaaaattctaattgtagacgacaatggtgtgaaccgtgcagtagcagctggtgcattgaaaaagtatggagcagatgtggtttgtgttagcagtggaaaagatgccatctcttccttgaagccaccccatcagtttgatgcctgtttcatggatattcaaatgccagaaatggatggatttgaagctacaaagcgaattagggagatggaagatagtgtgaacagagaagtatctatggatgactttgagaatattacaaactggcatgtacccattttagccatgaccgcagatgtgatacaggctacacacgaggaatgcctaaggtgtggcatggatggatatgtttcaaaaccatttgaagctgaacagctgtatagagaagtctcacggtttttccagtcatcttga

SEQ ID NO: 2771 - DNA, 3093 bp, Glycine Max; identical to SEQ ID NO: 2770

SEQ ID NO: 2772 - DNA, 747 bp, Glycine Max
atgagcttgtctcttattcaaggctattcttccgcagaagaggaacaagacgaagaccaaccccaaccccacaattccgacctcgaagattccgacgacgacgacgccgccgctggcaccatcaccgccgcaaaccacccttctcttggcgacagatccatcttcgaccacgttccgaatcctccttccgcctcgggtcttccttctgcattcgatgctttctccgaaattgcaggaccgccccaatttctgaacaatagtgtggaagagtacaaaccttcaagagacgctgatgagcaacaagggaagcatgccaataggaggcgccgcaagaacaagaaggatttacccacaggtgcagtggtagaggcaaaacctcaactggttgggattcatgagcgagtaagaagtgacatcaatggtagccaaccaccaacatcagctgccttgggcacatcagaaggaggcaagcgggtgccgactgcaacaaatcctaatgctgaagatgctgcagaccttttaagaatgtgtttgcagtgtgggattcccaagacctactccaatgcacgcggaatggtctgccctgtatgtggtgatcgccctccaaaggatgatacaagcgcagaatccaagaagaaaggatcaactgtcaaagataaggaaaaatctaaaaggatgaagggtcaatcatcccatgcaacctggaaaagtgaaacagagatgcatctaaggcaacagtttgattag

SEQ ID NO: 2773 - DNA, 741 bp, Glycine Max
atgagcttgtctcttattcaaggctattcttccgcagaagaggaacaagacgaagaccaaccccaaccccacaattccgacctcgaagattccgacgacgacgacgccgccgctggcaccatcaccgccgcaaaccacccttctcttggcgacagatccatcttcgaccacgttccgaatcctccttccgcctcgggtcttccttctgcattcgatgctttctccgaaattgcaggaccgccccaatttctgaacaatagtgtggaagagtacaaaccttcaagagacgctgatgagcaacaagggaagcatgccaataggaggcgccgcaagaacaagaaggatttacccacagtggtagaggcaaaacctcaactggttgggattcatgagcgagtaagaagtgacatcaatggtagccaaccaccaacatcagctgccttgggcacatcagaaggaggcaagcgggtgccgactgcaacaaatcctaatgctgaagatgctgcagaccttttaagaatgtgtttgcagtgtgggattcccaagacctactccaatgcacgcggaatggtctgccctgtatgtggtgatcgccctccaaaggatgatacaagcgcagaatccaagaagaaaggatcaactgtcaaagataaggaaaaatctaaaaggatgaagggtcaatcatcccatgcaacctggaaaagtgaaacagagatgcatctaaggcaacagtttgattag

SEQ ID NO: 2774 - DNA, 1434 bp, Glycine Max
atgaggaaaagaatcaaactttccctcaaattttcactcttttctgcaccgccagtgatgggagatgggtgcgcggttgagggcaccacggggaattccaattctaataacaataataacaataagaagaagaacaagaagaagaagaacaggggtgggagcaagaagaagatgacccacgaacaggtcttggccttcaagttagtgagtgagtgggttttcttggatcacccttctgcttcgtcttcatcttcttctgctgcttcctgtgttgtcgatgattttggtgttcagaagcctctagggagaggcggggaaaagctcctctttgaattgcattcgcactccaaattcagcgatggcttcttctccccttctaaagttgttgaaagagctcacatcaacggcgtgaaagttcttgctctgacagatcatgacactatgtcaggcattcctgaagctgtagaatcagctcgtaaatatggcatcaagataatcccaggtgttgaaattagtaccatattttctccaagaggagactctgaagtagaggaaccagttcacattttagcatactacagcagtattggaccatcaaggtttgaggagctggacaagtttctatcaaatataagggatggacgttttcttcgtgcgcagaacattgtcttaaaactgaacaagctcaagttgcctcttaaatgggagcatgtttgcaggattgccggcaagggggttgcccctgggaggcttcatgtcgcccgtgccatgcttgaagctggttatgtagagaatctcagacaagccttcgctcggtatctctttgacggtggacctgcttactccacgggaagtgagcctctggcagaagaagcaataaaaatgattagtcatactgggggtgttgctgttctggctcatccatgggcattgaaaaatccagttcccattgttagaaggttaaaagaagctggtcttcatgggatggaggtctacaaaagtgatggaaggctggcagcatatagtgacttggctgatgcctatggacttctaaagattggagggtcagactatcatgggagaggagggcacaatgaatctgagctgggaagtgtgaaccttccagtgatagtgttgcatgacttccttaaggtagctcggcctatctggtgcaatgccatcagggagatattagagtgttatgctgaggagccttctgattctaacctagcaacaattactaggtttgggagaacctggagttttaagggaggttcaccctttagttgtggacaggacttgattgatcattgtttacctctctggttgtctagccaggagatggaaaatgcagagtttgaagctatcaagttaaagctttccaatgtttcagttagtcagggaggaattcaggttctcatagagactaaataa

SEQ ID NO: 2775 - DNA, 1413 bp, Glycine Max
atgaggaacgtaattgggaaaatttacaagacgctaaagtattcaagttgggaaagcgccgagcaagagctgaataatatgtctttgaggtgggactcttacacggtgaaccaggttctcaagtcccaccctccaatggagaaagcgtggttgttcttcaactgggcctcttccctcagaggcttcaagcacgaccactacacttacactaccatgcttgatattttcggagaagctggcagagtctcttccatcaagcttgattctttccgggaacgtcgagatcaggctatgcaaatgtggcaccaaatcaaatccaagactgttgtctcttacaccgcttatatcaagattctctttcataatcgaagactcaaagaggccactcgtgtttacaaggagatgattagctccggtgttgctcctaattgccacacttacaccgttctaatggactatcttattgcctctggaaaatgcaaagaggccctagagatttttgaaaagatgcaagaggctggggcgcaacctgataaagctgcatgcaatattttgattcagaggtgttctaaagttggtgggactgagttcatgacccatatccttcagtacatgaaagaaaaccgtctagttcttcgctaccctactgatacccttctgaggcaagtcaatccacaattttatatggattgtagcacaaggaaggatgcaagtaatagtatcacggttgctgcagattgtcctactaatatagataacgagcttctatttgttctcttgaaaaatagaaatgttgttgctattgaccatttacttacagggatgatggataagaaaatatatttagaacataaggttgtctcaaccattattgaggtaaattgtagtcattgtcgacctaaaggtgctttgttggctttcaagtacagtgttacaatgggaataagtattgagagaacaggatatctttccttaatcggcttgttgatcagatcaaatatgttttcaaagctggtggaaattgttgaggaaatgactagagctgggtattctcttggaacctatttggcttcacttttgatcattagcttggttattttcaacttattacctgataaccataagtgcactgctacctttactgctttaattagtgtttacttctctgttagaagagttaccaaggctcttgagatttacaaaatcatgtgcaccaaaggattttgtcccgtgttaggtacttatgatgtactaatagctggttttgaaacaaatggtaaatatgctgaagcagaacattataggaaagcaaagaagagcaagagcttacatgccaatagtggttctcaagaaagtgtttgcatagaggggaagatatgcaatcttctgttttctgttgatgtagtactttga

SEQ ID NO: 2776 - DNA, 3081 bp, Glycine Max; identical to SEQ ID NO: 227

SEQ ID NO: 2777 - DNA, 453 bp, Glycine Max
atgaggaagaattgcaacttggagcttcgccttttccctccttccctctccgatcttcgccccatgatggaagcagaagttagtgagagaccccaacaacaggtcgcccaccatcaacagcaacagcaaccacaaccacaacatccgctgaccattttctatgatggcaagatttcagtttcagatgtcacagagcttcaggccagatccatattaatgctagcaaataaagagatggagaaaagagtgatgacaccaacggggtcagaaccatcttcaccaatattactgcaatcacctcataacatgtatagccccggcactggactttccatgaaaagatcactgcagaggtttctccagaagagaaagaatcgtgtccaagaaacatccccataccatcacgagctaattaatgttaaattatcaaaatcatcaagggaaaacaaatga

SEQ ID NO: 2778 - DNA, 618 bp, Glycine Max
atgaggaagccgccgtcctctccttctcgaggtctgcgcacgccgcattggccttctgccgctccatcctcacgattcttctcagcgtcattacgtcgaacacctcgtcctcattgcaaccctctctctcgttctctacctttccctccgacccatcatccgaaaccgcgttgcctctctccccggactcattgggccgcctccggaaggaagagctcgaagttgggtggcgcggttttttcaaagccgaagcgcagaagcttgaagcagaaggtgagcatgagaaagaggcctagaagattgaaaatgcgcgagagggagcggagaaggacgaagccgcaaccgaattcggcgggaggaggaggcgaaaggagggaaggaacaccgatcagagttggcgcgaaagggagcgaagaaaagagaagaatgaagaaagagagtgttgggagcgcagagaggaggaagagtggcactggtgatggaggaagtggtggcggacaaatagaggagtggtgtgtggtcatttggaccatttcagagattctgtcatcacctaaatttatatcgaatgccttactgactgacattgtttgttgtagttttattaaaagtttatag

SEQ ID NO: 2779 - DNA, 1173 bp, Glycine Max
atgaggagaactctggtgagaaatggcagtctctacactcgcaaccttcttcatcactccgccctcgcacttgccgcttcatctcgtcctcaattcagactcttttcctccaatgaaaaccccccaccggttccccaaatcgacgacgtgaacaacaaagagctgaaagcgcagatcgagacctacttcaagggcgacgagaaggtgctcccgtcgatcatggaggcgattctgaagcggaagctgtcggggaatcacgaggacaccgacgacgagctcatggaggagctccgcatgcgtcccctcgacgacgtcgacgaccgggactttgagtccgacttcgagtccattcacgacaccgacgaggagatcgacgatttgtacaacgccagggacgtggtgatgaagaggatggtgaaggatgagtacttcaacatggatgataaaaagtgggatgacattgttgaggacgggatcaagcacgggcttcttagggacaccaaggagtgcgaggagattctcgaggatatgctcagctgggacaaactcctccctgatgatataaaacagaaggtggaagtaaaatttaatgagctaggggacatgtgtgaaagaggtgaacttgaacctgaagaagcttacgaacagtttaagaagtttgaggatgagattgtggcgaaatacttggacaaaatggaaaaagaggaggcctcacagtttgatgatactgttgtgccagataagaaaaaggacttggatgatccaccgggtgaaggtccaattctgcggtggcaaactcgggtagtctttgctcctggtggtgatgcttggcatccaaaaaacaggaaagtgaaactgtcagttaccgtgaaggagctagggctttcaaaataccaatttcgccgtctcagagaattggtaggaaaacgttatcatccagggagagatgagcttacaataactagtgagaggtttgaacatcgagaagaaaacagaaaggactgcttaaggacccttctctctctcattgaggaggcagggaaagctaataaactagtggatgatgctcgatcttcatacgtaaaagagaggcttcataccaatccagctttcatggagaggctgcatgcgaagtcaatgaggttgcgagaatctaatcaggttcctgcttga

SEQ ID NO: 2780 - DNA, 1173 bp, Glycine Max; identical to SEQ ID NO: 2779

SEQ ID NO: 2781 - DNA, 729 bp, Glycine Max; identical to SEQ ID NO: 228

SEQ ID NO: 2782 - DNA, 1023 bp, Glycine Max; identical to SEQ ID NO: 229

SEQ ID NO: 2783 - DNA, 102 bp, Glycine Max
atgaggagttatgaggagagccggtgcaacctctccacagtacttttggatgcctctcacttccttcaccatatccttcttcaaatcaacactttaatttga

SEQ ID NO: 2784 - DNA, 1254 bp, Glycine Max
atgaggattctgcaacttgatcccagttatcacctcacggatgaagacacccaagcattgctttccctgcacgacactttccagaagtgtgtgagtgcaaatggacttggcctaaaagcaaccaggggcacagattattgccaaaccacaataaatttccccagtgacaccatccccaaatggaaagatcccaaaaccggtgaacttgaagctctgtcttttgattttaatctatgtgaagctgtggctacatgggaacaagtgcgaaacagtaccactatacttaccaaggaattcattgattctttaccaaatggatgggaggaatatgcatggcgtaggatcaataaaggaatacagctcaaccgctgtgagaacaagaccttgtgcatggagaaactttcactggttctccctgaaacaccaccatacttcccaagacagtttggacgctgtgctgttattggtaactcgggagatctcttgaaaacaaaatttggaaatgagatagatggttatgaagttgtcattagagaaaatggtgctccaacacagaactacactgattacgtgggtaggaaaagcacatttcgccttctaaaccgaggatccgccaaagcactggataaagttgtagagttagatgaacaaagaaaagaagtcttgataataaaaacaacaattcatgacatcatgaacaaaatgattcgggaggttcctataaaaaatcctgtgtacctcatgctaggtgcatcctttggctcagcagcaaaaggaactggacttaaagctcttgaatttgctctctctatgtgtgattcagtggatatgtatggtttcactgtagatcctggttataaagaatggacaagatatttctctgaatcccgtcaaggccataccccgttgcatggtagagcttattaccaaatgatggagtgcttggggcttatcaaaattcattctcccatgcgagctgatctaaatcgtgttgtaaaatgggttccaagccgccatattataagatctgctagaattgcatcagagaaattactgaggagagttggagcaggatctgaagatccactggctgcatgttccataattaagaagcaagtaaaaagaaatctaaatgcagtttcaaagctcagaaaggcagcacttgatcatttacggtatgtgaaaagaacaaccatgtatcctctagagcatagtcctggacatgggtcgctttgcactgtgccaactgattaa

SEQ ID NO: 2785 - DNA, 1038 bp, Glycine Max
atgaggattctgcaacttggtttgtttcttgctttagcatctggatttgcagccatttccatttacatcaccggcctctctgatccttttgtatatcccagttatcacctcacggatgaagacacccaagcattgctttccctgcacgacactttccagaagtgtgtgagtgcaaatggacttggcctaaaagcaaccaggggcacagattattgccaaaccacaataaatttccccagtgacaccatccccaaatggaaagatcccaaaaccggtgaacttgaagctctgtcttttgattttaatctatgtgaagctgtggctacatgggaacaagtgcgaaacagtaccactatacttaccaaggaattcattgattctttaccaaatggatgggaggaatatgcatggcgtaggatcaataaaggaatacagctcaaccgctgtgagaacaagaccttgtgcatggagaaactttcactggttctccctgaaacaccaccatacttcccaagacagtttggacgctgtgctgttattggtaactcgggagatctcttgaaaacaaaatttggaaatgagatagatggttatgaagttgtcattagagaaaatggtgctccaacacagaactacactgattacgtgggtaggaaaagcacatttcgccttctaaaccgaggatccgccaaagcactggataaagttgtagagttagatgaacaaagaaaagaagtcttgataataaaaacaacaattcatgacatcatgaacaaaatgattcgggaggttcctataaaaaatcctgtgtacctcatgctaggtgcatcctttggctcagcagcaaaaggaactggacttaaagctcttgaatttgctctctctatgtgtgattcagtggatatgtatggtttcactgtagatcctggttataaagaatggacaagatatttctctgaatcccgtcaaggccataccccgttgcatggtagagcttattaccaaatgatggagtgcttgggggtaagtaaatcatag

SEQ ID NO: 2786 - DNA, 1335 bp, Glycine Max
atgaggattcttctcagcctcacatgtttggttctcaccttcatctccttcaatccttgtaatgcagaacaagcacaaactatttcaaattccctcagcattgaccatgtcctccagaaaatatatgaatggggaaatggtgcacaagggttgcaagaggcacatattcaaatttctggccctatagtggtggcaggagtgttatgtttcatagcttcttcaatatctagtgctggtggaattggtggtggtggacttttcataccaatattaaccattgtggctagcctagacctcaaaacagcttcaagtttgtcagctttcatggtcacaggagggtcaattgcaaatgtcatgtgcaaccttcgtgccacaaatcctaaacttggtggcaagtcattgattgactatgacatagcacttttatcagaaccttgtatgctgctaggagtgagtgttggagtcatatgcaaccttgtgttcccagaatggttgattaccatgctatttgctgtttttctaacttggtctacctcaaagacctgcaacagtggagtggtgttttggaagattgagtcagaggagagaaggaaaaatgatggatttgaagggctagaaaaaggactattggaagatgagaaaaatataagggtgaggattccttggttgaaattagtggtcttactcttggtctggttctctttcttctccctctatcttcttcgtggaaacaaatatggacagagtatcattccaatggagccatgtggtgtgggatactggattatttcatcagctcaagtccctcttgctttatttttcactgcttggattgtatatagaaaagaaagccatcaagaccaaaatctcatgcaagaggactcatgcctatcctcaaatggaccatcaaacaagcttatttttccaatgatggcactgctagcagggatattgggtggtgtctttggaattggtggtggaatgctgataagtccacttcttctacatgttggaatagctcccgaggtcacagcagcaacatgttctttcatggttttcttctcatccaccatgtcagccttgcaatacctattgttgggcatggatcacatagagactgccctcatcttggccctaatatgttttgttgcatcactaattgggttattagtggtgcagaaagcaattcaaagctatggaagaccatctttaatagtattttcggttagcatagtgatgactttaagtattgttctaatgactagcttcggagccattcgaacttggaaagactatacatcagggagatacatgggattcaaactaccctgttga

SEQ ID NO: 2787 - DNA, 2322 bp, Glycine Max
atgaggccaccaagtccttccatccactttctgctccaaattcttctagtctgtctattgcacagacccagctttgcagtgaaaaagtcatatgtggtgtacttgggagcccactcacacggcccagaattatcctcagttgacttcaatcaagtgacacagtcccaccatgactttctgggatctttcttaggaagttctaatacagccaaagactccatcttttactcgtacacaaggcacatcaatggttttgctgcaactttggacgaagaagtagctgttgagatagctaagcaccccaaagtgttgtcagtgttcgagaaccgtgggagaaagctacacaccactcgatcatgggatttcatggagctagagcataatggggtgatccaatccagctcaatctggaagaaagctagatttggtgagggtgtcatcataggaaacctggatacaggtgtttggcctgaatcaaagagctttagtgagcaaggtttgggaccaattccatcaaagtggagaggaatctgtgataacggaattgatcatacttttcactgcaacaggaagctaataggggcaaggtacttcaacaagggctacgcctcagtggcgggcccactgaactcctcctttgactcgccacgtgacaacgagggccacgggacccacaccctatccacagctggcgggaacatggtcgcacgtgtcagcgtcttcggccagggccagggaacagccaagggtggctcaccaatggcacgtgtggcagcctacaaggtctgctggccccccgtcggaggcgaggagtgcttcgacgctgatatcttggcggccttcgacctcgccatccacgacggcgtcgatgtcctctccgtctcgctcggtggctcttcctccacgtttttcaaggatagtgttgccatcggatccttccatgcggccaagcgtggcgttgtggtggtttgctctgctggcaacagtgggcccgcggaagccactgcggaaaatctcgcaccctggcatgttacggttgctgccagcaccatggatcgacagttccccacttacgttgtccttggtaacgatattaccttcaagggggaaagcttatcagctacaaaattggcacacaagttctatccaattattaaagccacagatgctaaattggcgagtgcaagagctgaagacgcggtgctgtgccagaatgggaccctggatcccaacaaggcgaagggaaagatcgtggtgtgtctccgaggaataaatgcaagagtggacaagggagagcaagcttttctagctggtgctgtgggaatggtccttgctaatgacaagactactgggaatgaaattatagcggatcctcatgtccttcctgcttctcatatcaattttactgatggtagtgctgtctttaattacatcaactcaaccaagttcccagtggcatatattacacatccaaagactcaattggatactaagccagccccatttatggcagcattttcatcaaaaggaccaaatactatggtgccagagatcctaaagcctgatatcactgcaccaggcgtgtcagttatagcagcctatactgaggcccaaggaccaaccaatcaagtgttcgacaagcgcaggattccgtttaactcagtctcaggcacatcaatgtcatgccctcatgtttcaggcattgtgggactgttgagagccttatatcctacgtggagtaccgctgcaattaaatcagcaatcatgaccacagctacaacactagacaatgaggtggagccactactgaatgctactgatggcaaggcgacaccattcagttacggggcagggcatgttcaaccaaacagagcaatggatcccgggctagtttatgacataacaattgatgattacctcaacttcttatgtgctttaggatacaacgagacacagatctcagtgttcacagaaggtccatataaatgccgcaagaaatttagtctcctcaacctgaactatccctcaatcacagtcccaaaactctctgggtcagtgacagttacaaggacattgaaaaatgttggttctccagggacttacattgctcatgttcaaaacccgtatggaatcaccgtttctgtgaagccaagcatcttgaagttcaaaaatgttggtgaagagaagagctttaaattaaccttcaaggccatgcaaggaaaggccacaaataactacgcgtttggaaaactgatatggtcagatggcaagcattacgtcacgagtccaatagttgtgaaggccctcttaactagaaattga

SEQ ID NO: 2788 - DNA, 384 bp, Glycine Max
atgaggcctacaatgatgcttagggctctaaccaagcagtttcttggaattgtaggcgatacagcaaacactgttgctaagaagccacccccacctcctcctctggtgtcacgcaaaccggcgttcattgatgcattcttgtataagatgaagaagaatccaaatcttttgttgaacaagaccatttggtcacggagatcgactatcttgccagaatttgttgatagcactgtcaagatttacaatgggaaaaccactattcgttgtaggatcactgagggaaaagtgggtcataagtttggagagtttgctctcaccaggaaacgcaagaccagagaacaagccaattccaaaaatgttaaacaacttaagaaaaagaagtga

SEQ ID NO: 2789 - DNA, 3303 bp, Glycine Max
atgaggccttcgtgcagtgacggggacgaaggagattccatagctcagaggatttccagtgattccttgtccatcaacggtcaaaacttcacatttgattccgttgctcactccaatgcaactcaggcacgatttcaattagatatttttgagcttgtcggggcgcctcttgtagagaattgcttggctggatttaatagttctgtattcgcatatgggcagactgggagtgggaagacctataccatgtggggtcctgctgatgctttgtcagatgacaattcagcaagtgatcaacaaggcctcgcgcctcgtgtttttgaaagactcttttccctcataaatgaggagcaaattaagcattctgataagcaactcaagtatcagtgccactgctcttttctcgagatatacaacgagcaaatagcagatctattagatccaaatcaaagaaacctacagattagagaagatgtcaaatctggtgtctatgttgaaaatcttacagaggagcaagtgtgtacgaagaaagatgtggctcagcttttgataaagggtttgttaaacagaagaattggtgcaaccagtataaattctgaaagttcacgctctcatactgtttttacttgtgtggttgaatctcgatgcaagagtactgcagatggtgtaagcagatttagaacaagtaaaataaatcttgttgatctagctgggtcagaacgacaaaaattaacgggtgcagcaggagaccgtttaaaggaagctggcaatattaatagatcactttcacagcttgggaatttgataaacattctagctgaagtttctcagacaggaaagctgcgacatataccatatagagactccaggttgacatttttattgcaggagtctcttggcggaaatgcaaaattagcattggtttgtgctatttccccagcactaagttgtaagagtgaaactcttagtacattgagatttgcacaacgtgtaaaggctatcaagaataaagcagttgtcaatgaagtaatgcacgatgatgtgaatcaattacgagacgtgatatgccaactcagggatgaactgcatcgaattaaagaaaatggttacagtccaagtgatggaagtcggggtcattcagcagctttgatcagaagaagtttgattttattgaagcctaccctcaatcacccattatcactacctcatgttgatgaagatggtgatgaggagatggagattgatgaggaaggtgttgaggatcatgctgtagttctccacaactcaaatggaggttttgctggtttttcagcccctaatggatctattggttctcctagtgctgcaatgaatggtgacagccctgctggcggcatggttaaatgcaaaacatcccccatcctcaaattccgtccttccagcctttcaccaacaatcagaagcagcaggaaaagtttgaggacctcattaaagcagtctccttctgagaataatattcatggtgaaagtgatttaggtacaaacaccgttaaccagaaatgtttgtctgcagctctctctagccagacagctccaaatttcctaactaaaacggaaaatttagcagtaagcatctgccatggtcttgaaattattgatagccaccatcatggtgcatcgttatcgaatctctcattgagatccaaagattccaggctaattattcctgtggaaaaagttgatgttcccgcccagacttttcttgatgataatgccaaaaaggaagattatgctatgcttacctgtaataactgtaaaagcagaatgcagcttgatgccaatgagattgccaatagctcaaatgtgcagctggtactgattgatcgcccggagtcaactgataaaccaaagaagcaaattcttaaagcagcagagaaggttttggcaggatcgataaggagagaaatggcactagaagagttctgtgcaaagcagacttctgatataatgcagctcaattgcttgttgcaaaagtacaggcaagagagggaatgcaatgccacaatagcacagataagagaagataaaattctacgccttcagagccatattgatggtgttttatccaccaaggagttcatggatgaagagccggtgtcccttgcacatgaaaacaagcttttaaaggagaaccatgagcatcatttagaagttctgaagatgaagatagagttaaaaagagtacaagatgagttacaagagtatcagaatttttaccaatttggggagagggaagtgttgatggaagagatatgtagtttaagaaatcagcttcacttttatgttgactcttcatccaaatccacaagaaagcaatatcctccattgcaatttacttattcatctgaacctagtttggcagcaaacctcactgccatttcagatttaacagaggctagcactgaggcaaatgcaaatccagaatcgactgaagacagtgccaaagtaaaaattaaacaggaaaaaagtcaatggaccgaggcagaaagcaggtggatttctctaactgaaaaactgagagctgaacttgaagctagcaggtcactagctgaaaagaggaagcaggaactagatactgagaggaagtgtgctgaggaactgaataaaacaatgcaaatggctatagaaggtcatacacgaactttagaacagtatgctgatttagaagagaaacatatccaattgcttgaaaggcatagaaagatccaggatggaattgatgatgtcaaggaagcagcttccggagccggggttagaggtgcagactctaaattcataaatgaccttgctgcagaaatttctgcattaaaagcagaaacagaaaaagaaaaagaaatgaaaatcctaagagatgaaaatagaggtcttcgagctcaactgaaggatactgctgaagcagtgcaagctgcaggtgaacttcttgtgcgacttaatgaagcagaagaaggtgtcattactgcacagaagcgggcgatggatgcagagcaggaagctgcaaaggcctacaaacaaattgataaattgaagaagaaaaatgacaaagacattagcacacataataagctacttgccaaaacacgtttgcctaatgaagaaatacaacctaccttggatgacctccttgtcatgcctatttgtgatgacaccaaggtgctgaaaaatgttaatggtcaatttgagttgttttgtaacgaagaggacagtgaacttgcaaatttggcagaccaatcatggttctctgcttatgacacatgcaacatatag

SEQ ID NO: 2790 - DNA, 1203 bp, Glycine Max
atgaggcgctacttgtcaaaattcattcattacccaattggctttaatccatcaaactcctttccgttgaattgtgagatggggtcctactgtgctgccagaagtactaaccgtcaagcttcattcagtggcaacatgcatgaatatgccacaagagcttttgcaacaacatcttgtgcttcattgtctgaagatcaaccaaaggataactctgtctctgatatgttagtagattcatttggaaggcttcacacttacttgagaatatctttaacagagaggtgcaatttaaggtgtcagtattgtatgccagcagatggtgtggaactcactcctagtcctcaacttttaacaaagactgagattctgcgatgcgcaaatctgtttgtaagctctggagtaaacaaaatacgtttgaccggtggggaaccaactattagaaaagatattgaagacatatgtttggaactgtcgaccttgaagggactgaagacattgtcaatgactaccaatggtattgccctggcaagaaaacttccaaagctgaaagaatgtgggcttaattctgtaaacattagtttagacactctagtaccagcaaagtttgagtttatgacaagacgcaaagggcatgaaaaagtaatggattcaattaatgcagccatagaccttggatttaatccagttaaggtcaattgtgttgtaatgcgtggatttaatgatgatgaaatctgtgactttgttgagttgacgcgtgaaaagccaattgatattcggtttatagagttcatgccctttgatggaaatgtttggaatgtcaagaaacttgtaccctactcagaaatgttggatacagtgatgaaacagtttacaagcttaaaaagagttcaggatcaccctacagatacagccaagaatttcacaatagatgggcatgcaggtagaatttcatttatcacatcgatgactgagcatttttgtgctggttgcaatagattgcgactactagctgatggaaactttaaagtctgtttatttggtccttcagagattagcttaagagatcccctgagacgtggtgcagaggatgatgaacttagagagataatagcggcagcagtgaagaggaagaaagcttcacatgctggtatgttcgacatagcaaagactgcaaataggcctatgatacatattggtggataa

SEQ ID NO: 2791 - DNA, 846 bp, Glycine Max
atgaggctcaacgaagtcagagatgcaactgattgcttttccatagacaatgccattgggatggggaaaattggaataatgtacaagggaaggttaccaaatggttggaaccttgcgatcaagagactattcgattctaaactatttaagaggcaatttcttttagaaataagaattttgggcaagtacagacacaaaaatatagttcccctgcttgggttctgtgtggaaggaaaggaaaggattctggtataccaatacatgtcaaatggaaggctttcaaaatggttgcatcctttagaaagtgaagttacattgaaatggcctcagaggatcaaaatagctcttggggtagcaagaggcttatcctggctccatcatatctgtgatttgcatgttgtgcatcgtaatataagttcgggatgtgtcttgctagataagaattttgaacccaaaatatccaattttggaaatgccaagtttatcaatcccaacattgaggacagtgcaagcacaacattttatgtaagcgacgggaagaaggatgtctatgactttggtagtttgatttttgagctaatcacagggaaaacatttaacgagttgtcgcgttcatcatacaatgctactaacctgtctggcaacccatcgaatttttatgatgcaattgaggaatctctcattggggaaggttttgaaaatgaggtctacactctcatcaaagtagcatgtaagtgtgttaagcctttcccagatgaaagaccaacgatgcttgaagtttataactatatgatcgatatatggggagagcgacatagaataagtgatggttctgacacactcaac

SEQ ID NO: 2792 - DNA, 1023 bp, Glycine Max
atgaggctccactaccttacccttttcctccttttggtccctttggagttgagcaccatttatggtctctctacacaaggaaatgtgcctaagaaatcatccatcaagcccttattaccaccccctgaggccttgctgtccattggtcactatcacacaacatgtcctgatgctgaaggcatcatctcacaaaaggttgctgcttgggttaagaaggaccctacattggcccctgccatcatacgccttcatttccatgactgtgctgttatgggatgcgatgcatcaatattgctcaaccatccagggagtgagaggactgcattagagagcagaaccctgagaggattccaattgattgatgatatcaagagtgagttagaaaaaaagtgtccaaggacagtctcttgtgctgacattcttactgcagcagctagagatgccactcttttggctggaggaccattctgggaagtcccatttggcagaaaagatggcaagatttccttagccagagaggccaatttggtccctcatggccatgaaaacataacagcccttattacattctttcaagaaagaggtttagacattcttgacttggtcactctctcaggctcacacacaattgggaggagcacttgttcttctatcatggataggatttacaacttcaatgggactaaaaagccagatccctcactaaatgtctttttcttgaagttgttgaggaaaaggtgcaaaagggtgatggatttggtgcaccttgatgtcataacccctaggacttttgacacaacctattacactaaccttatgaggaaagtggggttattgtcaacagatcagtcacttttttcagatgcaaggactgctccttttgttgaagcatttgcaacacaaccttttcttttcactagccagttttcagtgtcaatggtgaagcttgggaatgttcaagttctgactaggcctaatgaaggtgaaataagggttaattgcaattatgtcaatactgtctaa

SEQ ID NO: 2793 - DNA, 1473 bp, Glycine Max
atgagggaaccatcgtcggtgggattcgaaggcaacggcgtcgtttcttcgccgccgcaagctctcatcgagagactgaaagactacggccaagaagacgttttcgccctctggtacgagctctcccccgaggaacgcgagtttctcgtcaaggacattgagagtttagatctttcgagaattgaccggattattcgatgctcgctgcgatctcaaggactgccggcggcggccattgagccggtgccggagagcaatgtgtcgacggtggaggagagaagccaggaggatcgagagagatggttgaaaatgggattgaaagctatttcagatggcaaattagccgtgttgcttttatctggtggccaggggactcgacttggaagttcagatccaaaaggatgtttcaatattggacttccatctggaaaatcactttttcaacttcaagctgagaggattttgtgtgcacagagactagctgctcaagctacaaatgagaattcttcttcttcagtgcaaatacactggtacatcatgactagtccattcactgatgaggcaacacgcaaattctttgaaagtcataaattttttggtcttgaggcagaacaggttacctttttccagcaaggaacaatcccttgtgtttccaaggatggcagatttattatggagactccatacagggtagcaaaggctcctgatgggaatggtggagtgtattcagctctgaaatctaccaaattattggaggatatggcctcaaaaggaattaagtatattgattgctatggagttgacaatgcactggttcgagttgctgatccaacttttttaggttacttcattgataaaggtgttgctgctgctgcaaaagttgtccgtaaggcgtatccacaagaaaaggttggtgtgtttgtaagacgaggtaaaggtggtcctcttactgtagttgaatacagtgagttggaccagtcactagcttctgcagtcaatcaagcaactggccgtcttcgtttttgttggagtaatgtctgcttacacatgttcactctggattttctgaaccaagtggcaaatggccttgaaaaagacagcatttatcatcttgcagagaagaaaataccttccatacatggatatacaatgggattaaaacttgaacagtttatatttgatgcatttccatatgctcctacgactgcactttttgaggtgttacgggaggaggaatttgcaccagtgaaaaatgcaaatggatccaatgttgacactccagacagtgcgaaactacttgttcttcgactccatactcgttgggtagttgctgcaggtggcttcttaacacattcagtgcccttatatgcaacaggtgttgaagtgtcaccactctgttcgtatgctggtgaaaacctggaaccaatatgtcgaggaagaacatttcatgcaccttgtgagatctcgttctag

SEQ ID NO: 2794 - DNA, 1473 bp, Glycine Max; identical to SEQ ID NO: 2793

SEQ ID NO: 2795 - DNA, 213 bp, Glycine Max
atgagggctagaaatgatgagaaggacactgcattacatgaggctgtgcgcaatcatcacattgaagtagtgaagaccttgttagaaatggatcctgattactcctatgagactccactttatctgccttcagaaagacaatatcagcaagtggtggctcagatatcaaacaaagtgaaagcaccggcatatgttggccccaataatcagtag

SEQ ID NO: 2796 - DNA, 1123 bp, Glycine Max
atgagggtatttgaaagagcgagtggagccatcaaggacaagaacagcatttgggctgcaaaattctcacgaaagggtccactccacaaccctgatttagaaaccgtggtaatcaaggcaacgagccacgacgatcaccacatagattcaaagaacgtgcaaagagtgttccagtggttacgaacttcacccttgtacctgaagcctctcgtgtgggccctctccatgcgcatgcaaaagactcgaagctgggtcgtggcgctcaaaggcttgatgctcatccatggcatttactgctgtgacattcccgttgtgaaccgcatggggaggttaccctttgacctctcaaacttctccgatggacacttgagccctgcaaaggcttggagcttcaacggtttcgttcgcgcttatttcgcctatttggatcagaggtcatcgtttgtgtcctccgaggttaagcagaagaagaatgttagtaataacaagaagacggaggaggtggaggagacgttgatggaagagcttgagaagctgcaaaagttgcaagggatgattgacatgcttctccagatcaggccaaaggatgagaatttgaacattggtttgattcttgaggctatggattgtatcatagtcgaggtttttggtgtgtatagtaagttttgcaacaagattgcaaaagttttggtgaggatatatgaggttggtgggaagatggaagcgaatattggcctccaggttcttcagaaagcatcgattcaagtggaggagatatctttgttctttgacttgtgcaaggatattggggtcctcaatgcatctcagtgccctaagattgatagaatttcaccggaagatattcaagatcttgagaggataatcaatggtgcttcttccaagaagggttgtggttttgtgggaaatgatgaggataataataaggccattgtggtgagagattgttcttccactgcaatggtttcgcaacaggaggagtcagagaatggtttaatgaccgtgatcacgcaacaatgggaggtgtttgatgatgatcatgaatcatatagcatcgtaccttatgttcctgttcatcaccatcaagctcttcctgatctaatta

SEQ ID NO: 2797 - DNA, 1017 bp, Glycine Max
atgaggtcttatgagttggacagtgctgattcgttttgggttgcaaatgggtcgctggagtttccggaggttgcggtggagattgagacgcagttgaataagtataagaaggatgtggatgaggtgaacaagaggactggcgggactcatggcgcggagtttgatgggacggatttgattgggaacacgaagcatttgatgaatgctgtgaattctctgcctgagttgactgagaggaaacaggtgattgataagcataccaacattgcgactgtgttgttgggcgagatcaaggagaggtctcttgattcttatgctaagaaggagaatgacatgatggttagagggggcattgaacggggtgacctgcttggtgtgctcagagggaagggaacgaagatggataagcttaggtttgccatcatatatctcatttcatcggaaaccattaatctgtcggaagtggaagctgtggaagcggcactgagagagtctgaggttgatactgctgcttttcagtatgtgaagaagatcaagtcgttgaatgtgtcgttggcatcggcaaattctgccagcagaagtaatattgttgattgggctgagaagctctatgggcagtcaattagtgcagtgacggctggtgtcaaaaatcttttgtctaatgacaggcagctagcattggcaaggacagtcgaggccttgattgaagggaggacaaatcctgaaacagatgtgtacctttcgtttgatcctcgtgctccgaagtctggttcgggagcaagtagcagccatttgaaagggccatttaaggaagcaattgtgttcatgattggtggtggtaattacgttgaatattgcagtctgcaagagcttgcacaacatcagcaacctgccaaacatattatatatggaacaacagaaatgctaactggagttgactttgtagagcagctaacattgttggggcagaagatgggtttgggtaatgttggttctagttctaccccagctcagtag

SEQ ID NO: 2798 - DNA, 186 bp, Glycine Max; identical to SEQ ID NO: 230

SEQ ID NO: 2799 - DNA, 957 bp, Glycine Max; identical to SEQ ID NO: 231

SEQ ID NO: 2800 - DNA, 1833 bp, Glycine Max
atgagtcacgagctgttagagacctacgcctgcatgcccacgacggagcgcggccgcgggattctgatctccggcgatgccaagtccaactcagtcgtctacaccaacggcagatcggtggtcatgatgaacctccagaaccccctccacgtgtccgtttacggggaccacgcctaccccgccaccgtggcccgcttttcccccaacggcgagtgggtggcctccgccgacgcctccggcaccgtcaggatctggggcacgcgaaacgacttcgttttgaagaaggagttcagagtcctctccgctcgcatcgacgaccttcagtggtctcccgatggtctcagaatcgttgcctgcggcgaaggcaaagggaagtccttcgtccgcgcttttatgtgggattcggggactaatgttggtgaattcgatggtcactctcgccgggttttgagttgcgcctataaacccacgaggccttttcgcgttgtcacttgtggagaggattttctggttaacttttatgagggacctccctttagatttaagctatctcacagggatcattcaaattttgtgaattgtgtaagatattctccagatggcagtaaatttataagtgtaagttctgacaagaagggtgtcatattcgatggaaagagtgcagaaaagattggtgagctgtcttctgaaggtgggcatactggtagtatttatgctgttagctggagtcctgatggaaagcaggtgctgactgtatctgccgacaagtctgcaaaagtatgggacattactgagggcaataacggaaaggtgaagaaaacattgacttgtgctggctctggtggagttgaagacatgctagtggggtgcctatggttgaatgattatcttgtcactgtttctcttggtgggacaatatctatatttttagcaactgatcttgataaagccccgacaacattttctggacatatgaaaaatgtttcctccttaactattcttagaagtaaccctagggtgctattgtctagcagttatgatggcttaatagttaagtggattcaagggattggatatagtggaaaactacacaggaaggaaaattctcaaatcaaatgcttagcagctgtagaagaagagattgttacatctggatttgataataagataaggcgagtttctttacatagggatcagtgtggagatactgaagccattgatataggaagtcaaccaaaggacttgagtgttgcacttctttctcctgaacttgctctagtttcaattgattcaggagttgtcatgttgcgtggtaccaaaattgtgtcaaccataaatcttgggtttattgtgacagcatctgctgtctcacctgatggaagtgaagccattatcggtggacaggatggtaaattgcacatatattctgtttctggtgatactcttgtagaagaggtagtccttgagaaacataggggtgctattagtgtcatacgttattccccagacgtttcgatgtttgcatcaggggatgtcaatcgagaagctgtagtgtgggaccgtgcctcccgagaggtgaagctgaagaacatgttgtaccatactgctaggataaactgcctagcgtggtcccctgatagccataggattgctacaggatcactcgacacatgtgtcatcatatatgaagttgatcagcctgcatctagtagaattaccataaagggtgctcatttaggtggggtttatgggttagcatttactgatgaatatagtttggttagctcaggtgaggatgcttttatccgtgtttggaggataacccctccttga

SEQ ID NO: 2801 - DNA, 483 bp, Glycine Max; identical to SEQ ID NO: 232

SEQ ID NO: 2802 - DNA, 5202 bp, Glycine Max
atgagtgagagagagcgacacatagagagagaaccaaacactgtgagagagcggaacatagggagagagccaaacactgagagagagtatgatgatgtgagtgagactgagtggacagaacagaaatcacctcattttacttcactcaattccctgaggagagaagggaggaggtatggtttcgtccgttacaaaggaatctccgacaaaggaagaatcgaaaaggaactagataacagtatcgtaagagaccttaaactccatgttaacactccgaaatatggaagaggaaagacgaagatggaccaatacaaggtcgttcttgtgaagaagggggaaggtgtggttgctcatgatcaaagggaagaagtctcgttcagaacaacaaagaacaaggcacctaagaagtcatatgcagaagcagtggccttgtcgtcagataataatacacacaggggacctggcggtgctcaggtggctagttacaggggctcacaatcatcgatagcattggatatatcgatggaagatatacggcgacatgaaaatgtatgggtgggaagattgaagaagttagagatcttcgaacgactagaagatgaggtctcatggaaactgggtccaggtgtgtcgcccaagtacttgggtgatgacatgacccttctcctcggcctctccgacacgagagcaacggagattatagcggaagaaatcgaacaagtcgtgtggacgatagacaacatccgtaagatagtggcggcggtgggcgatcttgtggaggtagacgacgatgtggagcacatgcagagactcgaccgtgctagagtcttggttaggacacctcgaccaccgttaatacagcaggtagaagtccacgccggaggagagacttaccgcgttcacatggtggaagaaaacggcagtgacgggtcgaacaacaggtgtcgcgagagatgtagatgggagtcttcggaggagattatatcggacgatgatgatatggacagtgtccaatcatggaggtgcgaggcggcgccgtcatcacagggcgaaaaccgcgtcggcgacaggcgcgaaccacacccaattcttttacccactgttctccacatagctgatgacccagtggatggtcaacacacaccatacccggcagatgacgaggaagaggaaatagctacagcagagatacgtatcaacatagatggaaaaaggaaggatgacgccagctcagcagcaggagcttctgaaaaatcctatattgagcctgcatcagactctaagcttggtaaaaatgtggatatcattaatatccccaatggtccaaatatgatttcttcagattactcaccagctcacaactccaaccttattgggcctgctaccagcctggacttttccacatataacacccccgaggcccaacataacatctctgctaattctaaaatcaaaggagtgctggctgatatggagaacagagataaaacaatggcaattgagaagggagaaactaagaaggaaaacttcaacaagcttacctgccagagcatatggggggactctaatgtttcatgggacagtgtcccctcagtccacacttttggtggattactatgcttatggaataactctgcttttgaggtagacaggagggtgaaaggtagcaacttcctaatgcttgcaggtagctggattaaggatgaccagaggatatacattgttaatatatatgctccctgtgacctaccagggaagagagctatgtgggaagagttgaggcaattaagaacctctaacactgatgatctatggtgtttccttggggacttcaatagcattagaagtcaggaagaaagaataggctcatctcaaagaatgggaagtgtctggtctcagaacagtggctatcccattggccggattcctcacaacataagcttgactaaggctgagcttatgtctaagaagtccatacaacatgacctgtggatggcttcaaatgcatatgaattcctattaaggcagaaatccagggttaagtggttcaaggaaggagacagtaacacagcctatttccacaaaacaatcaatttcagaagacatcataacaccatccatggaatcttcagcgaagggatatgggtccagcaacctaaaatggtcaaggatgaagctgtcaaattttttgttagaagattcactaaggaaaacttctctagacctactttggatggggttcacttcaataggattactcacagtcaatgggaggagatgactgcccctttttctgatcaagaacttaaagaagctgtgtggagctgtggaggagagaaatcccttggactggatggatttaattttaactttatcaaggagttttggggggtgctaaaaccagaatttaggagatttgtggatgaattccatgtgcatggtagcttccctaaaggcagcaatgcttcttttctggctttaattccaaaatcaaatcaacctcagtcattcagtgactatagacccatatcccttataggatgcatgtataaaataatagccaaactattggcaaatagactgaggatggtggtgcctggccttattgatgaaagacaatcaactttcataaaggatagacatatccttcatggaactttgattctcaatgaggttgtggaggaagcaaaaagatgtaagaagccaactttggtatttaaggtggacttcgagaaggcatatgattctgtttcatggtcattcctggattacatgttggataggaggggtttcaatcttacatggagaaaatggatcaatgcttgtttgcaatctgccactatatcaatcctagtaaatggcagccctacaaaggaatttgttcccactagaggtctgagacaaggggatcctctagcccccttgctcttcaacatagtggctgaaggcttgactggaatgatgagggttgcaacagccaagaacctgtatagaagtttccaggctatgctgaggggttttgaattggcatctggattgaagattaattttgcaaaaagtcaatttgggatatttggagctgaggctaactggattcatgaagcagcacaatttctgaactgcagacatatggagactccattctattatttgggcattcccattggggcaaagtctactagcagtttggtgtgggaacctctgatcagcaaatatgaagataagctatctaaatggaaccagaaaattttatctatggctgggaagatggtatggaaggtgggaggaggggaaaaaataaaattctggaaagataattggttgggggaagattataaacttgaacagcaatttaatcagcagaatagtaccatatccaacatgggaaccttctcccaaggcaattggtgttgggacttaaagtggagaaggaatctatttgattatgagcaacatacagctgtgacattcatggaagcaattactgatattcaaatccagcctcatatgcaggatattagggtctggaaagctgatcccagtgttatatattctactaagtcagcctacagattattgatgaccagcaatccaattccggaggccaacatcttaaagactatatggaagctgaatgtacccccaagggctgcgattttctcttggagacttcttttagatagattgcccactagaggaaatctccttcgaagaaatgtgcagattcaggataattcatgccctctgtgtgggaatgctcaagaggaggtggatcacttgttcttcaattgtaaaatgactttagggctttggtgggaatctatgagttggaaccagatggttggccccattgcatcatctccagcatcacactttgtccaattttgtgagggttatgttgcagggcaaaatcaatctcatcgatatggatggtcatttgcaacattggaggactgttttggacttttggcaaccttggttcaacatgagtttactgccaacctaaagaagtgcaattttgggcagcaagaaattgaatatctaggggtcacattatttctgcaaaagggagtggctatggatacaagaaaaattgaggcagtgcttcaatgcccgttacccaaatcagtcaagagtttgagaagatttttaagaaagggaattttatttagactaaggaaagctcataagccttctgcaattaaagcgagcattaactacagttttgcagaagagggtcattgcttatttcaacctttatcagaagcatccttgaataagtcagtgtatgagaaagaattgatggctttggtgttagccaatccagcattggcggccttgcctgctggtgcaataaatcaagtagttgatgctctgtctgagaaggaaaatgataaagaaacacagaccttatccaaaccttattggcaagatatctctgagattgaccagaaacacttggtggcagcatgccatatttgccaaagaagtaagtacctcacttcttcaccagctggtttatatttgccaaagaagtacctcacttcttcaccagctggtttattacaaccattgccaatccccaatgctcatccctatattgctagtagtgtgccggatatctttactaaggaagtaataaggctgcatgggattccttcttcaatagtgagtgacaaggatgcattgcttttgagggaagtcctacttgaggcaatgactcaagatcttatggaaacaattaatcagttgaagtttcatctaaacaaagctcataatcacatgacaaaatatgtcaataatcatcgcttaccttcgaagattaaggagggggattgggtgtgtctcaagataaggccgcatagacaagcttcaatgcctacaagattaaatcctaagctatcagccaaatactatggcccttatcgggtggttaaacaaattggagtagtggcatttcagttgcaattacctgacgctgctcaaatccaccttgttttttttcacgtttcccaattgaaacttgcagtgcaagaacatcaaattgaggagagaggaatacttggagaaattgaacaaaacaaggaaattgtgaaggagtctcctgcagagaaaagcagaagcacttcaatagttgatggaagagaaacaaaagccttggacatgttttggttcctcaagccttgcacactgtcaggctga

SEQ ID NO: 2803 - DNA, 1311 bp, Glycine Max
atgagtgctctgaataggactattatttccttcaacaaaacttcatccttcaatcatcgaaggactctcggcattgtaagtcccagagtgattcataacaaccgcttcggatgtgtctctctgaggcttcaggttcttgtcatctttgtctctgtggtttccttctttttagccataggtggctacatgtacgtgcttccaagccttagccacgcgtttttcaatggccaagttcccttgttattatctgaacataacagcaacggatcagtgagagaatgtgatgtatttgatggaagctgggtgcaggttaaaaaagatcacaccttgtacaatgccacagagtgtccttttgtggaacgaggattcgattgtttagggaatgggaggagtgacagggattatcttggttggaggtggaagccaaggagttgtgagattccaaggtttgatgtgcgtggtgtgttggaaatgttgagaagcaaaagggttgtttttgttggtgattcaatgagtaggacgcagtgggagtctctgatttgtatgctgatggctggtgttgaagataagaggggtgtttatgaagtgaaccagaatcagataacaaagcggatcaggttcttaggggttcggttcagtgccttcaatttcaccattgagttttttcgctcggttttccttgtgcagcagggtcgagtgcctagacatgcaccaaagagggtcaaatcgacgcttttgttggacaagttggatgatataagtgaccagtgggttaattcagatattctgattttcaatactggacattggtgggtgccatctaagctttttgatatgggctgctatttccaggttggaagctctctgaaacttgggatgacaattccaactgcctttagaatagcacttgaaacttggtcatcatgggttgacagagagattaataaaaatagaacacgtatcttctttagaacttttgagccttcccactggagtgatcttacccgttggatttgcaatgtgacccagtacccaacattagaaactaatggaagggaccaaagcttgttttcagatacaattttacaagttgtaaagaatgttactattcctataaatgttcttcatgttacttctatgtctgctttccggagtgatgcacatgttggtaactggagtgacaacccatctattcaagattgtagccactggtgtcttcctggggtacctgatatgtggaatgaaattatcctgtcccaactttttactgaatttgaaatcccttctcagcaaattgaatcactcaattag

SEQ ID NO: 2804 - DNA, 186 bp, Glycine Max
atgagtgtgaagcctgcatctgcatggcttgagaggcttatggctgagacattctttggtggttgtggggtccaccagaatcacaagaagaacgagaagaacatcttttgcttgcactgttgccttagcatctgcccccactgcctcccttctcaccgctcccattcccttctccaggccagctag

SEQ ID NO: 2805 - DNA, 744 bp, Glycine Max
atgagtgtgcatcaaagttgtgcccacccaaagaatcaatctttatcccaaacagaaccccccttgtctactcttcctttactctgggcaatagctttgaacacgaccacaccatcacctccttactatgacacctcaccaccaagcccaacaaccataacacctggcccaccagatccacctgactcctcaatgggcccacccgggatcacgccaggctctcctgagcccgtactcaatcctcccatcattattccaagcccacctgactcctcaatgggcccaccctactttgagcccaccccaccattcataatcccttcccccacgggtggcatcaccccaggcccaccaagcactgttccatcccccactgaaggcactgtcccaagcccaagtgtgtttcagccacctgtggtgtaccctccaccgagtgtgccaccaccacccaactatgcccctaggaccaccttgtggtgtgtggctaagccctcagtcccagacccaatcatccaagaggccatgaactatgcttgctggtcaggagcagactgcacttcaattcagcccaatgggccgtgctatgagcccaacactgtgtatgcacatgcttcatacgctttcaatagttattggcaaaggaccaaaggtgctggtggcaattgtgaatttggaggcacagcgatgctggttgcagttgatcctagtgagtctcacaatcataaaatgggtttggattcttaa

SEQ ID NO: 2806 - DNA, 1353 bp, Glycine Max; identical to SEQ ID NO: 233

SEQ ID NO: 2807 - DNA, 1719 bp, Glycine Max
atgagtgttgatgccatacctttaaagtcttctggtaaacctagccttcaaacgtttatggttgttgtggagaaggagctgtctactttagtgcatcagattacatcattgctccataattcttcacttcatagtaattcaaaacaggtttctggactccacgaggctcttcaaaatgagaatcaaattcgtgaaaaatactccagtggctctgatatattatattctgtggaagatctgcaagaggagttgacaaagctttctcaaggtcgacgattgcagctaactttggggggacaagggtactccactttttcttacagagctgtaattcttgatgctgaggaacaggctgacccatttacctatcactgtggggttttcattgtgcctaagactcgtgcacgtgaatggcttttctattctgaagaaggacagtggatggtggtcagaagctccaaagcagctcgtctcataatggtttacttggatgccagccattcagataccagcatggaggagattcagaaggatttgtctccgttggttacacagttggcacctgcagaaaatgggaatggagctaaaatacctttcatgatggcaagtgaggggatcaaggagcgaaacatcattcataaggtcacatcttcattaactggatcaattattgttgaagatgtaatttatgaaaatgttgatagtgaagtcagttgtatttttccttctggagagttgatgtttcgacgccttgtattcgagagagctgcaaatttggtgcagtctgaagctttgctaaaagatgaacagttgcctaccaaattggttagtgagacagggaagaagaaaaacaatgcatcttccaaatctaggaaaagtggatcttggagagacagtgttggagcaagcagtcagttgactgtctatcatggctatgtagctagttcttatcatacagggattatttcaggattcatgctaatatcttctcacatggaaaatgtggcatcaagtgggaaaatggtaaaagctgtaataataggtcttggagcaggtttacttcccatgtttcttcacggatgtatcccctttttggaaattgagactgtggagttagaccccatgattgttgatattgcaagggactacttcagttttgttgaggataaacatgtaaaggtgcatatagctgatgggatccagtttgtccgggagattgacagttctggagcagctcagattcatggaaaaagtaatgatcctagctatacagataccgctttaaatgcaagttcagctgtgtctcatgctgatgtagaagtgacaaaagttgatataattattgttgatgttgactcttcagacccaagctcgggattgacatgccctgctccggattttttggatgagtcttttcttgagactgtaaaggatagactttcagaggatggtctctttgttgtcaatttggtgtcacggtcccaagccattaaagatatggctctctcaaaaatgaaaaaggttttcagccacctcttctgcctccagcttgacgaggacgtcaatgaggttcattttgccctcaaatctgagtcctgtattgaggatagctgtttctccgaagcttctcttaaacttgataaattgttggagttcaaacacccggagataggtcaaaacattatcaatgcgacaaaaaagatcagacgtacaatataa

SEQ ID NO: 2808 - DNA, 210 bp, Glycine Max
atgagttccggaaagaagagcattcagaattttcttgcccacacaacaaggccagcgcctaagagtagtaactccaaacccccaagcaatggagggataagcattaagaatgttcttgcagctacaacaaggccacctcctaagggtacaaactccaaacctccaaccactggaactaaattgcccactatccaaaaggctttttactag

SEQ ID NO: 2809 - DNA, 354 bp, Glycine Max
atgagttcctcagcttcagaggctcagacacacgctatggtttttctggcaatctctacaaggctcttcatgacagaggaattcacactttcattgataacgagaatcttcggagtggacatcgttgtgctctctaacaactacgcttcttccttgttttgcttagatgaacttgcctacacccttgagtgtcgtgagagaaaaaatttattggttttgccgatcttttataacctcaatccttctcacgtgcgacaccagaaaggtagttatgacgaagcattggctaagcatgcaaggaggttccagcataacccggaaaagttgcacaaatggaagatggctctgcgtcaa

SEQ ID NO: 2810 - DNA, 2457 bp, Glycine Max
atgagttcgaaagagcgaagccagcagccgcattcgagggttcctcgtcgtcaggagtggattcgtagagatgttggtggttgctccaatccaagaaagcccaagaagggatcatcttcgaattcgagggaggagtctaatttgcctcagctgctgcaagagattcaggacaagctcgtcaaaggagctgtcgaatgcatgatttgttatgacatggtgcgcaggtctgcgcctatctggtcttgctccggttgcttctctatctttcacctcacttgtatcaagaagtgggctcgtgcacccatttctgtggatttgtccgttgagaagaaccagggcggcttcaattggcgttgccctggttgccagtctgtgcagctcacttcatccaaggatattaggtatctatgcttctgtggaaagaggccagatccaccctctgatttgtatctcatgccacattcctgtggagaaccatgtggcaagcctcttgagagggaccttcaaggggataaggagcttctttgccctcatctttgtgtcttgcaatgccatcccggcccctgtcctccttgcaaagcatttgcccctccacgtctgtgtccttgtgggaagaaaaatattaccactcgttgctctgaccgccagtctgttcttacctgtggccagcgctgccaaaagcttcttcaatgtggccgtcatcgctgtcagcaaatctgtcatctgggtccttgtcatccttgtcaagttccaatcaatgcctcttgcttttgtgcccaaaagatggaggtaattctttgtggggagatggctgtcaagggtgaaatcagagcagatggtggagtattctcttgtggttccacttgtcaaaagaaacttaattgtggtaatcatatctgtatcgagacttgtcatccaggtagctgtggggactgtgaattattaccatcccgtattaagacatgctgttgtgggaaaactagattggaggagaaacgccacagttgtttagacccaattcctacctgttcacaagtatgtggcaagtaccttccttgcgggattcatcattgtgaagagccatgccatgctggggattgttctccttgtctggttctagtttctcagaagtgtagatgtggctcgacttcccgaactgtggagtgttgcaagacaaaaatggaaaatgagaaatttacttgtgaaaggccttgtgggcagaaaaagaattgtggaaggcatcgatgtagtgaaaggtgttgtccactttctaatccaaataatattctaaatgcagattgggatccacacttctgtcaattgccgtgtggaaagaagttaaggttgcttccatgttcagttcctcagccttgttcgcatccagcctctcacagctgtcattttggagattgccctccttgttcaatgcccatagcaaaagaatgtattggtggacataccagacagtgtggtttacatgcatgtggcagaacatgtcacctccccccttgtgataatctgtcagctgtgccaggtatccgagcctcttgtgggcaaacatgtggtgctcctaggagagactgccggcatacatgtacagctccttgtcacccttcaactccatgtccagatacaagatgcaaattccctgtcacaattacttgttcttgtggccgaataacagaaaatttgcctgtgcttcttcaacccgtggctgcaaatggcaaaaaagtccccctcggacaaagaaaactgatgtgtaatgatgactgtgctaagttagagcggaaaagggttcttgcagatgcttttgagattaccgctccaaatctggattcactccattttggtgagaattcggttgcttctgaattgctggctgacatgttgagacgtgattctaaatgggttttatctgttgaagagagatgcaagtttttagtacttggcaagagcagaggaaatgcacatggtccaaaagtccatgttttctgtcctatgttaaaggacaaaagagatgcagtgagggtgattgctgagagatggaagcttgcagtgaatgcagctggtcgggagccaaagcatttcgtagttgttcatgttaccccaaaatcaagagctcctgctcgtgtgctagggtttaagggtactacaactgtaaatgtaccccttcctccggcatttgatcctttggttgatatggatcctcgacttgttgtctcttttatagacttaccaatggatgcagatattagtgcattggtgttgagatttggtggtgagtgtgaacttgtttggttaaatgacaaaaatgcattggccgtttttaatgaccctgcccggagctgtggtggtggttgttccaaatgtcggggcatcagtagcatcttcagctaccaatgcctggggaggatctgggacaatgaaaggaggagcactggcagcattaaagagtaa

SEQ ID NO: 2811 - DNA, 1758 bp, Glycine Max; identical to SEQ ID NO: 234

SEQ ID NO: 2812 - DNA, 333 bp, Glycine Max
atgagtttggagaccgtgaattcttccacacttaaaagctccatgagctgtaagagcatttgcagcaccagtttcagccgtctctccttcgatctcctccctccctcgtcggagagtctctccatcaagcctcactgctcctccgacttcgcctactccgccatccgctctgccaccttcctttgcaaggccgccctctccttccgcgacttccacctcctcttttgcatcgacgccgacgacatcagaaccgtctacctctttcgcctccgacagccaacaacaaccaattcaacaaccacgaagaagatgcttcctgtttatatgccatga

SEQ ID NO: 2813 - DNA, 153 bp, Glycine Max; identical to SEQ ID NO: 235

SEQ ID NO: 2814 - DNA, 1812 bp, Glycine Max
atgataacgttaaccgacttttaccatgtgatgaccgcaatggtgccactgtacgtggccatgatactcgcctacggctccgtgaaatggtggaaaatcttctccccggaccaatgctctggcatcaaccggttcgttgctctgtttgcggtccctctgctctcgttccacttcatagcctccaacaacccctacgaaatgaacttccggttcatcgccgccgacacgctccagaagatgatcgtgttggttgtcctgggcatctgggcgaacgtgagcaagagagggtgcttggagtggaccataacgctgttctccatctccaccctcccaaacacgcttgtgatgggaatccccttgctcaaaggcatgtacggcgagttctcggggagtctgatggtccaaattgtggtcctccagtgcatcatctggtacaccttgatgctcttcatgttcgagtacagaggcgccagattgttgatctctgagcagttcccagacactgccggtaccattgtctccatccatgtcgactctgatgtcatgtctcttgacggacgacagcaccctctggaaaccgatgcccaaatcaaagaggacggcaagctccacgtcactgtcagaaaatccaacgcttccagatccgacatcttttctagaaggtcccagggcttctcttccaccacccctcgcccttccaatctcaccaatgctgagatttactctcttcagtcctctcgaaaccctactccacgtggctccagtttcaaccacaccgatttctactccatgatggctgctggtcgtaattctaactttggtgccaacgatgtttatggcctttctgcttccagaggaccaactcccagaccttccaattacgacgaggatgcttctaataataacaatgggaagccgaggtaccactaccctgctgctggaacaggaacaggaacaggaacaggaacgggaacgggaacagggcactaccctgctcctaaccctggcatgttctctcccactgcttctaaaaacgtcgccaagaagccagacgatccaaataaggaccttcatatgttcgtttggagttcaagtgcttccccggtttcggatgtgtttggtggtggacatgaatatgatcataaagaactcaagttaactgtatctccaggaaaagtggagggtaatattaatagagacactcaagaggagtaccagccagagaaagatgaatttagttttggaaacagagggattgaggatgagcatgaaggtgagaaagttggaaacggaaatccaaaaacaatgcctccagcaagtgtaatgacgaggcttattttgatcatggtgtggaggaaacttatcagaaaccccaacacctactccagcctaatcggcctaacttggtcactcatttcattcaggtggaacgtaaaaatgccagccataattgccaagtctatttcgatattgtcagatgcagggcttgggatggccatgtttagtcttggtctgttcatggctttgcaaccgaggatcatagcatgtggaaattccacagcagctttttctatggccgtgagattccttacaggtccagctgtcatggcagctgcttccattgctgttggactcaaaggcgttctcttgcacgttgctattgttcaggcagctcttcctcaaggaattgtcccatttgtctttgccaaggaatacaatgtacatcctgatattctcagtacgggtgttatttttgggatgttgattgcattgcccattacgctcgtgtactacatcttgctggggttatga

SEQ ID NO: 2815 - DNA, 219 bp, Glycine Max; identical to SEQ ID NO: 236

SEQ ID NO: 2816 - DNA, 198 bp, Glycine Max
atgatagtagttgttacttcattgattgaagatcctcctcctgatgttgatgactcaggcaaatcttggttctcattgaataaaaatgctggctttttgggtgggggaagagttgtttcattgcctagcatgaaaacaacttctaacatggatggtctattgatggcattttcttgcacacacaatagaccaatttga

SEQ ID NO: 2817 - DNA, 255 bp, Glycine Max; identical to SEQ ID NO: 237

SEQ ID NO: 2818 - DNA, 1002 bp, Glycine Max
atgatcatggtcttgctcatagtcctatacctttctgcaccagcactctcaaaactgtgcaaccaagacaagcaagtcctcctccaaatcaagaaagagcttggcaacccaaccaaactctcttcatggctcccaaccactgactattgcgacaccatttgggaaggtgtcgcttgtgtcaccgacagcaacaaccagacatgccgcgtcgacatcctctacctctcccaccttaacctccccaaaccctaccctattcccccctccataggcaaccttccctacttgaattatctttacctcattgacacaaacttcttcggcgcaatcccctcttccatcgctaatctcaccaacctcaattatctcaacatcacatacaccaatgtctctggcacaataccagatttcttgtcccatatcaaaaccctagtcagcattgacttctcttacaacaacctctccggcaacctccctgcctcgctctcctcgctccccaacctcggcgaaatgatcttcaccggcaaccgaatctccggcgccatccccgactccttcggctccttctccgaggagctcatattgatgaggctctcccgcaaccgcctcaccgggaagattccggcgacgctggcgaagctgaatctgcggttcttggacttgtctcggaacatgctggagggtgacgcgtcggtgctgtttgggtcggagaaagacacggtgcagataaatctggggaagaacaatcttgcttttgacctggggaaagtggagttttcagagatattggccatcttggatcttaggcataaccgtatctatggaacgttacctcagggacttacggcgcttaagcatctgactaagctgaacgtgagtaacaacaatctgtgtggtgagattccgcaaggtggcaacttgcagagaattaaggtgaattcctatgctcacaacaagtgcttgtgtggctctcctcttcccgcttgcactttggttaattaa

SEQ ID NO: 2819 - DNA, 531 bp, Glycine Max
atgatcctgatccaatccttgacagctaggaagcgtctgagtccgagggaagacatgttcccacaaaccctaatattgttctcagcactcataatcctcttccatggagatctcgtcttaagcacaacagcaccagatgatatccacgatgttctccctcagtacggtttcccaaagggtcttcttcccaacaacgcggtctcctacaccctctcccccgacgatggcttcttcaccgtccagctcgatgccccctgctacgtccactgggacgaccaattagtctactaccacagccaaatcagtggcactctcacctacggttccgtctcgcacgtgtcggggattcaggcccagaaactcttcctctggctccctgttaccggaattaaggtccaccaggattccggcatgttagagttcttcgttggagctttgtcccagacgctacccgccagcgacttccaggatgtgcctgggtgctcccgcagaggatcgctgctcgctacaaacctcattcttcctctctga

SEQ ID NO: 2820 - DNA, 1143 bp, Glycine Max
atgatcgacatgttagtgatccataactcattacctcccacttctgaggccgagaatggtactgctgctactgccactaataaaaggaagagaaggcctgcaggaacaccagatccagatgcagaagtagtgtccctctcacccaaaaccttgctggaatcagatcgttatgtgtgtgagatctgcaaccagggatttcagagggaccagaaccttcagatgcaccggcggcggcacaaggtgccatggaagctgttgaagagggaaactacagcggtggtgaagaagcgagtgtttgtatgcccggagcctagttgtttgcaccatgacccatgccatgctctgggtgatcttgtcggcataaagaagcatttcagaaggaaacacaacaatcacaagcaatgggtctgcgagagatgctccaaaggctatgcggtgcagtctgattacaaagcacatctcaaaacttgtggcacccgaggacactcttgcgattgtggccgcgttttctcaagggtggagagctttattgagcaccaagacgcgtgcaacgtagggaggctggggccagaaacacaatcacaggcacaggcagtgcaagcagctgcatgcttgtctcgaacagcttcaagcgaaaccaatttcagcactggttccccttggccacaaagcggtactataataattccaaatcccaccgttacggtagtagaaccctcctcatacaccattgtcactgccgaaaccaacaacaaagtccaccccaacctggagcttcagctctctaataccactcctactgcatcatcacaggaagaaagggttcatcaagagcagttgaggattgcgaaggcgaagaaagcgttggcggaagaggcaaggaagcaagccaagaggcaaatcgaactggccgaacttgagttcactaacgccaagaggataagacaagaagcgcttgcggaacttgacaaagcctatgccttcaaggaccatgcaatcaaacacatcaattcaatcatgcttcaaatcacttgccgagcttgcaagcaccattttcattcgccaaccgacgaccaaatcttctcctacataacacaagctcgccaagtacaaaaacatcgtctcaaacccattattaattaa

SEQ ID NO: 2821 - DNA, 2403 bp, Glycine Max
atgatcttgctgactcaacaagtgcacccacttctcaccttttcctctacctataagtctaattctccattgcacccccatgttcaactcaaggttggggttggtgtggttaccccattttcccaagtgcccattatgcccttttgcaaaggaaggccttacaggaggaggaggaaggggagcaggtgttcctcttctgctgcagcacaggctccgttgccacctgacccagataagttaatggttgtcactttgttgaaaagtttgaaaaactgtttggaagtgcaggaaaatagggaagacagtgatggtgtagttgttgcacagggtgagagtcctgatctgcagactcttttcagaaggttctggaaggtggcagctccttactggacttcagatgacaagggaccggcaaggttgcagcttgctggtgtttttgctctcactttggccaccactggaatcataagttcatgtgtatatgtgctcatagctgcttttgttaatattaggataaaccaaagttcctcgttgactagtgatgaggccaaaatagtgtatataaatgagggtagccctcatcccacaagccgacaaggatcaagagcaattcacgaagcaactactttactacttgggtgccttgctggaggaatcccgatttttgtgttgagagattatgcaagagaaactctttctttgagatggagatcttggatgacaagatattacattgatcgctatctgaagaatcaaactttctataaaattcagtcacaatcaatcattgataatccagaccaacgaattgttgatgatctaagttctttcactgggacatcccttgctttctccctgactctctttaatgctgctgtagacttaatctcatttagtaatatcttgtatgggatctatcctccactctttgttgttcttatcgtatactcgattggtgggacagctatcagtgttttccttggaagaggactggtgaatttaaatttcttgcaagagaaaaaggaagcagactttcgttatggacttgtgcgggttcgggaaaatgctgaatcaattgctttctacagtggtgaagaaagtgaaatgcaacttcttctgcagcgctttaaaagtgcttttgaaaatctgactcaattgttgattgcttccagaaatctggatttcttcaccagtggctaccgctatctaattcaagttcttcctgctgctgttgttgcccccctgtatttctcaggaaaaatcgagtttggtgtaatcaatcagtcactttctgcttttaatcatatccttggcgacttttccctcattgtgtaccagtttcaagctataagtgctttttctgctgttattaatcggttaggtgaatttgatgatgttttggacagaagtagctctaattctctcactgatactgtggaagacatacaaattacatacaaagattttagtagttcatctgcattggaatctaatggatccactccaccagaaaaatacgcgacattactggagatagaagatttgattttgaaaacaccaagtgaatctacacttattagagacttgtcattgacgatcaaggaaaaggatagtttactggtaatgggaccaagtggaagtggcaagacttctttgttaagagctatggctggtctatggaaaactggaactggaaagatcacatactatgtaaaaggtggagaatatcctgagcaatccatttgttcagatgtgaatactccagtaaataatgctaatgacacatatgaagcacgtggaaaatgcttaagcagaaaatctggaatttttttccttccgcaaagaccgtatatggttttgggtacccttcgtgaacaattaatgtatccaacttggacagatgacgtagttcctatgtcagacagtactaaagaaaaaaatgcacttcctttcttgacaaacttgccaaacttggataatgcaaatgataagcctatgaagccaacaacagacgagctgataaaggtcttagaggatgtccgccttggatatttattggctcgtttcagtttggattcaatacatgaatggtctagtgttctttctctgggagagcagcaacgccttgcatttgctcgtcttttgctttcaaagcctcaattggctttactggatgagtctacaagtgcacttgatgaagtcaatgaggtacatttgtaccaaaagattggagcagctaacataacatatgtcagcattggccatcggtcatccttatgtgcttaccacgacaagatcttaagcatatccacatttaattctgacagtgaacagctaaattggtgcattgaacccattgaacccactagacccgagtcctctttaaaatttacaaatctttga

SEQ ID NO: 2822 - DNA, 1086 bp, Glycine Max
atgatgaaatttcaagcatgttcaaaccccatctcaaacttgttctatgcgtgttgtgtccttcttttaccaccaaccatggccttaggagattgcacctgtgacacaaaagaggccacaaagagtgactcaattgaagtcctccactacaaaattggctcaattgcttctgtgcttgttgctggggcacttggggtgagcctcccattgttaagcaagagaatcccaacacttaaccccaagaatgacatattctttatggttaaggcctttgctgcaggggtgattcttgcaactgggtttgtgcacatacttcctgaggcatatgagagcctaacttcaccttgccttaaggaaaatccttggggcaagtttcccttcactggatttgttgccatgttgtcctccatagggaccttaatggtggactcatttgccacagggttttatcataggcaacattttaacccctctaagcaggttcctgctgatgatgaggaaatgggagatgaacatgctggtcacatgcatgttcatacacatgccacacatggtcatgctcatggatcagctgtgtcccctgagggttcaattacatctgaagtaattaggcagcgcatcatatcacaagtgttggagataggtatagtggtccattcagtgatcattggaatatcattgggtactgcagggagcattgataccataaagcctcttctcgtggccctgtctttccatcaattttttgagggtatggggcttggtggttgcatatctcaggcaaagttcgagtccaagtctacggtaattatggcgacctttttctccctaacaaccccaattggaattgcaattggaatgggggtgtcaagtgtgtacaaagagaatagccctactgctttaactgttgaagggattttcaattctgcttctgctggaattttgatttacatggcattggtggatttgttagcagctgattttatgagcccaaagttgcagaaaaatttgaagctccaactaggggcaaatatttcccttctcttaggtgcaggttgcatgtctctattggccaaatgggcctaa

SEQ ID NO: 2823 - DNA, 891 bp, Glycine Max; identical to SEQ ID NO: 238

SEQ ID NO: 2824 - DNA, 1293 bp, Glycine Max
atgatgaagcttgcaggatattccctggccgtttcatttgctcccataagttctaatgtcgttaaaagcaataaaagattcacggtaggtatatctcataggaataggtgcagctataggctgttttctactcatgcccagaaacaccaattacatgagaaacctggggtggttgccagataccaccttcctccttggtttagtgttgctccaatgatggactggacagaccatcactataggactctagcgcgcctcatatcaaaacatgcttggctgtacacggagatgcttgcagctgaaacaattgttcatcaaaaggacaatttggacagattcttggcatattctccagatcagcatcccattgtgcttcaaattggagggagtaatatagaaaatctggctaaagcaactgagcttgctaatgcttattgctatgatgagatcaacttaaactgtgggtgccctagtccaaaagttgctgggcatgggtgttttggtgtgagccttatgcttaaccccaagtttgttgctgaggccatgtcagcaattgctgccagcacaaatgtacctgtcagtgtcaaatgtcgaattggcgtggacgatcatgattcttacaatgagttgtgtgatttcatatatcaggtttcttctttatcacccactaagcatttcataattcactcgcggaaggcacttctcaatggcattagccctgctgaaaataggagtattcctccactaaaatatgaatacttctatggtctcttacgtgactttcctgacctaagatttacaatcaatggtggcattactagtgttgatgaggttagtgcagctcgagaagctggagctcatggtgtcatggttggacgtgcagcatacaacaacccttggcagattttgggacatgttgacgctgcaatttatggtacaccaagctgtgatcttacacgacgtcaggtccttgaaagatatctagtctatggggactcagtattgggaaaatacggacatcggccaactttgcgagatattgtgaagcctctactccatcttttccattcggaacctgggaatggactttggaagcgcaaagctgatgctgctttcaaaaattgcacgacaatggaatcattttttgaagaaacccttgtagcaattcccgactcagtattggattcgcctgttgcggagccacctcctggccgtgatctttttgctaacatgcacaatttattgcctgcaccatacagaacaagagaagcaacagtaattatttgcgcttaa

SEQ ID NO: 2825 - DNA, 1908 bp, Glycine Max; identical to SEQ ID NO: 239

(The sequence listing continues in the following parts.)

We claim:

1. A method for generating a transgenic plant using a host plant, said transgenic plant being more resistant to soybean cyst nematode (SCN) when compared to the host plant, said method comprising a step of introducing at least one transgene into said host plant, said at least one transgene being located within the chromosomal region as defined by one QTL selected from the group consisting of SCN QTL 1-11.

2. A method for generating a new soybean cyst nematode (SCN) resistant plant by crossing two parental strains, said new plant being more resistant to SCN than at least one of the two parental strains, said method comprising a step of introducing a genomic region into said new plant through the crossing, said genomic region being the chromosomal region of claim 1 containing the transgene.

3. The method of claim 2, wherein the genomic region comprises less than 100,000 nucleotides.

4. The method of claim 2, wherein the genomic region comprises less than 10,000 nucleotides.

5. A method for generating a soybean plant, said method comprising (a) introgressing SCN resistance into an SCN sensitive soybean germplasm, (b) determining the presence or absence of a marker gene or a fragment thereof and a transgene, said marker gene being selected from the group consisting of the polynucleotide molecules of SEQ ID Nos. 1-22 and said transgene being the transgene of claim 1, and (c) allowing the germplasm generated in (a) to develop into a soybean plant resistant to soybean cyst nematode (SCN) if the marker and transgene are present, wherein step (a) precedes step (b).

6. The method of claim 5, wherein the soybean plant is generated through one or more crosses of two or more parental soybean plants.

7. The method of claim 5, wherein the presence or absence of the marker gene is determined by using DNA hybridization.

8. The method of claim 5, wherein the presence or absence of the marker gene is determined by using DNA polymerase chain reaction (PCR).

* * * * *